(12) United States Patent
Doucette-Stamm et al.

(10) Patent No.: US 6,380,370 B1
(45) Date of Patent: Apr. 30, 2002

(54) **NUCLEIC ACID AND AMINO ACID SEQUENCES RELATING TO *STAPHYLOCOCCUS EPIDERMIDIS* FOR DIAGNOSTICS AND THERAPEUTICS**

(75) Inventors: Lynn A. Doucette-Stamm, Framingham; David Bush, Somerville, both of MA (US)

(73) Assignee: Genome Therapeutics Corporation, Waltham, MA (US)

( * ) Notice: Subject to any disclaimer, the term of this patent is extended or adjusted under 35 U.S.C. 154(b) by 0 days.

(21) Appl. No.: 09/134,001

(22) Filed: Aug. 13, 1998

Related U.S. Application Data

(60) Provisional application No. 60/064,964, filed on Nov. 8, 1997, and provisional application No. 60/055,779, filed on Aug. 14, 1997.

(51) Int. Cl.[7] .................................................. C07H 21/02
(52) U.S. Cl. ...................................... 536/23.1; 536/22.1
(58) Field of Search ......................... 435/5, 6; 536/22.1, 536/23.1

(56) References Cited

FOREIGN PATENT DOCUMENTS

WO          9608582          3/1996

*Primary Examiner*—Eggerton A. Campbell
(74) *Attorney, Agent, or Firm*—Burns, Doane, Swecker & Mathis L.L.P.

(57) ABSTRACT

The invention provides isolated polypeptide and nucleic acid sequences derived from *Staphylococcus epidermidis* that are useful in diagnosis and therapy of pathological conditions; antibodies against the polypeptides; and methods for the production of the polypeptides. The invention also provides methods for the detection, prevention and treatment of pathological conditions resulting from bacterial infection.

10 Claims, No Drawings

NUCLEIC ACID AND AMINO ACID SEQUENCES RELATING TO *STAPHYLOCOCCUS EPIDERMIDIS* FOR DIAGNOSTICS AND THERAPEUTICS

This application claims priority of U.S. Provisional Application No. 60/055,779, filed Aug. 14, 1997 and U.S. Provisional Application No. 60/064,964, filed Nov. 8, 1997 all of which is hereby incorporated herein by reference in their entirety.

FIELD OF THE INVENTION

The invention relates to isolated nucleic acids and polypeptides derived from *Staphylococcus epidermidis* that are useful as molecular targets for diagnostics, prophylaxis and treatment of pathological conditions, as well as materials and methods for the diagnosis, prevention, and amelioration of pathological conditions resulting from bacterial infection.

BRIEF DESCRIPTION OF THE SEQUENCE LISTING

Incorporated herein by reference in its entirety is a Sequence Listing, comprising SEQ ID NO: 1 to SEQ ID NO: 5674. The Sequence Listing is contained on a CD-ROM, three copies of which are filed, the Sequence Listing being in a computer-readable ASCII file named "Gtc007.pto", created on May 15, 2001 and of 9,485,000 bytes in size, in IBM-PC Windows®NT v4.0 format.

BACKGROUND OF THE INVENTION

*Staphylococcus epidermidis* (*S. epidermidis*) is a species of staphylococcal bacteria that are Gram-positive, nonmotile, nonpigmented and coagulase-negative cocci, which are mainly found on the skin and mucous membrane of warm-blooded animals. Their large numbers and ubiquitous distribution result in frequent contamination of specimens collected from or through the skin, making these organisms amongst the most frequently isolated in the clinical laboratory. In the past, *S. epidermidis* was rarely the cause of significant infections, but with the increasing use of implanted catheters and prosthetic devices, it has emerged as an important agent of hospital-acquired infections and has been recognized as a true pathogen (Lowy and Hammer, 1983, Ann Intern Med, 99: 834–9; Blum and Rodvold, 1987, Clin Pharm, 6: 464–75; Hamory, Parisi et al., 1987, Am J Infect Control, 15: 59–74). *S. epidermidis* is a major cause of infection of indwelling foreign devices such as, orthopedic devices, intravenous catheters, prosthetic heart valves, central nervous system shunts, and peritoneal dialysis catheters (Blum and Rodvold, 1987, Clin Pharm, 6: 464–75; Archer, 1988, J Antimicrob Chemother, 21 Suppl C: 133–8) (Lowy and Hammer, 1983, Ann Intern Med, 99: 834–9; Hamory, Parisi et al., Staphylococcus 1987. Am J Infect Control, 15: 59–74). In addition *S. epidermidis* is a common cause of postoperative wound infections, bacteremia of immunosuppressed patients, intensive-care unit patients and premature newborns (MacLowry, 1983, Am J Med, 75: 2–6)(Eykyn, 1988, Lancet, 1: 100–4). According to a national survey (Centers for Disease Control, 1981:7) *S. epidermidis* caused 8.9% of primary nosocomial bacteremias.

Treatment of *S. epidermidis* infections remains difficult because of the occult nature, association with foreign bodies, and frequent resistance to antimicrobial agents. Ordinarily, *S. epidermidis* is an organism with low virulence, however breaks in host defense caused by surgery, catheter placement, prosthesis insertion or immunosuppression is prerequisite for infection. The presence of foreign bodies itself facilitates infection by protecting the organism from elimination by host defenses or antimicrobial therapy (Lowy and Hammer, 1983, Ann Intern Med, 99: 834–9). Furthermore, *S. epidermidis* due to its ability to produce extracellular polysaccharide material or slime, may be uniquely adapted to adhere to smooth surfaces such as plastics or metal. Slime producing strains of *S. epidermidis* appear to be more pathogenic than non-slime producing strains (Christensen, Simpson et al., 1983, Infect Immun, 40: 407–10; Peters and Pulverer, 1984, J Antimicrob Chemother, 14 Suppl D: 67–71; Gallimore, Gagnon et al., 1991, J Infect Dis, 164: 1220–3). This property and many factors are involved in the pathogenesis of device associated infections. Despite the increased recognition as a pathogen, *S. epidermidis* infections are difficult to diagnose. Differentiating clinically important from clinically unimportant bacterial isolates of *S. epidermidis* is difficult because of the high rate of contamination.

Although laboratory isolates of *S. epidermidis* have generally been susceptible to semisynthetic penicillins (methicillin, nafcillin, oxacillin), cephalosporins, aminoglycosides, vancomycin and rafampin, recent clinical isolates have had an increased resistance. Recent reports (Karchmer, 1985, Am J Med, 78: 116–27; Karchmer, 1991, J Hosp Infect, 18 Suppl A: 355–66) show that 83% of *S. epidermidis* isolates from patients with prosthetic valve endocarditis are methicillin resistant and 32% are gentamicin resistant as well. Multi-drug resistant staphylococci have emerged in the midst of high level use of penicillin and aminoglycosides (Centers for Disease Control and Prevention, 1993 *MMWR* 42:597; and S. Handwerger et al., 1993, *Clin Infect Dis* 16:750).

The use of antibiotics for therapeutics and prophylactic purposes, promotes the selection of resistant organisms and the spread of antibiotic resistance genes among bacteria. Previous studies have shown that virtually all staphylococci carry some antibiotic resistance genes on naturally occurring extrachromosomal mobile genetic elements, such as the plasmids. Survey and analysis of plasmids in clinical isolates of *S. epidermidis* have shown that more that 80% of isolates carry plasmids and in several cases more than one plasmid (Archer et al., 1982, Infect Immun, 35:627–632; Kloos et al., 1981, Can J Microbiol, 27:271–278; Moller, 1988, J Hosp Infect 12:19–27). Though the most important forms of resistance has been the inactivation of antibiotics, particularly penicillins and cephalosporins, recent clinical isolates have resistance to one or more of the following antibiotics, methicillin, tetracycline, erythromycin, gentamycin, kanamycin and chloramphenicol. In fact due to the wide spread occurrence of plasmids and their involvement in antibiotic resistance, plasmid profiling has been used as an epidemiological reagent to study nosocomial infections. This invention relates to isolated nucleic acids and polypeptides derived from *S. epidermidis* plasmids that are useful as molecular targets for diagnosis, prophylaxis and treatment of pathological conditions, as well as materials and methods for the diagnosis, prevention, and amelioration of pathological conditions resulting from bacterial infection.

These concerns point to the need for diagnostic tools and therapeutics aimed at proper identification of strain and eradication of virulence. The design of vaccines that will limit the spread of infection and halt transfer of resistance factors is very desirable.

SUMMARY OF THE INVENTION

The present invention fulfills the need for diagnostic tools and therapeutics by providing bacterial-specific compositions and methods for detecting, treating, and preventing bacterial infection, in particular *S. epidermidis* infection.

The present invention encompasses isolated nucleic acids and polypeptides derived from *S. epidermidis* that are useful as reagents for diagnosis of bacterial disease, components of effective antibacterial vaccines, and/or as targets for antibacterial drugs including anti-*S. epidermidis* drugs. They can also be used to detect the presence of *S. epidermidis* and other Staphylococcus species in a sample; and in screening compounds for the ability to interfere with the *S. epidermidis* life cycle or to inhibit *S. epidermidis* infection. They also has use as biocontrol agents for plants.

More specifically, this invention features compositions of nucleic acids corresponding to entire coding sequences of *S. epidermidis* proteins, including surface or secreted proteins or parts thereof, nucleic acids capable of binding mRNA from *S. epidermidis* proteins to block protein translation, and methods for producing *S. epidermidis* proteins or parts thereof using peptide synthesis and recombinant DNA techniques. This invention also features antibodies and nucleic acids useful as probes to detect *S. epidermidis* infection. In addition, vaccine compositions and methods for the protection or treatment of infection by *S. epidermidis* are within the scope of this invention.

The nucleotide sequences provided in SEQ ID NO: 1–SEQ ID NO: 2837, a fragment thereof, or a nucleotide sequence at least 99.5% identical to SEQ ID NO: 1–SEQ ID NO: 2837 may be "provided" in a variety of medias to facilitate use thereof. As used herein, "provided" refers to a manufacture, other than an isolated nucleic acid molecule, which contains a nucleotide sequence of the present invention, i.e., the nucleotide sequence provided in SEQ ID NO: 1–SEQ ID NO: 2837, a fragment thereof, or a nucleotide sequence at least 99.5% identical to a sequence contained within SEQ ID NO: 1–SEQ ID NO: 2837. Uses for and methods for providing nucleotide sequences in a variety of media is well known in the art (see e.g., EPO Publication No. EP 0 756 006).

In one application of this embodiment, a nucleotide sequence of the present invention can be recorded on computer readable media. As used herein, "computer readable media" refers to any media which can be read and accessed directly by a computer. Such media include, but are not limited to: magnetic storage media, such as floppy discs, hard disc storage media, and magnetic tape; optical storage media such as CD-ROM; electrical storage media such as RAM and ROM; and hybrids of these categories such as magnetic/optical storage media. A person skilled in the art can readily appreciate how any of the presently known computer readable media can be used to create a manufacture comprising computer readable media having recorded thereon a nucleotide sequence of the present invention.

As used herein, "recorded" refers to a process for storing information on computer readable media. A person skilled in the art can readily adopt any of the presently known methods for recording information on computer readable media to generate manufactures comprising the nucleotide sequence information of the present invention.

A variety of data storage structures are available to a person skilled in the art for creating a computer readable media having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A person skilled in the art can readily adapt any number of data processor structuring formats (e.g. text file or database) in order to obtain computer readable media having recorded thereon the nucleotide sequence information of the present invention.

By providing the nucleotide sequence of SEQ ID NO: 1–SEQ ID NO: 2837, a fragment thereof, or a nucleotide sequence at least 99.5% identical to SEQ ID NO: 1–SEQ ID NO: 2837 in computer readable form, a person skilled in the art can routinely access the coding sequence information for a variety of purposes. Computer software is publicly available which allows a person skilled in the art to access sequence information provided in a computer readable media. Examples of such computer software include programs of the "Staden Package", "DNA Star", "MacVector", GCG "Wisconsin Package" (Genetics Computer Group, Madison, Wis.) and "NCBI Toolbox" (National Center For Biotechnology Information).

Computer algorithms enable the identification of *S. epidermidis* open reading frames (ORFs) within SEQ ID NO: 1–SEQ ID NO: 2837 which contain homology to ORFs or proteins from other organisms. Examples of such similarity-search algorithms include the BLAST [Altschul et al., J. Mol. Biol. 215:403–410 (1990)] and Smith-Waterman [Smith and Waterman (1981) Advances in Applied Mathematics, 2:482–489] search algorithms. These algorithms are utilized on computer systems as exemplified below. The ORFs so identified represent protein encoding fragments within the *S. epidermidis* genome and are useful in producing commercially important proteins such as enzymes used in fermentation reactions and in the production of commercially useful metabolites.

The present invention further provides systems, particularly computer-based systems, which contain the sequence information described herein. Such systems are designed to identify commercially important fragments of the *S. epidermidis* genome. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A person skilled in the art can readily appreciate that any one of the currently available computer-based systems is suitable for use in the present invention. The computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the *S. epidermidis* genome which are similar to, or "match", a particular target sequence or target motif. A variety of known algorithms are known in the art and have been disclosed publicly, and a variety of commercially available software for conducting homology-based similarity searches are available and can be used in the computer-based systems of the present invention. Examples of such software includes, but is not limited to, FASTA (GCG Wisconsin Package), Bic_SW (Compugen Bioccelerator), BLASTN2, BLASTP2, BLASTX2 (NCBI) and Motifs (GCG). A person skilled in the art can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A person skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that many genes are longer than 500 amino acids, or 1.5 kb in length, and that commercially important fragments of the *S. epidermidis* genome, such as sequence fragments involved in gene expression and protein processing, will often be shorter than 30 nucleotides.

As used herein, "a target structural motif," or "target motif," refers to any rationally selected sequence or combination of sequences in which the sequence(s) are chosen based on a specific functional domain or three-dimensional configuration which is formed upon the folding of the target polypeptide. There are a variety of target motifs known in the art. Protein target motifs include, but are not limited to, enzymatic active sites, membrane-spanning regions, and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the *S. epidermidis* genome possessing varying degrees of homology to the target sequence or target motif. Such presentation provides a person skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the *S. epidermidis* genome. In the present examples, implementing software which implement the BLASTP2 and bic_SW algorithms (Altschul et al., J Mol. Biol. 215:403–410 (1990); Compugen Biocellerator) was used to identify open reading frames within the *S. epidermidis* genome. A person skilled in the art can readily recognize that any one of the publicly available homology search programs can be used as the search means for the computer-based systems of the present invention.

The invention features *S. epidermidis* polypeptides, preferably a substantially pure preparation of a *S. epidermidis* polypeptide, or a recombinant *S. epidermidis* polypeptide. In preferred embodiments: the polypeptide has biological activity; the polypeptide has an amino acid sequence at least 60%, 70%, 80%, 90%, 95%, 98%, or 99% identical to an amino acid sequence of the invention contained in the Sequence Listing, preferably it has about 65% sequence identity with an amino acid sequence of the invention contained in the Sequence Listing, and most preferably it has about 92% to about 99% sequence identity with an amino acid sequence of the invention contained in the Sequence Listing; the polypeptide has an amino acid sequence essentially the same as an amino acid sequence of the invention contained in the Sequence Listing; the polypeptide is at least 5, 10, 20, 50, 100, or 150 amino acid residues in length; the polypeptide includes at least 5, preferably at least 10, more preferably at least 20, more preferably at least 50, 100, or 150 contiguous amino acid residues of the invention contained in the Sequence Listing. In yet another preferred embodiment, the amino acid sequence which differs in sequence identity by about 7% to about 8% from the *S. epidermidis* amino acid sequences of the invention contained in the Sequence Listing is also encompassed by the invention.

In preferred embodiments: the *S. epidermidis* polypeptide is encoded by a nucleic acid of the invention contained in the Sequence Listing, or by a nucleic acid having at least 60%, 70%, 80%, 90%, 95%, 98%, or 99% homology with a nucleic acid of the invention contained in the Sequence Listing.

In a preferred embodiment, the subject *S. epidermidis* polypeptide differs in amino acid sequence at 1, 2, 3, 5, 10 or more residues from a sequence of the invention contained in the Sequence Listing. The differences, however, are such that the *S. epidermidis* polypeptide exhibits a *S. epidermidis* biological activity, e.g., the *S. epidermidis* polypeptide retains a biological activity of a naturally occurring *S. epidermidis* enzyme.

In preferred embodiments, the polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

In yet other preferred embodiments, the *S. epidermidis* polypeptide is a recombinant fusion protein having a first *S. epidermidis* polypeptide portion and a second polypeptide portion, e.g., a second polypeptide portion having an amino acid sequence unrelated to *S. epidermidis*. The second polypeptide portion can be, e.g., any of glutathione-S-transferase, a DNA binding domain, or a polymerase activating domain. In preferred embodiment the fusion protein can be used in a two-hybrid assay.

Polypeptides of the invention include those which arise as a result of alternative transcription events, alternative RNA splicing events, and alternative translational and postranslational events.

In a preferred embodiment, the encoded *S. epidermidis* polypeptide differs (e.g., by amino acid substitution, addition or deletion of at least one amino acid residue) in amino acid sequence at 1, 2, 3, 5, 10 or more residues, from a sequence of the invention contained in the Sequence Listing. The differences, however, are such that: the *S. epidermidis* encoded polypeptide exhibits a *S. epidermidis* biological activity, e.g., the encoded *S. epidermidis* enzyme retains a biological activity of a naturally occurring *S. epidermidis*.

In preferred embodiments, the encoded polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

The *S. epidermidis* strain, from which the nucleotide sequences have been sequenced, was deposited on Jul. 10, 1997 in the American Type Culture Collection (ATCC #55998) as strain 18972.

Included in the invention are: allelic variations; natural mutants; induced mutants; proteins encoded by DNA that hybridize under high or low stringency conditions to a nucleic acid which encodes a polypeptide of the invention contained in the Sequence Listing (for definitions of high and low stringency see Current Protocols in Molecular Biology, John Wiley & Sons, New York, 1989, 6.3.1–6.3.6, hereby incorporated by reference); and, polypeptides specifically bound by antisera to *S. epidermidis* polypeptides, especially by antisera to an active site or binding domain of *S. epidermidis* polypeptide. The invention also includes fragments, preferably biologically active fragments. These and other polypeptides are also referred to herein as *S. epidermidis* polypeptide analogs or variants.

The invention further provides nucleic acids, e.g., RNA or DNA, encoding a polypeptide of the invention. This includes double stranded nucleic acids as well as coding and antisense single strands.

In preferred embodiments, the subject *S. epidermidis* nucleic acid will include a transcriptional regulatory sequence, e.g. at least one of a transcriptional promoter or transcriptional enhancer sequence, operably linked to the *S. epidermidis* gene sequence, e.g., to render the *S. epidermidis* gene sequence suitable for expression in a recombinant host cell.

In yet a further preferred embodiment, the nucleic acid which encodes a *S. epidermidis* polypeptide of the invention, hybridizes under stringent conditions to a nucleic acid probe corresponding to at least 8 consecutive nucleotides of the invention contained in the Sequence Listing; more preferably to at least 12 consecutive nucleotides of the invention contained in the Sequence Listing; more preferably to at least 20 consecutive nucleotides of the invention contained in the Sequence Listing; more preferably to at least 40 consecutive nucleotides of the invention contained in the Sequence Listing.

In another aspect, the invention provides a substantially pure nucleic acid having a nucleotide sequence which encodes a *S. epidermidis* polypeptide. In preferred embodiments: the encoded polypeptide has biological activity; the encoded polypeptide has an amino acid sequence at least 60%, 70%, 80%, 90%, 95%, 98%, or 99% homologous to an amino acid sequence of the invention contained in the Sequence Listing; the encoded polypeptide has an amino acid sequence essentially the same as an amino acid sequence of the invention contained in the Sequence Listing; the encoded polypeptide is at least 5, 10, 20, 50, 100, or 150 amino acids in length; the encoded polypeptide comprises at least 5, preferably at least 10, more preferably at least 20, more preferably at least 50, 100, or 150 contiguous amino acids of the invention contained in the Sequence Listing.

In another aspect, the invention encompasses: a vector including a nucleic acid which encodes a *S. epidermidis* polypeptide or a *S. epidermidis* polypeptide variant as described herein; a host cell transfected with the vector; and a method of producing a recombinant *S. epidermidis* polypeptide or *S. epidermidis* polypeptide variant; including culturing the cell, e.g., in a cell culture medium, and isolating a *S. epidermidis* or *S. epidermidis* polypeptide variant, e.g., from the cell or from the cell culture medium.

One embodiment of the invention is directed to substantially isolated nucleic acids. Nucleic acids of the invention include sequences comprising at least about 8 nucleotides in length, more preferably at least about 12 nucleotides in length, even more preferably at least about 15–20 nucleotides in length, that correspond to a subsequence of any one of SEQ ID NO: 1–SEQ ID NO: 2837 or complements thereof. Alternatively, the nucleic acids comprise sequences contained within any ORF (open reading frame), including a complete protein-coding sequence, of which any of SEQ ID NO: 1–SEQ ID NO: 2837 forms a part. The invention encompasses sequence-conservative variants and function-conservative variants of these sequences. The nucleic acids may be DNA, RNA, DNA/RNA duplexes, protein-nucleic acid (PNA), or derivatives thereof.

In another aspect, the invention features, a purified recombinant nucleic acid having at least 50%, 60%, 70%, 80%, 90%, 95%, 98%, or 99% homology with a sequence of the invention contained in the Sequence Listing.

The invention also encompasses recombinant DNA (including DNA cloning and expression vectors) comprising these *S. epidermidis*-derived sequences; host cells comprising such DNA, including fungal, bacterial, yeast, plant, insect, and mammalian host cells; and methods for producing expression products comprising RNA and polypeptides encoded by the *S. epidermidis* sequences. These methods are carried out by incubating a host cell comprising a *S. epidermidis*-derived nucleic acid sequence under conditions in which the sequence is expressed. The host cell may be native or recombinant. The polypeptides can be obtained by (a) harvesting the incubated cells to produce a cell fraction and a medium fraction; and (b) recovering the *S. epidermidis* polypeptide from the cell fraction, the medium fraction, or both. The polypeptides can also be made by in vitro translation.

In another aspect, the invention features nucleic acids capable of binding mRNA of *S. epidermidis*. Such nucleic acid is capable of acting as antisense nucleic acid to control the translation of mRNA of *S. epidermidis*. A further aspect features a nucleic acid which is capable of binding specifically to a *S. epidermidis* nucleic acid. These nucleic acids are also referred to herein as complements and have utility as probes and as capture reagents.

In another aspect, the invention features an expression system comprising an open reading frame corresponding to *S. epidermidis* nucleic acid. The nucleic acid further comprises a control sequence compatible with an intended host. The expression system is useful for making polypeptides corresponding to *S. epidermidis* nucleic acid.

In another aspect, the invention encompasses: a vector including a nucleic acid which encodes a *S. epidermidis* polypeptide or a *S. epidermidis* polypeptide variant as described herein; a host cell transfected with the vector; and a method of producing a recombinant *S. epidermidis* polypeptide or *S. epidermidis* polypeptide variant; including culturing the cell, e.g., in a cell culture medium, and isolating the *S. epidermidis* or *S. epidermidis* polypeptide variant, e.g., from the cell or from the cell culture medium.

In yet another embodiment of the invention encompasses reagents for detecting bacterial infection, including *S. epidermidis* infection, which comprise at least one *S. epidermidis*-derived nucleic acid defined by any one of SEQ ID NO: 1–SEQ ID NO: 2837, or sequence-conservative or function-conservative variants thereof. Alternatively, the diagnostic reagents comprise polypeptide sequences that are contained within any open reading frames (ORFs), including complete protein-coding sequences, contained within any of SEQ ID NO: 1–SEQ ID NO: 2837, or polypeptide sequences contained within any of SEQ ID NO: 2838–SEQ ID NO: 5674, or polypeptides of which any of the above sequences forms a part, or antibodies directed against any of the above peptide sequences or function-conservative variants and/or fragments thereof.

The invention further provides antibodies, preferably monoclonal antibodies, which specifically bind to the polypeptides of the invention. Methods are also provided for producing antibodies in a host animal. The methods of the invention comprise immunizing an animal with at least one S. epidermidis-derived immunogenic component, wherein the immunogenic component comprises one or more of the polypeptides encoded by any one of SEQ ID NO: 1–SEQ ID NO: 2837 or sequence-conservative or function-conservative variants thereof; or polypeptides that are contained within any ORFs, including complete protein-coding sequences, of which any of SEQ ID NO: 1–SEQ ID NO: 2837 forms a part; or polypeptide sequences contained within any of SEQ ID NO: 2838–SEQ ID NO: 5674, or polypeptides of which any of SEQ ID NO: 2838–SEQ ID NO: 5674 forms a part. Host animals include any warm blooded animal, including without limitation mammals and birds. Such antibodies have utility as reagents for immunoassays to evaluate the abundance and distribution of S. epidermidis-specific antigens.

In yet another aspect, the invention provides diagnostic methods for detecting S. epidermidis antigenic components or anti-S. epidermidis antibodies in a sample. S. epidermidis antigenic components are detected by a process comprising: (i) contacting a sample suspected to contain a bacterial antigenic component with a bacterial-specific antibody, under conditions in which a stable antigen-antibody complex can form between the antibody and bacterial antigenic components in the sample; and (ii) detecting any antigen-antibody complex formed in step (i), wherein detection of an antigen-antibody complex indicates the presence of at least one bacterial antigenic component in the sample. In different embodiments of this method, the antibodies used are directed against a sequence encoded by any of SEQ ID NO: 1–SEQ ID NO: 2837 or sequence-conservative or function-conservative variants thereof, or against a polypeptide sequence contained in any of SEQ ID NO: 2838–SEQ ID NO: 5674 or function-conservative variants thereof.

In yet another aspect, the invention provides a method for detecting antibacterial-specific antibodies in a sample, which comprises: (i) contacting a sample suspected to contain antibacterial-specific antibodies with a S. epidermidis antigenic component, under conditions in which a stable antigen-antibody complex can form between the S. epidermidis antigenic component and antibacterial antibodies in the sample; and (ii) detecting any antigen-antibody complex formed in step (i), wherein detection of an antigen-antibody complex indicates the presence of antibacterial antibodies in the sample. In different embodiments of this method, the antigenic component is encoded by a sequence contained in any of SEQ ID NO: 1–SEQ ID NO: 2837 or sequence-conservative and function-conservative variants thereof, or is a polypeptide sequence contained in any of SEQ ID NO: 2838–SEQ ID NO: 5674 or function-conservative variants thereof.

In another aspect, the invention features a method of generating vaccines for immunizing an individual against S. epidermidis. The method includes: immunizing a subject with a S. epidermidis polypeptide, e.g., a surface or secreted polypeptide, or a combination of such peptides or active portion(s) thereof, and a pharmaceutically acceptable carrier. Such vaccines have therapeutic and prophylactic utilities.

In another aspect, the invention features a method of evaluating a compound, e.g. a polypeptide, e.g., a fragment of a host cell polypeptide, for the ability to bind a S. epidermidis polypeptide. The method includes: contacting the Staphylococcus compound with a S. epidermidis polypeptide and determining if the compound binds or otherwise interacts with a S. epidermidis polypeptide. Compounds which bind S. epidermidis are candidates as activators or inhibitors of the bacterial life cycle. These assays can be performed in vitro or in vivo.

In another aspect, the invention features a method of evaluating a compound, e.g. a polypeptide, e.g., a fragment of a host cell polypeptide, for the ability to bind a S. epidermidis nucleic acid, e.g., DNA or RNA. The method includes: contacting the Staphylococcus compound with a S. epidermidis nucleic acid and determining if the compound binds or otherwise interacts with a S. epidermidis polypeptide. Compounds which bind S. epidermidis are candidates as activators or inhibitors of the bacterial life cycle. These assays can be performed in vitro or in vivo.

A particularly preferred embodiment of the invention is directed to a method of screening test compounds for anti-bacterial activity, which method comprises: selecting as a target a bacterial specific sequence, which sequence is essential to the viability of a bacterial species; contacting a test compound with said target sequence; and selecting those test compounds which bind to said target sequence as potential anti-bacterial candidates. In one embodiment, the target sequence selected is specific to a single species, or even a single strain, i.e., the S. epidermidis 18972. In a second embodiment, the target sequence is common to at least two species of bacteria. In a third embodiment, the target sequence is common to a family of bacteria. The target sequence may be a nucleic acid sequence or a polypeptide sequence. Methods employing sequences common to more than one species of microorganism may be used to screen candidates for broad spectrum anti-bacterial activity.

The invention also provides methods for preventing or treating disease caused by certain bacteria, including S. epidermidis, which are carried out by administering to an animal in need of such treatment, in particular a warm-blooded vertebrate, including but not limited to birds and mammals, a compound that specifically inhibits or interferes with the function of a bacterial polypeptide or nucleic acid. In a particularly preferred embodiment, the mammal to be treated is human.

DETAILED DESCRIPTION OF THE INVENTION

The sequences of the present invention include the specific nucleic acid and amino acid sequences set forth in the Sequence Listing that forms a part of the present specification, and which are designated SEQ ID NO: 1–SEQ ID NO: 5674. Use of the terms "SEQ ID NO: 1–SEQ ID NO: 2837," "SEQ ID NO: 2838–SEQ ID NO: 5674," and "the sequences depicted in Table 2", etc., is intended, for convenience, to refer to each individual SEQ ID NO individually, and is not intended to refer to the genus of these sequences. In other words, it is a shorthand for listing all of these sequences individually. The invention encompasses each sequence individually, as well as any combination thereof.

Definitions

"Nucleic acid" or "polynucleotide" as used herein refers to purine- and pyrimidine-containing polymers of any length, either polyribonucleotides or polydeoxyribonucleotides or mixed polyribo-polydeoxyribo nucleotides. This includes single- and double-stranded molecules, i.e., DNA-DNA, DNA-RNA and RNA-RNA hybrids, as well as "protein nucleic acids" (PNA) formed by conjugating bases to an amino acid backbone. This also includes nucleic acids containing modified bases.

A nucleic acid or polypeptide sequence that is "derived from" a designated sequence refers to a sequence that corresponds to a region of the designated sequence. For nucleic acid sequences, this encompasses sequences that are homologous or complementary to the sequence, as well as "sequence-conservative variants" and "function-conservative variants." For polypeptide sequences, this encompasses "function-conservative variants." Sequence-conservative variants are those in which a change of one or more nucleotides in a given codon position results in no alteration in the amino acid encoded at that position. Function-conservative variants are those in which a given amino acid residue in a polypeptide has been changed without altering the overall conformation and function of the native polypeptide, including, but not limited to, replacement of an amino acid with one having similar physico-chemical properties (such as, for example, acidic, basic, hydrophobic, and the like). "Function-conservative" variants also include any polypeptides that have the ability to elicit antibodies specific to a designated polypeptide.

An "S. epidermidis-derived" nucleic acid or polypeptide sequence may or may not be present in other bacterial species, and may or may not be present in all S. epidermidis strains. This term is intended to refer to the source from which the sequence was originally isolated. Thus, a S. epidermidis-derived polypeptide, as used herein, may be used, e.g., as a target to screen for a broad spectrum antibacterial agent, to search for homologous proteins in other species of bacteria or in eukaryotic organisms such as fungi and humans, etc.

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it. Preferably, the polypeptide constitutes at least 10, 20, 50 70, 80 or 95% dry weight of the purified preparation. Preferably, the preparation contains: sufficient polypeptide to allow protein sequencing; at least 1, 10, or 100 mg of the polypeptide.

A purified preparation of cells refers to, in the case of plant or animal cells, an in vitro preparation of cells and not an entire intact plant or animal. In the case of cultured cells or microbial cells, it consists of a preparation of at least 10% and more preferably 50% of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally-occurring genome of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant DNA which is part of a hybrid gene encoding additional S. epidermidis DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA, synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitro-cellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared x100. For example, if 6 of 10 of the positions in two sequences are matched or homologous then the two sequences are 60% homologous. By way of example, the DNA sequences ATTGCC and TATGGC share 50% homology. Generally, a comparison is made when two sequences are aligned to give maximum homology.

Nucleic acids are hybridizable to each other when at least one strand of a nucleic acid can anneal to the other nucleic acid under defined stringency conditions. Stringency of hybridization is determined by: (a) the temperature at which hybridization and/or washing is performed; and (b) the ionic strength and polarity of the hybridization and washing solutions. Hybridization requires that the two nucleic acids contain complementary sequences; depending on the stringency of hybridization, however, mismatches may be tolerated. Typically, hybridization of two sequences at high stringency (such as, for example, in a solution of 0.5×SSC, at 65° C.) requires that the sequences be essentially completely homologous. Conditions of intermediate stringency (such as, for example, 2×SSC at 65° C.) and low stringency (such as, for example 2×SSC at 55° C.), require correspondingly less overall complementarity between the hybridizing sequences. (1×SSC is 0.15 M NaCl, 0.015 M Na citrate).

The terms peptides, proteins, and polypeptides are used interchangeably herein.

As used herein, the term "surface protein" refers to all surface accessible proteins, e.g. inner and outer membrane proteins, proteins adhering to the cell wall, and secreted proteins.

A polypeptide has S. epidermidis biological activity if it has one, two and preferably more of the following properties: (1) if when expressed in the course of a S. epidermidis infection, it can promote, or mediate the attachment of S. epidermidis to a cell; (2) it has an enzymatic activity, structural or regulatory function characteristic of a S. epidermidis protein; (3) or the gene which encodes it can rescue a lethal mutation in a S. epidermidis gene. A polypeptide has biological activity if it is an antagonist, agonist, or superagonist of a polypeptide having one of the above-listed properties.

A biologically active fragment or analog is one having an in vivo or in vitro activity which is characteristic of the S. epidermidis polypeptides of the invention contained in the Sequence Listing, or of other naturally occurring S. epidermidis polypeptides, e.g., one or more of the biological activities described herein. Especially preferred are fragments which exist in vivo, e.g., fragments which arise from post transcriptional processing or which arise from translation of alternatively spliced RNA's. Fragments include those expressed in native or endogenous cells as well as those made in expression systems, e.g., in CHO (Chinese Hamster Ovary) cells. Because peptides such as S. epidermidis polypeptides often exhibit a range of physiological properties and because such properties may be attributable to different portions of the molecule, a useful S. epidermidis fragment or S. epidermidis analog is one which exhibits a biological activity in any biological assay for S. epidermidis activity. Most preferably the fragment or analog possesses 10%, preferably 40%, more preferably 60%, 70%, 80% or 90% or greater of the activity of S. epidermidis, in any in vivo or in vitro assay.

Analogs can differ from naturally occurring S. epidermidis polypeptides in amino acid sequence or in ways that do not involve sequence, or both. Non-sequence modifications include changes in acetylation, methylation, phosphorylation, carboxylation, or glycosylation. Preferred analogs include S. epidermidis polypeptides (or biologically active fragments thereof) whose sequences differ from the wild-type sequence by one or more conservative amino acid substitutions or by one or more non-conservative amino acid substitutions, deletions, or insertions which do not substantially diminish the biological activity of the S. epidermidis polypeptide. Conservative substitutions typically include the substitution of one amino acid for another with similar characteristics, e.g., substitutions within the following groups: valine, glycine; glycine, alanine; valine, isoleucine, leucine; aspartic acid, glutamic acid; asparagine, glutamine; serine, threonine; lysine, arginine; and phenylalanine, tyrosine. Other conservative substitutions can be made in view of the table below.

TABLE 1

CONSERVATIVE AMINO ACID REPLACEMENTS

| For Amino Acid | Code | Replace with any of |
|---|---|---|
| Alanine | A | D-Ala, Gly, beta-Ala, L-Cys, D-Cys |
| Arginine | R | D-Arg, Lys, D-Lys, homo-Arg, D-homo-Arg, Met, Ile, D-Met, D-Ile, Orn, D-Orn |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me-Cys, Met, D-Met, Thr, D-Thr |
| Glutamine | Q | D-Gln, Asn, D-Asn, Glu, D-Glu, Asp, D-Asp |
| Glutamic Acid | E | D-Glu, D-Asp, Asp, Asn, D-Asn, Gln, D-Gln |
| Glycine | G | Ala, D-Ala, Pro, D-Pro, β-Ala, Acp |
| Isoleucine | I | D-Ile, Val, D-Val, Leu, D-Leu, Met, D-Met |
| Leucine | L | D-Leu, Val, D-Val, Leu, D-Leu, Met, D-Met |
| Lysine | K | D-Lys, Arg, D-Arg, homo-Arg, D-homo-Arg, Met, D-Met, Ile, D-Ile, Orn, D-Orn |
| Methionine | M | D-Met, S-Me-Cys, Ile, D-Ile, Leu, D-Leu, Val, D-Val |
| Phenylalanine | F | D-Phe, Tyr, D-Thr, L-Dopa, His, D-His, Trp, D-Trp, Trans-3,4, or 5-phenylproline, cis-3,4, or 5-phenylproline |
| Proline | P | D-Pro, L-I-thioazolidine-4-carboxylic acid, D-or L-1-oxazolidine-4-carboxylic acid |
| Serine | S | D-Ser, Thr, D-Thr, allo-Thr, Met, D-Met, Met(O), D-Met(O), L-Cys, D-Cys |
| Threonine | T | D-Thr, Ser, D-Ser, allo-Thr, Met, D-Met, Met(O), D-Met(O), Val, D-Val |
| Tyrosine | Y | D-Tyr, Phe, D-Phe, L-Dopa, His, D-His |
| Valine | V | D-Val, Leu, D-Leu, Ile, D-Ile, Met, D-Met |

Other analogs within the invention are those with modifications which increase peptide stability; such analogs may contain, for example, one or more non-peptide bonds (which replace the peptide bonds) in the peptide sequence. Also included are: analogs that include residues other than naturally occurring L-amino acids, e.g., D-amino acids or non-naturally occurring or synthetic amino acids, e.g., β or γ amino acids; and cyclic analogs.

As used herein, the term "fragment", as applied to a S. epidermidis analog, will ordinarily be at least about 20 residues, more typically at least about 40 residues, preferably at least about 60 residues in length. Fragments of S. epidermidis polypeptides can be generated by methods known to those skilled in the art. The ability of a Staphylococcus fragment to exhibit a biological activity of S. epidermidis polypeptide can be assessed by methods known to those skilled in the art as described herein. Also included are S. epidermidis polypeptides containing residues that are not required for biological activity of the peptide or that result from alternative mRNA splicing or alternative protein processing events.

An "immunogenic component" as used herein is a moiety, such as a S. epidermidis polypeptide, analog or fragment thereof, that is capable of eliciting a humoral and/or cellular immune response in a host animal.

An "antigenic component" as used herein is a moiety, such as a S. epidermidis polypeptide, analog or fragment thereof, that is capable of binding to a specific antibody with sufficiently high affinity to form a detectable antigen-antibody complex.

The term "antibody" as used herein is intended to include fragments thereof which are specifically reactive with S. epidermidis polypeptides.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

Misexpression, as used herein, refers to a non-wild type pattern of gene expression. It includes: expression at non-wild type levels, i.e., over or under expression; a pattern of expression that differs from wild type in terms of the time or stage at which the gene is expressed, e.g., increased or decreased expression (as compared with wild type) at a predetermined developmental period or stage; a pattern of expression that differs from wild type in terms of increased expression (as compared with wild type) in a predetermined cell type or tissue type; a pattern of expression that differs from wild type in terms of the splicing size, amino acid sequence, post-translational modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

As used herein, "host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

The "metabolism" of a substance, as used herein, means any aspect of the expression, function, action, or regulation of the substance. The metabolism of a substance includes modifications, e.g., covalent or non-covalent modifications of the substance. The metabolism of a substance includes modifications, e.g., covalent or non-covalent modification, the substance induces in other substances. The metabolism of a substance also includes changes in the distribution of the substance. The metabolism of a substance includes changes the substance induces in the distribution of other substances.

A "sample" as used herein refers to a biological sample, such as, for example, tissue or fluid isolated from an individual (including without limitation plasma, serum, cerebrospinal fluid, lymph, tears, saliva and tissue sections) or from in vitro cell culture constituents, as well as samples from the environment.

Technical and scientific terms used herein have the meanings commonly understood by one of ordinary skill in the art to which the present invention pertains, unless otherwise defined. Reference is made herein to various methodologies known to those of skill in the art. Publications and other materials setting forth such known methodologies to which reference is made are incorporated herein by reference in their entireties as though set forth in full. The practice of the invention will employ, unless otherwise indicated, conventional techniques of chemistry, molecular biology, microbiology, recombinant DNA, and immunology, which are within the skill of the art. Such techniques are explained fully in the literature. See e.g., Sambrook, Fritsch, and Maniatis, *Molecular Cloning: Laboratory Manual* 2nd ed. (1989); *DNA Cloning*, Volumes I and II (D. N Glover ed. 1985); *Oligonucleotide Synthesis* (M. J. Gait ed, 1984); *Nucleic Acid Hybridization* (B. D. Hames & S. J. Higgins eds. 1984); the series, *Methods in Enzymology* (Academic Press, Inc.), particularly Vol. 154 and Vol. 155 (Wu and Grossman, eds.); *PCR-A Practical Approach* (McPherson, Quirke, and Taylor, eds., 1991); *Immunology*, 2d Edition, 1989, Roitt et al., C. V. Mosby Company, and New York; *Advanced Immunology*, 2d Edition, 1991, Male et al., Grower Medical Publishing, New York.; *DNA Cloning. A Practical Approach*, Volumes I and II, 1985 (D. N. Glover ed.); *Oligonucleotide Synthesis*, 1984, (M. L. Gait ed); *Transcription and Translation*, 1984 (Hames and Higgins eds.); *Animal Cell Culture*, 1986 (R. I. Freshney ed.); *Immobilized Cells and Enzymes*, 1986 (IRL Press); Perbal, 1984, *A Practical Guide to Molecular Cloning; and Gene Transfer Vectors for Mammalian Cells*, 1987 (J. H. Miller and M. P. Calos eds., Cold Spring Harbor Laboratory).

Any suitable materials and/or methods known to those of skill can be utilized in carrying out the present invention: however preferred materials and/or methods are described. Materials, reagents and the like to which reference is made in the following description and examples are obtainable from commercial sources, unless otherwise noted.

S. epidermidis Genomic Sequence

This invention provides nucleotide sequences of the genome of S. epidermidis which thus comprises a DNA sequence library of S. epidermidis genomic DNA. The detailed description that follows provides nucleotide sequences of S. epidermidis, and also describes how the sequences were obtained and how ORFs and protein-coding sequences were identified. Also described are methods of using the disclosed S. epidermidis sequences in methods including diagnostic and therapeutic applications. Furthermore, the library can be used as a database for identification and comparison of medically important sequences in this and other strains of S. epidermidis.

To determine the genomic sequence of S. epidermidis, DNA from strain 18972 of S. epidermidis was isolated after Zymolyase digestion, sodium dodecyl sulfate lysis, potassium acetate precipitation, phenol:chloroform extraction and ethanol precipitation (Soll, D. R., T. Srikantha and S. R. Lockhart: Characterizing Developmentally Regulated Genes in S. epidermidis. In Microbial Genome Methods. K. W. Adolph, editor. CRC Press. New York. p 17–37.). DNA was sheared hydrodynamically using an HPLC (Oefner, et. al., 1996) to an insert size of 2000–3000 bp. After size fractionation by gel electrophoresis the fragments were blunt-ended, ligated to adapter oligonucleotides and cloned into the pGTC (Thomann) vector to construct a "shotgun" subclone library DNA sequencing was achieved using established ABI sequencing methods on ABI377 automated DNA sequencers. The cloning and sequencing procedures are described in more detail in the Exemplification.

Individual sequence reads were assembled using PHRAP (P. Green, Abstracts of DOE Human Genome Program Contractor-Grantee Workshop V, January 1996, p. 157). The average contig length was about 3–4 kb.

All subsequent steps were based on sequencing by ABI377 automated DNA sequencing methods. The cloning and sequencing procedures are described in more detail in the Exemplification.

A variety of approaches are used to order the contigs so as to obtain a continuous sequence representing the entire *S. epidermidis* genome. Synthetic oligonucleotides are designed that are complementary to sequences at the end of each contig. These oligonucleotides may be hybridized to libraries of *S. epidermidis* genomic DNA in, for example, lambda phage vectors or plasmid vectors to identify clones that contain sequences corresponding to the junctional regions between individual contigs. Such clones are then used to isolate template DNA and the same oligonucleotides are used as primers in polymerase chain reaction (PCR) to amplify junctional fragments, the nucleotide sequence of which is then determined.

The *S. epidermidis* sequences were analyzed for the presence of open reading frames (ORFs) comprising at least 180 nucleotides. As a result of the analysis of ORFs based on stop-to-stop codon reads, it should be understood that these ORFs may not correspond to the ORF of a naturally-occurring *S. epidermidis* polypeptide. These ORFs may contain start codons which indicate the initiation of protein synthesis of a naturally-occurring *S. epidermidis* polypeptide. Such start codons within the ORFs provided herein were identified by those of ordinary skill in the relevant art, and the resulting ORF and the encoded *S. epidermidis* polypeptide is within the scope of this invention. For example, within the ORFs a codon such as AUG or GUG (encoding methionine or valine) which is part of the initiation signal for protein synthesis were identified and the portion of an ORF to corresponding to a naturally-occurring *S. epidermidis* polypeptide was recognized. The predicted coding regions were defined by evaluating the coding potential of such sequences with the program GENEMARK™ (Borodovsky and McIninch, 1993, *Comp.* 17:123).

Each predicted ORF amino acid sequence was compared with all sequences found in current GENBANK, SWISS-PROT, and PIR databases using the BLAST algorithm. BLAST identifies local alignments occurring by chance between the ORF sequence and the sequence in the databank (Altschal et al., 1990, L Mol. Biol. 215:403–410). Homologous ORFs (probabilities less than $10^{-5}$ by chance) and ORF's that are probably non-homologous (probabilities greater than $10^{-5}$ by chance) but have good codon usage were identified. Both homologous, sequences and non-homologous sequences with good codon usage, are likely to encode proteins and are encompassed by the invention.

S. *epidermidis* Nucleic Acids

The present invention provides a library of *S. epidermidis*-derived nucleic acid sequences. The libraries provide probes, primers, and markers which are used as markers in epidemiological studies. The present invention also provides a library of *S. epidermidis*-derived nucleic acid sequences which comprise or encode targets for therapeutic drugs.

The nucleic acids of this invention may be obtained directly from the DNA of the above referenced *S. epider-midis* strain by using the polymerase chain reaction (PCR). See "*PCR, A Practical Approach*" (McPherson, Quirke, and Taylor, eds., IRL Press, Oxford, UK, 1991) for details about the PCR. High fidelity PCR issued to ensure a faithful DNA copy prior to expression. In addition, the authenticity of amplified products is verified by conventional sequencing methods. Clones carrying the desired sequences described in this invention may also be obtained by screening the libraries by means of the PCR or by hybridization of synthetic oligonucleotide probes to filter lifts of the library colonies or plaques as known in the art (see, e.g., Sambrook et al., *Molecular Cloning, A Laboratory Manual* 2nd edition, 1989, Cold Spring Harbor Press, N.Y.).

It is also possible to obtain nucleic acids encoding *S. epidermidis* polypeptides from a cDNA library in accordance with protocols herein described. A cDNA encoding a *S. epidermidis* polypeptide can be obtained by isolating total mRNA from an appropriate strain. Double stranded cDNAs can then be prepared from the total mRNA. Subsequently, the cDNAs can be inserted into a suitable plasmid or viral (e.g., bacteriophage) vector using any one of a number of known techniques. Genes encoding *S. epidermidis* polypeptides can also be cloned using established polymerase chain reaction techniques in accordance with the nucleotide sequence information provided by the invention. The nucleic acids of the invention can be DNA or RNA. Preferred nucleic acids of the invention are contained in the Sequence Listing.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

In another example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Nucleic acids isolated or synthesized in accordance with features of the present invention are useful, by way of example, without limitation, as probes, primers, capture ligands, antisense genes and for developing expression systems for the synthesis of proteins and peptides corresponding to such sequences. As probes, primers, capture ligands and antisense agents, the nucleic acid normally consists of all or part (approximately twenty or more nucleotides for specificity as well as the ability to form stable hybridization products) of the nucleic acids of the invention contained in the Sequence Listing. These uses are described in further detail below.

Probes

A nucleic acid isolated or synthesized in accordance with the sequence of the invention contained in the Sequence Listing can be used as a probe to specifically detect *S. epidermidis*. With the sequence information set forth in the present application, sequences of twenty or more nucleotides are identified which provide the desired inclusivity and exclusivity with respect to *S. epidermidis*, and extraneous nucleic acids likely to be encountered during hybridization conditions. More preferably, the sequence will comprise at least twenty to thirty nucleotides to convey stability to the hybridization product formed between the probe and the intended target molecules.

Sequences larger than 1000 nucleotides in length are difficult to synthesize but can be generated by recombinant DNA techniques. Individuals skilled in the art will readily recognize that the nucleic acids, for use as probes, can be provided with a label to facilitate detection of a hybridization product.

Nucleic acid isolated and synthesized in accordance with the sequence of the invention contained in the Sequence Listing can also be useful as probes to detect homologous regions (especially homologous genes) of other Staphylococcus species using appropriate stringency hybridization conditions as described herein.

Capture Ligand

For use as a capture ligand, the nucleic acid selected in the manner described above with respect to probes, can be readily associated with a support. The manner in which nucleic acid is associated with supports is well known. Nucleic acid having twenty or more nucleotides in a sequence of the invention contained in the Sequence Listing have utility to separate S. epidermidis nucleic acid from one strain from the nucleic acid of other another strain as well as from other organisms. Nucleic acid having twenty or more nucleotides in a sequence of the invention contained in the Sequence Listing can also have utility to separate other Staphylococcus species from each other and from other organisms. Preferably, the sequence will comprise at least twenty nucleotides to convey stability to the hybridization product formed between the probe and the intended target molecules. Sequences larger than 1000 nucleotides in length are difficult to synthesize but can be generated by recombinant DNA techniques.

Primers

Nucleic acid isolated or synthesized in accordance with the sequences described herein have utility as primers for the amplification of S. epidermidis nucleic acid. These nucleic acids may also have utility as primers for the amplification of nucleic acids in other Staphylococcus species. With respect to polymerase chain reaction (PCR) techniques, nucleic acid sequences of $\geq$10–15 nucleotides of the invention contained in the Sequence Listing have utility in conjunction with suitable enzymes and reagents to create copies of S. epidermidis nucleic acid. More preferably, the sequence will comprise twenty or more nucleotides to convey stability to the hybridization product formed between the primer and the intended target molecules. Binding conditions of primers greater than 100 nucleotides are more difficult to control to obtain specificity. High fidelity PCR can be used to ensure a faithful DNA copy prior to expression. In addition, amplified products can be checked by conventional sequencing methods.

The copies can be used in diagnostic assays to detect specific sequences, including genes from S. epidermidis and/or other Staphylococcus species. The copies can also be incorporated into cloning and expression vectors to generate polypeptides corresponding to the nucleic acid synthesized by PCR, as is described in greater detail herein.

The nucleic acids of the present invention find use as templates for the recombinant production of S. epidermidis-derived peptides or polypeptides.

Antisense

Nucleic acid or nucleic acid-hybridizing derivatives isolated or synthesized in accordance with the sequences described herein have utility as antisense agents to prevent the expression of S. epidermidis genes. These sequences also have utility as antisense agents to prevent expression of genes of other Staphylococcus species.

In one embodiment, nucleic acid or derivatives corresponding to S. epidermidis nucleic acids is loaded into a suitable carrier such as a liposome or bacteriophage for introduction into bacterial cells. For example, a nucleic acid having twenty or more nucleotides is capable of binding to bacteria nucleic acid or bacteria messenger RNA. Preferably, the antisense nucleic acid is comprised of 20 or more nucleotides to provide necessary stability of a hybridization product of non-naturally occurring nucleic acid and bacterial nucleic acid and/or bacterial messenger RNA. Nucleic acid having a sequence greater than 1000 nucleotides in length is difficult to synthesize but can be generated by recombinant DNA techniques. Methods for loading antisense nucleic acid in liposomes is known in the art as exemplified by U.S. Pat. No. 4,241,046 issued Dec. 23, 1980 to Papahadjopoulos et al.

The present invention encompasses isolated polypeptides and nucleic acids derived from S. epidermidis that are useful as reagents for diagnosis of bacterial infection, components of effective anti-bacterial vaccines, and/or as targets for anti-bacterial drugs, including anti-S. epidermidis drugs.

Expression of S. epidermidis Nucleic Acids

Table 2, which is appended herewith and which forms part of the present specification, provides a list of open reading frames (ORFs) in both strands and a putative identification of the particular function of a polypeptide which is encoded by each ORF, based on the homology match (determined by the BLAST algorithm) of the predicted polypeptide with known proteins encoded by ORFs in other organisms. An ORF is a region of nucleic acid which encodes a polypeptide. This region may represent a portion of a coding sequence or a total sequence and was determined from stop to stop codons. The first column contains a designation for the contig from which each ORF was identified (numbered arbitrarily). Each contig represents a continuous stretch of the genomic sequence of the organism. The second column lists the ORF designation. The third and fourth columns list the SEQ ID numbers for the nucleic acid and amino acid sequences corresponding to each ORF, respectively. The fifth and sixth columns list the length of the nucleic acid and the length of the amino acid, respectively. The nucleotide sequence corresponding to each ORF designation begins at the first nucleotide immediately following a stop codon and ends at the nucleotide immediately preceding the next downstream stop codon in the same reading frame. It will be recognized by one skilled in the art that the natural translation initiation sites will correspond to ATG, GTG, or TTG codons located within the ORFs. The natural initiation sites depend not only on the sequence of a start codon but also on the context of the DNA sequence adjacent to the start codon. Usually, a recognizable ribosome binding site is found within 20 nucleotides upstream from the initiation codon. In some cases where genes are translationally coupled and coordinately expressed together in "operons", ribosome binding sites are not present, but the initiation codon of a downstream gene may occur very close to, or overlap, the stop codon of the an upstream gene in the same operon. The correct start codons can be generally identified without undue experimentation because only a few codons need be tested. It is recognized that the translational machinery in bacteria initiates all polypeptide chains with the amino acid methionine, regardless of the sequence of the start codon. In some cases, polypeptides are post-translationally modified, resulting in an N-terminal amino acid other than methionine in vivo. The seventh and eighth columns provide metrics for assessing the likelihood of the homology match (determined by the BLASTP2 algorithm), as is known in the art, to the genes indicated in the eleventh column when the designated ORF was compared against a non-redundant comprehensive protein database. Specifically, the seventh column represents the "Blast Score" for the match (a higher score is a better match), and the eighth column represents the "P-value" for the match (the probability that such a match can have occurred by chance; the lower the value, the more likely the match is valid). If a BLASTP2 score of less than 46 was obtained, no value is reported in the table the , "P-value". Column nine, Subject Taxonomy," provides the name of the organism that was identified as having the closest homology match. The tenth column,"Subject Name," provides where available, either a public database accession number or our own sequence name. The eleventh column provides, where available, the Swissprot accession number (SP), the locus name (LN), the Organism (OR), Source of variant (SR), E.C. number (EC),the gene name (GN), the product name (PN), the Function Description (FN), Left End (LE), Right End (RE), Coding Direction (DI), and the description (DE) or notes (NT) for each ORF. Information that is not preceded by a code designation in the eleventh column represents a description of the ORF. This information allows one of ordinary skill in the art to determine a potential use for each identified coding sequence and, as a result, allows use of the polypeptides of the present invention for commercial and industrial purposes.

Using the information provided in SEQ ID NO: 1–SEQ ID NO: 2837 and in Table 2 together with routine cloning and sequencing methods, one of ordinary skill in the art will be able to clone and sequence all the nucleic acid fragments of interest including open reading frames (ORFs) encoding a large variety proteins of S. epidermidis.

Nucleic acid isolated or synthesized in accordance with the sequences described herein have utility to generate polypeptides. The nucleic acid of the invention exemplified in SEQ ID NO: 1–SEQ ID NO: 2837 and in Table 2 or fragments of said nucleic acid encoding active portions of S. epidermidis polypeptides can be cloned into suitable vectors or used to isolate nucleic acid. The isolated nucleic acid is combined with suitable DNA linkers and cloned into a suitable vector.

The function of a specific gene or operon can be ascertained by expression in a bacterial strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression can be accomplished in a mutant strain which lacks the activity of the gene to be tested, or in a strain that does not produce the same gene product(s). This includes, but is not limited to, Eucaryotic species such as the yeast *Saccharomyces cerevisiae,* Methanobacterium strains or other Archaea, and Eubacteria such as *E. coli, B. Subtilis, S. Aureus, S. Pneumonia* or *Pseudomonas putida*. In some cases the expression host will utilize the natural *S. epidermidis* promoter whereas in others, it will be necessary to drive the gene with a promoter sequence derived from the expressing organism (e.g., an *E. coli* beta-galactosidase promoter for expression in *E. coli*).

To express a gene product using the natural *S. epidermidis* promoter, a procedure such as the following can be used. A restriction fragment containing the gene of interest, together with its associated natural promoter element and regulatory sequences (identified using the DNA sequence data) is cloned into an appropriate recombinant plasmid containing an origin of replication that functions in the host organism and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by, for example, electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into an expression plasmid after treating the PCR product with a restriction enzyme or exonuclease to create suitable ends for cloning.

A suitable host cell for expression of a gene can be any procaryotic or eucaryotic cell. Suitable methods for transforming host cells can be found in Sambrook et al. (*Molecular Cloning: A Laboratory Manual,* 2nd Edition, Cold Spring Harbor Laboratory press (1989)), and other laboratory textbooks.

For example, a host cell transfected with a nucleic acid vector directing expression of a nucleotide sequence encoding a *S. epidermidis* polypeptide can be cultured under appropriate conditions to allow expression of the polypeptide to occur. Suitable media for cell culture are well known in the art. Polypeptides of the invention can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such polypeptides. Additionally, in many situations, polypeptides can be produced by chemical cleavage of a native protein (e.g., tryptic digestion) and the cleavage products can then be purified by standard techniques.

In the case of membrane bound proteins, these can be isolated from a host cell by contacting a membrane-associated protein fraction with a detergent forming a solubilized complex, where the membrane-associated protein is no longer entirely embedded in the membrane fraction and is solubilized at least to an extent which allows it to be chromatographically isolated from the membrane fraction. Chromatographic techniques which can be used in the final purification step are known in the art and include hydrophobic interaction, lectin affinity, ion exchange, dye affinity and immunoaffinity.

One strategy to maximize recombinant *S. epidermidis* peptide expression in *E. coli* is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119–128). Another strategy would be to alter the nucleic acid encoding a *S. epidermidis* peptide to be inserted into an expression vector so that the individual codons for each amino acid would be those preferentially utilized in highly expressed *E. coli* proteins (Wada et al., (1992) *Nuc. Acids Res.* 20:2111–2118). Such alteration of nucleic acids of the invention can be carried out by standard DNA synthesis techniques.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See, e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

The present invention provides a library of *S. epidermidis*-derived nucleic acid sequences. The libraries provide probes primers, and markers which can be used as markers in epidemiological studies. The present invention also provides a library of *S. epidermidis*-derived nucleic acid sequences which comprise or encode targets for therapeutic drugs.

Nucleic acids comprising any of the sequences disclosed herein or sub-sequences thereof can be prepared by standard methods using the nucleic acid sequence information provided in SEQ ID NO: 1–SEQ ID NO: 2837. For example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Of course, due to the degeneracy of the genetic code, many different nucleotide sequences can encode polypeptides having the amino acid sequences defined by SEQ ID NO: 2838–SEQ ID NO: 5674 or sub-sequences thereof. The codons can be selected for optimal expression in prokaryotic or eukaryotic systems. Such degenerate variants are also encompassed by this invention.

Insertion of nucleic acids (typically DNAs) encoding the polypeptides of the invention into a vector is easily accomplished when the termini of both the DNAs and the vector comprise compatible restriction sites. If this cannot be done, it may be necessary to modify the termini of the DNAs and/or vector by digesting back single-stranded DNA overhangs generated by restriction endonuclease cleavage to produce blunt ends, or to achieve the same result by filling in the single-stranded termini with an appropriate DNA polymerase.

Alternatively, any site desired may be produced, e.g., by ligating nucleotide sequences (linkers) onto the termini. Such linkers may comprise specific oligonucleotide sequences that define desired restriction sites. Restriction sites can also be generated by the use of the polymerase chain reaction (PCR). See, e.g., Saiki et al., 1988, *Science* 239:48. The cleaved vector and the DNA fragments may also be modified if required by homopolymeric tailing.

The nucleic acids of the invention may be isolated directly from cells. Alternatively, the polymerase chain reaction (PCR) method can be used to produce the nucleic acids of the invention, using either chemically synthesized strands or genomic material as templates. Primers used for PCR can be synthesized using the sequence information provided herein and can further be designed to introduce appropriate new restriction sites, if desirable, to facilitate incorporation into a given vector for recombinant expression.

The nucleic acids of the present invention may be flanked by natural *S. epidermidis* regulatory sequences, or may be associated with heterologous sequences, including promoters, enhancers, response elements, signal sequences, polyadenylation sequences, introns, 5'- and 3'-noncoding regions, and the like. The nucleic acids may also be modified by many means known in the art. Non-limiting examples of such modifications include methylation, "caps", substitution of one or more of the naturally occurring nucleotides with an analog, internucleotide modifications such as, for example, those with uncharged linkages (e.g., methyl phosphonates, phosphotriesters, phosphoroamidates, carbamates, etc.) and with charged linkages (e.g., phosphorothioates, phosphorodithioates, etc.). Nucleic acids may contain one or more additional covalently linked moieties, such as, for example, proteins (e.g., nucleases, toxins, antibodies, signal peptides, poly-L-lysine, etc.), intercalators (e.g., acridine, psoralen, etc.), chelators (e.g., metals, radioactive metals, iron, oxidative metals, etc.), and alkylators. PNAs are also included. The nucleic acid may be derivatized by formation of a methyl or ethyl phosphotriester or an alkyl phosphoramidate linkage. Furthermore, the nucleic acid sequences of the present invention may also be modified with a label capable of providing a detectable signal, either directly or indirectly. Exemplary labels include radioisotopes, fluorescent molecules, biotin, and the like.

The invention also provides nucleic acid vectors comprising the disclosed *S. epidermidis*-derived sequences or derivatives or fragments thereof. A large number of vectors, including plasmid and bacterial vectors, have been described for replication and/or expression in a variety of eukaryotic and prokaryotic hosts, and may be used for cloning or protein expression.

The encoded *S. epidermidis* polypeptides may be expressed by using many known vectors, such as pUC plasmids, pET plasmids (Novagen, Inc., Madison, Wis.), or pRSET or pREP (Invitrogen, San Diego, Calif.), and many appropriate host cells, using methods disclosed or cited herein or otherwise known to those skilled in the relevant art. The particular choice of vector/host is not critical to the practice of the invention.

Recombinant cloning vectors will often include one or more replication systems for cloning or expression, one or more markers for selection in the host, e.g. antibiotic resistance, and one or more expression cassettes. The inserted *S. epidermidis* coding sequences may be synthesized by standard methods, isolated from natural sources, or prepared as hybrids, etc. Ligation of the *S. epidermidis* coding sequences to transcriptional regulatory elements and/or to other amino acid coding sequences may be achieved by known methods. Suitable host cells may be transformed/transfected/infected as appropriate by any suitable method including electroporation, $CaCl_2$ mediated DNA uptake, bacterial infection, microinjection, microprojectile, or other established methods.

Appropriate host cells include bacteria, archebacteria, fungi, especially yeast, and plant and animal cells, especially mammalian cells. Of particular interest are *S. epidermidis, E. coli, B. Subtilis, Saccharomyces cerevisiae, Saccharomyces carlsbergensis, Schizosaccharomyces pombi*, SF9 cells, C129 cells, 293 cells, Neurospora, and CHO cells, COS cells, HeLa cells, and immortalized mammalian myeloid and lymphoid cell lines. Preferred replication systems include M13, ColE1, SV40, baculovirus, lambda, adenovirus, and the like. A large number of transcription initiation and termination regulatory regions have been isolated and shown to be effective in the transcription and translation of heterologous proteins in the various hosts. Examples of these regions, methods of isolation, manner of manipulation, etc. are known in the art. Under appropriate expression conditions, host cells can be used as a source of recombinantly produced *S. epidermidis*-derived peptides and polypeptides.

Advantageously, vectors may also include a transcription regulatory element (i.e., a promoter) operably linked to the S. epidermidis portion. The promoter may optionally contain operator portions and/or ribosome binding sites. Non-limiting examples of bacterial promoters compatible with E. coli include: b-lactamase (penicillinase) promoter; lactose promoter; tryptophan (trp) promoter; araBAD (arabinose) operon promoter; lambda-derived PI promoter and N gene ribosome binding site; and the hybrid tac promoter derived from sequences of the trp and lac UV5 promoters. Non-limiting examples of yeast promoters include 3-phosphoglycerate kinase promoter, glyceraldehyde-3-phosphate dehydrogenase (GAPDH) promoter, galactokinase (GAL1) promoter, galactoepimerase promoter, and alcohol dehydrogenase (ADH) promoter. Suitable promoters for mammalian cells include without limitation viral promoters such as that from Simian Virus 40 (SV40), Rous sarcoma virus (RSV), adenovirus (ADV), and bovine papilloma virus (BPV). Mammalian cells may also require terminator sequences, polyA addition sequences and enhancer sequences to increase expression. Sequences which cause amplification of the gene may also be desirable. Furthermore, sequences that facilitate secretion of the recombinant product from cells, including, but not limited to, bacteria, yeast, and animal cells, such as secretory signal sequences and/or prohormone pro region sequences, may also be included. These sequences are well described in the art.

Nucleic acids encoding wild-type or variant S. epidermidis-derived polypeptides may also be introduced into cells by recombination events. For example, such a sequence can be introduced into a cell, and thereby effect homologous recombination at the site of an endogenous gene or a sequence with substantial identity to the gene. Other recombination-based methods such as nonhomologous recombinations or deletion of endogenous genes by homologous recombination may also be used.

The nucleic acids of the present invention find use as templates for the recombinant production of S. epidermidis-derived peptides or polypeptides.

Identification and Use of S. epidermidis Nucleic Acid Sequences

The disclosed S. epidermidis polypeptide and nucleic acid sequences, or other sequences that are contained within ORFs, including complete protein-coding sequences, of which any of the disclosed S. epidermidis-specific sequences forms a part, are useful as target components for diagnosis and/or treatment of S. epidermidis-caused infection.

It will be understood that the sequence of an entire protein-coding sequence of which each disclosed nucleic acid sequence forms a part can be isolated and identified based on each disclosed sequence. This can be achieved, for example, by using an isolated nucleic acid encoding the disclosed sequence, or fragments thereof, to prime a sequencing reaction with genomic S. epidermidis DNA as template; this is followed by sequencing the amplified product. The isolated nucleic acid encoding the disclosed sequence, or fragments thereof, can also be hybridized to S. epidermidis genomic libraries to identify clones containing additional complete segments of the protein-coding sequence of which the shorter sequence forms a part. Then, the entire protein-coding sequence, or fragments thereof, or nucleic acids encoding all or part of the sequence, or sequence-conservative or function-conservative variants thereof, may be employed in practicing the present invention.

Preferred sequences are those that are useful in diagnostic and/or therapeutic applications. Diagnostic applications include without limitation nucleic-acid-based and antibody-based methods for detecting bacterial infection. Therapeutic applications include without limitation vaccines, passive immunotherapy, and drug treatments directed against gene products that are both unique to bacteria and essential for growth and/or replication of bacteria.

Identification of Nucleic Acids Encoding Vaccine Components and Targets for Agents Effective Against S. epidermidis The disclosed S. epidermidis genome sequence includes segments that direct the synthesis of ribonucleic acids and polypeptides, as well as origins of replication, promoters, other types of regulatory sequences, and intergenic nucleic acids. The invention encompasses nucleic acids encoding immunogenic components of vaccines and targets for agents effective against S. epidermidis. Identification of said immunogenic components involved in the determination of the function of the disclosed sequences, which can be achieved using a variety of approaches. Non-limiting examples of these approaches are described briefly below.

Homology to Known Sequences

Computer-assisted comparison of the disclosed S. epidermidis sequences with previously reported sequences present in publicly available databases is useful for identifying functional S. epidermidis nucleic acid and polypeptide sequences. It will be understood that protein-coding sequences, for example, may be compared as a whole, and that a high degree of sequence homology between two proteins (such as, for example, >80–90%) at the amino acid level indicates that the two proteins also possess some degree of functional homology, such as, for example, among enzymes involved in metabolism, DNA synthesis, or cell wall synthesis, and proteins involved in transport, cell division, etc. In addition, many structural features of particular protein classes have been identified and correlate with specific consensus sequences, such as, for example, binding domains for nucleotides, DNA, metal ions, and other small molecules; sites for covalent modifications such as phosphorylation, acylation, and the like; sites of protein-:protein interactions, etc. These consensus sequences may be quite short and thus may represent only a fraction of the entire protein-coding sequence. Identification of such a feature in a S. epidermidis sequence is therefore useful in determining the function of the encoded protein and identifying useful targets of antibacterial drugs.

Of particular relevance to the present invention are structural features that are common to secretory, transmembrane, and surface proteins, including secretion signal peptides and hydrophobic transmembrane domains. S. epidermidis proteins identified as containing putative signal sequences and/or transmembrane domains are useful as immunogenic components of vaccines.

Targets for therapeutic drugs according to the invention include, but are not limited to, polypeptides of the invention, whether unique to S. epidermidis or not, that are essential for growth and/or viability of S. epidermidis under at least one growth condition. Polypeptides essential for growth and/or viability can be determined by examining the effect of deleting and/or disrupting the genes, i.e., by so-called gene "knockout". Alternatively, genetic footprinting can be used (Smith et al., 1995, Proc. Natl. Acad. Sci. USA 92:5479–6433; Published International Application WO 94/26933; U.S. Pat. No. 5,612,180). Still other methods for assessing essentiality includes the ability to isolate conditional lethal mutations in the specific gene (e.g., temperature sensitive mutations). Other useful targets for therapeutic drugs, which include polypeptides that are not essential for growth or viability per se but lead to loss of viability of the cell, can be used to target therapeutic agents to cells.

Strain-specific Sequences

Because of the evolutionary relationship between different *S. epidermidis* strains, it is believed that the presently disclosed *S. epidermidis* sequences are useful for identifying, and/or discriminating between, previously known and new *S. epidermidis* strains. It is believed that other *S. epidermidis* strains will exhibit at least 70% sequence homology with the presently disclosed sequence. Systematic and routine analyses of DNA sequences derived from samples containing *S. epidermidis* strains, and comparison with the present sequence allows for the identification of sequences that can be used to discriminate between strains, as well as those that are common to all *S. epidermidis* strains. In one embodiment, the invention provides nucleic acids, including probes, and peptide and polypeptide sequences that discriminate between different strains of *S. epidermidis*. Strain-specific components can also be identified functionally by their ability to elicit or react with antibodies that selectively recognize one or more *S. epidermidis* strains.

In another embodiment, the invention provides nucleic acids, including probes, and peptide and polypeptide sequences that are common to all *S. epidermidis* strains but are not found in other bacterial species.

*S. epidermidis* Polypeptides

This invention encompasses isolated *S. epidermidis* polypeptides encoded by the disclosed *S. epidermidis* genomic sequences, including the polypeptides of the invention contained in the Sequence Listing. Polypeptides of the invention are preferably at least 5 amino acid residues in length. Using the DNA sequence information provided herein, the amino acid sequences of the polypeptides encompassed by the invention can be deduced using methods well-known in the art. It will be understood that the sequence of an entire nucleic acid encoding a *S. epidermidis* polypeptide can be isolated and identified based on an ORF that encodes only a fragment of the cognate protein-coding region. This can be achieved, for example, by using the isolated nucleic acid encoding the ORF, or fragments thereof, to prime a polymerase chain reaction with genomic *S. epidermidis* DNA as template; this is followed by sequencing the amplified product.

The polypeptides of the present invention, including function-conservative variants of the disclosed ORFs, may be isolated from wild-type or mutant *S. epidermidis* cells, or from heterologous organisms or cells (including, but not limited to, bacteria, fungi, insect, plant, and mammalian cells) including *S. epidermidis* into which a *S. epidermidis*-derived protein-coding sequence has been introduced and expressed. Furthermore, the polypeptides may be part of recombinant fusion proteins.

*S. epidermidis* polypeptides of the invention can be chemically synthesized using commercially automated procedures such as those referenced herein, including, without limitation exclusive solid phase synthesis, partial solid phase methods, fragment condensation or classical solution synthesis. The polypeptides are preferably prepared by solid phase peptide synthesis as described by Merrifield, 1963, *J Am. Chem. Soc.* 85:2149. The synthesis is carried out with amino acids that are protected at the alpha-amino terminus. Trifunctional amino acids with labile side-chains are also protected with suitable groups to prevent undesired chemical reactions from occurring during the assembly of the polypeptides. The alpha-amino protecting group is selectively removed to allow subsequent reaction to take place at the amino-terminus. The conditions for the removal of the alpha-amino protecting group do not remove the side-chain protecting groups.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the *S. epidermidis* protein contains an additional sequence tag that facilitates purification, such as, but not limited to, a polyhistidine sequence. The polypeptide can then be purified from a crude lysate of the host cell by chromatography on an appropriate solid-phase matrix. Alternatively, antibodies produced against a *S. epidermidis* protein or against peptides derived therefrom can be used as purification reagents. Other purification methods are possible.

The present invention also encompasses derivatives and homologues of *S. epidermidis*-encoded polypeptides. For some purposes, nucleic acid sequences encoding the peptides may be altered by substitutions, additions, or deletions that provide for functionally equivalent molecules, i.e., function-conservative variants. For example, one or more amino acid residues within the sequence can be substituted by another amino acid of similar properties, such as, for example, positively charged amino acids (arginine, lysine, and histidine); negatively charged amino acids (aspartate and glutamate); polar neutral amino acids; and non-polar amino acids.

The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds.

To identify *S. epidermidis*-derived polypeptides for use in the present invention, essentially the complete genomic sequence of a *Staphyolococcus epidermidis* isolate was analyzed. While, in very rare instances, a nucleic acid sequencing error may be revealed, resolving a rare sequencing error is well within the art, and such an occurrence will not prevent one skilled in the art from practicing the invention.

Also encompassed are any *S. epidermidis* polypeptide sequences that are contained within the open reading frames (ORFs), including complete protein-coding sequences, of which any of SEQ ID NO: 2838–SEQ ID NO: 5674 forms a part. Table 2, which is appended herewith and which forms part of the present specification, provides a putative identification of the particular function of a polypeptide which is encoded by each ORF, based on the homology match (determined by the BLAST algorithm) of the predicted polypeptide with known proteins encoded by ORFs in other organisms. As a result, one skilled in the art can use the polypeptides of the present invention for commercial and industrial purposes consistent with the type of putative identification of the polypeptide.

The present invention provides a library of *S. epidermidis*-derived polypeptide sequences, and a corresponding library of nucleic acid sequences encoding the polypeptides, wherein the polypeptides themselves, or polypeptides contained within ORFs of which they form a part, comprise sequences that are contemplated for use as components of vaccines. Non-limiting examples of such sequences are listed by SEQ ID NO in Table 2, which is appended herewith and which forms part of the present specification.

The present invention also provides a library of *S. epidermidis*-derived polypeptide sequences, and a corresponding library of nucleic acid sequences encoding the polypeptides, wherein the polypeptides themselves, or polypeptides contained within ORFs of which they form a part, comprise sequences lacking homology to any known prokaryotic or eukaryotic sequences. Such libraries provide probes, primers, and markers which can be used to diagnose S. epidermidis infection, including use as markers in epidemiological studies. Non-limiting examples of such sequences are listed by SEQ ID NO in Table 2, which is appended. The present invention also provides a library of S. epidermidis-derived polypeptide sequences, and a corresponding library of nucleic acid sequences encoding the polypeptides, wherein the polypeptides themselves, or polypeptides contained within ORFs of which they form a part, comprise targets for therapeutic drugs.

SPECIFIC EXAMPLE

Determination of Staphylococcus Protein Antigens for Antibody and Vaccine Development The selection of Staphylococcus protein antigens for vaccine development can be derived from the nucleic acids encoding S. epidermidis polypeptides. First, the ORF's can be analyzed for homology to other known exported or membrane proteins and analyzed using the discriminant analysis described by Klein, et al. (Klein, P., Kanehsia, M., and DeLisi, C. (1985) Biochimica et Biophysica Acta 815, 468–476) for predicting exported and membrane proteins.

Homology searches can be performed using the BLAST algorithm contained in the Wisconsin Sequence Analysis Package (Genetics Computer Group, University Research Park, 575 Science Drive, Madison, Wis. 53711) to compare each predicted ORF amino acid sequence with all sequences found in the current GenBank, SWISS-PROT and PIR databases. BLAST searches for local alignments between the ORF and the databank sequences and reports a probability score which indicates the probability of finding this sequence by chance in the database. ORF's with significant homology (e.g. probabilities lower than $1 \times 10^{-6}$ that the homology is only due to random chance) to membrane or exported proteins represent protein antigens for vaccine development. Possible functions can be provided to S. epidermidis genes based on sequence homology to genes cloned in other organisms.

Discriminant analysis (Klein, et al. supra) can be used to examine the ORF amino acid sequences. This algorithm uses the intrinsic information contained in the ORF amino acid sequence and compares it to information derived from the properties of known membrane and exported proteins. This comparison predicts which proteins will be exported, membrane associated or cytoplasmic. ORF amino acid sequences identified as exported or membrane associated by this algorithm are likely protein antigens for vaccine development.

Production of Fragments and Analogs of S. epidermidis Nucleic Acids and Polypeptides Based on the discovery of the S. epidermidis gene products of the invention provided in the Sequence Listing, one skilled in the art can alter the disclosed structure of S. epidermidis genes, e.g., by producing fragments or analogs, and test the newly produced structures for activity. Examples of techniques known to those skilled in the relevant art which allow the production and testing of fragments and analogs are discussed below. These, or analogous methods can be used to make and screen libraries of polypeptides, e.g., libraries of random peptides or libraries of fragments or analogs of cellular proteins for the ability to bind S. epidermidis polypeptides. Such screens are useful for the identification of inhibitors of S. epidermidis.

Generation of Fragments

Fragments of a protein can be produced in several ways, e.g., recombinantly, by proteolytic digestion, or by chemical synthesis. Internal or terminal fragments of a polypeptide can be generated by removing one or more nucleotides from one end (for a terminal fragment) or both ends (for an internal fragment) of a nucleic acid which encodes the polypeptide. Expression of the mutagenized DNA produces polypeptide fragments. Digestion with "end-nibbling" endonucleases can thus generate DNAs which encode an array of fragments. DNAs which encode fragments of a protein can also be generated by random shearing, restriction digestion or a combination of the above-discussed methods.

Fragments can also be chemically synthesized using techniques known in the art such as conventional Merrifield solid phase f-Moc or t-Boc chemistry. For example, peptides of the present invention may be arbitrarily divided into fragments of desired length with no overlap of the fragments, or divided into overlapping fragments of a desired length.

Alteration of Nucleic Acids and Polypeptides: Random Methods

Amino acid sequence variants of a protein can be prepared by random mutagenesis of DNA which encodes a protein or a particular domain or region of a protein. Useful methods include PCR mutagenesis and saturation mutagenesis. A library of random amino acid sequence variants can also be generated by the synthesis of a set of degenerate oligonucleotide sequences. (Methods for screening proteins in a library of variants are elsewhere herein).

PCR Mutagenesis

In PCR mutagenesis, reduced Taq polymerase fidelity is used to introduce random mutations into a cloned fragment of DNA (Leung et al., 1989, Technique 1:11–15). The DNA region to be mutagenized is amplified using the polymerase chain reaction (PCR) under conditions that reduce the fidelity of DNA synthesis by Taq DNA polymerase, e.g., by using a dGTP/dATP ratio of five and adding $Mn^{2+}$ to the PCR reaction. The pool of amplified DNA fragments are inserted into appropriate cloning vectors to provide random mutant libraries.

Saturation Mutagenesis

Saturation mutagenesis allows for the rapid introduction of a large number of single base substitutions into cloned DNA fragments (Mayers et al., 1985, Science 229:242). This technique includes generation of mutations, e.g., by chemical treatment or irradiation of single-stranded DNA in vitro, and synthesis of a complimentary DNA strand. The mutation frequency can be modulated by modulating the severity of the treatment, and essentially all possible base substitutions can be obtained. Because this procedure does not involve a genetic selection for mutant fragments both neutral substitutions, as well as those that alter function, are obtained. The distribution of point mutations is not biased toward conserved sequence elements.

Degenerate Oligonucleotides

A library of homologs can also be generated from a set of degenerate oligonucleotide sequences. Chemical synthesis of a degenerate sequences can be carried out in an automatic DNA synthesizer, and the synthetic genes then ligated into an appropriate expression vector. The synthesis of degenerate oligonucleotides is known in the art (see for example, Narang, SA (1983) Tetrahedron 39:3; Itakura et al. (1981) Recombinant DNA, Proc 3rd Cleveland Sympos. Macromolecules, ed. A G Walton, Amsterdam: Elsevier pp273–289; Itakura et al. (1984) Annu. Rev. Biochem. 53:323; Itakura et al. (1 984) Science 198:1056; Ike et al.

(1983) *Nucleic Acid Res.* 11:477. Such techniques have been employed in the directed evolution of other proteins (see, for example, Scott et al. (1990) *Science* 249:386–390; Roberts et al. (1992) *PNAS* 89:2429–2433; Devlin et al. (1990) *Science* 249: 404–406; Cwirla et al. (1990) *PNAS* 87: 6378–6382; as well as U.S. Pat. Nos. 5,223,409, 5,198,346, and 5,096,815).

Alteration of Nucleic Acids and Polypeptides: Methods for Directed Mutagenesis

Non-random or directed, mutagenesis techniques can be used to provide specific sequences or mutations in specific regions. These techniques can be used to create variants which include, e.g., deletions, insertions, or substitutions, of residues of the known amino acid sequence of a protein. The sites for mutation can be modified individually or in series, e.g., by (1) substituting first with conserved amino acids and then with more radical choices depending upon results achieved, (2) deleting the target residue, or (3) inserting residues of the same or a different class adjacent to the located site, or combinations of options 1–3.

Alanine Scanning Mutagenesis

Alanine scanning mutagenesis is a useful method for identification of certain residues or regions of the desired protein that are preferred locations or domains for mutagenesis, Cunningham and Wells (*Science* 244:1081–1085, 1989). In alanine scanning, a residue or group of target residues are identified (e.g., charged residues such as Arg, Asp, His, Lys, and Glu) and replaced by a neutral or negatively charged amino acid (most preferably alanine or polyalanine). Replacement of an amino acid can affect the interaction of the amino acids with the surrounding aqueous environment in or outside the cell. Those domains demonstrating functional sensitivity to the substitutions are then refined by introducing further or other variants at or for the sites of substitution. Thus, while the site for introducing an amino acid sequence variation is predetermined, the nature of the mutation per se need not be predetermined. For example, to optimize the performance of a mutation at a given site, alanine scanning or random mutagenesis may be conducted at the target codon or region and the expressed desired protein subunit variants are screened for the optimal combination of desired activity.

Oligonucleotide-Mediated Mutagenesis

Oligonucleotide-mediated mutagenesis is a useful method for preparing substitution, deletion, and insertion variants of DNA, see, e.g., Adelman et al., (*DNA* 2:183, 1983). Briefly, the desired DNA is altered by hybridizing an oligonucleotide encoding a mutation to a DNA template, where the template is the single-stranded form of a plasmid or bacteriophage containing the unaltered or native DNA sequence of the desired protein. After hybridization, a DNA polymerase is used to synthesize an entire second complementary strand of the template that will thus incorporate the oligonucleotide primer, and will code for the selected alteration in the desired protein DNA. Generally, oligonucleotides of at least 25 nucleotides in length are used. An optimal oligonucleotide will have 12 to 15 nucleotides that are completely complementary to the template on either side of the nucleotide(s) coding for the mutation. This ensures that the oligonucleotide will hybridize properly to the single-stranded DNA template molecule. The oligonucleotides are readily synthesized using techniques known in the art such as that described by Crea et al. (*Proc. Natl. Acad. Sci. USA*, 75: 5765[1978]).

Cassette Mutagenesis

Another method for preparing variants, cassette mutagenesis, is based on the technique described by Wells et al. (*Gene,* 34:315–[1985]). The starting material is a plasmid (or other vector) which includes the protein subunit DNA to be mutated. The codon(s) in the protein subunit DNA to be mutated are identified. There must be a unique restriction endonuclease site on each side of the identified mutation site(s). If no such restriction sites exist, they may be generated using the above-described oligonucleotide-mediated mutagenesis method to introduce them at appropriate locations in the desired protein subunit DNA. After the restriction sites have been introduced into the plasmid, the plasmid is cut at these sites to linearize it. A double-stranded oligonucleotide encoding the sequence of the DNA between the restriction sites but containing the desired mutation(s) is synthesized using standard procedures. The two strands are synthesized separately and then hybridized together using standard techniques. This double-stranded oligonucleotide is referred to as the cassette. This cassette is designed to have 3' and 5' ends that are comparable with the ends of the linearized plasmid, such that it can be directly ligated to the plasmid. This plasmid now contains the mutated desired protein subunit DNA sequence.

Combinatorial Mutagenesis

Combinatorial mutagenesis can also be used to generate mutants (Ladner et al., WO 88/06630). In this method, the amino acid sequences for a group of homologs or other related proteins are aligned, preferably to promote the highest homology possible. All of the amino acids which appear at a given position of the aligned sequences can be selected to create a degenerate set of combinatorial sequences. The variegated library of variants is generated by combinatorial mutagenesis at the nucleic acid level, and is encoded by a variegated gene library. For example, a mixture of synthetic oligonucleotides can be enzymatically ligated into gene sequences such that the degenerate set of potential sequences are expressible as individual peptides, or alternatively, as a set of larger fusion proteins containing the set of degenerate sequences.

Other Modifications of *S. epidermidis* Nucleic Acids and Polypeptides

It is possible to modify the structure of a *S. epidermidis* polypeptide for such purposes as increasing solubility, enhancing stability (e.g., shelf life ex vivo and resistance to proteolytic degradation in vivo). A modified *S. epidermidis* protein or peptide can be produced in which the amino acid sequence has been altered, such as by amino acid substitution, deletion, or addition as described herein.

An *S. epidermidis* peptide can also be modified by substitution of cysteine residues preferably with alanine, serine, threonine, leucine or glutamic acid residues to minimize dimerization via disulfide linkages. In addition, amino acid side chains of fragments of the protein of the invention can be chemically modified. Another modification is cyclization of the peptide.

In order to enhance stability and/or reactivity, a *S. epidermidis* polypeptide can be modified to incorporate one or more polymorphisms in the amino acid sequence of the protein resulting from any natural allelic variation. Additionally, D-amino acids, non-natural amino acids, or non-amino acid analogs can be substituted or added to produce a modified protein within the scope of this invention. Furthermore, an *S. epidermidis* polypeptide can be modified using polyethylene glycol (PEG) according to the method of A. Sehon and co-workers (Wie et al., supra) to produce a protein conjugated with PEG. In addition, PEG can be added during chemical synthesis of the protein. Other modifications of *S. epidermidis* proteins include reduction/alkylation (Tarr, *Methods of Protein Microcharacterization,*

J. E. Silver ed., Humana Press, Clifton N.J. 155–194 (1986)); acylation (Tarr, supra); chemical coupling to an appropriate carrier (Mishell and Shiigi, eds, *Selected Methods in Cellular Immunology*, W H Freeman, San Francisco, Calif. (1980), U.S. Pat. No. 4,939,239; or mild formalin treatment (Marsh, (1971) *Int. Arch. of Allergy and Appl Immunol.*, 41: 199–215).

To facilitate purification and potentially increase solubility of a *S. epidermidis* protein or peptide, it is possible to add an amino acid fusion moiety to the peptide backbone. For example, hexa-histidine can be added to the protein for purification by immobilized metal ion affinity chromatography (Hochuli, E. et al., (1988) *Bio/Technology*, 6: 1321–1325). In addition, to facilitate isolation of peptides free of irrelevant sequences, specific endoprotease cleavage sites can be introduced between the sequences of the fusion moiety and the peptide.

To potentially aid proper antigen processing of epitopes within an *S. epidermidis* polypeptide, canonical protease sensitive sites can be engineered between regions, each comprising at least one epitope via recombinant or synthetic methods. For example, charged amino acid pairs, such as KK or RR, can be introduced between regions within a protein or fragment during recombinant construction thereof. The resulting peptide can be rendered sensitive to cleavage by cathepsin and/or other trypsin-like enzymes which would generate portions of the protein containing one or more epitopes. In addition, such charged amino acid residues can result in an increase in the solubility of the peptide.

Primary Methods for Screening Polypeptides and Analogs

Various techniques are known in the art for screening generated mutant gene products. Techniques for screening large gene libraries often include cloning the gene library into replicable expression vectors, transforming appropriate cells with the resulting library of vectors, and expressing the genes under conditions in which detection of a desired activity, e.g., in this case, binding to *S. epidermidis* polypeptide or an interacting protein, facilitates relatively easy isolation of the vector encoding the gene whose product was detected. Each of the techniques described below is amenable to high through-put analysis for screening large numbers of sequences created, e.g., by random mutagenesis techniques.

Two Hybrid Systems

Two hybrid assays such as the system described below (as with the other screening methods described herein), can be used to identify polypeptides, e.g., fragments or analogs of a naturally-occurring *S. epidermidis* polypeptide, e.g., of cellular proteins, or of randomly generated polypeptides which bind to an *S. epidermidis* protein. (The *S. epidermidis* domain is used as the bait protein and the library of variants are expressed as prey fusion proteins.) In an analogous fashion, a two hybrid assay (as with the other screening methods described herein), can be used to find polypeptides which bind a *S. epidermidis* polypeptide.

Display Libraries

In one approach to screening assays, the Staphylococcus peptides are displayed on the surface of a cell or viral particle, and the ability of particular cells or viral particles to bind an appropriate receptor protein via the displayed product is detected in a "panning assay". For example, the gene library can be cloned into the gene for a surface membrane protein of a bacterial cell, and the resulting fusion protein detected by panning (Ladner et al., WO 88/06630; Fuchs et al. (1991) *Bio/Technology* 9:1370–1371; and Goward et al. (1992) *TIBS* 18:136–140). In a similar fashion, a detectably labeled ligand can be used to score for potentially functional peptide homologs. Fluorescently labeled ligands, e.g., receptors, can be used to detect homologs which retain ligand-binding activity. The use of fluorescently labeled ligands, allows cells to be visually inspected and separated under a fluorescence microscope, or, where the morphology of the cell permits, to be separated by a fluorescence-activated cell sorter.

A gene library can be expressed as a fusion protein on the surface of a viral particle. For instance, in the filamentous phage system, foreign peptide sequences can be expressed on the surface of infectious phage, thereby conferring two significant benefits. First, since these phage can be applied to affinity matrices at concentrations well over $10^{13}$ phage per milliliter, a large number of phage can be screened at one time. Second, since each infectious phage displays a gene product on its surface, if a particular phage is recovered from an affinity matrix in low yield, the phage can be amplified by another round of infection. The group of almost identical *E. coli* filamentous phages, M13, fd., and f1, are most often used in phage display libraries. Either of the phage gIII or gVIII coat proteins can be used to generate fusion proteins without disrupting the ultimate packaging of the viral particle. Foreign epitopes can be expressed at the $NH_2$-terminal end of pIII and phage bearing such epitopes recovered from a large excess of phage lacking this epitope (Ladner et al. PCT publication WO 90/02909; Garrard et al., PCT publication WO 92/09690; Marks et al. (1992) *J. Biol. Chem.* 267:16007–16010; Griffiths et al. (1993) *EMBO J* 12:725–734; Clackson et al. (1991) *Nature* 352:624–628; and Barbas et al. (1992) *PNAS* 89:4457–4461).

A common approach uses the maltose receptor of *E. coli* (the outer membrane protein, LamB) as a peptide fusion partner (Charbit et al. (1986) *EMBO* 5, 3029–3037). Oligonucleotides have been inserted into plasmids encoding the LamB gene to produce peptides fused into one of the extracellular loops of the protein. These peptides are available for binding to ligands, e.g., to antibodies, and can elicit an immune response when the cells are administered to animals. Other cell surface proteins, e.g., OmpA (Schorr et al. (1991) *Vaccines* 91, pp. 387–392), PhoE (Agterberg, et al. (1990) *Gene* 88, 37–45), and PAL (Fuchs et al. (1991) *Bio/Tech* 9, 1369–1372), as well as large bacterial surface structures have served as vehicles for peptide display. Peptides can be fused to pilin, a protein which polymerizes to form the pilus-a conduit for interbacterial exchange of genetic information (Thiry et al. (1989) *Appl. Environ. Microbiol.* 55, 984–993). Because of its role in interacting with other cells, the pilus provides a useful support for the presentation of peptides to the extracellular environment. Another large surface structure used for peptide display is the bacterial motive organ, the flagellum. Fusion of peptides to the subunit protein flagellin offers a dense array of many peptide copies on the host cells (Kuwajima et al. (1988) *Bio/Tech.* 6, 1080–1083). Surface proteins of other bacterial species have also served as peptide fusion partners. Examples include the Staphylococcus protein A and the outer membrane IgA protease of Neisseria (Hansson et al. (1992) *J. Bacteriol.* 174, 4239–4245 and Klauser et al. (1990) *EMBO J.* 9, 1991–1999).

In the filamentous phage systems and the LamB system described above, the physical link between the peptide and its encoding DNA occurs by the containment of the DNA within a particle (cell or phage) that carries the peptide on its surface. Capturing the peptide captures the particle and the DNA within. An alternative scheme uses the DNA-binding protein LacI to form a link between peptide and DNA (Cull et al. (1992) *PNAS USA* 89:1865–1869). This system uses a plasmid containing the LacI gene with an oligonucleotide cloning site at its 3'-end. Under the controlled induction by arabinose, a LacI-peptide fusion protein is produced. This fusion retains the natural ability of LacI to bind to a short DNA sequence known as LacO operator (LacO). By installing two copies of LacO on the expression plasmid, the LacI-peptide fusion binds tightly to the plasmid that encoded it. Because the plasmids in each cell contain only a single oligonucleotide sequence and each cell expresses only a single peptide sequence, the peptides become specifically and stably associated with the DNA sequence that directed its synthesis. The cells of the library are gently lysed and the peptide-DNA complexes are exposed to a matrix of immobilized receptor to recover the complexes containing active peptides. The associated plasmid DNA is then reintroduced into cells for amplification and DNA sequencing to determine the identity of the peptide ligands. As a demonstration of the practical utility of the method, a large random library of dodecapeptides was made and selected on a monoclonal antibody raised against the opioid peptide dynorphin B. A cohort of peptides was recovered, all related by a consensus sequence corresponding to a six-residue portion of dynorphin B. (Cull et al. (1992) *Proc. Natl. Acad Sci. USA.* 89–1869).

This scheme, sometimes referred to as peptides-on-plasmids, differs in two important ways from the phage display methods. First, the peptides are attached to the C-terminus of the fusion protein, resulting in the display of the library members as peptides having free carboxy termini. Both of the filamentous phage coat proteins, pIII and pVIII, are anchored to the phage through their C-termini, and the guest peptides are placed into the outward-extending N-terminal domains. In some designs, the phage-displayed peptides are presented right at the amino terminus of the fusion protein. (Cwirla, et al. (1990) *Proc. Natl. Acad Sci. U.S.A.* 87, 6378–6382) A second difference is the set of biological biases affecting the population of peptides actually present in the libraries. The LacI fusion molecules are confined to the cytoplasm of the host cells. The phage coat fusions are exposed briefly to the cytoplasm during translation but are rapidly secreted through the inner membrane into the periplasmic compartment, remaining anchored in the membrane by their C-terminal hydrophobic domains, with the N-termini, containing the peptides, protruding into the periplasm while awaiting assembly into phage particles. The peptides in the LacI and phage libraries may differ significantly as a result of their exposure to different proteolytic activities. The phage coat proteins require transport across the inner membrane and signal peptidase processing as a prelude to incorporation into phage. Certain peptides exert a deleterious effect on these processes and are underrepresented in the libraries (Gallop et al. (1994) *J. Med Chem.* 37(9):1233–1251). These particular biases are not a factor in the LacI display system.

The number of small peptides available in recombinant random libraries is enormous. Libraries of $10^7$–$10^9$ independent clones are routinely prepared. Libraries as large as $10^{11}$ recombinants have been created, but this size approaches the practical limit for clone libraries. This limitation in library size occurs at the step of transforming the DNA containing randomized segments into the host bacterial cells. To circumvent this limitation, an in vitro system based on the display of nascent peptides in polysome complexes has recently been developed. This display library method has the potential of producing libraries 3–6 orders of magnitude larger than the currently available phage/ phagemid or plasmid libraries. Furthermore, the construction of the libraries, expression of the peptides, and screening, is done in an entirely cell-free format.

In one application of this method (Gallop et al. (1994) *J. Med. Chem.* 37(9):1233–1251), a molecular DNA library encoding $10^{12}$ decapeptides was constructed and the library expressed in an *E. coli* S30 in vitro coupled transcription/translation system. Conditions were chosen to stall the ribosomes on the mRNA, causing the accumulation of a substantial proportion of the RNA in polysomes and yielding complexes containing nascent peptides still linked to their encoding RNA. The polysomes are sufficiently robust to be affinity purified on immobilized receptors in much the same way as the more conventional recombinant peptide display libraries are screened. RNA from the bound complexes is recovered, converted to cDNA, and amplified by PCR to produce a template for the next round of synthesis and screening. The polysome display method can be coupled to the phage display system. Following several rounds of screening, cDNA from the enriched pool of polysomes was cloned into a phagemid vector. This vector serves as both a peptide expression vector, displaying peptides fused to the coat proteins, and as a DNA sequencing vector for peptide identification. By expressing the polysome-derived peptides on phage, one can either continue the affinity selection procedure in this format or assay the peptides on individual clones for binding activity in a phage ELISA, or for binding specificity in a completion phage ELISA (Barret, et al. (1992) *Anal. Biochem.* 204,357–364). To identify the sequences of the active peptides one sequences the DNA produced by the phagemid host.

Secondary Screening of Polypeptides and Analogs

The high through-put assays described above can be followed by secondary screens in order to identify further biological activities which will, e.g., allow one skilled in the art to differentiate agonists from antagonists. The type of a secondary screen used will depend on the desired activity that needs to be tested. For example, an assay can be developed in which the ability to inhibit an interaction between a protein of interest and its respective ligand can be used to identify antagonists from a group of peptide fragments isolated though one of the primary screens described above.

Therefore, methods for generating fragments and analogs and testing them for activity are known in the art. Once the core sequence of interest is identified, it is routine for one skilled in the art to obtain analogs and fragments.

Peptide Mimetics of *S. epidermidis* Polypeptides

The invention also provides for reduction of the protein binding domains of the subject *S. epidermidis* polypeptides to generate mimetics, e.g. peptide or non-peptide agents. The peptide mimetics are able to disrupt binding of a polypeptide to its counter ligand, e.g., in the case of a *S. epidermidis* polypeptide binding to a naturally occurring ligand. The critical residues of a subject *S. epidermidis* polypeptide which are involved in molecular recognition of a polypeptide can be determined and used to generate *S. epidermidis*-derived peptidomimetics which competitively or noncompetitively inhibit binding of the *S. epidermidis* polypeptide with an interacting polypeptide (see, for example, European patent applications EP-412,762A and EP-B31,080A).

For example, scanning mutagenesis can be used to map the amino acid residues of a particular *S. epidermidis* polypeptide involved in binding an interacting polypeptide, peptidomimetic compounds (e.g. diazepine or isoquinoline derivatives) can be generated which mimic those residues in binding to an interacting polypeptide, and which therefore can inhibit binding of a *S. epidermidis* polypeptide to an interacting polypeptide and thereby interfere with the function of *S. epidermidis* polypeptide. For instance, non-hydrolyzable peptide analogs of such residues can be generated using benzodiazepine (e.g., see Freidinger et al. in *Peptides. Chemistry and Biology*, G. R. Marshall ed., ESCOM Publisher: Leiden, Netherlands, 1988), azepine (e.g., see Huffman et al. in *Peptides: Chemistry and Biology*, G. R. Marshall ed., ESCOM Publisher: Leiden, Netherlands, 1988), substituted gama lactam rings (Garvey et al. in *Peptides: Chemistry and Biology*, G. R. Marshall ed., ESCOM Publisher: Leiden, Netherlands, 1988), keto-methylene pseudopeptides (Ewenson et al. (1986) *J Med Chem* 29:295; and Ewenson et al. in *Peptides: Structure and Function* (Proceedings of the 9th American Peptide Symposium) Pierce Chemical Co. Rockland, Ill., 1985), b-turn dipeptide cores (Nagai et al. (1985) *Tetrahedron Lett* 26:647; and Sato et al. (1986) *J Chem Soc Perkin Trans* 1:1231), and b-aminoalcohols (Gordon et al. (1985) *Biochem Biophys Res Commun* 126:419; and et al. (1986) *Biochem Biophys Res Commun* 134:71).

Vaccine Formulations for *S. epidermidis* Nucleic Acids and Polypeptides

This invention also features vaccine compositions for protection against infection by *S. epidermidis* or for treatment of *S. epidermidis* infection, a gram-positive spiral bacterium. In one embodiment, the vaccine compositions contain one or more immunogenic components such as a surface protein from *S. epidermidis*, or portion thereof, and a pharmaceutically acceptable carrier. Nucleic acids within the scope of the invention are exemplified by the nucleic acids of the invention contained in the Sequence Listing which encode *S. epidermidis* surface proteins. Any nucleic acid encoding an immunogenic *S. epidermidis* protein, or portion thereof, which is capable of expression in a cell, can be used in the present invention. These vaccines have therapeutic and prophylactic utilities.

One aspect of the invention provides a vaccine composition for protection against infection by *S. epidermidis* which contains at least one immunogenic fragment of an *S. epidermidis* protein and a pharmaceutically acceptable carrier. Preferred fragments include peptides of at least about 10 amino acid residues in length, preferably about 10–20 amino acid residues in length, and more preferably about 12–16 amino acid residues in length.

Immunogenic components of the invention can be obtained, for example, by screening polypeptides recombinantly produced from the corresponding fragment of the nucleic acid encoding the full-length *S. epidermidis* protein. In addition, fragments can be chemically synthesized using techniques known in the art such as conventional Merrifield solid phase f-Moc or t-Boc chemistry.

In one embodiment, immunogenic components are identified by the ability of the peptide to stimulate T cells. Peptides which stimulate T cells, as determined by, for example, T cell proliferation or cytokine secretion are defined herein as comprising at least one T cell epitope. T cell epitopes are believed to be involved in initiation and perpetuation of the immune response to the protein allergen which is responsible for the clinical symptoms of allergy. These T cell epitopes are thought to trigger early events at the level of the T helper cell by binding to an appropriate HLA molecule on the surface of an antigen presenting cell, thereby stimulating the T cell subpopulation with the relevant T cell receptor for the epitope. These events lead to T cell proliferation, lymphokine secretion, local inflammatory reactions, recruitment of additional immune cells to the site of antigen/T cell interaction, and activation of the B cell cascade, leading to the production of antibodies. A T cell epitope is the basic element, or smallest unit of recognition by a T cell receptor, where the epitope comprises amino acids essential to receptor recognition (e.g., approximately 6 or 7 amino acid residues). Amino acid sequences which mimic those of the T cell epitopes are within the scope of this invention.

Screening immunogenic components can be accomplished using one or more of several different assays. For example, in vitro, peptide T cell stimulatory activity is assayed by contacting a peptide known or suspected of being immunogenic with an antigen presenting cell which presents appropriate MHC molecules in a T cell culture. Presentation of an immunogenic *S. epidermidis* peptide in association with appropriate MHC molecules to T cells in conjunction with the necessary co-stimulation has the effect of transmitting a signal to the T cell that induces the production of increased levels of cytokines, particularly of interleukin-2 and interleukin-4. The culture supernatant can be obtained and assayed for interleukin-2 or other known cytokines. For example, any one of several conventional assays for interleukin-2 can be employed, such as the assay described in *Proc. Natl. Acad. Sci USA,* 86: 1333 (1989) the pertinent portions of which are incorporated herein by reference. A kit for an assay for the production of interferon is also available from Genzyme Corporation (Cambridge, Mass.).

Alternatively, a common assay for T cell proliferation entails measuring tritiated thymidine incorporation. The proliferation of T cells can be measured in vitro by determining the amount of $^3$H-labeled thymidine incorporated into the replicating DNA of cultured cells. Therefore, the rate of DNA synthesis and, in turn, the rate of cell division can be quantified.

Vaccine compositions of the invention containing immunogenic components (e.g., *S. epidermidis* polypeptide or fragment thereof or nucleic acid encoding an *S. epidermidis* polypeptide or fragment thereof) preferably include a pharmaceutically acceptable carrier. The term "pharmaceutically acceptable carrier" refers to a carrier that does not cause an allergic reaction or other untoward effect in patients to whom it is administered. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise minor amounts of auxiliary substances such as wetting or emulsifying agents, preservatives or buffers, which enhance the shelf life or effectiveness of the antibody. For vaccines of the invention containing *S. epidermidis* polypeptides, the polypeptide is co-administered with a suitable adjuvant.

It will be apparent to those of skill in the art that the therapeutically effective amount of DNA or protein of this invention will depend, inter alia, upon the administration schedule, the unit dose of antibody administered, whether the protein or DNA is administered in combination with other therapeutic agents, the immune status and health of the patient, and the therapeutic activity of the particular protein or DNA.

Vaccine compositions are conventionally administered parenterally, e.g., by injection, either subcutaneously or intramuscularly. Methods for intramuscular immunization are described by Wolff et al. (1990) *Science* 247: 1465–1468 and by Sedegah et al. (1994) *Immunology* 91: 9866–9870. Other modes of administration include oral and pulmonary formulations, suppositories, and transdermal applications.

Oral immunization is preferred over parenteral methods for inducing protection against infection by S. epidermidis. Cain et. al. (1993) Vaccine 11: 637–642. Oral formulations include such normally employed excipients as, for example, pharmaceutical grades of mannitol, lactose, starch, magnesium stearate, sodium saccharine, cellulose, magnesium carbonate, and the like.

The vaccine compositions of the invention can include an adjuvant, including, but not limited to aluminum hydroxide; N-acetyl-muramyl--L-threonyl-D-isoglutamine (thr-MDP); N-acetyl-nor-muramyl-L-alanyl-D-isoglutamine (CGP 11637, referred to as nor-MDP); N-acetylmuramyl-L-alanyl-D-isoglutaminyl-L-alanine-2-(1'-2'-dipalmitoyl-sn-glycero-3-hydroxyphos-phoryloxy)-ethylamine (CGP 19835A, referred to a MTP-PE); RIBI, which contains three components from bacteria; monophosphoryl lipid A; trehalose dimycoloate; cell wall skeleton (MPL+TDM+CWS) in a 2% squalene/Tween 80 emulsion; and cholera toxin. Others which may be used are non-toxic derivatives of cholera toxin, including its B subunit, and/or conjugates or genetically engineered fusions of the S. epidermidis polypeptide with cholera toxin or its B subunit, procholeragenoid, fungal polysaccharides, including schizophyllan, muramyl dipeptide, muramyl dipeptide derivatives, phorbol esters, labile toxin of E. coli, non-S. epidermidis bacterial lysates, block polymers or saponins.

Other suitable delivery methods include biodegradable microcapsules or immuno-stimulating complexes (ISCOMs), cochleates, or liposomes, genetically engineered attenuated live vectors such as viruses or bacteria, and recombinant (chimeric) virus-like particles, e.g., bluetongue. The amount of adjuvant employed will depend on the type of adjuvant used. For example, when the mucosal adjuvant is cholera toxin, it is suitably used in an amount of 5 mg to 50 mg, for example 10 mg to 35 mg. When used in the form of microcapsules, the amount used will depend on the amount employed in the matrix of the microcapsule to achieve the desired dosage. The determination of this amount is within the skill of a person of ordinary skill in the art.

Carrier systems in humans may include enteric release capsules protecting the antigen from the acidic environment of the stomach, and including S. epidermidis polypeptide in an insoluble form as fusion proteins. Suitable carriers for the vaccines of the invention are enteric coated capsules and polylactide-glycolide microspheres. Suitable diluents are 0.2 N NaHCO3 and/or saline.

Vaccines of the invention can be administered as a primary prophylactic agent in adults or in children, as a secondary prevention, after successful eradication of S. epidermidis in an infected host, or as a therapeutic agent in the aim to induce an immune response in a susceptible host to prevent infection by S. epidermidis. The vaccines of the invention are administered in amounts readily determined by persons of ordinary skill in the art. Thus, for adults a suitable dosage will be in the range of 10 mg to 10 g, preferably 10 mg to 100 mg. A suitable dosage for adults will also be in the range of 5 mg to 500 mg. Similar dosage ranges will be applicable for children. Those skilled in the art will recognize that the optimal dose may be more or less depending upon the patient's body weight, disease, the route of administration, and other factors. Those skilled in the art will also recognize that appropriate dosage levels can be obtained based on results with known oral vaccines such as, for example, a vaccine based on an E. coli lysate (6 mg dose daily up to total of 540 mg) and with an enterotoxigenic E. coli purified antigen (4 doses of 1 mg) (Schulman et al., J. Urol. 150:917–921 (1993); Boedecker et al., American Gastroenterological Assoc. 999:A-222 (1993)). The number of doses will depend upon the disease, the formulation, and efficacy data from clinical trials. Without intending any limitation as to the course of treatment, the treatment can be administered over 3 to 8 doses for a primary immunization schedule over 1 month (Boedeker, American Gastroenterological Assoc. 888:A-222 (1993)).

In a preferred embodiment, a vaccine composition of the invention can be based on a killed whole E. coli preparation with an immunogenic fragment of a S. epidermidis protein of the invention expressed on its surface or it can be based on an E. coli lysate, wherein the killed E. coli acts as a carrier or an adjuvant.

It will be apparent to those skilled in the art that some of the vaccine compositions of the invention are useful only for preventing S. epidermidis infection, some are useful only for treating S. epidermidis infection, and some are useful for both preventing and treating S. epidermidis infection. In a preferred embodiment, the vaccine composition of the invention provides protection against S. epidermidis infection by stimulating humoral and/or cell-mediated immunity against S. epidermidis. It should be understood that amelioration of any of the symptoms of S. epidermidis infection is a desirable clinical goal, including a lessening of the dosage of medication used to treat S. epidermidis-caused disease, or an increase in the production of antibodies in the serum or mucous of patients.

Antibodies Reactive With S. epidermidis Polypeptides

The invention also includes antibodies specifically reactive with the subject S. epidermidis polypeptide. Anti-protein/anti-peptide antisera or monoclonal antibodies can be made by standard protocols (See, for example, Antibodies: A Laboratory Manual ed. by Harlow and Lane (Cold Spring Harbor Press: 1988)). A mammal such as a mouse, a hamster or rabbit can be immunized with an immunogenic form of the peptide. Techniques for conferring immunogenicity on a protein or peptide include conjugation to carriers or other techniques well known in the art. An immunogenic portion of the subject S. epidermidis polypeptide can be administered in the presence of adjuvant. The progress of immunization can be monitored by detection of antibody titers in plasma or serum. Standard ELISA or other immunoassays can be used with the immunogen as antigen to assess the levels of antibodies.

In a preferred embodiment, the subject antibodies are immunospecific for antigenic determinants of the S. epidermidis polypeptides of the invention, e.g. antigenic determinants of a polypeptide of the invention contained in the Sequence Listing, or a closely related human or non-human mammalian homolog (e.g., 90% homologous, more preferably at least 95% homologous). In yet a further preferred embodiment of the invention, the anti-S. epidermidis antibodies do not substantially cross react (i.e., react specifically) with a protein which is for example, less than 80% percent homologous to a sequence of the invention contained in the Sequence Listing. By "not substantially cross react", it is meant that the antibody has a binding affinity for a non-homologous protein which is less than 10 percent, more preferably less than 5 percent, and even more preferably less than 1 percent, of the binding affinity for a protein of the invention contained in the Sequence Listing. In a most preferred embodiment, there is no cross-reactivity between bacterial and mammalian antigens.

The term antibody as used herein is intended to include fragments thereof which are also specifically reactive with S. epidermidis polypeptides. Antibodies can be fragmented using conventional techniques and the fragments screened for utility in the same manner as described above for whole antibodies. For example, F(ab')$_2$ fragments can be generated by treating antibody with pepsin. The resulting F(ab')$_2$ fragment can be treated to reduce disulfide bridges to produce Fab' fragments. The antibody of the invention is further intended to include bispecific and chimeric molecules having an anti-*S. epidermidis* portion.

Both monoclonal and polyclonal antibodies (Ab) directed against *S. epidermidis* polypeptides or *S. epidermidis* polypeptide variants, and antibody fragments such as Fab' and F(ab')$_2$, can be used to block the action of *S. epidermidis* polypeptide and allow the study of the role of a particular *S. epidermidis* polypeptide of the invention in aberrant or unwanted intracellular signaling, as well as the normal cellular function of the *S. epidermidis* and by microinjection of anti-*S. epidermidis* polypeptide antibodies of the present invention.

Antibodies which specifically bind *S. epidermidis* epitopes can also be used in immunohistochemical staining of tissue samples in order to evaluate the abundance and pattern of expression of *S. epidermidis* antigens. Anti-*S. epidermidis* polypeptide antibodies can be used diagnostically in immuno-precipitation and immuno-blotting to detect and evaluate *S. epidermidis* levels in tissue or bodily fluid as part of a clinical testing procedure. Likewise, the ability to monitor *S. epidermidis* polypeptide levels in an individual can allow determination of the efficacy of a given treatment regimen for an individual afflicted with such a disorder. The level of a *S. epidermidis* polypeptide can be measured in cells found in bodily fluid, such as in urine samples or can be measured in tissue, such as produced by gastric biopsy. Diagnostic assays using anti-*S. epidermidis* antibodies can include, for example, immunoassays designed to aid in early diagnosis of *S. epidermidis* infections. The present invention can also be used as a method of detecting antibodies contained in samples from individuals infected by this bacterium using specific *S. epidermidis* antigens.

Another application of anti-*S. epidermidis* polypeptide antibodies of the invention is in the immunological screening of cDNA libraries constructed in expression vectors such as λgt11, λgt18–23, λZAP, and λORF8. Messenger libraries of this type, having coding sequences inserted in the correct reading frame and orientation, can produce fusion proteins. For instance, λgt11 will produce fusion proteins whose amino termini consist of β-galactosidase amino acid sequences and whose carboxy termini consist of a foreign polypeptide. Antigenic epitopes of a subject *S. epidermidis* polypeptide can then be detected with antibodies, as, for example, reacting nitrocellulose filters lifted from infected plates with anti-*S. epidermidis* polypeptide antibodies. Phage, scored by this assay, can then be isolated from the infected plate. Thus, the presence of *S. epidermidis* gene homologs can be detected and cloned from other species, and alternate isoforms (including splicing variants) can be detected and cloned.

Kits Containing Nucleic Acids, Polypeptides or Antibodies of the Invention

The nucleic acid, polypeptides and antibodies of the invention can be combined with other reagents and articles to form kits. Kits for diagnostic purposes typically comprise the nucleic acid, polypeptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose. Kits further can include instructions for use.

Drug Screening Assays Using *S. epidermidis* Polypeptides

By making available purified and recombinant *S. epidermidis* polypeptides, the present invention provides assays which can be used to screen for drugs which are either agonists or antagonists of the normal cellular function, in this case, of the subject *S. epidermidis* polypeptides, or of their role in intracellular signaling. Such inhibitors or potentiators may be useful as new therapeutic agents to combat *S. epidermidis* infections in humans. A variety of assay formats will suffice and, in light of the present inventions, will be comprehended by the person skilled in the art.

In many drug screening programs which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or change in enzymatic properties of the molecular target. Accordingly, in an exemplary screening assay of the present invention, the compound of interest is contacted with an isolated and purified *S. epidermidis* polypeptide.

Screening assays can be constructed in vitro with a purified *S. epidermidis* polypeptide or fragment thereof, such as a *S. epidermidis* polypeptide having enzymatic activity, such that the activity of the polypeptide produces a detectable reaction product. The efficacy of the compound can be assessed by generating dose response curves from data obtained using various concentrations of the test compound. Moreover, a control assay can also be performed to provide a baseline for comparison. Suitable products include those with distinctive absorption, fluorescence, or chemiluminescence properties, for example, because detection may be easily automated. A variety of synthetic or naturally occurring compounds can be tested in the assay to identify those which inhibit or potentiate the activity of the *S. epidermidis* polypeptide. Some of these active compounds may directly, or with chemical alterations to promote membrane permeability or solubility, also inhibit or potentiate the same activity (e.g., enzymatic activity) in whole, live *S. epidermidis* cells.

Overexpression Assays

Overexpression assays are based on the premise that overproduction of a protein would lead to a higher level of resistance to compounds that selectively interfere with the function of that protein. Overexpression assays may be used to identify compounds that interfere with the function of virtually any type of protein, including without limitation enzymes, receptors, DNA- or RNA-binding proteins, or any proteins that are directly or indirectly involved in regulating cell growth.

Typically, two bacterial strains are constructed. One contains a single copy of the gene of interest, and a second contains several copies of the same gene. Identification of useful inhibitory compounds of this type of assay is based on a comparison of the activity of a test compound in inhibiting growth and/or viability of the two strains. The method involves constructing a nucleic acid vector that directs high level expression of a particular target nucleic acid. The vectors are then transformed into host cells in single or multiple copies to produce strains that express low to moderate and high levels of protein encoding by the target sequence (strain A and B, respectively). Nucleic acid comprising sequences encoding the target gene can, of course, be directly integrated into the host cell.

Large numbers of compounds (or crude substances which may contain active compounds) are screened for their effect on the growth of the two strains. Agents which interfere with an unrelated target equally inhibit the growth of both strains. Agents which interfere with the function of the target at high concentration should inhibit the growth of both strains. It should be possible, however, to titrate out the inhibitory effect of the compound in the overexpressing strain. That is, if the compound is affecting the particular target that is being tested, it should be possible to inhibit the growth of strain A at a concentration of the compound that allows strain B to grow.

Alternatively, a bacterial strain is constructed that contains the gene of interest under the control of an inducible promoter. Identification of useful inhibitory agents using this type of assay is based on a comparison of the activity of a test compound in inhibiting growth and/or viability of this strain under both inducing and non-inducing conditions. The method involves constructing a nucleic acid vector that directs high-level expression of a particular target nucleic acid. The vector is then transformed into host cells that are grown under both non-inducing and inducing conditions (conditions A and B, respectively).

Large numbers of compounds (or crude substances which may contain active compounds) are screened for their effect on growth under these two conditions. Agents that interfere with the function of the target should inhibit growth under both conditions. It should be possible, however, to titrate out the inhibitory effect of the compound in the overexpressing strain. That is, if the compound is affecting the particular target that is being tested, it should be possible to inhibit growth under condition A at a concentration that allows the strain to grow under condition B.

Ligand-binding Assays

Many of the targets according to the invention have functions that have not yet been identified. Ligand-binding assays are useful to identify inhibitor compounds that interfere with the function of a particular target, even when that function is unknown. These assays are designed to detect binding of test compounds to particular targets. The detection may involve direct measurement of binding. Alternatively, indirect indications of binding may involve stabilization of protein structure or disruption of a biological function. Non-limiting examples of useful ligand-binding assays are detailed below.

A useful method for the detection and isolation of binding proteins is the Biomolecular Interaction Assay (BIAcore) system developed by Pharmacia Biosensor and described in the manufacturer's protocol (LKB Pharmacia, Sweden). The BIAcore system uses an affinity purified anti-GST antibody to immobilize GST-fusion proteins onto a sensor chip. The sensor utilizes surface plasmon resonance which is an optical phenomenon that detects changes in refractive indices. In accordance with the practice of the invention, a protein of interest is coated onto a chip and test compounds are passed over the chip. Binding is detected by a change in the refractive index (surface plasmon resonance).

A different type of ligand-binding assay involves scintillation proximity assays (SPA, described in U.S. Pat. No. 4,568,649).

Another type of ligand binding assay, also undergoing development, is based on the fact that proteins containing mitochondrial targeting signals are imported into isolated mitochondria in vitro (Hurt et al., 1985, *Embo J.* 4:2061–2068; Eilers and Schatz, *Nature,* 1986, 322:228–231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

Another ligand-binding assay is the yeast two-hybrid system (Fields and Song, 1989, *Nature* 340:245–246). The yeast two-hybrid system takes advantage of the properties of the GAL4 protein of the yeast *Saccharomyces cerevisiae.* The GAL4 protein is a transcriptional activator required for the expression of genes encoding enzymes of galactose utilization. This protein consists of two separable and functionally essential domains: an N-terminal domain which binds to specific DNA sequences ($UAS_G$); and a C-terminal domain containing acidic regions, which is necessary to activate transcription. The native GAL4 protein, containing both domains, is a potent activator of transcription when yeast are grown on galactose media. The N-terminal domain binds to DNA in a sequence-specific manner but is unable to activate transcription. The C-terminal domain contains the activating regions but cannot activate transcription because it fails to be localized to $UAS_G$. In the two-hybrid system, a system of two hybrid proteins containing parts of GAL4: (1) a GAL4 DNA-binding domain fused to a protein 'X' and (2) a GAL4 activation region fused to a protein 'Y'. If X and Y can form a protein-protein complex and reconstitute proximity of the GAL4 domains, transcription of a gene regulated by $UAS_G$ occurs. Creation of two hybrid proteins, each containing one of the interacting proteins X and Y, allows the activation region of $UAS_G$ to be brought to its normal site of action.

The binding assay described in Fodor et al., 1991, *Science* 251:767–773, which involves testing the binding affinity of test compounds for a plurality of defined polymers synthesized on a solid substrate, may also be useful.

Compounds which bind to the polypeptides of the invention are potentially useful as antibacterial agents for use in therapeutic compositions.

Pharmaceutical formulations suitable for antibacterial therapy comprise the antibacterial agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The antibacterial compositions include an antibacterial effective amount of active agent. Antibacterial effective amounts are those quantities of the antibacterial agents of the present invention that afford prophylactic protection against bacterial infections or which result in amelioration or cure of an existing bacterial infection. This antibacterial effective amount will depend upon the agent, the location and nature of the infection, and the particular host. The amount can be determined by experimentation known in the art, such as by establishing a matrix of dosages and frequencies and comparing a group of experimental units or subjects to each point in the matrix.

The antibacterial active agents or compositions can be formed into dosage unit forms, such as for example, creams, ointments, lotions, powders, liquids, tablets, capsules, suppositories, sprays, aerosols or the like. If the antibacterial composition is formulated into a dosage unit form, the dosage unit form may contain an antibacterial effective amount of active agent. Alternatively, the dosage unit form may include less than such an amount if multiple dosage unit forms or multiple dosages are to be used to administer a total dosage of the active agent. Dosage unit forms can include, in addition, one or more excipient(s), diluent(s), disintegrant (s), lubricant(s), plasticizer(s), colorant(s), dosage vehicle (s), absorption enhancer(s), stabilizer(s), bactericide(s), or the like.

For general information concerning formulations, see, e.g., Gilman et al. (eds.), 1990, *Goodman and Gilman's. The Pharmacological Basis of Therapeutics*, 8th ed., Pergamon Press; and *Remington's Pharmaceutical Sciences*, 17th ed., 1990, Mack Publishing Co., Easton, Pa.; Avis et al. (eds.), 1993, *Pharmaceutical Dosage Forms: Parenteral Medications*, Dekker, N.Y.; Lieberman et al (eds.), 1990, *Pharmaceutical Dosage Forms: Disperse Systems*, Dekker, N.Y.

The antibacterial agents and compositions of the present invention are useful for preventing or treating *S. epidermidis* infections. Infection prevention methods incorporate a prophylactically effective amount of an antibacterial agent or composition. A prophylactically effective amount is an amount effective to prevent *S. epidermidis* infection and will depend upon the specific bacterial strain, the agent, and the host. These amounts can be determined experimentally by methods known in the art and as described above.

*S. epidermidis* infection treatment methods incorporate a therapeutically effective amount of an antibacterial agent or composition. A therapeutically effective amount is an amount sufficient to ameliorate or eliminate the infection. The prophylactically and/or therapeutically effective amounts can be administered in one administration or over repeated administrations. Therapeutic administration can be followed by prophylactic administration, once the initial bacterial infection has been resolved.

The antibacterial agents and compositions can be administered topically or systemically. Topical application is typically achieved by administration of creams, ointments, lotions, or sprays as described above. Systemic administration includes both oral and parental routes. Parental routes include, without limitation, subcutaneous, intramuscular, intraperitoneal, intravenous, transdermal, inhalation and intranasal administration.

EXEMPLIFICATION

Cloning and Sequencing *S. epidermidis* Genomic Sequence

This invention provides nucleotide sequences of the genome of *S. epidermidis* which thus comprises a DNA sequence library of *S. epidermidis* genomic DNA. The detailed description that follows provides nucleotide sequences of *S. epidermidis*, and also describes how the sequences were obtained and how ORFs (Open Reading Frames) and protein-coding sequences can be identified.

Also described are methods of using the disclosed *S. epidermidis* sequences in methods including diagnostic and therapeutic applications. Furthermore, the library can be used as a database for identification and comparison of medically important sequences in this and other strains of *S. epidermidis* as well as other species of Staphylococcus.

Chromosomal DNA from strain19804 of *S. epidermidis* was isolated after Zymolyase digestion, sodium dodecyl sulfate lysis, potassium acetate precipitation, phenol:chloroform extraction and ethanol precipitation (Soll, D. R., T. Srikantha and S. R. Lockhart: Characterizing Developmentally Regulated Genes in *S. epidermidis*. In Microbial Genome Methods. K. W. Adolph, editor. CRC Press. New York. p 17–37.). Genomic *S. epidermidis* DNA was hydrodynamically sheared in an HPLC and then separated on a standard 1% agarose gel. Fractions corresponding to 2500–3000 bp in length were excised from the gel and purified by the GeneClean procedure (Bio101, Inc.).

The purified DNA fragments were then blunt-ended using T4 DNA polymerase. The healed DNA was then ligated to unique BstXI-linker adapters (5'-GTCTTCACCACGGGG-3' and 5'-GTGGTGAAGAC-3' in 100–1000 fold molar excess). These linkers are complimentary to the BstXI-cut pGTC vector, while the overhang is not self-complimentary. Therefore, the linkers will not concatermerize nor will the cut-vector religate itself easily. The linker-adapted inserts were separated from the unincorporated linkers on a 1% agarose gel and purified using GeneClean. The linker-adapted inserts were then ligated to BstXI-cut vector to construct a "shotgun" sublclone libraries.

Only major modifications to the protocols are highlighted. Briefly, the library was then transformed into DH5á competent cells (Gibco/BRL, DH5á transformation protocol). It was assessed by plating onto antibiotic plates containing ampicillin and IPTG/Xgal. The plates were incubated overnight at 37° C. Transformants were then used for plating of clones and picking for sequencing. The cultures were grown overnight at 37° C. DNA was purified using a silica bead DNA preparation (Engelstein, 1996) method. In this manner, 25 µg of DNA was obtained per clone.

These purified DNA samples were then sequenced using primarily ABI dye-terminator chemistry. All subsequent steps were based on sequencing by ABI377 automated DNA sequencing methods. The ABI dye terminator sequence reads were run on ABI377 machines and the data was transferred to UNIX machines following lane 1 5 tracking of the gels. Base calls and quality scores were determined using the program PHRED (Ewing et al., 1998, Genome Res. 8: 175–185; Ewing and Green, 1998, Genome Res. 8: 685–734). Reads were assembled using PHRAP (P. Green, Abstracts of DOE Human Genome Program Contractor-Grantee Workshop V, January 1996, p. 157) with default program parameters and quality scores. The initial assembly was done at 2.3-fold coverage and yielded 5821 contigs.

Finishing can follow the initial assembly. Missing mates (sequences from clones that only gave reads from one end of the Staphylococcus DNA inserted in the plasmid) can be identified and sequenced with ABI technology to allow the identification of additional overlapping contigs.

End-sequencing of randomly picked genomic lambda was also performed. Sequencing on a both sides was done for all lambda sequences. The lambda library backbone helped to verify the integrity of the assembly and allowed closure of some of the physical gaps.Primers for walking off the ends of contigs would be selected using pick_primer (a GTC program) near the ends of the clones to facilitate gap closure. These walks can be sequenced using the selected clones and primers. These data are then reassembled with PHRAP. Additional sequencing using PCR-generated templates and screened and/or unscreened lambda templates can be done in addition.

To identify S. epidermidis polypeptides the complete genomic sequence of S. epidermidis were analyzed essentially as follows: First, all possible stop-to-stop open reading frames (ORFs) greater than 180 nucleotides in all six reading frames were translated into amino acid sequences. Second, the identified ORFs were analyzed for homology to known (archeabacter, prokaryotic and eukaryotic) protein sequences. Third, the coding potential of non-homologous sequences were evaluated with the program GENEMARK™ (Borodovsky and Mclninch, 1993, Comp. Chem. 17:123). EE341901427US*Identification, Cloning and Expression of S. epidermidis Nucleic Acids*

Expression and purification of the S. epidermidis polypeptides of the invention can be performed essentially as outlined below.

To facilitate the cloning, expression and purification of membrane and secreted proteins from S. epidermidis, a gene expression system, such as the pET System (Novagen), for cloning and expression of recombinant proteins in E. coli, is selected. Also, a DNA sequence encoding a peptide tag, the His-Tag, is fused to the 3' end of DNA sequences of interest in order to facilitate purification of the recombinant protein products. The 3' end is selected for fusion in order to avoid alteration of any 5' terminal signal sequence.

PCR Amplification and Cloning of Nucleic Acids Containing ORF's Encoding Enzymes Nucleic acids chosen (for example, from the nucleic acids set forth in SEQ ID NO: 1–SEQ ID NO: 2837) for cloning from the 18972 strain of S. epidermidis are prepared for amplification cloning by polymerase chain reaction (PCR). Synthetic oligonucleotide primers specific for the 5' and 3' ends of open reading frames (ORFs) are designed and purchased from GibcoBRL Life Technologies (Gaithersburg, Md., USA). All forward primers (specific for the 5' end of the sequence) are designed to include an NcoI cloning site at the extreme 5' terminus. These primers are designed to permit initiation of protein translation at a methionine residue followed by a valine residue and the coding sequence for the remainder of the native S. epidermidis DNA sequence. All reverse primers (specific for the 3' end of any S. epidermidis ORF) include a EcoRI site at the extreme 5' terminus to permit cloning of each S. epidermidis sequence into the reading frame of the pET-28b. The pET-28b vector provides sequence encoding an additional 20 carboxy-terminal amino acids including six histidine residues (at the extreme C-terminus), which comprise the His-Tag.

Genomic DNA prepared from the 18972 strain of S. epidermidis is used as the source of template DNA for PCR amplification reactions (Current Protocols in Molecular Biology, John Wiley and Sons, Inc., F. Ausubel et al., eds., 1994). To amplify a DNA sequence containing a S. epidermidis ORF, genomic DNA (50 nanograms) is introduced into a reaction vial containing 2 mM $MgCl_2$, 1 micromolar synthetic oligonucleotide primers (forward and reverse primers) complementary to and flanking a defined S. epidermidis ORF, 0.2 mM of each deoxynucleotide triphosphate; dATP, dGTP, dCTP, dTTP and 2.5 units of heat stable DNA polymerase (Amplitaq, Roche Molecular Systems, Inc., Branchburg, N.J., USA) in a final volume of 100 microliters.

Upon completion of thermal cycling reactions, each sample of amplified DNA is washed and purified using the Qiaquick Spin PCR purification kit (Qiagen, Gaithersburg, Md., USA). All amplified DNA samples are subjected to digestion with the restriction endonucleases, e.g., NcoI and EcoRI (New England BioLabs, Beverly, Mass., USA) (Current Protocols in Molecular Biology, John Wiley and Sons, Inc., F. Ausubel et al., eds., 1994). DNA samples are then subjected to electrophoresis on 1.0% NuSeive (FMC BioProducts, Rockland, Me. USA) agarose gels. DNA is visualized by exposure to ethidium bromide and long wave uv irradiation. DNA contained in slices isolated from the agarose gel is purified using the Bio 101 GeneClean Kit protocol (Bio 101 Vista, Calif., USA).

Cloning of S. epidermidis Nucleic Acids Into an Expression Vector

The pET-28b vector is prepared for cloning by digestion with restriction endonucleases, e.g., NcoI and EcoRI (Current Protocols in Molecular Biology, John Wiley and Sons, Inc., F. Ausubel et al., eds., 1994). The pET-28a vector, which encodes a His-Tag that can be fused to the 5' end of an inserted gene, is prepared by digestion with appropriate restriction endonucleases.

Following digestion, DNA inserts are cloned (Current Protocols in Molecular Biology, John Wiley and Sons, Inc., F. Ausubel et al., eds., 1994) into the previously digested pET-28b expression vector. Products of the ligation reaction are then used to transform the BL21 strain of E. coli (Current Protocols in Molecular Biology, John Wiley and Sons, Inc., F. Ausubel et al., eds., 1994) as described below.

Transformation of Competent Bacteria with Recombinant Plasmids

Competent bacteria, E coli strain BL21 or E. coli strain BL21 (DE3), are transformed with recombinant pET expression plasmids carrying the cloned S. epidermidis sequences according to standard methods (Current Protocols in Molecular, John Wiley and Sons, Inc., F. Ausubel et al., eds., 1994). Briefly, 1 microliter of ligation reaction is mixed with 50 microliters of electrocompetent cells and subjected to a high voltage pulse, after which, samples are incubated in 0.45 milliliters SOC medium (0.5% yeast extract, 2.0% tryptone, 10 mM NaCl, 2.5 mM KCl, 10 mM MgCl2, 10 mM MgSO4 and 20, mM glucose) at 37° C. with shaking for 1 hour. Samples are then spread on LB agar plates containing 25 microgram/ml kanamycin sulfate for growth overnight. Transformed colonies of BL21 are then picked and analyzed to evaluate cloned inserts as described below.

Identification of Recombinant Expression Vectors with S. epidermidis Nucleic Acids Individual BL21 clones transformed with recombinant pET-28b S. epidermidis ORFs are analyzed by PCR amplification of the cloned inserts using the same forward and reverse primers, specific for each S. epidermidis sequence, that were used in the original PCR amplification cloning reactions. Successful amplification verifies the integration of the S. epidermidis sequences in the expression vector (Current Protocols in Molecular Biology, John Wiley and Sons, Inc., F. Ausubel et al., eds., 1994).

Isolation and Preparation of Nucleic Acids From Transformants

Individual clones of recombinant pET-28b vectors carrying properly cloned S. epidermidis ORFs are picked and incubated in 5 mls of LB broth plus 25 microgram/ml kanamycin sulfate overnight. The following day plasmid DNA is isolated and purified using the Qiagen plasmid purification protocol (Qiagen Inc., Chatsworth, Calif., USA).

Expression of Recombinant S. epidermidis Sequences in E. coli

The pET vector can be propagated in any *E. coli* K-12 strain e.g. HMS 174, HB101, JM109, DH5, etc. for the purpose of cloning or plasmid preparation. Hosts for expression include *E. coli* strains containing a chromosomal copy of the gene for T7 RNA polymerase. These hosts are lysogens of bacteriophage DE3, a lambda derivative that carries the lacI gene, the lacUV5 promoter and the gene for T7 RNA polymerase. T7 RNA polymerase is induced by addition of isopropyl-B-D-thiogalactoside (IPTG), and the T7 RNA polymerase transcribes any target plasmid, such as pET-28b, carrying its gene of interest. Strains used include: BL21(DE3) (Studier, F. W., Rosenberg, A. H., Dunn, J. J., and Dubendorff, J. W. (1990) Meth. Enzymol. 185, 60–89).

To express recombinant *S. epidermidis* sequences, 50 nanograms of plasmid DNA isolated as described above is used to transform competent BL21(DE3) bacteria as described above (provided by Novagen as part of the pET expression system kit). The lacZ gene (beta-galactosidase) is expressed in the pET-System as described for the *S. epidermidis* recombinant constructions. Transformed cells are cultured in SOC medium for 1 hour, and the culture is then plated on LB plates containing 25 micrograms/ml kanamycin sulfate. The following day, bacterial colonies are pooled and grown in LB medium containing kanamycin sulfate (25 micrograms/ml) to an optical density at 600 nM of 0.5 to 1.0 O.D. units, at which point, 1 millimolar IPTG was added to the culture for 3 hours to induce gene expression of the *S. epidermidis* recombinant DNA constructions.

After induction of gene expression with IPTG, bacteria are pelleted by centrifugation in a Sorvall RC-3B centrifuge at 3500×g for 15 minutes at 4° C. Pellets are resuspended in 50 milliliters of cold 10 mM Tris-HCl, pH 8.0, 0.1 M NaCl and 0.1 mM EDTA (STE buffer). Cells are then centrifuged at 2000×g for 20 min at 4° C. Wet pellets are weighed and frozen at −80° C. until ready for protein purification.

A variety of methodologies known in the art can be utilized to purify the isolated proteins. (Current Protocols in Protein Science, John Wiley and Sons, Inc., J. E. Coligan et al., eds., 1995). For example, the frozen cells may be thawed, resuspended in buffer and ruptured by several passages through a small volume microfluidizer (Model M-110S, Microfluidics International Corporation, Newton, Mass.). The resultant homogenate may be centrifuged to yield a clear supernatant (crude extract) and following filtration the crude extract may be fractionated over columns. Fractions may be monitored by absorbance at $OD_{280}$ nm. and peak fractions may analyzed by SDS-PAGE.

The concentrations of purified protein preparations may be quantified spectrophotometrically using absorbance coefficients calculated from amino acid content (Perkins, S. J. 1986 Eur. J. Biochem. 157, 169–180). Protein concentrations are also measured by the method of Bradford, M. M. (1976) Anal. Biochem. 72, 248–254, and Lowry, O. H., Rosebrough, N., Farr, A. L. & Randall, R. J. (1951) J. Biol. Chem. 193, pages 265–275, using bovine serum albumin as a standard.

SDS-polyacrylamide gels of various concentrations may be purchased from BioRad (Hercules, Calif., USA), and stained with Coomassie blue. Molecular weight markers may include rabbit skeletal muscle myosin (200 kDa), *E. coli* (-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

EQUIVALENTS

Those skilled in the art will recognize, or be able to ascertain using no more than routine experimentation, many equivalents to the specific embodiments and methods described herein. The specific embodiments described herein are offered by way of example only, and the invention is to limited only by the terms of the appended claims, along with the full scope of equivalents to which such claims are entitled.

Table 2

| Contig | Orf | ntID | aaID | nt Length | aa Length | Blast Score | Blast Probability | Subject Taxonomy | Subject Name | Subject Definition |
|---|---|---|---|---|---|---|---|---|---|---|
| Contig001D | 14634450_c1_1 | 1 | 2838 | 204 | 68 | | | | | |
| Contig001D | 24225000_c3_3 | 2 | 2839 | 342 | 114 | 152 | 4.80E-11 | Archaeoglobus fulgidus | g2649613 | AF0984ABC transporter, ATP-binding proteinArchaeoglobus fulgidus section 71 of 172 of the complete genome.similar to SP |
| Contig001D | 801552_c2_2 | 3 | 2840 | 381 | 127 | | | | | |
| Contig002D | 32204583_f2_4 | 4 | 2841 | 198 | 66 | | | | | |
| Contig002D | 34101427_c3_13 | 5 | 2842 | 549 | 183 | 301 | 7.80E-27 | Haemophilus influenzae | P44609 | HI0277hypotheticalHaemophilus influenzae from bases 308943 to 320513 (section 29 of163) of the complete genome.similar to SP |
| Contig002D | 39113337_c2_11 | 6 | 2843 | 243 | 81 | | | | | |
| Contig003D | 16972205_f1_1 | 7 | 2844 | 240 | 80 | 192 | 3.70E-14 | Pseudomonas putida | g1778585 | catCstationary-phase inducible catalase CIPseudomonas putida stationary-phase inducible catalase C (catC)gene, complete cds. |
| Contig003D | 31817898_c3_14 | 8 | 2845 | 249 | 83 | | | | | |
| Contig003D | 3220277_f1_2 | 9 | 2846 | 735 | 245 | | | | | |
| Contig003D | 6773543_f3_5 | 10 | 2847 | 267 | 89 | | | | | |
| Contig004D | 29339567_f3_3 | 11 | 2848 | 237 | 79 | | | | | |
| Contig005D | 197187_f2_3 | 12 | 2849 | 324 | 108 | 252 | 1.20E-21 | Haemophilus influenzae | P44862 | HI0754glucokinaseHaemophilus influenzae from bases 809329 to 819404 (section 74 of163) of the complete genome.similar to SP |
| Contig005D | 33214506_f1_1 | 13 | 2850 | 888 | 296 | 206 | 3.50E-15 | Borrelia burgdorferi | g2689897 | BBB07outer surface protein, putativeBorrelia burgdorferi plasmid cp26, complete plasmid sequence.similar to GB |
| Contig006D | 14566626_f2_4 | 14 | 2851 | 228 | 76 | | | | | |
| Contig006D | 15661656_c1_12 | 15 | 2852 | 186 | 62 | | | | | |

| Contig | ID | | | | | | | | Organism | Accession | Description |
|---|---|---|---|---|---|---|---|---|---|---|---|
| Contig006D | 16601688_c2_13 | 16 | | 2853 | 1368 | 456 | | 2.30E-08 | Caenorhabditis elegans | e229183 | C11G6.3 Caenorhabditis elegans cosmid C11G6, complete sequence.cDNA EST CEESG55F comes from this gene |
| Contig006D | 24476091_c1_11 | 17 | | 2854 | 444 | 148 | 127 | 1.10E-07 | Orf virus | g332564 | ORF5 proteinOrf virus homologue of retroviral pseudoprotease gene, completecds.ORF5 |
| Contig006D | 24867191_c3_14 | 18 | | 2855 | 267 | 89 | 108 | 1.60E-05 | Caenorhabditis elegans | e229183 | C11G6.3Caenorhabditis elegans cosmid C11G6, complete sequence.cDNA EST CEESG55F comes from this gene |
| Contig006D | 34180317_c1_10 | 19 | | 2856 | 357 | 119 | 169 | 7.00E-12 | SACCHAROMYCES CEREVISIAE | P36043 | YKL201Chypothetical protein YKL201c64.6 KD PROTEIN IN TOR2-PAS1 INTERGENIC REGION |
| Contig007D | 1959693_c2_1 | 20 | | 2857 | 195 | 65 | | | | | |
| Contig008D | 2776391_f2_1 | 21 | | 2858 | 207 | 69 | | | | | |
| Contig008D | 4304683_c1_3 | 22 | | 2859 | 396 | 132 | 571 | 1.90E-55 | Plasmid pIM13 | P13956 | mlsmacrolide-lincosamide-streptogramin B-resistancePlasmid pIM13 (from B.subtilis), complete genome, encoding apossible replication protein andmacrolide-lincosamide-streptogramin B resistance protein, completecds.rRNA (adenine-N6-)-methyltransferase |
| Contig008D | 976035_c3_4 | 23 | | 2860 | 405 | 135 | 662 | 4.40E-65 | Staphylococcus chromogenes | g2317796 | rRNA N-6-methyltransferaseStaphylococcus chromogenes plasmid pPV141 erythromycin resistanceplasmid. rRNA N-6-methyltransferase (ermM) and plasmid replicationprotein genes, complete cds. |
| Contig009D | 2349191_f2_2 | 24 | | 2861 | 321 | 107 | 149 | 7.90E-10 | Acinetobacter sp. ADP1 | g2352826 | benK benzoate transport proteinAcinetobacter sp. ADP1 ben operon and cat operon, completesequence. |
| Contig009D | 31770762_c2_5 | 25 | | 2862 | 735 | 245 | | | | | |
| Contig009D | 45605468_c3_6 | 26 | | 2863 | 312 | 104 | | | | | |
| Contig009D | 9961566_f3_3 | 27 | | 2864 | 819 | 273 | 947 | 2.70E-95 | Plasmid pWW0 | P23102 | xylL1,2-dihydroxycyclohexa-3,4-diene carboxylatePseudomonas putida plasmid pWW0 meta operon, 5' genes. |
| Contig010D | 10980305_c3_12 | 28 | | 2865 | 189 | 63 | | | | | |
| Contig010D | 11075275_f3_7 | 29 | | 2866 | 564 | 188 | | | | | |

| | | | | | | | | |
|---|---|---|---|---|---|---|---|---|
| Contig010D | 33614811_f1_1 | 30 | 2867 | 504 | 168 | 274 | 5.70E-24 | Bacillus subtilis | g1934656 | yrdOCation transport protein YrdOBacillus subtilis.aminoglycoside 6-adenyltltransferase (aadK) gene,partial cds, and YrdA (yrdA), YrdB (yrdB), hypothetical proteinYrdC (yrdC), YrdD (yrdD), hypothetical cytochrome P450 protein YrdE(yrdE), ribonuclease inhi |
| Contig010D | 4968908_c2_11 | 31 | 2868 | 729 | 243 | 195 | 1.90E-14 | Escherichia coli | P11585 | relAGTP pyrophosphokinaseEscherichia coli K-12 MG1655 section 252 of 400 of the completegenome.guanosine 3',5'-bis(diphosphate) 3'-pyrophosphatasef744; 99 pct identical to RELA_ECOLI SW |
| Contig011D | 11724141_f2_4 | 32 | 2869 | 750 | 250 | 139 | 3.20E-07 | Plasmodium vivax | g482894 | circumsporozoite proteinPlasmodium vivax isolate SOL101 circumsporozoite protein gene,partial cds. |
| Contig011D | 22772930_c1_7 | 33 | 2870 | 357 | 119 | 114 | 1.60E-06 | Homo sapiens | A60533 | tumor-associated antigen DF3 |
| Contig011D | 26770911_f3_5 | 34 | 2871 | 852 | 284 | 328 | 1.10E-29 | Mycobacterium tuberculosis | e319154 | MT1376.03cunknownMycobacterium tuberculosis cosmid 1376.MT1376.03c, unknown, len |
| Contig013D | 12542203_f2_1 | 35 | 2872 | 699 | 233 | | | | | |
| Contig014D | 16254012_c2_18 | 36 | 2873 | 627 | 209 | 340 | 5.80E-31 | Rhizobium leguminosarum bv. trifolii | g1439550 | Rhizobium leguminosarum bv. trifolii TfuA (tfuA), gene, completecds.ORF1; high similarity to members of the LysR |
| Contig014D | 24020200_f3_13 | 37 | 2874 | 1044 | 348 | 620 | 1.20E-60 | Bacillus subtilis | P42086 | ypaQtransport proteinBacillus subtilis (YAC10-9 clone) DNA region between the serA andkdg loci.26% of identity to the Bacillus caldolyticus uracil |
| Contig014D | 26377261_c2_17 | 38 | 2875 | 624 | 208 | 122 | 6.30E-05 | Oryctolagus cuniculus | P16230 | histidine-rich calcium-binding protein precursorRabbit histidine-rich calcium-binding protein mRNA, complete cds.histidine-rich calcium-binding protein |
| Contig014D | 36581376_f2_9 | 39 | 2876 | 192 | 64 | | | | | |
| Contig015D | 14109413_c2_14 | 40 | 2877 | 741 | 247 | 608 | 2.30E-59 | Haemophilus influenzae | P44849 | HI0736sodium-dependent noradrenaline transporterHaemophilus influenzae from bases 788391 to 799271 (section 72 of163) of the complete genome,similar to SP |

| | | | | | | | | | |
|---|---|---|---|---|---|---|---|---|---|
| Contig015D | 26462913_c1_10 | 41 | 2878 | 183 | 61 | | | | |
| Contig015D | 29964176_f1_2 | 42 | 2879 | 279 | 93 | 210 | 3.40E-17 | Synechocystis sp. | dl017357 | msrApeptide methionine sulfoxide reductaseSynechocystis sp. PCC6803 complete genome, 1/27, 1-133859.ORF_ID |
| Contig015D | 30257686_f3_6 | 43 | 2880 | 240 | 80 | | | | |
| Contig015D | 36020031_f3_8 | 44 | 2881 | 387 | 129 | | | | |
| Contig015D | 36441953_f1_3 | 45 | 2882 | 450 | 150 | 324 | 2.90E-29 | Escherichia coli | g1790665 | msrApeptide methionine sulfoxide reductaseEscherichia coli K-12 MG1655 section 383 of 400 of the completegenome.f212; 100 pct identical amino acid sequence and |
| Contig015D | 7036628_c1_11 | 46 | 2883 | 339 | 113 | | | | |
| Contig016D | 16507686_c2_9 | 47 | 2884 | 186 | 62 | | | | |
| Contig016D | 26853200_c1_8 | 48 | 2885 | 1287 | 429 | 263 | 3.90E-20 | Escherichia coli | P23886 | cydCTransport ATP-binding protein CydCEscherichia coli genomic DNA.(19.9 - 20.2 min).unassigned ATP-binding cassette proteinsf573; 100 pct identical to CYDC_ECOLI SW |
| Contig016D | 286293_f3_7 | 49 | 2886 | 192 | 64 | | | | |
| Contig017D | 20423412_f3_4 | 50 | 2887 | 324 | 108 | | | | |
| Contig017D | 26580008_f3_3 | 51 | 2888 | 195 | 65 | | | | |
| Contig061D | 10556712_c3_208 | 52 | 2889 | 990 | 330 | 1667 | 1.40E-171 | Staphylococcus aureus | g1408063 | mecRmethicillin-resistance proteinStaphylococcus aureus methicillin resistance protein (mecR) geneand unknown ORF, complete cds.putative |
| Contig061D | 10634800_c1_138 | 53 | 2890 | 966 | 322 | 143 | 2.00E-07 | Bacillus subtilis | g2619048 | yobVtranscription regulatorBacillus subtilis chromosome region between terC and odhAB.similar to Mycobacterium tuberculosis hypothetical |
| Contig061D | 10928_c2_207 | 54 | 2891 | 1242 | 414 | 240 | 6.90E-18 | Rhodobacter capsulatus | g3128293 | hypothetical proteinRhodobacter capsulatus strain SB1003, partial genome. |
| Contig061D | 111500_c3_227 | 55 | 2892 | 546 | 182 | 101 | 1.60E-05 | Listeria monocytogenes | g940753 | iapinvasive associated proteinL.monocytogenes type 2 partial iap gene (strain 64.1.1).invades nonprofessional phagocytic cells |

83

| | | | | | | | | |
|---|---|---|---|---|---|---|---|---|
| Contig061D | 1379132_c1_133 | 56 | 2893 | 564 | 188 | 446 | 3.40E-42 | Bacillus anthracis | g929972 | Bacillus anthracis Weybridge A toxin plasmid pXO1 right invertedrepeat element (

| | | | | | | | | | | |
|---|---|---|---|---|---|---|---|---|---|---|
| Contig061D | 16688_c2_196 | 69 | 2906 | 216 | 72 | | | | | |
| Contig061D | 16695311_f2_59 | 70 | 2907 | 693 | 231 | 1184 | 2.10E-120 | Staphylococcus aureus | P19380 | putative transposaseS. aureus IS431mec gene associated with methicillin resistance.putative transposase (AA 1 - 224) |
| Contig061D | 16695311_f2_68 | 71 | 2908 | 693 | 231 | 1191 | 3.80E-121 | Staphylococcus aureus | P19380 | putative transposaseS. aureus IS431mec gene associated with methicillin resistance.putative transposase (AA 1 - 224) |
| Contig061D | 16975082_c1_159 | 72 | 2909 | 306 | 102 | | | | | |
| Contig061D | 19647213_c3_217 | 73 | 2910 | 342 | 114 | 157 | 1.40E-11 | Bacillus subtilis | d1020073 | ydcNtranscriptional regulator (phage-related) homolog ydcNBacillus subtilis genome sequence, 148 kb sequence of the regionbetween 35 and 47 degree.PROBABLE REPRESSOR PROTEIN. |
| Contig061D | 19719812_c1_165 | 74 | 2911 | 474 | 158 | 803 | 5.00E-80 | Staphylococcus aureus | P19380 | putative transposaseS. aureus IS431mec gene associated with methicillin resistance.putative transposase (AA 1 - 224) |
| Contig061D | 19720462_f2_81 | 75 | 2912 | 1203 | 401 | 370 | 3.80E-34 | Escherichia coli | P39381 | yjiJhypothetical 41.4 kD protein in iadA-mcrDEscherichia coli K-12 MG1655 section 393 of 400 of the completegenome.f392; 100 pct identical amino acid sequence and |
| Contig061D | 20523253_c3_220 | 76 | 2913 | 252 | 84 | 447 | 2.60E-42 | Staphylococcus aureus | g46597 | transposaseS.aureus plasmid pSH6 DNA for insertion sequences IS257-1 andIS256. |
| Contig061D | 20585963_c3_213 | 77 | 2914 | 348 | 116 | 216 | 8.00E-18 | Bacillus anthracis | g929966 | Bacillus anthracis Weybridge A toxin plasmid pXO1 lcfi invertedrepeat element (WeyAL) bordering the toxin-encoding region,truncated ORFA and truncated ORFB genes, complete cds.truncated ORFB due to a basepair deletion; similar |
| Contig061D | 20585963_c3_248 | 78 | 2915 | 906 | 302 | 647 | 1.70E-63 | Bacillus anthracis | g929972 | Bacillus anthracis Weybridge A toxin plasmid pXO1 right invertedrepeat element (WeyAR) bordering the toxin-encoding region, ORFAand ORFB genes, complete cds.ORFB; similar to B. anthracis SterneL element ORFB; |

85

| | | | | | | | | |
|---|---|---|---|---|---|---|---|---|
| Contig061D | 20964212_c3_223 | 79 | 2916 | 1692 | 564 | 344 | 1.10E-29 | Bacteriophage TP901-1 | e155312 | integraseBacteriophage TP901-1 ORF1,2 & 3.OrfI |
| Contig061D | 2120265_c3_218 | 80 | 2917 | 870 | 290 | 151 | 5.10E-08 | Synechocystis sp. | d1019159 | hypothetical proteinSynechocystis sp. PCC6803 complete genome, 16/27, 1991550-2137258.ORF_ID |
| Contig061D | 21521878_c1_130 | 81 | 2918 | 354 | 118 | 181 | 9.90E-13 | Haemophilus influenzae | g1574743 | HI1285type I restriction enzyme ECOR124/3 R proteinHaemophilus influenzae from bases 1356902 to 1368850 (section 123of 163) of the complete genome.similar to SP |
| Contig061D | 21651677_f1_44 | 82 | 2919 | 255 | 85 | | | | | |
| Contig061D | 2209675_f1_28 | 83 | 2920 | 1470 | 490 | 465 | 3.30E-44 | Petroselinum crispum | Q06086 | TryDC-2tyrosine decarboxylaseParsley tyrosine decarboxylase (TryDC-2) mRNA, complete cds.aromatic-L-amino-acid decarboxylase |
| Contig061D | 22537563_c1_149 | 84 | 2921 | 231 | 77 | | | | | |
| Contig061D | 23437803_f3_91 | 85 | 2922 | 714 | 238 | 122 | 1.60E-06 | Streptococcus pyogenes | JH0364 | hypothetical protein 176 (SAGP 5' region) |
| Contig061D | 23438876_f3_116 | 86 | 2923 | 258 | 86 | | | | | |
| Contig061D | 23439193_c3_240 | 87 | 2924 | 495 | 165 | 453 | 6.10E-43 | Bacillus subtilis | e1182558 | ydhKhypothetical protein ydhKBacillus subtilis complete genome (section 4 of 21)membrane protein |
| Contig061D | 23556577_f1_46 | 88 | 2925 | 324 | 108 | | | | | |
| Contig061D | 235678_f2_53 | 89 | 2926 | 216 | 72 | 203 | 1.90E-16 | Bacillus subtilis | g2529473 | yokZYokZBacillus subtilis 168 region at 182 min containing the cge genecluster.similar to the VanYB (D,D-carboxypeptidase) of |
| Contig061D | 23610952_c2_206 | 90 | 2927 | 855 | 285 | 305 | 2.90E-27 | Archaeoglobus fulgidus | g2648798 | AF1753lysophospholipaseArchaeoglobus fulgidus section 125 of 172 of the complete genome.similar to GP |
| Contig061D | 23632883_c1_151 | 91 | 2928 | 183 | 61 | | | | | |
| Contig061D | 23634682_c2_171 | 92 | 2929 | 375 | 125 | | | | | |

86

| Contig061D | 23635931_c1_155 | 93 | 2930 | 375 | 125 | 637 | 1.90E-62 | Plasmid pI258 | P08656 | merT hypothetical 14K protein (mer operon)Plasmid pI258 (from S.aureus strain RN23 8325) mercury resistance(mer) operon encoding mercuric reductase (merA), organomercuriallyase (merB), regulatory protein (merR) and membrane transportprotein (merT), complet |
|---|---|---|---|---|---|---|---|---|---|---|
| Contig061D | 23679765_f3_90 | 94 | 2931 | 1269 | 423 | 1182 | 3.40E-120 | Lactobacillus sake | e1227704 | arcAarginine deiminaseLactobacillus sake DNA encoding the arginine-deiminase pathwaygenes. |
| Contig061D | 23959802_f2_80 | 95 | 2932 | 210 | 70 | | | | | |
| Contig061D | 24101587_f3_93 | 96 | 2933 | 339 | 113 | | | | | |
| Contig061D | 24250010_c3_243 | 97 | 2934 | 225 | 75 | | | | | |
| Contig061D | 24256550_c2_191 | 98 | 2935 | 258 | 86 | | | | | |
| Contig061D | 24273442_f1_37 | 99 | 2936 | 384 | 128 | 142 | 5.50E-10 | Bacillus subtilis | g2618844 | yvlAYvlABacillus subtilis 300-304 degree genomic sequence. |
| Contig061D | 24273442_f1_9 | 100 | 2937 | 384 | 128 | 144 | 3.40E-10 | Bacillus subtilis | g2618844 | yvlAYvlABacillus subtilis 300-304 degree genomic sequence. |
| Contig061D | 24299037_c3_226 | 101 | 2938 | 255 | 85 | | | | | |
| Contig061D | 24401712_c1_140 | 102 | 2939 | 1125 | 375 | | | | | |
| Contig061D | 24407828_c3_222 | 103 | 2940 | 2013 | 671 | 136 | 7.70E-05 | Plasmodium yoelii | g1041785 | rhoptry proteinPlasmodium yoelii rhoptry protein gene, partial cds. |
| Contig061D | 24409452_c3_253 | 104 | 2941 | 432 | 144 | 132 | 6.30E-09 | Methanococcus jannaschii | Q57997 | MJ0577conserved hypothetical proteinMethanococcus jannaschii section 48 of 150 of the complete genome.hypothetical protein b0607similar to SP |
| Contig061D | 24414680_c1_150 | 105 | 2942 | 1287 | 429 | | | | | |
| Contig061D | 24414818_f3_113 | 106 | 2943 | 441 | 147 | | | | | |
| Contig061D | 24424092_c2_174 | 107 | 2944 | 522 | 174 | | | | | |

| | | | | | | | | |
|---|---|---|---|---|---|---|---|---|
| Contig061D | 24430392_c1_157 | 108 | 2945 | 681 | 227 | 1116 | 3.40E-113 | Plasmid pI258 | P08653 | merBorganomercurial lyasePlasmid pI258 (from S.aureus strain RN23 8325) mercury resistance(mer) operon encoding mercuric reductase (merA), organomercuriallyase (merB), regulatory protein (merR) and membrane transportprotein (merT), complete cds.alkylmercu |
| Contig061D | 24432662_c2_190 | 109 | 2946 | 969 | 323 | 304 | 8.70E-48 | Escherichia coli | P36649 | yacKhypothetical protein in speE-gcd intergenicEscherichia coli K-12 MG1655 section 11 of 400 of the completegenome.o516; 100 pct identical to 463 residues from |
| Contig061D | 24486008_c2_194 | 110 | 2947 | 978 | 326 | | | | | |
| Contig061D | 24641941_f3_94 | 111 | 2948 | 510 | 170 | | | | | |
| Contig061D | 24650427_f3_110 | 112 | 2949 | 3126 | 1042 | 1653 | 1.90E-220 | Haemophilus influenzae | gi574743 | HI1285type I restriction enzyme ECOR124/3 R proteinHaemophilus influenzae from bases 1356902 to 1368850 (section 123of 163) of the complete genome.similar to SP |
| Contig061D | 24783462_c2_173 | 113 | 2950 | 339 | 113 | | | | | |
| Contig061D | 24797126_f1_40 | 114 | 2951 | 249 | 83 | | | | | |
| Contig061D | 24812927_f2_50 | 115 | 2952 | 183 | 61 | | | | | |
| Contig061D | 254527_c2_183 | 116 | 2953 | 186 | 62 | | | | | |
| Contig061D | 25583568_f1_3 | 117 | 2954 | 363 | 121 | | | | | |
| Contig061D | 25587802_c1_134 | 118 | 2955 | 777 | 259 | 114 | 8.50E-05 | Borrelia burgdorferi | g2688190 | BB0276flagellar biosynthesis protein (fliZ)Borrelia burgdorferi (section 23 of 70) of the complete genome.similar to PID |
| Contig061D | 26597010_f3_118 | 119 | 2956 | 186 | 62 | 103 | 2.40E-05 | Rhizobium sp. NGR234 | Q53200 | y4uHY4uHRhizobium sp. NGR234 plasmid pNGR234a, section 36 of 46 of thecomplete plasmid sequence,putative insertion sequence ATP-binding protein |
| Contig061D | 26759707_c1_143 | 120 | 2957 | 450 | 150 | 319 | 9.70E-29 | Staphylococcus aureus | A60450 | hypothetical protein att155 (transposon attachment site) |
| Contig061D | 2819632_f1_48 | 121 | 2958 | 387 | 129 | | | | | |
| Contig061D | 2867812_c2_195 | 122 | 2959 | 213 | 71 | | | | | |

| Contig061D | 2946092_c2_169 | 123 | 2960 | 435 | 145 | | | | |
|---|---|---|---|---|---|---|---|---|---|
| Contig061D | 30086682_c2_185 | 124 | 2961 | 732 | 244 | 1134 | 4.20E-115 | Plasmid pI258 | g459905 | hypothetical 24K protein (mer operon)Plasmid pI258 (from S.aureus strain RN23 8325) mercury resistance(mer) operon encoding mercuric reductase (merA), organomercuriallyase (merB), regulatory protein (merR) and membrane transportprotein (merT), complete cd |
| Contig061D | 30111718_c2_189 | 125 | 2962 | 2124 | 708 | 1980 | 6.20E-211 | Enterococcus hirae | P05425 | copBATPaseEnterococcus hirae ATPase (copA) gene, complete cds; ATPase (copB)gene, complete cds.Enterococcus Cu2+-transporting ATPaseputative |
| Contig061D | 32148381_f3_112 | 126 | 2963 | 198 | 66 | | | | | |
| Contig061D | 32226577_c3_236 | 127 | 2964 | 354 | 118 | 596 | 4.30E-58 | Plasmid pI258 | g459904 | hypothetical 18K protein (mer operon)Plasmid pI258 (from S.aureus strain RN23 8325) mercury resistance(mer) operon encoding mercuric reductase (merA), organomercuriallyase (merB), regulatory protein (merR) and membrane transportprotein (merT), complete cd |
| Contig061D | 33261588_c2_168 | 128 | 2965 | 690 | 230 | | | | | |
| Contig061D | 33261637_c3_225 | 129 | 2966 | 543 | 181 | | | | | |
| Contig061D | 3332776_f3_129 | 130 | 2967 | 228 | 76 | | | | | |
| Contig061D | 33867212_f3_128 | 131 | 2968 | 339 | 113 | | | | | |
| Contig061D | 34016880_f2_89 | 132 | 2969 | 273 | 91 | 422 | 3.40E-39 | Staphylococcus aureus | g46611 | mecAPBP2AS. aureus mecA gene for PBP2' (penicillin binding protein 2),PBP2' (AA 1-668) |

09134001.081398

| | | | | | | | | | | |
|---|---|---|---|---|---|---|---|---|---|---|
| Contig061D | 34631527_f1_8 | 133 | 2970 | 834 | 278 | 472 | 5.90E-45 | Marinococcus halophilus | g2098612 | putative transposaseMarinococcus halophilus L-2,4-diaminobutyric acid acetyltransferase (ectA) gene, L-2,4-diaminobutyric acid transaminase(ectB) gene, ectoine synthase (ectC) gene, putative transposaseorfA gene, complete cds, and putative transposase orf |
| Contig061D | 35157813_f2_54 | 134 | 2971 | 519 | 173 | 473 | 4.60E-45 | Escherichia coli | P37354 | speGSpermidine N1-acetyltransferase (EC 2.3.1.57)E.coli genomic DNA, Kohara clone #308(35.3-35.7 min.).ORF_ID |
| Contig061D | 35334686_f2_87 | 135 | 2972 | 1713 | 571 | 1253 | 1.00E-127 | Staphylococcus haemolyticus | g1022726 | unknownStaphylococcus haemolyticus IS1272 ORF1 and ORF2 genes, completecds.ORF1 |
| Contig061D | 36135952_f2_85 | 136 | 2973 | 1650 | 550 | 463 | 5.30E-44 | Bacteriophage TP901-1 | e155312 | integraseBacteriophage TP901-1 ORF1,2 & 3.Orf1 |
| Contig061D | 36211052_c1_156 | 137 | 2974 | 1662 | 554 | 2755 | 7.00E-287 | Plasmid pI258 | P08663 | merAmercuric reductasePlasmid pI258 (from S.aureus strain RN23 8325) mercury resistance(mer) operon encoding mercuric reductase (merA), organomercuriallyase (merB), regulatory protein (merR) and membrane transportprotein (merT), complete cds.dihydrolipoam |
| Contig061D | 36225427_f2_83 | 138 | 2975 | 615 | 205 | | | | | |
| Contig061D | 36226501_c2_175 | 139 | 2976 | 891 | 297 | | | | | |
| Contig061D | 36584652_c1_132 | 140 | 2977 | 339 | 113 | 300 | 1.00E-26 | Bacillus anthracis | g929968 | Bacillus anthracis Sterne toxin plasmid pXO1 right inverted repeatelement (SterneR) bordering the toxin-encoding region, ORFA andtruncated ORFB genes, complete cds.ORFA; similar to B. anthracis WeyAR element ORFA; |
| Contig061D | 3913137_f2_62 | 141 | 2978 | 570 | 190 | 982 | 5.40E-99 | Plasmid pI258 | g459909 | Plasmid pI258 (from S.aureus strain RN23 8325) mercury resistance(mer) operon encoding mercuric reductase (merA), organomercuriallyase (merB), regulatory protein (merR) and membrane transportprotein (merT), complete cds.ORF1 |

| | | | | | | | | |
|---|---|---|---|---|---|---|---|---|
| Contig061D | 3938802_f2_84 | 142 | 2979 | 1383 | 461 | 238 | 2.50E-17 | Bacteriophage TP901-1 | e155312 | integraseBacteriophage TP901-1 ORF1,2 & 3.Orf1 |
| Contig061D | 4022952_f1_29 | 143 | 2980 | 1515 | 505 | 1186 | 3.30E-140 | Mycobacterium tuberculosis | e1173886 | hsdMDNA methylaseMycobacterium tuberculosis sequence v002.MTV002.21c, hsdM, type I restriction/modification |
| Contig061D | 4025302_f3_97 | 144 | 2981 | 1293 | 431 | 1892 | 2.00E-195 | Plasmid pI258 | P30329 | arsBarsenic efflux pump proteinPlasmid pI258 arsenic resistance operon (arsRBC) genes, completeeds.arsenical pump membrane protein |
| Contig061D | 4098518_c2_184 | 145 | 2982 | 417 | 139 | 682 | 3.30E-67 | Plasmid pI258 | P22874 | MERRhypothetical 16K protein (mer operon)Plasmid pI258 (from S.aureus strain RN23 8325) mercury resistance(mer) operon encoding mercuric reductase (merA), organomercuriallyase (merB), regulatory protein (merR) and membrane transportprotein (merT), complet |
| Contig061D | 4120462_f2_52 | 146 | 2983 | 945 | 315 | 791 | 9.30E-79 | Escherichia coli | Q46807 | YQEAhypothetical protein b2874Escherichia coli K-12 MG1655 section 260 of 400 of the completegenome.carbamate kinaseo310; This 310 aa ORF is 45 pct identical (21 gaps) |
| Contig061D | 4196051_f1_14 | 147 | 2984 | 333 | 111 | 424 | 7.20E-40 | Staphylococcus xylosus | A41902 | arsRarsenical resistance operon repressorarsenical resistance operon repressor |
| Contig061D | 4453165_c1_160 | 148 | 2985 | 537 | 179 | 202 | 1.50E-15 | Escherichia coli | d1006123 | 'ORF'Escherichia coli genome, 2.4-4.1 min region (110,917-193,643 bpfrom 0 min),'copper resistance protein copA homology' |
| Contig061D | 4485937_f1_2 | 149 | 2986 | 1044 | 348 | 1060 | 2.90E-107 | Haemophilus influenzae | P44770 | HI0596ornithine carbamoyltransferase (arcB)Haemophilus influenzae from bases 614291 to 624841 (section 56 ofL63) of the complete genome.ornithine carbamoyltransferasesimilar to GB |

91

| | | | | | | | | | |
|---|---|---|---|---|---|---|---|---|---|
| Contig061D | 448785_f3_114 | 150 | 2987 | 927 | 309 | 408 | 3.60E-38 | Arthrobacter sp. | Q44311 | soxRnegative regulatorArthrobacter sp. gene for negative regulator, sarcosine oxidase,transporter, creatinase, creatininase and transporter,complete cds. |
| Contig061D | 4694677_c1_144 | 151 | 2988 | 324 | 108 | | | | | |
| Contig061D | 4697337_f3_115 | 152 | 2989 | 549 | 183 | 255 | 5.90E-22 | Bacillus subtilis | g1934639 | yrpB2-nitropropane dioxygenaseBacillus subtilis alcohol dehydrogenase (adhB) gene, partial cds,hypothetical spore coat protein (yraF), hypothetical spore coatprotein (yraG), YraH (yraH), YraI (yraI), YraJ (yraJ), YraK (yraK),YraL (yraL), chitosanase precu |
| Contig061D | 4722338_c3_224 | 153 | 2990 | 234 | 78 | | | | | |
| Contig061D | 4726555_f2_51 | 154 | 2991 | 474 | 158 | 183 | 2.50E-14 | Bacillus subtilis | P17893 | ahrC,AhrCB.subtilis ahrC gene, encoding an arginine repressor/activatorprotein.ahrC protein |
| Contig061D | 4866425_f2_82 | 155 | 2992 | 465 | 155 | 305 | 2.90E-27 | Bacillus subtilis | g1934639 | yrpB2-nitropropane dioxygenaseBacillus subtilis alcohol dehydrogenase (adhB) gene, partial cds,hypothetical spore coat protein (yraF), hypothetical spore coatprotein (yraG), YraH (yraH), YraI (yraI), YraJ (yraJ), YraK (yraK),YraL (yraL), chitosanase precu |
| Contig061D | 4867343_c3_215 | 156 | 2993 | 2739 | 913 | 234 | 5.10E-16 | Borrelia burgdorferi | g2688552 | BB0632exodeoxyribonuclease V, alpha chain (recD)Borrelia burgdorferi (section 50 of 70) of the complete genome,similar to SP |
| Contig061D | 492086_f3_124 | 157 | 2994 | 1824 | 608 | | | | | |
| Contig061D | 4971051_c2_178 | 158 | 2995 | 825 | 275 | 181 | 1.10E-13 | Lactococcus lactis cremoris | g1405404 | abiGiAbiGiLactococcus lactis cremoris abortive infection proteins (abiGi andabiGii) genes, complete cds. |
| Contig061D | 5133462_f3_122 | 159 | 2996 | 1530 | 510 | 119 | 1.60E-05 | Saccharomyces cerevisiae | P47037 | SCP160hypothetical proteinS.cerevisiae DNA for hypotetical proteins and esterase genes.ORF YJL074c |
| Contig061D | 5292300_c2_167 | 160 | 2997 | 342 | 114 | | | | | |

92

| | | | | | | | | | | |
|---|---|---|---|---|---|---|---|---|---|---|
| Contig061D | 649141_f2_86 | 161 | 2998 | 567 | 189 | | | | | |
| Contig061D | 6521882_f1_16 | 162 | 2999 | 195 | 65 | | | | | |
| Contig061D | 6643751_c1_158 | 163 | 3000 | 270 | 90 | | | | | |
| Contig061D | 6819462_f1_1 | 164 | 3001 | 1491 | 497 | 1230 | 2.80E-125 | Clostridium perfringens | e242289 | arcDarginine ornithine antiporterC.perfringens strain 13 arcABDC, ahrC and colA genes. |
| Contig061D | 6834501_c1_142 | 165 | 3002 | 231 | 77 | | | | | |
| Contig061D | 6929627_c2_197 | 166 | 3003 | 1146 | 382 | 756 | 4.80E-75 | Mycobacterium tuberculosis | e322878 | MTCI28.02calcohol dehydrogenaseMycobacterium tuberculosis cosmid I28.MTCI28.02c, alcohol dehydrogenase, len |
| Contig061D | 6929642_f1_4 | 167 | 3004 | 243 | 81 | | | | | |
| Contig061D | 6929686_c2_205 | 168 | 3005 | 264 | 88 | 368 | 6.20E-34 | Staphylococcus aureus | g46597 | transposaseS.aureus plasmid pSH6 DNA for insertion sequences IS257-1 andIS256. |
| Contig061D | 862927_c3_251 | 169 | 3006 | 195 | 65 | | | | | |
| Contig061D | 892142_f2_55 | 170 | 3007 | 198 | 66 | | | | | |
| Contig061D | 917550_c1_163 | 171 | 3008 | 216 | 72 | 143 | 4.30E-10 | Bacillus anthracis | g929968 | Bacillus anthracis Sterne toxin plasmid pXO1 right inverted repeatelement (SterneR) bordering the toxin-encoding region, ORFA andtruncated ORFB genes, complete cds.ORFA; similar to B. anthracis WeyAR element ORFA; |
| Contig061D | 970250_c2_193 | 172 | 3009 | 912 | 304 | 446 | 3.40E-42 | Methanobacterium thermoautotrophicum | g2621989 | MTH894conserved proteinMethanobacterium thermoautotrophicum from bases 808939 to 820180(section 71 of 148) of the complete genome.Function Code |
| Contig061D | 970386_f1_27 | 173 | 3010 | 333 | 111 | 270 | 4.30E-23 | Bacillus subtilis | e1184706 | yxcCmetabolite transport protein homolog yxcCBacillus subtilis complete genome (section 21 of 21)similar to metabolite transport protein |
| Contig061D | 979178_c3_246 | 174 | 3011 | 243 | 81 | | | | | |

| | | | | | | | | |
|---|---|---|---|---|---|---|---|---|
| Contig061D | 9806332_f3_109 | 175 | 3012 | 450 | 150 | 237 | 7.70E-20 | Pyrococcus horikoshii | d1027703 | PH:AB011376aa long hypothetical dehydrogenasePyrococcus horikoshii OT3 genomic DNA, 512441-547109 nt position(complementary strand), clonecontains ATP/GTP-binding site motif A (P-loop); |
| Contig061D | 9806692_c3_235 | 176 | 3013 | 1374 | 458 | 907 | 4.70E-91 | Plasmid pI258 | P08655 | merRregulatory proteinPlasmid pI258 (from S.aureus strain RN23 8325) mercury resistance(mer) operon encoding mercuric reductase (merA), organomercuriallyase (merB), regulatory protein (merR) and membrane transportprotein (merT), complete cds. |
| Contig140D | 1385927_f3_8 | 177 | 3014 | 369 | 123 | | | | | |
| Contig140D | 14882135_f2_4 | 178 | 3015 | 2112 | 704 | 167 | 1.30E-09 | Escherichia coli | P10411 | melRmelibiose operon regulatory proteinEscherichia coli K-12 MG1655 section 374 of 400 of the completegenome:arabinose operon regulatory protein302: CG Site No. 18166 |
| Contig140D | 24110652_c2_10 | 179 | 3016 | 822 | 274 | 879 | 4.40E-88 | Bacillus cereus | e1179988 | gltIproton /sodium-glutamate symport proteinB.cereus partial gltI, aspA and partial maoX genes. |
| Contig140D | 25634627_f2_5 | 180 | 3017 | 468 | 156 | 290 | 1.10E-25 | Bacillus subtilis | P80238 | ydaGgeneral stress protein homolog ydaGBacillus subtilis genome sequence, 148 kb sequence of the regionbetween 35 and 47 degree.FUNCTION UNKNOWN. |
| Contig140D | 29352342_c3_12 | 181 | 3018 | 531 | 177 | 371 | 3.00E-34 | Bacillus stearothermophilus | P24943 | gltPproton glutamate symport proteinBacillus stearothermophilus proton glutamate symport protein (gltP)gene, complete cds. |
| Contig140D | 32242200_f1_1 | 182 | 3019 | 378 | 126 | | | | | |
| Contig140D | 22042187_c2_15 | 183 | 3020 | 1401 | 467 | 1065 | 8.60E-108 | Klebsiella pneumoniae | g2735583 | rbiTribitol transporterKlebsiella pneumoniae ribitol kinase (rbtK) and ribitol transporter(rbtT) genes, complete cds.RbtT |
| Contig149D | 22947833_c1_12 | 184 | 3021 | 192 | 64 | | | | | |
| Contig149D | 31877334_c2_14 | 185 | 3022 | 521 | 174 | 432 | 1.00E-40 | Azorhizobium caulinodans | g763062 | AraC-like proteinA.caulinodans nodD gene.gtg start codon; homologous to AraC family of |

| | | | | | | | | |
|---|---|---|---|---|---|---|---|---|
| Contig149D | 6938816_c3_17 | 186 | 3023 | 453 | 151 | | | |
| Contig150D | 24645942_c1_12 | 187 | 3024 | 444 | 148 | 384 | 1.30E-35 | Haemophilus influenzae | l110670hypotheticalHaemophilus influenzae from bases 712950 to 723016 (section 65 of163) of the complete genome.similar to GB P44814 |
| Contig150D | 24713531_f2_5 | 188 | 3025 | 228 | 76 | | | |
| Contig150D | 26377250_c2_14 | 189 | 3026 | 711 | 237 | 643 | 4.50E-63 | Xanthomonas campestris | aminopeptidaseXanthomonas campestris DNA for aminopeptidase, complete cds. d1012290 |
| Contig150D | 29423955_c1_11 | 190 | 3027 | 183 | 61 | 90 | 5.20E-06 | Pseudomonas putida | pip1 proline iminopeptidasePseudomonas putida inducible histidine transporter (hutT),imidazolone propionate hydrolase (hutI), and N-formylglutamateamidohydrolase (hutG) genes, complete cds; and prolineiminopeptidase (pip1) gene, partial cds. g2642342 |
| Contig150D | 3179561_f1_2 | 191 | 3028 | 225 | 75 | | | |
| Contig150D | 32697905_c3_16 | 192 | 3029 | 207 | 69 | | | |
| Contig150D | 35207326_c1_13 | 193 | 3030 | 1191 | 397 | 1384 | 1.30E-141 | Escherichia coli | mdoGMdoG proteinEscherichia coli genomic DNA. (23.6 - 23.9 min). d1015377 |
| Contig150D | 35408180_f2_8 | 194 | 3031 | 261 | 87 | | | |
| Contig150D | 10008513_c1_34 | 195 | 3032 | 2667 | 889 | 3361 | 0 | Bacillus stearothermophilus | valSvaline--tRNA ligase,valine--tRNA ligase A26738 |
| Contig157D | 10720877_c2_39 | 196 | 3033 | 1329 | 443 | 1343 | 3.00E-137 | Bacillus subtilis | tigtrigger factor (prolyl isomerase)Bacillus subtilis complete genome (section 15 of 21)alternate gene name e1184072 |
| Contig157D | 1211562_c3_48 | 197 | 3034 | 1269 | 423 | 1518 | 8.50E-156 | Bacillus subtilis | clpXClpX proteinB.subtilis clpX gene.ATP-dependent protease P50866 |
| Contig157D | 188388_c1_38 | 198 | 3035 | 333 | 111 | 110 | 5.70E-06 | Bacillus subtilis | mreCMreC proteinBacillus subtilis orfA, orfB, mreB, mreC, mreD, minC, and minDgenes, complete coding regions. g142856 |
| Contig157D | 19707767_f3_22 | 199 | 3036 | 324 | 108 | | | |
| Contig157D | 20348160_f3_20 | 200 | 3037 | 222 | 74 | | | |

95

| | | | | | | | | |
|---|---|---|---|---|---|---|---|---|
| Contig157D | 23522567_c3_46 | 201 | 3038 | 381 | 127 | 450 | 1.30E-42 | Bacillus subtilis | P55873 | rplT Ribosomal protein L20 Bacillus subtilis complete genome (section 15 of 21) homology to rplT of Bacillus stearothermphilus; |
| Contig157D | 23697141_c3_50 | 202 | 3039 | 930 | 310 | 1327 | 1.50E-135 | Staphylococcus aureus | g2589181 | hemC porphobilinogen deaminase Staphylococcus aureus hemCDBL gene cluster |
| Contig157D | 24240877_c1_36 | 203 | 3040 | 522 | 174 | | | | | |
| Contig157D | 24665777_c3_45 | 204 | 3041 | 234 | 78 | 226 | 6.90E-19 | Bacillus subtilis | e1184135 | rpmI ribosomal protein L35 Bacillus subtilis complete genome (section 15 of 21) homology to rpmI of Bacillus stearothermophilus; |
| Contig157D | 24897312_c1_31 | 205 | 3042 | 186 | 62 | 255 | 5.90E-22 | Staphylococcus aureus | g632816 | hemB porphobilinogen synthase hemB = porphobilinogen synthase [Staphylococcus aureus, SA1959,Genomic, 1087 nt]This sequence comes from Fig. 3. Protein sequence |
| Contig157D | 25554642_c3_47 | 206 | 3043 | 486 | 162 | 363 | 2.10E-33 | Bacillus subtilis | P50619 | ymaB Y maBB.subtilis cwlC, nrdE, nrdF. ymaA and ymaB genes,no similarities, cannot be inactivated |
| Contig157D | 25596000_c1_30 | 207 | 3044 | 825 | 275 | 460 | 1.10E-43 | Bacillus subtilis | P16645 | hemX membrane-bound protein Bacillus subtilis hemAXCDBL gene cluster.unidentified gene product |
| Contig157D | 2866255_f2_17 | 208 | 3045 | 264 | 88 | | | | | |
| Contig157D | 315190_f2_12 | 209 | 3046 | 627 | 209 | 435 | 4.90E-41 | Haemophilus influenzae | P44321 | HI0654 DNA-3-methyladenine glycosidase I (tag) Haemophilus influenzae from bases 690801 to 702086 (section 63 of 163) of the complete genome. 3-methyladenine DNA glycosylase I similar to SP |
| Contig157D | 33395050_c3_49 | 210 | 3047 | 618 | 206 | 577 | 4.40E-56 | Bacillus subtilis | P38424 | ysxC hypothetical protein B. subtilis lon gene for protease La.orfX |
| Contig157D | 33517_c2_41 | 211 | 3048 | 1077 | 359 | 258 | 2.60E-21 | Bacillus subtilis | e1183059 | yhjN hypothetical protein Bacillus subtilis complete genome (section 6 of 21) TTG start; Similarity to a hypothetical protein |

| Contig | ID | SEQ ID NO | | | | E-value | Organism | Accession | Description |
|---|---|---|---|---|---|---|---|---|---|
| Contig157D | 34642092_c2_43 | 212 | 3049 | 1284 | 428 | 907 | 4.70E-91 | Bacillus subtilis | Q05865 | folC folyl-polyglutamate synthetase Bacillus subtilis valyl tRNA synthetase (valS) gene, 3' end cds;folyl-polyglutamate synthetase (folC) gene, complete cds; comCgene, 5' end cds. |
| Contig157D | 3914012_c3_51 | 213 | 3050 | 690 | 230 | 710 | 3.60E-70 | Staphylococcus aureus | g2589182 | hemD uroporphyrinogen III synthase Staphylococcus aureus hemCDBL gene cluster |
| Contig157D | 4080443_c1_32 | 214 | 3051 | 1296 | 432 | 2041 | 3.20E-211 | Staphylococcus aureus | g2589184 | hemL GSA-1-aminotransferase Staphylococcus aureus hemCDBL gene cluster |
| Contig157D | 439183_f3_24 | 215 | 3052 | 297 | 99 | 208 | 5.60E-17 | Bacillus subtilis | e1165375 | ysoC hypothetical protein B. subtilis genomic sequence 89009bp. unknown function; putative |
| Contig157D | 500052_c1_35 | 216 | 3053 | 669 | 223 | 440 | 1.50E-41 | Bacillus subtilis | Q02170 | orfB DNA repair protein homolog ysxA Bacillus subtilis orfA, orfB, mreB, mreC, mreD, minC, and minD genes, complete coding regions. homologous to E. coli radC gene product and to |
| Contig157D | 5268775_c1_28 | 217 | 3054 | 960 | 320 | 138 | 7.10E-07 | Bacillus subtilis | e1184073 | ysoA hypothetical protein Bacillus subtilis complete genome (section 15 of 21) unknown function; putative |
| Contig157D | 5860827_c1_29 | 218 | 3055 | 1347 | 449 | 1172 | 3.90E-119 | Bacillus subtilis | P16618 | hemA NAD(P)H Bacillus subtilis hemAXCDBL gene cluster. glutamyl-tRNA reductase The product of this hemA gene is not an |
| Contig157D | 6845382_f1_1 | 219 | 3056 | 219 | 73 | | | | | |
| Contig157D | 806510_c2_44 | 220 | 3057 | 714 | 238 | 189 | 5.80E-15 | Bacillus subtilis | P15378 | comC late competence protein Bacillus subtilis late competence protein (comC) gene, complete cds. |
| Contig157D | 820253_f3_25 | 221 | 3058 | 297 | 99 | 206 | 9.10E-17 | Bacillus subtilis | e1165375 | ysoC hypothetical protein B. subtilis genomic sequence 89009bp. unknown function; putative |
| Contig157D | 978562_c2_40 | 222 | 3059 | 861 | 287 | 1261 | 1.50E-128 | Staphylococcus aureus | P50915 | hemB d-aminolevulinic acid dehydratase Staphylococcus aureus hemCDBL gene cluster |
| Contig200D | 14900826_f3_4 | 223 | 3060 | 351 | 117 | 188 | 7.40E-15 | artificial sequence | g208931 | Synthetic E.coli ORF16/lacZ fusion protein, partial cds. ORF16-lacZ fusion protein |

| | | | | | | | | |
|---|---|---|---|---|---|---|---|---|
| Contig219D | 2214217_f1_2 | 224 | 3061 | 1845 | 615 | 1438 | 2.60E-147 | Bacillus subtilis | d1011961 | yycGtwo-component sensor histidine kinase [Yyc homolog yycGBacillus subtilis 36kb sequence between gntZ and trnY genesencoding 34 ORF's.homologous to sp |
| Contig219D | 24848452_f2_7 | 225 | 3062 | 792 | 264 | 223 | 1.40E-18 | Bacillus subtilis | d1011959 | yycFhypothetical protein yycIBacillus subtilis 36kb sequence between gntZ and trnY genesencoding 34 ORF's. |
| Contig219D | 33337760_f1_1 | 226 | 3063 | 705 | 235 | 954 | 5.00E-96 | Bacillus subtilis | P37478 | yycFunknownB. subtilis DNA, 180 kilobase region of replication origin.ompR proteinhomologous to sp |
| Contig219D | 34417813_f1_3 | 227 | 3064 | 807 | 269 | 851 | 4.10E-85 | Bacillus subtilis | d1011958 | yycFhypothetical protein yycIBacillus subtilis 36kb sequence between gntZ and trnY genesencoding 34 ORF's. |
| Contig219D | 4093937_f2_4 | 228 | 3065 | 192 | 64 | | | | | |
| Contig219D | 7223587_f2_6 | 229 | 3066 | 1401 | 467 | 218 | 4.10E-15 | Bacillus subtilis | d1011960 | yycHBacillus subtilis 36kb sequence between gntZ and trnY genesencoding 34 ORF's. |
| Contig241D | 30569025_c3_20 | 230 | 3067 | 2541 | 847 | 290 | 1.40E-21 | Caenorhabditis elegans | g1166621 | F35A5.1Caenorhabditis elegans cosmid F35A5. |
| Contig241D | 36042152_c3_21 | 231 | 3068 | 1152 | 384 | 202 | 1.90E-13 | Trypanosoma brucei | g530361 | I2 proteinT.brucei I2 mRNA for flagellar antigen. |
| Contig241D | 36042152_c3_22 | 232 | 3069 | 408 | 136 | 102 | 9.60E-06 | STAPHYLOCOCCUS AUREUS | P80544 | METHICILLIN-RESISTANT SURFACE PROTEIN (FRAGMENTS) |
| Contig255D | 12142768_c1_7 | 233 | 3070 | 300 | 100 | 110 | 3.50E-06 | Pyrococcus horikoshii | d1027343 | PHBW012106aa long hypothetical proteinPyrococcus horikoshii OT3 genomic DNA, 180023-216005 nt position,clone |
| Contig255D | 12603166_c3_17 | 234 | 3071 | 303 | 101 | 100 | 1.60E-05 | Pyrococcus horikoshii | d1027339 | PHBW012106aa long hypothetical proteinPyrococcus horikoshii OT3 genomic DNA, 180023-216005 nt position,clone |
| Contig255D | 14849093_f3_5 | 235 | 3072 | 294 | 98 | 127 | 2.10E-08 | Mitochondrion Chondrus crispus | e138028 | putative orf79.1C.crispus complete mitochondrial genome.unique orf |
| Contig255D | 14900826_f2_2 | 236 | 3073 | 351 | 117 | 188 | 7.40E-15 | artificial sequence | g208931 | Synthetic E.coli ORF16/lacZ fusion protein, partial cds.ORF16-lacZ fusion protein |
| Contig255D | 2379658_c2_10 | 237 | 3074 | 225 | 75 | | | | | |
| Contig255D | 285808_c2_12 | 238 | 3075 | 225 | 75 | | | | | |
| Contig255D | 3361326_f2_3 | 239 | 3076 | 207 | 69 | | | | | |
| Contig276D | 14147177_c2_3 | 240 | 3077 | 366 | 122 | | | | | |
| Contig276D | 23725442_c1_2 | 241 | 3078 | 411 | 137 | | | | | |

| | | | | | | | | |
|---|---|---|---|---|---|---|---|---|
| Contig278D | 194202_f3_8 | 242 | 3079 | 255 | 85 | | | |
| Contig278D | 20587536_c2_13 | 243 | 3080 | 630 | 210 | 241 | 1.80E-20 | Bacillus subtilis | P37467 | xpaChydrolysis of 5-bromo-4-chloroindolyl phosphateB. subtilis DNA, 180 kilobase region of replication origin. |
| Contig278D | 24615915_f2_5 | 244 | 3081 | 240 | 80 | 275 | 4.40E-24 | Staphylococcus aureus | g2226349 | cspCCspCStaphylococcus aureus CspC (cspC) gene, complete cds.similar to major cold-shock protein |
| Contig278D | 25423425_c3_16 | 245 | 3082 | 210 | 70 | | | | | |
| Contig278D | 25428378_c3_15 | 246 | 3083 | 228 | 76 | | | | | |
| Contig278D | 334770001_f2_4 | 247 | 3084 | 336 | 112 | 137 | 1.90E-09 | Streptococcus gordonii | g2058543 | putative DNA binding proteinStreptoococcus gordonii RNA polymerase beta' subunit (rpoC),putative DNA binding protein, putative ABC transporter subunitComYA (comYA), putative ABC transporter subunit ComYB (comYB) andComYC gene, complete cds, and ComYD gene, |
| Contig278D | 351159452_f2_3 | 248 | 3085 | 1302 | 434 | 1371 | 3.20E-140 | Staphylococcus aureus | g2315995 | branched-chain amino acid carrier proteinStaphylococcus aureus branched-chain amino acid carrier proteingene, complete cds.branched-chain amino acid transporter |
| Contig278D | 4718760_f3_9 | 249 | 3086 | 327 | 109 | | | | | |
| Contig278D | 4796875_c2_12 | 250 | 3087 | 315 | 105 | 146 | 2.10E-10 | Archaeoglobus fulgidus | g2649785 | AF0818acylphosphatase (acyP)Archaeoglobus fulgidus section 60 of 172 of the complete genome.similar to SP |
| Contig278D | 6442787_c3_17 | 251 | 3088 | 1179 | 393 | 923 | 9.60E-93 | Bacillus subtilis | P37535 | yaaNunknownB. subtilis DNA, 180 kilobase region of replication origin.similar to toxic cation resistance |
| Contig282D | 10563141_f1_4 | 252 | 3089 | 345 | 115 | | | | | |

| Contig282D | 12214635_c2_43 | 253 | 3090 | 387 | 129 | 202 | 2.40E-16 | Bacillus subtilis | Q08429 | kapB Kinase-associated protein B Bacillus subtilis putative aminotransferase (patB), ATP-dependent protein kinase B (kinB), kinase-associated protein B (kapB) and kapD (kapD) genes, complete cds.second and last ORF of the kinB-kapB operon; |
|---|---|---|---|---|---|---|---|---|---|---|
| Contig282D | 14460932_f2_13 | 254 | 3091 | 294 | 98 | 451 | 1.00E-42 | Staphylococcus haemolyticus | g1022726 | unknown Staphylococcus haemolyticus IS1272 ORF1 and ORF2 genes, complete cds.ORF1 |
| Contig282D | 14484553_f2_16 | 255 | 3092 | 1356 | 452 | 1726 | 7.70E-178 | Bacillus stearothermophilus | P13375 | PGIA glucose-6-phosphate isomerase, A Bacillus stearothermophilus pgiA gene for phosphoglucoisomeraseisoenzyme A (EC 5.3.1.9).glucose-6-phosphate isomerasephosphoglucose isomerase A (AA 1-449) |
| Contig282D | 150411078_f2_9 | 256 | 3093 | 279 | 93 | 319 | 9.70E-29 | Bacillus subtilis | e1184283 | yuiFconserved hypothetical protein yuiFBacillus subtilis complete genome (section 17 of 21)similar to hypothetical proteins |
| Contig282D | 21571937_c3_48 | 257 | 3094 | 213 | 71 | | | | | |
| Contig282D | 21646015_f3_24 | 258 | 3095 | 201 | 67 | 198 | 6.40E-16 | Staphylococcus haemolyticus | g1022725 | unknown Staphylococcus haemolyticus IS1272 ORF1 and ORF2 genes, complete cds.ORF2 |
| Contig282D | 22136087_c2_45 | 259 | 3096 | 1512 | 504 | 1214 | 1.40E-123 | Bacillus subtilis | e1184241 | yufDNADH dehydrogenase (ubiquinone) homolog yufDBacillus subtilis complete genome (section 17 of 21)similar to NADH dehydrogenase (ubiquinone) |
| Contig282D | 22462787_f1_8 | 260 | 3097 | 261 | 87 | 257 | 3.60E-22 | Staphylococcus aureus | g1595809 | spsAtype-I signal peptidase SpsAStaphylococcus aureus type-I signal peptidase SpsA (spsA) gene, andtype-I signal peptidase SpsB (spsB) gene, complete cds.inactive signal peptidase homologue; protein lacks |
| Contig282D | 23445958_f1_3 | 261 | 3098 | 243 | 81 | | | | | |

| | | | | | | | | |
|---|---|---|---|---|---|---|---|---|
| Contig282D | 23535910_f1_7 | 262 | 3099 | 603 | 201 | 358 | 7.10E-33 | Bacillus subtilis | e1183050 | yhjEhypothetical proteinBacillus subtilis complete genome (section 6 of 21)similar to hypothetical proteins from B. subtilis |
| Contig282D | 23859843_f1_5 | 263 | 3100 | 393 | 131 | 212 | 2.10E-17 | Bacillus subtilis | e1184217 | yugIunknownBacillus subtilis complete genome (section 17 of 21)similar to polyribonucleotide |
| Contig282D | 23947132_f3_17 | 264 | 3101 | 378 | 126 | 269 | 1.90E-23 | Bacillus licheniformis | e291128 | ComABB.licheniformis comAB gene. |
| Contig282D | 24644702_c1_33 | 265 | 3102 | 435 | 145 | 307 | 1.80E-27 | Bacillus subtilis | e1184239 | yufUunknownBacillus subtilis complete genome (section 17 of 21)similar to Na+/H+ antiporter |
| Contig282D | 24745437_f3_26 | 266 | 3103 | 1263 | 421 | 1659 | 9.70E-171 | Bacillus subtilis | P50735 | ypcAglutamate dehydrogenaseBacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC. spore cortexlytic enzyme (sleB), ypeB, ypfA, ypfB, cytidi |
| Contig282D | 26178400_f3_28 | 267 | 3104 | 186 | 62 | | | | | |
| Contig282D | 26756252_c3_54 | 268 | 3105 | 2427 | 809 | 2158 | 1.30E-223 | Bacillus subtilis | e1184238 | yufTunknownBacillus subtilis complete genome (section 17 of 21)similar to NADH dehydrogenase |
| Contig282D | 29742890_f2_14 | 269 | 3106 | 189 | 63 | | | | | |
| Contig282D | 31281253_f3_25 | 270 | 3107 | 1221 | 407 | 1513 | 2.90E-155 | Bacillus subtilis | P38021 | rocDornithine aminotransferaseBacillus subtilis 36kb sequence between gntZ and trnY genesencoding 34 ORFs. |
| Contig282D | 32689812_c2_46 | 271 | 3108 | 312 | 104 | 224 | 1.10E-18 | Bacillus subtilis | e1184242 | yufCunknownBacillus subtilis complete genome (section 17 of 21) |
| Contig282D | 33397338_c3_55 | 272 | 3109 | 492 | 164 | 167 | 1.20E-12 | Pyrococcus horikoshii | d1028563 | PHCC005174a long hypothetical proteinPyrococcus horikoshii OT3 genomic DNA, 1300517-1338254 nt position,clone |
| Contig282D | 34384380_c1_34 | 273 | 3110 | 333 | 111 | 278 | 2.10E-24 | Bacillus subtilis | e1184240 | yufVunknownBacillus subtilis complete genome (section 17 of 21)similar to Na+/H+ antiporter |
| Contig282D | 34617286_f2_12 | 274 | 3111 | 612 | 204 | 336 | 8.30E-40 | Homo sapiens | d1008136 | KIAA0073Human mRNA for KIAA0073 gene, partial cds.The ha1539 protein is related to cyclophilin. |

| | | | | | | | | |
|---|---|---|---|---|---|---|---|---|
| Contig282D | 36604587_c1_35 | 275 | 3112 | 1173 | 391 | | | | |
| Contig282D | 3985893_c3_53 | 276 | 3113 | 186 | 62 | | | | |
| Contig282D | 4100393_c3_47 | 277 | 3114 | 1215 | 405 | 1458 | 1.90E-149 | Bacillus subtilis | g2293242 | argGarginine succinate synthaseBacillus subtilis rrnB-dnaB genomic region. |
| Contig282D | 48587_c3_49 | 278 | 3115 | 1062 | 354 | 729 | 3.50E-72 | Bacillus subtilis | P37965 | glpQglycerophosphoryl diester phosphodiesteraseB.subtilis glpT and glpQ genes for glycerol 3-phosphate permeaseand glycerophosphoryl diester phosphodiesterase.alternate gene name |
| Contig282D | 5085003_c1_32 | 279 | 3116 | 1455 | 485 | 1439 | 2.00E-147 | Bacillus subtilis | g2293243 | argHarginine succinate lyaseBacillus subtilis rrnB-dnaB genomic region. |
| Contig282D | 5114680_c3_56 | 280 | 3117 | 363 | 121 | 227 | 5.40E-19 | Bacillus subtilis | e1184243 | yutfBunknownBacillus subtilis complete genome (section 17 of 21)similar to hypothetical proteins |
| Contig282D | 6672886_f3_23 | 281 | 3118 | 1173 | 391 | 914 | 8.60E-92 | Bacillus subtilis | P54524 | yqiGYqiGBacillus subtilis DNA, 283 Kb region containing skin element,similar to NADH-dependent flavin oxidoreductase |
| Contig282D | 783125_c3_52 | 282 | 3119 | 183 | 61 | | | | |
| Contig282D | 10031712_f2_69 | 283 | 3120 | 990 | 330 | 597 | 3.40E-58 | Bacillus subtilis | P54538 | yqjAYqjABacillus subtilis DNA, 283 Kb region containing skin element. |
| Contig296D | 10312561_f1_26 | 284 | 3121 | 1236 | 412 | 996 | 1.80E-100 | Bacillus subtilis | P38494 | ypfDunknownBacillus subtilis phosphoglycerate dehydrogenase (serA), ypaA,ferredoxin (fer), ypbB, recS, ypbD, ypbE, ypbF, ypbG, ypbI,glutamate dehydrogenase (ypcA), ypdA, ypdB, ypdC, spore cortexlytic enzyme (slcB), ypcB, ypfA, ypfB, cytidine monophosphate |
| Contig296D | 10334752_c3_311 | 285 | 3122 | 192 | 64 | | | | |
| Contig296D | 10642180_f3_143 | 286 | 3123 | 186 | 62 | | | | |
| Contig296D | 1070437_f1_37 | 287 | 3124 | 894 | 298 | 727 | 5.60E-72 | Bacillus subtilis | P54161 | ypcPexodeoxyribonucleaseBacillus subtilis (YAC10-9 clone) DNA region between the serA andkdg loci.36.1% identity with 219 aa at the 5' end of the |

101

| | | | | | | | | | |
|---|---|---|---|---|---|---|---|---|---|
| Contig296D | 1229750_f1_8 | 288 | 3125 | 468 | 156 | 504 | 2.40E-48 | Bacillus stearothermophilus | e290687 | argR Arginine repressor B.stearothermophilus argR gene. |
| Contig296D | 1345752_c1_194 | 289 | 3126 | 945 | 315 | 720 | 3.10E-71 | Bacillus subtilis | P54569 | yqkF YqkF Bacillus subtilis DNA, 283 Kb region containing skin element.similar to hypothetical proteins |
| Contig296D | 13853500_c2_221 | 290 | 3127 | 246 | 82 | | | | | |
| Contig296D | 13876943_f1_46 | 291 | 3128 | 1488 | 496 | 882 | 2.10E-88 | Bacillus subtilis | g2529476 | orfRM1 OrfRM1 Bacillus subtilis 168 region at 182 min containing the oge genecluster.similar to the E. coli PrcC and carboxyl-terminal |
| Contig296D | 14097011_f1_1 | 292 | 3129 | 612 | 204 | 522 | 3.00E-50 | Bacillus stearothermophilus | | argJ ornithine acetyltransferase Bacillus stearothermophilus ornithine acetyltransferase (argJ) andacetylglutamate kinase (argB) genes, complete cds's, argC gene, 3'end, and argD gene, 5' end.also bears acetyl-CoA |
| Contig296D | 16610088_f1_21 | 293 | 3130 | 393 | 131 | 217 | 6.20E-18 | Bacillus subtilis | Q07908 | ypaA hypothetical protein ypaA Bacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypcB, ypfA, ypfB, cyti |
| Contig296D | 16923383_f1_15 | 294 | 3131 | 339 | 113 | 156 | 2.60E-11 | Bacillus subtilis | P50726 | yqiQ YqiQ Bacillus subtilis DNA, 283 Kb region containing skin element.similar to ketoacyl reductase |
| Contig296D | 17002217_f1_16 | 295 | 3132 | 465 | 155 | 587 | 3.90E-57 | Bacillus subtilis | P54554 | yqkL YqkL Bacillus subtilis DNA, 283 Kb region containing skin element.similar to transcriptional regulator (Fur family) |

| | | | | | | | | | |
|---|---|---|---|---|---|---|---|---|---|
| Contig296D | 187593_f2_77 | 296 | 3133 | 972 | 324 | 177 | 3.20E-12 | Bacillus subtilis | P50728 | ypbBhypothetical protein ypbBBacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypeB, ypfA, ypfB, cyti |
| Contig296D | 19567588_f3_136 | 297 | 3134 | 513 | 171 | 443 | 7.00E-42 | Bacillus stearothermophilus | P42015 | ptsG'PTS glucose-specific permeaseBacillus stearothermophilus XL 65-6 phosphoenolpyruvate-dependentphosphotransferase system glucose-specific permease (ptsG') gene,partial cds, HPr (ptsH), enzyme I (ptsI), and PtsT (ptsT) genes,complete cds, and wall asso |
| Contig296D | 19567812_f3_135 | 298 | 3135 | 465 | 155 | 478 | 1.40E-45 | Bacillus subtilis | P54155 | yppQtranscriptional regulator (PilB family) homolog yppQBacillus subtilis (YAC10-9 clone) DNA region between the serA andkdg loci.54.8% identity with Neisseria gonorrhoeae |
| Contig296D | 19804838_c2_224 | 299 | 3136 | 717 | 239 | 549 | 4.10E-53 | Bacillus subtilis | P54163 | ypdPconserved hypothetical protein ypdPBacillus subtilis (YAC10-9 clone) DNA region between the serA andkdg loci.putative |
| Contig296D | 20035967_f2_78 | 300 | 3137 | 1059 | 353 | 920 | 2.00E-92 | Bacillus subtilis | g1146220 | glyCNAD+ dependent glycerol-3-phosphateBacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypfA, |
| Contig296D | 20485712_f3_137 | 301 | 3138 | 573 | 191 | | | | | |

| Contig296D | 20507937_f3_124 | 302 | 3139 | 1317 | 439 | 1823 | 4.10E-188 | Bacillus subtilis | P39772 | asnSasparaginyl-tRNA synthetaseBacillus subtilis (clone YAC15-6B) ypjABF genes, qcrABC genes,ypjABCDEFGHI genes, birA gene, panBCD genes, dinG gene, ypmB gene,aspB gene, asnS gene, dnaD gene, nth gene and ypoC gene, completecds's,41.1% of identity to the |
|---|---|---|---|---|---|---|---|---|---|---|
| Contig296D | 20517135_f1_27 | 303 | 3140 | 315 | 105 | 361 | 3.40E-33 | Bacillus stearothermophilus | P02346 | hubstDNA binding protein IIUBacillus stearothermophilus gene for DNA binding protein HU,complete cds.bacterial DNA-binding protein |
| Contig296D | 20594688_f2_100 | 304 | 3141 | 1725 | 575 | 126 | 5.10E-08 | Bacillus subtilis | P37966 | lplAlysis proteinBacillus subtilis lysis protein (lplA) gene, complete cds. |
| Contig296D | 20734677_f1_53 | 305 | 3142 | 774 | 258 | 277 | 2.70E-24 | Escherichia coli | g1789829 | glpRrepressor proteinEscherichia coli K-12 MG1655 section 308 of 400 of the completegenome.f252; CG Site No. 688 |
| Contig296D | 2148387_f2_82 | 306 | 3143 | 1278 | 426 | 1794 | 4.80E-185 | Staphylococcus aureus | Q59803 | aroCchorismate synthaseStaphylococcus aureus chorismate synthase (aroC) and nucleosidediphosphate kinase (ndk) genes, complete cds, dehydroauinatesynthase (aroB) and geranylgeranyl pyrophosphate synthetase homolog(gerCC) genes, partial cds.5-enolpyruvylsh |
| Contig296D | 21501550_f1_48 | 307 | 3144 | 1116 | 372 | 917 | 4.10E-92 | Bacillus subtilis | e1186380 | msmXmultiple sugar-binding transport ATP-bindingBacillus subtilis complete genome (section 20 of 21)alternate gene name |
| Contig296D | 21537962_f2_86 | 308 | 3145 | 612 | 204 | 357 | 9.10E-33 | Bacillus subtilis | P54392 | ypjAhypothetical protein ypjABacillus subtilis (clone YAC15-6B) ypjABF genes, qcrABC genes,ypjABCDEFGHI genes, birA gene, panBCD genes, dinG gene, ypmB gene,aspB gene, asnS gene, dnaD gene, nth gene and ypoC gene, completecds's, putative |
| Contig296D | 21674067_c1_151 | 309 | 3146 | 198 | 66 | | | | | |

| | | | | | | | | |
|---|---|---|---|---|---|---|---|---|
| Contig296D | 21678187_f3_131 | 310 | 3147 | 240 | 80 | | | |
| Contig296D | 21730443_f2_67 | 311 | 3148 | 1332 | 444 | 904 | 9.90E-91 | Bacillus subtilis | P37942 | bfmBBbranched chain alpha-keto acid dehydrogenase E2Bacillus subtilis branched chain alpha-keto acid dehydrogenaseE1-alpha, branched chain alpha-keto acid dehydrogenase E1-beta, andbranched chain alpha-keto acid dehydrogenase E2, complete cds.dihydrolipoa |
| Contig296D | 21756562_f3_127 | 312 | 3149 | 696 | 232 | 162 | 4.20E-12 | Bacillus subtilis | e1182974 | yheGhypothetical proteinBacillus subtilis complete genome (section 6 of 21)similar to calcium-binding protein |
| Contig296D | 21914067_f3_142 | 313 | 3150 | 1416 | 472 | 532 | 2.60E-51 | Lactococcus lactis cremoris | g2182835 | llkinAhistidine kinase L.kinALactococcus lactis subsp. cremoris MG1363 histidine kinase (llkinA)gene, complete cds. |
| Contig296D | 21962762_f1_56 | 314 | 3151 | 732 | 244 | 615 | 4.20E-60 | Bacillus subtilis | g143267 | B.subtilis 2-oxoglutarate dehydrogenase (odhA) gene 3' end, anddihydrolipoamide transsuccinylase (odhB) gene, complete cds.2-oxoglutarate dehydrogenase (odhA; EC 1.2.4.2) |
| Contig296D | 23445266_f1_45 | 315 | 3152 | 567 | 189 | 579 | 2.70E-56 | Bacillus subtilis | P54154 | yppPDNA-binding proteinBacillus subtilis (YAC10-9 clone) DNA region between the serA andkdg loci.42.4% identity with the Lycopersicon esculentum |
| Contig296D | 23625000_f3_110 | 316 | 3153 | 1683 | 561 | 2374 | 1.70E-246 | Staphylococcus xylosus | g474177 | malAalpha-D-1,4-glucosidaseS.xylosus malR gene and malA gene.alpha-amylase core homology |
| Contig296D | 23707890_f2_95 | 317 | 3154 | 240 | 80 | 123 | 5.70E-08 | Bacillus subtilis | e1185439 | yozEhypothetical protein yozEBacillus subtilis complete genome (section 11 of 21) |
| Contig296D | 23836052_c1_195 | 318 | 3155 | 849 | 283 | 392 | 1.80E-36 | Bacillus subtilis | P54552 | yqjOYqjOBacillus subtilis DNA, 283 Kb region containing skin element.similar to pyrroline-5-carboxylate reductase |
| Contig296D | 23884692_f1_5 | 319 | 3156 | 366 | 122 | 217 | 6.20E-18 | Bacillus subtilis | P54519 | yqhYYqhYBacillus subtilis DNA, 283 Kb region containing skin element.similar to hypothetical proteins from B. subtilis |

| Contig296D | 23964011_c2_214 | 320 | 3157 | 195 | 65 | | | | | bfmBAAbranched chain alpha-keto acid dehydrogenaseBacillus subtilis branched chain alpha-keto acid dehydrogenaseE1-alpha, branched chain alpha-keto acid dehydrogenase E1-beta, andbranched chain alpha-keto acid dehydrogenase E2, complete cds,pyruvate dehyd |
|---|---|---|---|---|---|---|---|---|---|---|
| Contig296D | 24100715_f1_11 | 321 | 3158 | 1035 | 345 | 888 | 4.90E-89 | Bacillus subtilis | P37940 | |
| Contig296D | 24104702_f2_93 | 322 | 3159 | 30549 | 10183 | 618 | 8.80E-55 | Plasmodium yoelii | gI041785 | rhoptry proteinPlasmodium yoelii rhoptry protein gene, partial cds. |
| Contig296D | 24226412_f2_73 | 323 | 3160 | 570 | 190 | 437 | 3.00E-41 | Bacillus subtilis | P54570 | yqkGYqkGBacillus subtilis DNA, 283 Kb region containing skin element,similar to hypothetical proteins |
| Contig296D | 24229515_f1_12 | 324 | 3161 | 1170 | 390 | 980 | 8.70E-99 | Bacillus subtilis | P54542 | yqiEYqiEBacillus subtilis DNA, 283 Kb region containing skin element,similar to tripeptidase |
| Contig296D | 24261692_f3_148 | 325 | 3162 | 1902 | 634 | 995 | 2.20E-100 | Bacillus subtilis | g3169331 | yojOYojOBacillus subtilis YojA (yojA), YojB (yojB), YojC (yojC), YojD(yojD), YojE (yojE), YojF (yojF), YojG (yojG), YojH (yojH), YojI(yojI), YojJ (yojJ), YojK (yojK), YojL (yojL), YojM (yojM), YojN(yojN), and YojO (yojO) genes, complete cds; and OdhA (odh |
| Contig296D | 24274192_c2_225 | 326 | 3163 | 417 | 139 | 204 | 1.50E-16 | Enterococcus faecalis | P36921 | ebsIBcell wall enzymeEnterococcus faecalis pore forming, cell wall enzyme, regulatory,and dehydroquinase homologue proteins (ebsA,ebsB,ebsC,and ebsD)genes, complete cds with repeat region,putative |
| Contig296D | 24410300_f2_74 | 327 | 3164 | 759 | 253 | 686 | 1.20E-67 | Bacillus subtilis | P35159 | ypuLconserved hypothetical protein ypuLBacillus subtilis spoVA to serA region,ORFX13 |
| Contig296D | 24480275_f3_138 | 328 | 3165 | 990 | 330 | 602 | 9.90E-59 | Bacillus subtilis | e1182690 | lplBtransmembrane lipoproteinBacillus subtilis complete genome (section 4 of 21) |

| | | | | | | | | | |
|---|---|---|---|---|---|---|---|---|---|
| Contig296D | 24511676_f1_57 | 329 | 3166 | 246 | 82 | 251 | 3.50E-21 | Bacillus subtilis | P16263 | odhB2-oxoglutarate dehydrogenase complexB.subtilis 2-oxoglutarate dehydrogenase (odhA) gene 3' end, anddihydrolipoamide transsuccinylase (odhB) gene, complete cds.dihydrolipoamide acetyltransferasedihydrolipoamide transsuccinylase (odhB); EC |
| Contig296D | 24650016_f1_34 | 330 | 3167 | 417 | 139 | 155 | 2.30E-11 | Bacillus subtilis | P50839 | ypsBhypothetical protein ypsBBacillus subtilis (clone YAC15-6B) ponA gene, yppBCDEFG genes,ypqAE genes, yprAB genes, cotD gene, ypsABC genes, maP gene, yptAgene, ypuA gene, kduDI genes, kdgRKAT genes, ypwA gene, completecds's,putative |
| Contig296D | 24650252_c2_235 | 331 | 3168 | 633 | 211 | 549 | 4.10E-53 | Bacillus subtilis | P39792 | yppBunknownBacillus subtilis (clone YAC15-6B) ponA gene, yppBCDEFG genes,ypqAE genes, yprAB genes, cotD gene, ypsABC genes, maP gene, yptAgene, ypuA gene, kduDI genes, kdgRKAT genes, ypwA gene, completecds's,50.3% of identity to the 23.1 kD protein from |
| Contig296D | 24797827_f3_144 | 332 | 3169 | 1857 | 619 | 1242 | 1.50E-126 | Bacillus subtilis | P23129 | odhAoxoglutarate dehydrogenase (NADP+)B. subtilis odhA gene for 2-oxoglutarate dehydrogenase.alternate gene name |
| Contig296D | 24800461_f1_55 | 333 | 3170 | 231 | 77 | 235 | 1.40E-18 | Bacillus subtilis | P23129 | odhAoxoglutarate dehydrogenase (NADP+)B. subtilis odhA gene for 2-oxoglutarate dehydrogenase.alternate gene name |
| Contig296D | 24807790_f2_63 | 334 | 3171 | 909 | 303 | 687 | 9.80E-68 | Bacillus stearothermophilus | Q08291 | farnesyl diphosphate synthaseB. stearothermophilus DNA for farnesyl diphosphate synthase,complete cds. |
| Contig296D | 25598818_f1_9 | 335 | 3172 | 1692 | 564 | 1195 | 1.40E-121 | Bacillus subtilis | P17894 | recNRecNBacillus subtilis DNA, 283 Kb region containing skin element.recN proteinrecombination protein (ttg start codon) |
| Contig296D | 25652217_f1_32 | 336 | 3173 | 348 | 116 | | | | | |
| Contig296D | 26058467_f2_72 | 337 | 3174 | 213 | 71 | 119 | 7.60E-07 | Caenorhabditis elegans | g861340 | F04F6.7Caenorhabditis elegans cosmid E04F6.similar to ribitol dehydrogenase |

| | | | | | | | | |
|---|---|---|---|---|---|---|---|---|
| Contig296D | 26225463_f3_114 | 338 | 3175 | 741 | 247 | 821 | 6.20E-82 | Bacillus subtilis | P35163 | resDtwo-component response regulatorBacillus subtilis spoVA to serA region.ompR proteinORFX17 |
| Contig296D | 26259657_f2_65 | 339 | 3176 | 1425 | 475 | 1155 | 2.50E-117 | BACILLUS SUBTILIS | P54533 | BFMBCDEHYDROGENASE)(LPD-VAL) |
| Contig296D | 26306713_f2_101 | 340 | 3177 | 912 | 304 | 580 | 2.10E-56 | Thermoanaerobacterium thermosulfurigenes | gl255237 | xynBXynBThermoanaerobacterium thermosulfurigenes endoxylanase precursor(XynA) and membrane component of an ABC transporter (XynB) genes,complete cds and XynC (xynC) gene, partial cds.Description |
| Contig296D | 26368950_f3_116 | 341 | 3178 | 1380 | 460 | 744 | 3.90E-76 | Bacillus subtilis | P50729 | recSDNA or RNA helicase, DNA-dependent ATPaseBacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypeB, |
| Contig296D | 26384682_f2_85 | 342 | 3179 | 1248 | 416 | 561 | 2.20E-54 | Bacillus subtilis | P54389 | ypiAconserved hypothetical protein ypiABacillus subtilis (clone YAC15-6B) ypiABF genes, qcrABC genes,ypjABCDEFGHI genes, birA gene, panBCD genes, dinG gene, ypmB gene,aspB gene, asnS gene, dnaD gene, nth gene and ypoC gene, completecds's.putative |
| Contig296D | 26597186_f2_68 | 343 | 3180 | 444 | 148 | 544 | 1.40E-52 | Bacillus subtilis | P54534 | yqjWYqjWBacillus subtilis DNA, 283 Kb region containing skin element.similar to hypothetical proteins from B. subtilis |
| Contig296D | 26600137_c3_304 | 344 | 3181 | 531 | 177 | 188 | 7.40E-15 | Bacillus subtilis | P17617 | ypuFhypothetical protein X6Bacillus subtilis spoVA to serA region.ORFX6 |
| Contig296D | 26754662_f1_25 | 345 | 3182 | 672 | 224 | 514 | 2.10E-49 | Bacillus subtilis | P38493 | cmkcytidine monophosphate kinaseBacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypeB, ypfA, ypfB, c |

| | | | | | | | | |
|---|---|---|---|---|---|---|---|---|
| Contig296D | 26774062_f3_119 | 346 | 3183 | 1332 | 444 | 1670 | 6.70E-172 | Bacillus subtilis | P50743 | yphCconserved hypothetical protein yphCBacillus subtilis phosphoglycerate dehydrogenase (serA), ypaA,ferredoxin (fer), ypbB, recS, ypbD, ypbE, ypbF, ypbG, ypbI1,glutamate dehydrogenase (ypcA), ypdA, ypdB, ypdC, spore cortex lytic enzyme (slcB), ypeB, ypfA, |
| Contig296D | 2756288_f1_18 | 347 | 3184 | 183 | 61 | | | | |
| Contig296D | 29457167_f1_43 | 348 | 3185 | 546 | 182 | 854 | 2.00E-85 | Staphylococcus epidermidis | Q59908 | dlrCdihydrofolate reductaseS.epidermidis thyF and dlrC genes,type I dihydrofolate reductase homology |
| Contig296D | 29532252_c2_223 | 349 | 3186 | 195 | 65 | | | | |
| Contig296D | 29570250_f3_113 | 350 | 3187 | 813 | 271 | 491 | 5.70E-47 | Bacillus subtilis | P35154 | ypuGconserved hypothetical protein ypuGBacillus subtilis spoVA to serA region,ORFX7 |
| Contig296D | 30085926_c2_256 | 351 | 3188 | 1554 | 518 | 1534 | 1.70E-157 | Bacillus subtilis | P54547 | yqjIYqjIBacillus subtilis DNA, 283 Kb region containing skin element,similar to glucose-6-phosphate 1-dehydrogenase |
| Contig296D | 30682927_f3_145 | 352 | 3189 | 828 | 276 | 211 | 2.70E-17 | Bacillus subtilis | e1181488 | ykcAYkcABacillus subtilis 168 56 kb DNA fragment between xlyA and ykoR, putative dioxygenase |
| Contig296D | 31306926_f3_140 | 353 | 3190 | 891 | 297 | 215 | 4.40E-16 | Saccharomyces cerevisiae | g609417 | YLR361CYlr361cpSaccharomyces cerevisiae chromosome XII cosmid 8039. |
| Contig296D | 31525262_f1_6 | 354 | 3191 | 393 | 131 | 275 | 4.40E-24 | Bacillus subtilis | P54520 | yqhZYqhZBacillus subtilis DNA, 283 Kb region containing skin element,similar to transcription termination |
| Contig296D | 317990057_f1_17 | 355 | 3192 | 918 | 306 | 855 | 1.50E-85 | Bacillus subtilis | P46352 | ripXYqkMBacillus subtilis DNA, 283 Kb region containing skin element,alternate gene name |
| Contig296D | 3182261_c1_190 | 356 | 3193 | 210 | 70 | 190 | 4.50E-15 | BACILLUS THERMOPROTEOLYTICUS | P10245 | ferredoxin [4Fe-4S]FERREDOXIN[ferredoxin 2[4Fe-4S |

| Contig296D | 32078568_f2_94 | 357 | 3194 | 969 | 323 | 1734 | 1.10E-178 | Staphylococcus aureus | P13954 | thyEThyEStaphylococcus aureus multi-resistance plasmid pSK1 DNA containingtransposon Tn4003.thymidylate synthasethymidylate synthetase (AA 1-318) |
|---|---|---|---|---|---|---|---|---|---|---|
| Contig296D | 33492927_f2_88 | 358 | 3195 | 705 | 235 | 358 | 7.10E-33 | Bacillus subtilis | P39787 | dnaDDnaD proteinBacillus subtilis (clone YAC15-6B) ypiABF genes, qcrABC genes,ypjABCDEFGHI genes, birA gene, panBCD genes, dinG gene, ypmB gene,aspB gene, asnS gene, dnaD gene, nth gene and ypoC gene, completecds's. |
| Contig296D | 33543_f1_59 | 359 | 3196 | 246 | 82 | 272 | 1.30E-23 | Bacillus subtilis | P16263 | odhB2-oxoglutarate dehydrogenase complexB.subtilis 2-oxoglutarate dehydrogenase (odhA) gene 3' end, anddihydrolipoamide transsuccinylase (odhB) gene, complete cds.dihydrolipoamide acetyltransferasedihydrolipoamide transsuccinylase (odhB; FC |
| Contig296D | 33646056_f2_75 | 360 | 3197 | 294 | 98 | 188 | 7.40E-15 | Bacillus subtilis | P50726 | ypaAhypothetical protein ypaABacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypeB, ypfA, ypfB, cyti |
| Contig296D | 34017062_f2_97 | 361 | 3198 | 1101 | 367 | 537 | 7.70E-52 | Borrelia burgdorferi | g2688704 | BB0767UDP-N-acetylglucosamine--N-acetylmuramyl-Borrelia burgdorferi (section 62 of 70) of the complete genome.similar to GB |
| Contig296D | 34027217_f3_118 | 362 | 3199 | 999 | 333 | 986 | 2.00E-99 | Bacillus subtilis | P50736 | ypdAthioredoxin reductase homolog ypdABacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypeB, ypfA, y |

| | | | | | | | | |
|---|---|---|---|---|---|---|---|---|
| Contig296D | 34415925_f3_106 | 363 | 3200 | 1134 | 378 | 905 | 7.70E-91 | Bacillus subtilis | P36839 | argDN-acetylornithine aminotransferaseB.subtilis (168) DNA for argC-F citrulline biosynthetic operon. |
| Contig296D | 34430342_f1_29 | 364 | 3201 | 711 | 237 | 475 | 2.80E-45 | Bacillus subtilis | e1184209 | yugPunknownBacillus subtilis complete genome (section 17 of 21) |
| Contig296D | 34432787_f2_87 | 365 | 3202 | 1221 | 407 | 672 | 3.80E-66 | Bacillus subtilis | P42977 | ypiIpoly(A) polymeraseBacillus subtilis (clone YAC15-6B) ypiABF genes, qcrABC genes,ypjABCDEFGHI genes, birA gene, panBCD genes, dinG gene, ypmB gene,aspB gene, asnS gene, dnaD gene, nth gene and ypoC gene, completecds.38.9% of identical aminoacids with |
| Contig296D | 35050_f1_38 | 366 | 3203 | 210 | 70 | | | | | |
| Contig296D | 35370250_f3_146 | 367 | 3204 | 222 | 74 | 199 | 5.00E-16 | Bacillus subtilis | e1185402 | yozChypothetical protein yozCBacillus subtilis complete genome (section 11 of 21) |
| Contig296D | 35975878_f3_132 | 368 | 3205 | 282 | 94 | 162 | 2.00E-11 | Bacillus subtilis | P54169 | ypgRconserved hypothetical protein ypgRBacillus subtilis (YAC10-9 clone) DNA region between the serA andkdg loci.25.8% identity over 120 aa with the Synenococcus |
| Contig296D | 36135875_f1_31 | 369 | 3206 | 1164 | 388 | 1034 | 1.70E-104 | Bacillus subtilis | P42982 | ypjIlipopolysaccharide biosynthesis-related pr homolog ypjHBacillus subtilis (clone YAC15-6B) ypiABF genes, qcrABC genes,ypjABCDEFGHI genes, birA gene, panBCD genes, dinG gene, ypmB gene,aspB gene, asnS gene, dnaD gene, nth gene and ypoC gene, completecds |
| Contig296D | 3915886_f2_66 | 370 | 3207 | 1014 | 338 | 1156 | 2.00E-117 | Bacillus subtilis | P37941 | bfmBABbranched chain alpha-keto acid dehydrogenaseBacillus subtilis branched chain alpha-keto acid dehydrogenaseE1-alpha, branched chain alpha-keto acid dehydrogenase E1-beta, andbranched chain alpha-keto acid dehydrogenase E2, complete cds,pyruvate dehyd |
| Contig296D | 3944838_f1_44 | 371 | 3208 | 858 | 286 | 791 | 9.30E-79 | Staphylococcus epidermidis | g886711 | ORF3unknownS.epidermidis thyF and dfrC genes. |

| Contig296D | 4007343_f2_98 | 372 | 3209 | 627 | 209 | 302 | 6.10E-27 | Bacillus megaterium | g288301 | ORF2hypothetical protein 2B.megaterium cytochrome P450mcg, ORF1 and ORF2 genes. |
|---|---|---|---|---|---|---|---|---|---|---|
| Contig296D | 4022203_f3_108 | 373 | 3210 | 1347 | 449 | 933 | 8.30E-94 | Bacillus subtilis | P54521 | yqiBYqiBBacillus subtilis DNA, 283 Kb region containing skin element,similar to exodeoxyribonuclease VII (large |
| Contig296D | 4086088_f1_2 | 374 | 3211 | 747 | 249 | 404 | 9.50E-38 | Lactobacillus plantarum | e284231 | argBacetylglutamate kinaseL.plantarum carA & ORF8 partial CDS, argC,J,B,D,F & ORF7 citrullinebiosynthetic operon. |
| Contig296D | 4101018_f1_54 | 375 | 3212 | 669 | 223 | 507 | 1.20E-48 | Bacillus subtilis | e1181525 | ykoGYkoGBacillus subtilis 168 56 kb DNA fragment between xlyA and ykoR,homologous to response regulators |
| Contig296D | 4103377_f2_61 | 376 | 3213 | 615 | 205 | 498 | 1.00E-47 | Lactobacillus plantarum | e284230 | argLglutamate N-acetyltransferaseL.plantarum carA & ORF8 partial CDS, argC,J,B,D,F & ORF7 citrullinebiosynthetic operon. |
| Contig296D | 4166443_c1_178 | 377 | 3214 | 2241 | 747 | 3168 | 0 | Staphylococcus aureus | g483534 | penicillin-binding protein 2S.aureus DNA for penicillin-binding protein 2. |
| Contig296D | 4336687_f1_42 | 378 | 3215 | 678 | 226 | 465 | 3.30E-44 | Methanococcus jannaschii | Q58206 | MJ0796ABC transporter, ATP-binding proteinMethanococcus jannaschii section 66 of 150 of the complete genome.unassigned ATP-binding cassette proteinsimilar to SP |
| Contig296D | 4476577_f2_81 | 379 | 3216 | 480 | 160 | 627 | 2.20E-61 | Staphylococcus aureus | P50588 | ndknucleoside diphosphate kinaseStaphylococcus aureus chorismate synthase (aroC) and nucleosidediphosphate kinase (ndk) genes, complete cds, dehydroauinatesynthase (aroB) and geranylgeranyl pyrophosphate synthetase homolog(gerCC) genes, partial cds.ATP |
| Contig296D | 4494143_f2_79 | 380 | 3217 | 588 | 196 | 105 | 7.30E-06 | Micrococcus luteus | d1026194 | hexs-acomponent A of hexaprenyl diphosphate synthaseMicrococcus luteus hexs-a, menG, hexs-b gene, complete cds. |

113

| Contig296D | 4510443_f3_123 | 381 | 3218 | 2721 | 907 | 728 | 2.10E-100 | Bacillus subtilis | P54394 | dinGATP-dependent helicaseBacillus subtilis (clone YAC15-6B) ypiABF genes, qcrABC genes,ypiABCDEFGHI genes, birA gene, panBCD genes, dinG gene, ypmB gene,aspB gene, asnS gene, dnaD gene, nth gene and ypoC gene, completecds.s.22.4% identity with Escherichi |
| Contig296D | 4570393_f2_83 | 382 | 3219 | 1074 | 358 | 617 | 2.60E-60 | Bacillus subtilis | P31102 | aroBAroBB.subtilis dbpA, mtr(A,B), gerC(1-3), ndk, cheR, aro(B,E,F,H),trp(A-F), hisH, and tyrA genes, complete cds. |
| Contig296D | 4689075_c1_196 | 383 | 3220 | 906 | 302 | 275 | 4.40E-24 | Bacillus subtilis | d1020105 | ydeEtranscriptional regulator (AraC/XylS famil) homolog ydeEBacillus subtilis genome sequence, 148 kb sequence of the regionbetween 35 and 47 degree.PROBABLE IITH_ARAC_FAMILY OF TRANSCRIPTIONAL |
| Contig296D | 4726643_f1_4 | 384 | 3221 | 1236 | 412 | 1459 | 1.50E-149 | Bacillus subtilis | d1013248 | accCYqhXBacillus subtilis DNA, 283 Kb region containing skin element,alternate gene name |
| Contig296D | 4860702_f1_33 | 385 | 3222 | 333 | 111 | | | | | |
| Contig296D | 4860953_f2_84 | 386 | 3223 | 1311 | 437 | 1735 | 8.60E-179 | Staphylococcus aureus | Q05615 | aroA3-phosphoshikimate-1-carboxyvinyltransferaseStaphylococcus aureus dehydroquinate synthase (aroB) gene, 3' endcds; 3-phosphoshikimate-1-carboxyvinyltransferase (aroA) gene.complete cds; ORF3, complete cds. |
| Contig296D | 4900342_f3_147 | 387 | 3224 | 804 | 268 | 825 | 2.30E-82 | Bacillus subtilis | g3169330 | yojNVojNBacillus subtilis YojA (yojA), YojB (yojB), YojC (yojC), YojD(yojD), YojE (yojE), YojF (yojF), YojG (yojG), YojH (yojH), YojI(yojI), YojJ (yojJ), YojK (yojK), YojL (yojL), YojM (yojM), YojN(yojN), and YojO (yojO) genes, complete cds; and OdhA (odh |

114

| | | | | | | | | |
|---|---|---|---|---|---|---|---|---|
| Contig296D | 4964202_f3_125 | 388 | 3225 | 675 | 225 | 719 | 4.00E-71 | Bacillus subtilis | P39788 | nth endonuclease III Bacillus subtilis (clone YAC15-6B) ypjABF genes, qcrABC genes,ypjABCDEFGHI genes, birA gene, panBCD genes, dinG gene, ypmB gene,aspB gene, asnS gene, dnaD gene, nth gene and ypoC gene, complete cds's.46.2% of identy to the Escherichia |
| Contig296D | 5116018_f1_7 | 389 | 3226 | 240 | 80 | 107 | 2.80E-06 | Escherichia coli | gi1786624 | xseB exodeoxyribonuclease small subunit Escherichia coli K-12 MG1655 section 38 of 400 of the complete genome.f80; 100 pct identical to EX7S_ECOLI SW |
| Contig296D | 5118762_f1_52 | 390 | 3227 | 1332 | 444 | 495 | 2.20E-47 | Bacillus subtilis | e1183083 | yisQ YisQ Bacillus subtilis complete genome (section 6 of 21)alternate gene name |
| Contig296D | 5131412_f1_20 | 391 | 3228 | 1776 | 592 | 886 | 8.00E-89 | Bacillus subtilis | P35164 | resE two-component sensor histidine kinase Bacillus subtilis spoVA to serA region.ORFX18 |
| Contig296D | 5324137_f3_122 | 392 | 3229 | 987 | 329 | 497 | 1.30E-47 | Bacillus subtilis | P42975 | birA Biotin [acetyl-CoA-carboxylase]Bacillus subtilis (clone YAC15-6B) ypjABF genes, qcrABC genes,ypjABCDEFGHI genes, birA gene, panBCD genes, dinG gene, ypmB gene,aspB gene, asnS gene, dnaD gene, nth gene and ypoC gene, complete cds's.26.7% of identy to the |
| Contig296D | 5367140_f2_96 | 393 | 3230 | 186 | 62 | 352 | 3.10E-32 | Bacillus subtilis | P42979 | |
| Contig296D | 571932_f1_30 | 394 | 3231 | 393 | 131 | 337 | 1.20E-30 | Bacillus subtilis | dl013247 | jojD unknown Bacillus subtilis dihydropicolinate reductase (jojE) gene, complete cds; poly(A) polymerase (jojI) gene, complete cds; biotin acetyl-CoA-carboxylase ligase (birA) gene, complete cds: jojC,jojD, jojF, jojG, jojH genes, complete cds's. putative |
| Contig296D | 587813_f2_62 | 395 | 3232 | 471 | 157 | | | Bacillus subtilis | | |
| Contig296D | 5892177_f1_47 | 396 | 3233 | 186 | 62 | | | | | accBY qhW Bacillus subtilis DNA, 283 Kb region containing skin element.alternate gene name |

115

| | | | | | | | | |
|---|---|---|---|---|---|---|---|---|
| Contig296D | 6414213_c1_188 | 397 | 3234 | 981 | 327 | 446 | 3.40E-42 | Bacillus licheniformis | P30363 | ansA,Asparaginase B.licheniformis ansA gene for asparaginase,the putative protein shows similarities with |
| Contig296D | 6438767_f3_117 | 398 | 3235 | 1404 | 468 | 268 | 7.70E-23 | Staphylococcus aureus | g1397239 | ebpSelastin binding proteinStaphylococcus aureus elastin binding protein (ebpS) gene, completecds. |
| Contig296D | 6739462_f3_126 | 399 | 3236 | 624 | 208 | 415 | 6.50E-39 | Bacillus subtilis | P50838 | ypsAconserved hypothetical protein ypsABacillus subtilis (clone YAC15-6B) ponA gene, yppBCDEFG genes,ypqAE genes, yprAB genes, cotD gene, ypsABC genes, rnaP gene, ypqAgene, ypuA gene, kduDI genes, kdgRKAT genes, ypwA gene, completecds,putative |
| Contig296D | 6821063_f1_58 | 400 | 3237 | 789 | 263 | 598 | 2.60E-58 | Bacillus subtilis | P16263 | odhB2-oxoglutarate dehydrogenase complexB.subtilis 2-oxoglutarate dehydrogenase (odhA) gene 3' end, anddihydrolipoamide transsuccinylase (odhB) gene, complete cds.dihydrolipoamide acetyltransferasedihydrolipoamide transsuccinylase (odhB); EC |
| Contig296D | 6853417_f3_112 | 401 | 3238 | 924 | 308 | 668 | 1.00E-65 | Bacillus subtilis | P54548 | yqjKYqjKBacillus subtilis DNA, 283 Kb region containing skin element.similar to hypothetical proteins |
| Contig296D | 6855301_f1_40 | 402 | 3239 | 204 | 68 | 140 | 9.00E-10 | Bacillus subtilis | P54165 | ypeQhypothetical protein ypeQBacillus subtilis (YAC10-9 clone) DNA region between the serA andkdg loci.putative |
| Contig296D | 7226552_c1_191 | 403 | 3240 | 195 | 65 | | | | | |
| Contig296D | 7242807_f2_70 | 404 | 3241 | 1425 | 475 | 1636 | 2.70E-168 | Salmonella enterica | P14062 | gnd6-phosphogluconate dehydrogenaseS. enterica gnd gene for 6-phosphogluconate dehydrogenase.phosphogluconate dehydrogenase (decarboxylating)6-phosphogluconate dehydrogenase (AA 1-468) |

| | | | | | | | | |
|---|---|---|---|---|---|---|---|---|
| Contig296D | 7320257_f1_36 | 405 | 3242 | 3456 | 1152 | 463 | 1.40E-39 | Bacillus subtilis | P54159 | ypbRhypothetical protein ypbRBacillus subtilis (YAC10-9 clone) DNA region between the serA andkdg loci.26.7% of identity in 165 aa to a Thermophilic |
| Contig296D | 788937_f3_133 | 406 | 3243 | 468 | 156 | 395 | 8.60E-37 | Bacillus subtilis | P54170 | ypbPconserved hypothetical protein ypbPBacillus subtilis (YAC10-9 clone) DNA region between the serA andkdg loci.putative |
| Contig296D | 814052_f3_120 | 407 | 3244 | 777 | 259 | 857 | 9.40E-86 | Micrococcus luteus | d1026195 | menG2-hexaprenyl-1,4-naphthoquinoneMicrococcus luteus hexs-a, menG, hexs-b gene, complete cds. |
| Contig296D | 863903_c1_150 | 408 | 3245 | 186 | 62 | | | | | |
| Contig296D | 866643_f1_41 | 409 | 3246 | 1062 | 354 | 185 | 4.60E-12 | Mycobacterium tuberculosis | e1246003 | MTV030.16putative ABC-transporter transmembrane subunitMycobacterium tuberculosis sequence v030.MTV030.16, possible ABC-transporter transmembrane |
| Contig296D | 912757_f1_19 | 410 | 3247 | 552 | 184 | 307 | 1.80E-27 | Bacillus subtilis | P35155 | ypuHconserved hypothetical protein ypuHBacillus subtilis spoVA to serA region.ORFX8 |
| Contig296D | 970275_f1_35 | 411 | 3248 | 1164 | 388 | 1150 | 8.40E-117 | Bacillus subtilis | P50840 | ypsCconserved hypothetical protein ypsCBacillus subtilis (clone YAC15-6B) ponA gene, ypbBCDEFG genes,ypqAE genes. yprAB genes, cotD gene, ypsABC genes, maP gene, yptAgene, yptA gene, kduDI genes, kdgRKAT genes, ypwA gene, completecds's,putative |
| Contig296D | 9783510_f2_60 | 412 | 3249 | 648 | 216 | 547 | 6.70E-53 | Bacillus stearothermophilus | Q07906 | argCBacillus stearothermophilus ornithine acetyltransferase (argJ) andacetylglutamate kinase (argB) genes, complete cds's, argC gene, 3'end, and argD gene, 5' end. |
| Contig296D | 9922962_f1_28 | 413 | 3250 | 1074 | 358 | 718 | 5.10E-71 | Bacillus subtilis | P31114 | gcrC3GcrC3B.subtilis dbpA, mtr(A,B), gerC(1-3), ndk, chcR, aro(B,E,F,H),trpt(A-F), hisH, and tyrA genes, complete cds.alternate gene name |

| | | | | | | | | |
|---|---|---|---|---|---|---|---|---|
| Contig296D | 9970327_13_121 | 414 | 3251 | 564 | 188 | 114 | 1.20E-05 | Bacillus subtilis | P54390 | ypiBHypothetical protein ypiBBacillus subtilis (clone YAC15-6B) ypiABF subtilis, qcrABC genes,ypjABCDEFGHI genes, birA gene, panBCD genes, dinG gene, ypnB gene,aspB gene, asnS gene, dnaD gene, nth gene and ypoC gene, completecds,putative |
| Contig310D | 11961568_c3_96 | 415 | 3252 | 945 | 315 | 1007 | 1.20E-101 | Staphylococcus aureus | P11099 | LACClacC proteinStaphylococcus aureus lacC and lacD genes,lacC polypeptide (AA 1-310) |
| Contig310D | 13871068_c2_66 | 416 | 3253 | 666 | 222 | 877 | 7.20E-88 | Bacillus subtilis | gi1165309 | rpsCS3Bacillus subtilis ribosomal protein gene cluster, rpsJ, rplC, rplD,rplW, rplB, rpsS, rplV and rpsC genes, complete cds, and rplP gene,partial cds.ribosomal protein |
| Contig310D | 13886593_c2_79 | 417 | 3254 | 252 | 84 | 96 | 4.10E-05 | Lactococcus lactis | g727435 | Lactococcus lactis N5-(1-carboxyethyl)-L-ornithine synthase (ceo)gene, complete cds,putative 6-kDa protein |
| Contig310D | 1408450_f1_8 | 418 | 3255 | 564 | 188 | 104 | 8.30E-06 | Pyrococcus horikoshii | d1028868 | PHLG013100aa long hypothetical proteinPyrococcus horikoshii OT3 genomic DNA, 1534516-1552267 nt position(complementary strand), clone |
| Contig310D | 14277217_c3_88 | 419 | 3256 | 516 | 172 | 626 | 2.80E-61 | Bacillus subtilis | P21467 | rpsEribosomal protein S5Bacillus subtilis ribosomal protein (rplPNXFFROQ, rpmCDJ,rpsQNHEMK) genes, integral membrane protein (secY) gene, adenylatekinase (adk) gene, methionine aminopeptidase (map) gene,initiation factor 1 (infA) gene, RNA polymerase alp |
| Contig310D | 14312750_c1_57 | 420 | 3257 | 492 | 164 | 665 | 2.10E-65 | Staphylococcus carnosus | Q00990 | rplMribosomal protein L13S.carnosus rplM gene for ribosomal protein L13.Escherichia coli ribosomal protein L13 |
| Contig310D | 14346067_c2_77 | 421 | 3258 | 1023 | 341 | 288 | 1.90E-25 | Vigna radiata | g1184121 | auxin-induced proteinVigna radiata clone MII-3 auxin-induced protein mRNA, complete cds. |

118

| | | | | | | | | |
|---|---|---|---|---|---|---|---|---|
| Contig310D | 16829627_c3_90 | 422 | 3259 | 372 | 124 | 484 | 3.20E-46 | Bacillus subtilis | g1044989 | rpsM ribosomal protein S13 Bacillus subtilis ribosomal protein (rplPNXEFROQ, rpmCDJ,rpsQNHEMK) genes, integral membrane protein (secY) gene, adenylatekinase (adk) gene, methionine aminopeptidase (map) gene,inititation factor 1 (infA) gene, RNA polymerase al |
| Contig310D | 16835333_c3_82 | 423 | 3260 | 840 | 280 | 1198 | 6.90E-122 | Bacillus subtilis | g1165306 | rplBL2 Bacillus subtilis ribosomal protein gene cluster, rpsJ, rplC, rplD,rplW, rplB, rpsS, rplV and rpsC genes, complete cds, and rplP gene,partial cds,ribosomal protein |
| Contig310D | 197127_f2_14 | 424 | 3261 | 1965 | 655 | 285 | 7.50E-22 | Rhizobium sp. NGR234 | P55706 | y4xNY4xNRhizobium sp. NGR234 plasmid pNGR234a, section 43 of 46 of the complete plasmid sequence.hypothetical 71 kd protein; similar to Escherichia |
| Contig310D | 19822151_c3_91 | 425 | 3262 | 372 | 124 | 433 | 8.00E-41 | Bacillus subtilis | g142464 | rplQ ribosomal protein L17 B.subtilis initiation factor 1, ribosomal proteins B, S13, S11, L17and RNA polymerase alpha core protein genes, complete cds.Escherichia coli ribosomal protein L17 |
| Contig310D | 21751063_c2_64 | 426 | 3263 | 579 | 193 | 621 | 9.60E-61 | Bacillus stearothermophilus | P28600 | rplC ribosomal protein L3B,stearothermophilus genes rplC and rplD for ribosomal proteins L3 and L4, respectively.Escherichia coli ribosomal protein L3 |
| Contig310D | 21915941_c2_69 | 427 | 3264 | 372 | 124 | 571 | 1.90E-55 | Bacillus subtilis | P12875 | rplN ribosomal protein L14 Bacillus subtilis ribosomal protein (rplPNXEFROQ, rpmCDJ,rpsQNHEMK) genes, integral membrane protein (secY) gene, adenylatekinase (adk) gene, methionine aminopeptidase (map) gene,inititation factor 1 (infA) gene, RNA polymerase al |
| Contig310D | 22003218_c1_51 | 428 | 3265 | 330 | 110 | 390 | 2.90E-36 | BACILLUS STEAROTHERMOPHILUS | P04455 | RPLX ribosomal protein L24 50S RIBOSOMAL PROTEIN L24 Escherichia coli ribosomal protein L24 |

| Contig310D | 23572128_c1_53 | 429 | 3266 | 183 | 61 | 282 | 8.10E-25 | Staphylococcus aureus | g2078380 | L30ribosomal protein L30Staphylococcus aureus NCTC 8325 ribosomal protein L30 (L30),ribosomal protein L15 (L15) and SecY (secY) genes, complete cds. |
|---|---|---|---|---|---|---|---|---|---|---|
| Contig310D | 23572180_c1_55 | 430 | 3267 | 222 | 74 | 326 | 1.80E-29 | Bacillus subtilis | g142459 | infXinitiation factor 1B.subtilis initiation factor 1, ribosomal proteins B, S13, S11, L17and RNA polymerase alpha core protein genes, complete cds. |
| Contig310D | 23573587_c3_85 | 431 | 3268 | 201 | 67 | 284 | 5.00E-25 | Bacillus subtilis | P12878 | rpsNribosomal protein L14Bacillus subtilis ribosomal protein (rpIPNXEFROQ, rpmCDJ,rpsQNHEMK) genes, integral membrane protein (secY) gene, adenylatekinase (adk) gene, methionine aminopeptidase (map) gene,initiation factor 1 (infA) gene, RNA polymerase al |
| Contig310D | 23603450_c2_78 | 432 | 3269 | 585 | 195 | | | | | |
| Contig310D | 23632750_c3_102 | 433 | 3270 | 525 | 175 | 726 | 7.20E-72 | Staphylococcus aureus | g894289 | asp23alkaline shock protein 23asp23=alkaline shock protein 23 {methicillin resistant}[Staphylococcus aureus, 912, Genomic, 1360 ntMethod |
| Contig310D | 23634813_c1_58 | 434 | 3271 | 771 | 257 | 970 | 1.00E-97 | Staphylococcus aureus | P16644 | LACRlacR repressorStaphylococcus aureus lac repressor (lacR) gene, complete cds andlacA repressor (lacA), partial cds. |
| Contig310D | 23683375_c1_59 | 435 | 3272 | 507 | 169 | 583 | 1.00E-56 | Streptococcus mutans | P26423 | lacAgalactosidase acetyltransferaseStreptococcus mutans lac operon. |
| Contig310D | 23882135_c3_92 | 436 | 3273 | 873 | 291 | 665 | 2.10E-65 | Bacillus subtilis | e1182078 | ybxAunknownBacillus subtilis complete genome (section 1 of 21)alternate gene name |
| Contig310D | 24337750_c3_97 | 437 | 3274 | 981 | 327 | 1524 | 2.00E-156 | Staphylococcus aureus | P11100 | LACDlacD proteinStaphylococcus aureus lacC and lacD genes.lacD polypeptide (AA 1-326) |

120

| | | | | | | | | |
|---|---|---|---|---|---|---|---|---|
| Contig310D | 24397127_c3_98 | 438 | 3275 | 1776 | 592 | 2460 | 1.30E-255 | Staphylococcus aureus | P11162 | L.ACEphosphotransferase system enzyme II, lactose-specific, factor IIS.aureus enzyme III-lac (lacF), enzyme II-lac (lacE), andphospho-beta-galactosidase (lacG) genes, complete cds.enzyme II-lac (lacE) |
| Contig310D | 24402217_c1_56 | 439 | 3276 | 405 | 135 | 560 | 2.80E-54 | Bacillus subtilis | P04969 | rpsKribosomal protein S11B.subtilis initiation factor 1, ribosomal proteins B, S13, S11, L17and RNA polymerase alpha core protein genes, complete cds.Escherichia coli ribosomal protein S11 ribosomal protein S11 |
| Contig310D | 24648312_f3_34 | 440 | 3277 | 747 | 249 | 905 | 7.70E-91 | Staphylococcus aureus | g845686 | Staphylococcus aureus lac repressor (lacR) gene, complete cds andlacA repressor (lacA), partial cds.ORF-27 |
| Contig310D | 24744040_c1_63 | 441 | 3278 | 1065 | 355 | | | | | |
| Contig310D | 24806662_c2_67 | 442 | 3279 | 237 | 79 | 252 | 1.20E-21 | Bacillus subtilis | P12873 | rpmCribosomal protein L29Bacillus subtilis ribosomal protein (rplPNXEFROQ, rpmCDJ,rpsQNHEMK) genes, integral membrane protein (secY) gene, adenylatekinase (adk) gene, methionine aminopeptidase (map) gene,initiation factor 1 (infA) gene, RNA polymerase al |
| Contig310D | 25908568_c2_71 | 443 | 3280 | 453 | 151 | 706 | 9.50E-70 | Staphylococcus aureus | O06445 | L15ribosomal protein L15Staphylococcus aureus NCTC 8325 ribosomal protein L30 (L30),ribosomal protein L15 (L15) and SecY (secY) genes, complete cds. |
| Contig310D | 26360036_c1_52 | 444 | 3281 | 387 | 129 | 429 | 2.10E-40 | Bacillus subtilis | P46899 | rplRribosomal protein L18Bacillus subtilis ribosomal protein (rplPNXEFROQ, rpmCDJ,rpsQNHEMK) genes, integral membrane protein (secY) gene, adenylatekinase (adk) gene, methionine aminopeptidase (map) gene,initiation factor 1 (infA) gene, RNA polymerase al |

| | | | | | | | |
|---|---|---|---|---|---|---|---|
| Contig310D | 26773450_c2_68 | 445 | 3282 | 285 | 95 | 380 | 3.30E-35 | Bacillus subtilis | P12874 | rpsQribosomal protein S17 (BS16)B.subtilis S10/spc opcron rpmC, rpsQ, rplN, rplX, rplE, rpsN genes.Escherichia coli ribosomal protein S17S17 protein (AA 1-87) |
| Contig310D | 26776678_c3_84 | 446 | 3283 | 372 | 124 | 431 | 1.30E-40 | Bacillus stearothermophilus | P23311 | RPLVribosomal protein L22B.stearothermophilu gene for ribosomal proteins L2, S19, L22, S3,and L16.Escherichia coli ribosomal protein L22 |
| Contig310D | 2735801_c1_62 | 447 | 3284 | 1848 | 616 | 274 | 1.10E-20 | Rhizobium sp. NGR234 | P55706 | y4xNY4xNRhizobium sp. NGR234 plasmid pNGR234a, section 43 of 46 of thecomplete plasmid sequence.hypothetical 71 kd protein; similar to Escherichia |
| Contig310D | 29328312_c3_83 | 448 | 3285 | 339 | 113 | 415 | 6.50E-39 | Bacillus subtilis | d1009468 | rpsSRibosomal Protein S19Bacillus subtilis genes for ribosomal proteins L13, L4, L23, L2,S19, L22, S3 and L16, partial and complete cds.ribosomal protein |
| Contig310D | 30742165_c1_54 | 449 | 3286 | 1323 | 441 | 1919 | 2.70E-198 | Staphylococcus carnosus | Q05217 | secYsecY proteinS.carnosus secY gene.secY protein |
| Contig310D | 31377318_c2_65 | 450 | 3287 | 291 | 97 | 297 | 2.10E-26 | Bacillus subtilis | P42924 | rplWRibosomal Protein L23Bacillus subtilis genes for ribosomal proteins L13, L4, L23, L2,S19, L22, S3 and L16, partial and complete cds.ribosomal protein |
| Contig310D | 3304562_c1_60 | 451 | 3288 | 366 | 122 | 411 | 1.70E-38 | Staphylococcus aureus | P02909 | LACFS.aureus enzyme III-lac (lacF), enzyme II-lac (lacE), andphospho-beta-galactosidase (lacG) genes, complete cds.enzyme III-lac (lacF) |
| Contig310D | 33437802_c3_89 | 452 | 3289 | 669 | 223 | 772 | 9.60E-77 | Bacillus subtilis | P16304 | adkadenylate kinaseBacillus subtilis ribosomal protein (rplIPNXEFROQ, rpmCDJ,rpsQNHEMK) genes, integral membrane protein (secY) gene, adenylatekinase (adk) gene, methionine aminopeptidase (map) gene,initiation factor 1 (infA) gene, RNA polymerase alpha (r |
| Contig310D | 34017517_c3_93 | 453 | 3290 | 828 | 276 | 714 | 1.30E-70 | Bacillus subtilis | e1182080 | ybaFHypothetical protein ybaFBacillus subtilis complete genome (section 1 of 21) |

| | | | | | | | |
|---|---|---|---|---|---|---|---|
| Contig310D | 34188213_c3_86 | 454 | 3291 | 423 | 141 | 579 | 2.70E-56 | Bacillus subtilis | g1044978 | rpsHribosomal protein S8Bacillus subtilis ribosomal protein (rplPNXEFROQ, rpmCDJ,rpsQNHEMK) genes, integral membrane protein (secY) gene, adenylatekinase (adk) gene, methionine aminopeptidase (map) gene,initiation factor 1 (infA) gene, RNA polymerase alp |
| Contig310D | 34406562_c2_73 | 455 | 3292 | 867 | 289 | 644 | 3.50E-63 | Bacillus subtilis | e1182079 | ybaEunknownBacillus subtilis complete genome (section 1 of 21)similar to ABC transporter (ATP-binding protein) |
| Contig310D | 34647177_c3_87 | 456 | 3293 | 558 | 186 | 594 | 7.00E-58 | Bacillus stearothermophilus | g143419 | ribosomal protein L6ribosomal protein L6B,stearothermophilus ribosomal protein L6 gene, complete cds. |
| Contig310D | 34651577_f2_15 | 457 | 3294 | 1047 | 349 | 502 | 3.90E-48 | Bacillus subtilis | d1023111 | yceBYceBBacillus subtilis genomic DNA, 22 to 25 degree region, completecds.homologue of a hypothetical 36.6 kDa protein in |
| Contig310D | 36135437_c3_81 | 458 | 3295 | 648 | 216 | 676 | 1.40E-66 | Bacillus stearothermophilus | P28601 | rplDribosomal protein L4B,stearothermophilus genes rplC and rplD for ribosomal proteins L3and L4, respectively.Escherichia coli ribosomal protein L4 |
| Contig310D | 36226575_c2_70 | 459 | 3296 | 558 | 186 | 766 | 4.20E-76 | Bacillus subtilis | P12877 | rplEribosomal protein L5Bacillus subtilis ribosomal protein (rplPNXEFROQ, rpmCDJ,rpsQNHEMK) genes, integral membrane protein (secY) gene, adenylatekinase (adk) gene, methionine aminopeptidase (map) gene,initiation factor 1 (infA) gene, RNA polymerase alp |
| Contig310D | 4165677_c3_94 | 460 | 3297 | 807 | 269 | 544 | 1.40E-52 | Bacillus subtilis | e1182081 | truApseudouridylate synthase IBacillus subtilis complete genome (section 1 of 21)alternate gene name |
| Contig310D | 4564036_c3_101 | 461 | 3298 | 1044 | 348 | 898 | 4.30E-90 | Bacillus subtilis | e1182735 | yimJYfmJBacillus subtilis complete genome (section 5 of 21)similar to quinone oxidoreductase |

| | | | | | | | |
|---|---|---|---|---|---|---|---|
| Contig310D | 4694030_c3_103 | 462 | 3299 | 1236 | 412 | 311 | 6.80E-28 | Mycobacterium smegmatis | g2073532 | Mycobacterium smegmatis catalase-peroxidase (katG), putativearabinosyl transferase (embC, embA, embB), genes complete cds andputative propionyl-coA carboxylase beta chain (pccB) genes, partialcds.orf7; hypothetical membrane protein |
| Contig310D | 4697262_c3_95 | 463 | 3300 | 540 | 180 | 806 | 2.40E-80 | Streptococcus mutans | D43258 | galactose-6-phosphate isomerase subunit LacB |
| Contig310D | 4714817_c2_76 | 464 | 3301 | 879 | 293 | | | | | |
| Contig310D | 4879442_c2_75 | 465 | 3302 | 576 | 192 | 981 | 6.80E-99 | Staphylococcus aureus | P11175 | LACGbeta-galactosidase,S.aureus enzyme III-lac (lacF), enzyme II-lac (lacE), andphospho-beta-galactosidase (lacG) genes, complete cds.Agrobacterium beta-glucosidasephospho-beta-galactosidase (lacG) |
| Contig310D | 4886592_c1_50 | 466 | 3303 | 450 | 150 | 614 | 5.30E-60 | Bacillus subtilis | P14577 | rplPribosomal protein L16Bacillus subtilis complete genome (section 1 of 21) |
| Contig310D | 4897202_c2_72 | 467 | 3304 | 768 | 256 | 996 | 1.80E-100 | Bacillus sp. | d1025104 | rpoARNA polymerase alpha subunitBacillus sp. gene for initiation factor IF-I, RNA polymerase alphasubunit and ribosomal proteins, partial and complete cds. |
| Contig310D | 4917712_c2_74 | 468 | 3305 | 408 | 136 | 496 | 1.70E-47 | Bacillus subtilis | e1182083 | rpsIribosomal protein S9Bacillus subtilis complete genome (section 1 of 21) |
| Contig310D | 55437_c3_99 | 469 | 3306 | 867 | 289 | 1458 | 1.90E-149 | Staphylococcus aureus | P11175 | LACGbeta-galactosidase,S.aureus enzyme III-lac (lacF), enzyme II-lac (lacE), andphospho-beta-galactosidase (lacG) genes, complete cds.Agrobacterium beta-glucosidasephospho-beta-galactosidase (lacG) |
| Contig313D | 10736002_c3_112 | 470 | 3307 | 1521 | 507 | 2313 | 4.90E-240 | Staphylococcus aureus | Q53638 | LYSSlysyl-tRNA synthetaseStaphylococcus aureus lysyl-tRNA sythetase gene, complete cds,transfer RNA (tRNA) genes, 5S ribosomal RNA (5S rRNA) gene, 16Sribosomal RNA (16S rRNA) gene, 23S ribosomal RNA (23S rRNA) gene. |

| Contig313D | 11210316_c3_106 | 471 | 3308 | 195 | 65 | 166 | 1.60E-12 | Bacillus subtilis | P37557 | yabOunknownB. subtilis DNA, 180 kilobase region of replication origin.similar to hypothetical proteins |
|---|---|---|---|---|---|---|---|---|---|---|
| Contig313D | 12142768_f3_62 | 472 | 3309 | 300 | 100 | 110 | 3.50E-06 | Pyrococcus horikoshii | d1027343 | PHBW016235aa long hypothetical proteinPyrococcus horikoshii OT3 genomic DNA, 180023-216005 nt position,clone |
| Contig313D | 12929625_c3_95 | 473 | 3310 | 810 | 270 | 819 | 1.00E-81 | Bacillus subtilis | P37541 | yaaTunknownB. subtilis DNA, 180 kilobase region of replication origin.similar to signal peptidase II |
| Contig313D | 13759888_c3_93 | 474 | 3311 | 615 | 205 | 527 | 8.80E-51 | Bacillus subtilis | P37537 | tmkunknownB. subtilis DNA, 180 kilobase region of replication origin.alternate gene name |
| Contig313D | 14849093_c1_63 | 475 | 3312 | 321 | 107 | 123 | 5.70E-08 | Mitochondrion Chondrus crispus | e138028 | putative orf79.1C.crispus complete mitochondrial genome.unique orf |
| Contig313D | 16522641_f3_46 | 476 | 3313 | 597 | 199 | 202 | 2.40E-16 | Pyrococcus horikoshii | d1027803 | PHCU003146aa long hypothetical proteinPyrococcus horikoshii OT3 genomic DNA, 609561-620132 nt position,clonecontains prokaryotic membrane lipoprotein lipid |
| Contig313D | 16594202_c1_73 | 477 | 3314 | 480 | 160 | 383 | 1.60E-35 | Bacillus subtilis | P29252 | folk7,8-dihydro-6-hydroxymethylpterin-pyrophosphokinB. subtilis DNA, 180 kilobase region of replication origin.2-amino-4-hydroxy-6-hydroxymethyldihydropteridine pyrophosphokinase |
| Contig313D | 190875_f2_22 | 478 | 3315 | 210 | 70 | | | | | |
| Contig313D | 194142_c3_101 | 479 | 3316 | 1386 | 462 | 1339 | 7.90E-137 | Bacillus subtilis | d1005827 | tms26temperature sensitive cell divisionB. subtilis DNA, 180 kilobase region of replication origin.alternate gene name |
| Contig313D | 211687_c2_87 | 480 | 3317 | 897 | 299 | 985 | 2.60E-99 | Bacillus subtilis | P37565 | yacCunknownB. subtilis DNA, 180 kilobase region of replication origin.similar to hypothetical proteins |
| Contig313D | 22694002_c2_86 | 481 | 3318 | 546 | 182 | 544 | 1.40E-52 | Bacillus subtilis | P37472 | hprthypoxanthine-guanine phosphoribosyltransferaseB. subtilis DNA, 180 kilobase region of replication origin.hypoxanthine phosphoribosyltransferase |

125

| | | | | | | | | |
|---|---|---|---|---|---|---|---|---|
| Contig313D | 23445130_c3_108 | 482 | 3319 | 417 | 139 | 134 | 3.40E-08 | Bacillus subtilis | e1182000 | yacAcell-cycle protein homolog yacABacillus subtilis complete genome (section 1 of 21)similar to cell-cycle protein |
| Contig313D | 23601702_c3_98 | 483 | 3320 | 891 | 297 | 919 | 2.50E-92 | Bacillus subtilis | P37468 | ksgAhigh level kasgamycin resistanceB. subtilis DNA, 180 kilobase region of replication origin.rRNA (adenine-N6-)-methyltransferase |
| Contig313D | 23631327_c2_79 | 484 | 3321 | 966 | 322 | 1225 | 9.50E-125 | Corynebacterium ammoniagenes | g2289093 | prsPRPP synthetaseCorynebacterium ammoniagenes N-acetyl glucosamine 1-phosphateuridyltransferase (glmU) gene, partial cds, and PRPP-synthetase(prs) gene, complete cds. |
| Contig313D | 23642135_c3_94 | 485 | 3322 | 357 | 119 | 389 | 3.70E-36 | Bacillus subtilis | P37538 | yaaQunknownB. subtilis DNA, 180 kilobase region of replication origin.similar to hypothetical proteins |
| Contig313D | 23860952_c3_107 | 486 | 3323 | 882 | 294 | 267 | 1.00E-22 | Bacillus subtilis | e1182000 | yacAcell-cycle protein homolog yacABacillus subtilis complete genome (section 1 of 21)similar to cell-cycle protein |
| Contig313D | 24647936_c2_84 | 487 | 3324 | 408 | 136 | 161 | 5.40E-12 | Bacillus subtilis | P37471 | divIC unknownB. subtilis DNA, 180 kilobase region of replication origin. |
| Contig313D | 24649092_c1_72 | 488 | 3325 | 378 | 126 | 351 | 3.90E-32 | Staphylococcus haemolyticus | g1118003 | folQdihydroneopterin aldolaseStaphylococcus haemolyticus cysteine synthase A (cysK) anddihydroneopterin aldolase (folQ) genes, partial cds, anddihydropteroate synthase (folP) gene, complete cds.DHNA |
| Contig313D | 24663892_c2_80 | 489 | 3326 | 1881 | 627 | 1224 | 1.20E-124 | Bacillus subtilis | P37474 | mfdtranscription-repair coupling factorB. subtilis DNA, 180 kilobase region of replication origin. |
| Contig313D | 24790916_c3_109 | 490 | 3327 | 2106 | 702 | 2133 | 5.80E-221 | Bacillus subtilis | P37476 | ftsHcell division proteinB. subtilis DNA, 180 kilobase region of replication origin.FtsH/SEC18/CDC48-type ATP-binding domain homology |
| Contig313D | 25662965_c3_102 | 491 | 3328 | 729 | 243 | 463 | 5.30E-44 | Bacillus subtilis | d1005829 | ctcexpressed at the end of exponential growyh underB. subtilis DNA, 180 kilobase region of replication origin. |

| | | | | | | | | |
|---|---|---|---|---|---|---|---|---|
| Contig313D | 26839660_c2_76 | 492 | 3329 | 855 | 285 | 655 | 2.40E-64 | Bacillus subtilis | P37544 | yabCunknownB. subtilis DNA, 180 kilobase region of replication origin.similar to hypothetical proteins |
| Contig313D | 2928502_c2_88 | 493 | 3330 | 960 | 320 | 1166 | 1.70E-118 | Bacillus subtilis | d1005850 | cysKcysteine synthetase AB. subtilis DNA, 180 kilobase region of replication origin.threonine dehydratase |
| Contig313D | 31446881_c1_64 | 494 | 3331 | 351 | 117 | 194 | 1.70E-15 | Bacillus subtilis | P37542 | yabAunknownB. subtilis DNA, 180 kilobase region of replication origin. |
| Contig313D | 32615811_f1_17 | 495 | 3332 | 189 | 63 | | | | | |
| Contig313D | 33225017_c1_68 | 496 | 3333 | 867 | 289 | 792 | 7.30E-79 | Bacillus subtilis | P37551 | purRunknownB. subtilis DNA, 180 kilobase region of replication origin.alternate gene name |
| Contig313D | 33313817_c3_100 | 497 | 3334 | 333 | 111 | 323 | 3.60E-29 | Bacillus megaterium | P28016 | spoVGspoVG proteinB.megaterium spoVG and tms genes. |
| Contig313D | 3361326_c3_90 | 498 | 3335 | 207 | 69 | | | | | |
| Contig313D | 34001510_c1_67 | 499 | 3336 | 798 | 266 | 916 | 5.30E-92 | Bacillus subtilis | P37545 | yabDunknownB. subtilis DNA, 180 kilobase region of replication origin.similar to hypothetical proteins |
| Contig313D | 34428515_c3_99 | 500 | 3337 | 285 | 95 | 284 | 5.00E-25 | Bacillus subtilis | P37466 | vegunknownB. subtilis DNA, 180 kilobase region of replication origin. |
| Contig313D | 34571011_c2_81 | 501 | 3338 | 1608 | 536 | 1712 | 2.40E-176 | Bacillus subtilis | P37474 | mfdtranscription-repair coupling factorB. subtilis DNA, 180 kilobase region of replication origin. |
| Contig313D | 3553_c2_75 | 502 | 3339 | 972 | 324 | 382 | 2.00E-35 | Bacillus subtilis | P37540 | holBsimilar to B. subtilis DnaHB. subtilis DNA, 180 kilobase region of replication origin.alternate gene name |
| Contig313D | 3916087_c1_65 | 503 | 3340 | 261 | 87 | 243 | 1.10E-20 | Bacillus subtilis | e1181968 | yazAconserved hypothetical protein yazABacillus subtilis complete genome (section 1 of 21)similar to hypothetical proteins |
| Contig313D | 3937950_f3_43 | 504 | 3341 | 186 | 62 | | | | | |
| Contig313D | 3938838_c3_111 | 505 | 3342 | 846 | 282 | 1087 | 4.00E-110 | Staphylococcus haemolyticus | Q59919 | folPdihydropteroate synthaseStaphylococcus haemolyticus cysteine synthase A (cysK) anddihydroneopterin aldolase (folQ) genes, partial cds, anddihydropteroate synthase (folP) gene, complete cds.DHPS |
| Contig313D | 4723192_c3_103 | 506 | 3343 | 606 | 202 | 539 | 4.70E-52 | Bacillus subtilis | P37470 | spoVCstage V sporulationB. subtilis DNA, 180 kilobase region of replication origin.thermosensitive mutant blocks spore coat formation |

| | | | | | | | | | | |
|---|---|---|---|---|---|---|---|---|---|---|
| Contig313D | 4775312_c2_85 | 507 | 3344 | 405 | 135 | 436 | 3.90E-41 | Bacillus subtilis | P37560 | yabRunknownB. subtilis DNA, 180 kilobase region of replication origin.orfl28x; homologous to RNA binding domain of E. coli |
| Contig313D | 4884625_c3_97 | 508 | 3345 | 549 | 183 | 445 | 4.30E-42 | Bacillus subtilis | P37547 | yabFunknownB. subtilis DNA, 180 kilobase region of replication origin.similar to hypothetical proteins |
| Contig313D | 5344015_c2_83 | 509 | 3346 | 1281 | 427 | 849 | 6.60E-85 | Bacillus subtilis | P37556 | yabNunknownB. subtilis DNA, 180 kilobase region of replication origin.beta-lactamase regulatory protein homolog.similar to hypothetical proteins |
| Contig313D | 5367813_c1_74 | 510 | 3347 | 543 | 181 | 432 | 1.00E-40 | Escherichia coli | P37354 | speGSpermidine N1-acetyltransferase (EC 2.3.1.57)E.coli genomic DNA, Kohara clone #308(35.3-35.7 min.),ORF_ID |
| Contig313D | 6015842_c2_78 | 511 | 3348 | 900 | 300 | 750 | 2.10E-74 | Bacillus subtilis | P37550 | yabHunknownB. subtilis DNA, 180 kilobase region of replication origin.similar to hypothetical proteins |
| Contig313D | 6136562_c1_69 | 512 | 3349 | 402 | 134 | 361 | 3.40E-33 | Bacillus subtilis | P37552 | yabJunknownB. subtilis DNA, 180 kilobase region of replication origin.hypothetical protein HI0719.similar to hypothetical proteins |
| Contig313D | 6742943_c1_66 | 513 | 3350 | 1983 | 661 | 2292 | 8.10E-238 | Bacillus subtilis | P37465 | metSmethionyl-tRNA synthetascB. subtilis DNA, 180 kilobase region of replication origin. |
| Contig313D | 761_c3_96 | 514 | 3351 | 750 | 250 | 541 | 2.90E-52 | Bacillus subtilis | P37543 | yabBunknownB. subtilis DNA, 180 kilobase region of replication origin.similar to hypothetical proteins |
| Contig313D | 781880_I3_50 | 515 | 3352 | 339 | 113 | 114 | 2.40E-06 | Schizosaccharomyces pombe | e317491 | SPBC3D6.14cunknownS.pombe chromosome II cosmid c3D6.SPBC3D6.14c, unknown; partial; serine rich, |
| Contig313D | 829800_c3_104 | 516 | 3353 | 1575 | 525 | 597 | 3.40E-58 | Bacillus subtilis | P37555 | yabMsimilar to SpoVBB. subtilis DNA, 180 kilobase region of replication origin.similar to amino acid transporter |
| Contig313D | 976638_c3_92 | 517 | 3354 | 1371 | 457 | 556 | 7.40E-54 | Bacillus subtilis | P37536 | yaaOsimilar to lysine decarboxylaseB. subtilis DNA, 180 kilobase region of replication origin.similar to lysine decarboxylase |

| | | | | | | | | | |
|---|---|---|---|---|---|---|---|---|---|
| Contig315D | 10657827_f2_7 | 518 | 3355 | 1401 | 467 | 393 | 1.40E-36 | Streptomyces pristinaespiralis | e304997 | Sequence 6 from Patent WO9408014.unnamed protein product |
| Contig315D | 11756543_c1_18 | 519 | 3356 | 231 | 77 | | | | | |
| Contig315D | 1207507_c3_32 | 520 | 3357 | 1245 | 415 | 1112 | 9.00E-113 | Bacillus subtilis | d1020148 | ydgFamino acid ABC transporter (permease) homolog ydgFBacillus subtilis genome sequence, 148 kb sequence of the regionbetween 35 and 47 degree.PROBABLE AMINO ACID TRANSPORT PERMIASE. |
| Contig315D | 157807_f2_10 | 521 | 3358 | 1584 | 528 | 1780 | 1.50E-183 | Staphylococcus sciuri | e316580 | C7ORF58S.sciuri mecA gene, strain K11 (792). |
| Contig315D | 16048828_f1_3 | 522 | 3359 | 261 | 87 | | | | | |
| Contig315D | 16410912_c1_20 | 523 | 3360 | 279 | 93 | | | | | |
| Contig315D | 24251400_c1_23 | 524 | 3361 | 792 | 264 | 721 | 2.40E-71 | Staphylococcus aureus | g1854577 | lytRStaphylococcus aureus lytS and lytR genes, complete cds. |
| Contig315D | 25431558_c3_38 | 525 | 3362 | 705 | 235 | 855 | 1.50E-85 | Staphylococcus aureus | g1575026 | lrgBLrgBStaphylococcus aureus holin-like protein LrgA (lrgA) and LrgB(lrgB) genes, complete cds.LytSR-regulated gene; similar to E.coli yohK |
| Contig315D | 25433452_c3_36 | 526 | 3363 | 1791 | 597 | 1867 | 8.90E-193 | Staphylococcus aureus | g862312 | lytSStaphylococcus aureus lytS and lytR genes, complete cds. |
| Contig315D | 25585932_f2_4 | 527 | 3364 | 276 | 92 | 249 | 2.50E-21 | Bacillus subtilis | d1020109 | ydelhypothetical protein ydelBacillus subtilis genome sequence, 148 kb sequence of the regionbetween 35 and 47 degree.FUNCTION UNKNOWN. |
| Contig315D | 26188837_f2_6 | 528 | 3365 | 975 | 325 | 838 | 9.70E-84 | Bacillus subtilis | g2293449 | opuBCcholine binding protein precursorBacillus subtilis choline transport system including ATPase(opuBA), transmembrane protein (opuBB), choline binding proteinprecursor (opuBC) and transmembrane protein (opuBD) genes, completecds; and unknown gene.part o |
| Contig315D | 26751887_f2_8 | 529 | 3366 | 954 | 318 | 297 | 2.10E-26 | Aquifex aeolicus | g2984043 | aq_1727putative protein/Aquifex aeolicus section 85 of 109 of the complete genome. |
| Contig315D | 2853431_c1_21 | 530 | 3367 | 195 | 65 | | | | | |

| | | | | | | | | |
|---|---|---|---|---|---|---|---|---|
| Contig315D | 30367767_c3_34 | 531 | 3368 | 1533 | 511 | 339 | 1.10E-30 | Pyrococcus horikoshii | dl027272 | PHDC009273aa long hypothetical proteinPyrococcus horikoshii OT3 genomic DNA, 124750-131579 nt position(complementary strand), clonecontains soybean trypsin inhibitor (Kunitz) |
| Contig315D | 34016937_f2_5 | 532 | 3369 | 1383 | 461 | 1178 | 9.10E-120 | Bacillus subtilis | g2271389 | opuCAATPaseBacillus subtilis osmoprotectant transport system OpuC includingATPase (opuCA), transmembrane protein (opuCB), osmoprotectantbinding protein precursor (opuCC) and transmembrane protein (opuCD)genes, complete cds.OpuCA; part of the osmoprotectan |
| Contig315D | 34273436_c1_19 | 533 | 3370 | 855 | 285 | 372 | 2.30E-34 | Bacillus subtilis | P54544 | yqjGYqjGBacillus subtilis DNA, 283 Kb region containing skin element,similar to lipoprotein SpoIIIJ-like |
| Contig315D | 34554692_c3_37 | 534 | 3371 | 474 | 158 | 403 | 1.20E-37 | Staphylococcus aureus | g1575025 | lrgAholin-like protein LrgAStaphylococcus aureus holin-like protein LrgA (lrgA) and LrgB(lrgB) genes, complete cds.LytSR-regulated gene; similar to E.coli yohJ |
| Contig315D | 36134678_f1_2 | 535 | 3372 | 699 | 233 | 674 | 2.30E-66 | Bacillus subtilis | g2271392 | opuCDtransmembrane proteinBacillus subtilis osmoprotectant transport system OpuC includingATPase (opuCA), transmembrane protein (opuCB), osmoprotectantbinding protein precursor (opuCC) and transmembrane protein (opuCD)genes, complete cds.OpuCD; part of th |
| Contig315D | 36596878_f3_12 | 536 | 3373 | 351 | 117 | | | | | |
| Contig315D | 3906718_c3_39 | 537 | 3374 | 1065 | 355 | 747 | 4.30E-74 | Bacillus subtilis | dl023636 | ydjLdehydrogenaseBacillus subtilis genomic DNA containing gutA to cotA region, 48degree.putative |
| Contig315D | 4725068_f1_1 | 538 | 3375 | 645 | 215 | 605 | 4.80E-59 | Bacillus subtilis | g2271390 | opuCBtransmembrane proteinBacillus subtilis osmoprotectant transport system OpuC includingATPase (opuCA), transmembrane protein (opuCB), osmoprotectantbinding protein precursor (opuCC) and transmembrane protein (opuCD)genes, complete cds.OpuCB; part of th |

| | | | | | | | | |
|---|---|---|---|---|---|---|---|---|
| Contig315D | 7242128_f3_15 | 539 | 3376 | 345 | 115 | | 3.10E-32 | Staphylococcus sciuri | e314909 | hypothetical proteinS.sciuri mecA gene & ORF's 450, 145 & 179.ORF450 |
| Contig315D | 882143_f3_16 | 540 | 3377 | 255 | 85 | 352 | | | |
| Contig329D | 10241287_c2_143 | 541 | 3378 | 663 | 221 | | | | |
| Contig329D | 1042202_c1_119 | 542 | 3379 | 1074 | 358 | 625 | 3.60E-61 | Escherichia coli | P23861 | potDSpermidine/putrescine-binding periplasmicEscherichia coli genomic DNA.(25.1 - 25.5 min).1348; 100 pct identical to POTD_ECOLI SW |
| Contig329D | 10579000_c2_154 | 543 | 3380 | 957 | 319 | 728 | 4.40E-72 | Bacillus subtilis | P24009 | ctaBCtaB proteinBacillus subtilis genomic DNA 23.9kB fragment.putative |
| Contig329D | 10928_c1_127 | 544 | 3381 | 1242 | 414 | 239 | 9.10E-18 | Rhodobacter capsulatus | g3128293 | hypothetical proteinRhodobacter capsulatus strain SB1003, partial genome. |
| Contig329D | 10969052_c3_165 | 545 | 3382 | 1725 | 575 | 2602 | 1.20E-270 | Staphylococcus aureus | P51183 | ptsIphosphoenolpyruvate-protein phosphataseS.aureus ptsH and ptsI genes. |
| Contig329D | 1173177_f3_103 | 546 | 3383 | 1053 | 351 | 691 | 3.70E-68 | Escherichia coli | P22564 | yaaFhypothetical 32.6 kD protein in lytB-dapBEscherichia coli K-12 MG1655 section 3 of 400 of the completegenome.o304; 100 pct identical to YAAF_ECOLI SW |
| Contig329D | 1178828_c2_137 | 547 | 3384 | 705 | 235 | 642 | 5.70E-63 | Bacillus subtilis | P12046 | purCphosphoribosylaminoimidazole succinocarboxamideB.subtilis pur operon encoding purine biosynthesis enzymes.12genes.phosphoribosylaminoimidazoles uccinocarboxamide synthasephosphoribosyl aminoidazole succinocarboxamide |
| Contig329D | 1179542_c3_175 | 548 | 3385 | 222 | 74 | | | | |
| Contig329D | 13864213_f3_83 | 549 | 3386 | 234 | 78 | 186 | 1.20E-14 | Bacillus subtilis | e1185044 | ykzGhypothetical protein ykzGBacillus subtilis complete genome (section 8 of 21) |
| Contig329D | 13866257_c1_124 | 550 | 3387 | 258 | 86 | 100 | 1.60E-05 | Saccharomyces cerevisiae | e222102 | SMF1 unknown proteinS.cerevisiae 10.6kbp fragment from chromosome XV.internal to SMF1 |

| | | | | | | | | |
|---|---|---|---|---|---|---|---|---|
| Contig329D | 13869091_f2_68 | 551 | 3388 | 294 | 98 | 246 | 5.30E-21 | Bacillus subtilis | P34959 | QOXDquinol oxidaseBacillus subtilis AA3-600 quinol oxidase (QOXA, QOXB, QOXC, QOXD)genes, complete cds.alternate gene name |
| Contig329D | 14460882_c3_176 | 552 | 3389 | 240 | 80 | 321 | 5.90E-29 | Staphylococcus haemolyticus | g1022726 | unknownStaphylococcus haemolyticus IS1272 ORF1 and ORF2 genes, completecds.ORF1 |
| Contig329D | 14642135_c1_126 | 553 | 3390 | 1905 | 635 | 2456 | 3.40E-255 | Bacillus subtilis | e1185067 | ylaGGTP-binding elongation factor homolog ylaGBacillus subtilis complete genome (section 8 of 21)similar to GTP-binding elongation factor |
| Contig329D | 14650302_c1_110 | 554 | 3391 | 264 | 88 | 179 | 6.60E-14 | Bacillus subtilis | P12049 | yexAconserved hypothetical protein yexABacillus subtilis complete genome (section 4 of 21)similar to hypothetical proteins |
| Contig329D | 156502_f1_21 | 555 | 3392 | 243 | 81 | | | | | |
| Contig329D | 19537562_f2_66 | 556 | 3393 | 198 | 66 | | | | | |
| Contig329D | 19804703_c2_138 | 557 | 3394 | 747 | 249 | 696 | 1.10E-68 | Bacillus subtilis | P12041 | purL,phosphoribosylformylglycinamidine synthetase IIB.subtilis pur operon encoding purine biosynthesis enzymes, 12genes,phosphoribosylformylglycinamidine synthase component Iphosphoribosylformyl glycinamidine synthetase I |
| Contig329D | 21648962_c3_163 | 558 | 3395 | 1827 | 609 | 1793 | 6.20E-185 | Streptococcus pyogenes | g517205 | 67 kDa Myosin-crossreactive streptococcalStreptococcus pyogenes 42 KD protein (ORF1) gene and 67 KDMyosin-crossreactive streptococcal antigen gene, complete cds.ORF2 |
| Contig329D | 21759653_f3_102 | 559 | 3396 | 609 | 203 | 552 | 2.00E-53 | Bacillus subtilis | P34958 | QOXCquinol oxidaseBacillus subtilis AA3-600 quinol oxidase (QOXA, QOXB, QOXC, QOXD)genes, complete cds.cytochrome-c oxidase chain IIIalternate gene name |
| Contig329D | 21915911_f1_24 | 560 | 3397 | 894 | 298 | 229 | 3.30E-19 | Bacillus subtilis | e1181521 | ykoCYkoCBacillus subtilis 168 56 kb DNA fragment between xlyA and ykoR. |
| Contig329D | 22775126_f2_59 | 561 | 3398 | 633 | 211 | 263 | 8.30E-23 | Bacillus subtilis | e1181523 | ykoEYkoEBacillus subtilis 168 56 kb DNA fragment between xlyA and ykoR. |

| | | | | | | | | | |
|---|---|---|---|---|---|---|---|---|---|
| Contig329D | 22931642_c2_132 | 562 | 3399 | 1224 | 408 | 1250 | 2.10E-127 | Staphylococcus aureus | d1024918 | fmtFmtStaphylococcus aureus DNA for Fmt, complete cds. |
| Contig329D | 23442177_f2_43 | 563 | 3400 | 669 | 223 | 429 | 2.10E-40 | Bacillus subtilis | g1377842 | yktBunknownBacillus subtilis ampS-nprE_gene region. |
| Contig329D | 23448838_f1_33 | 564 | 3401 | 873 | 291 | 786 | 3.20E-78 | Bacillus subtilis | P54382 | folDYqiABacillus subtilis DNA, 283 Kb region containing skin element.alternate gene name |
| Contig329D | 23459753_f3_78 | 565 | 3402 | 276 | 92 | | | | | |
| Contig329D | 23532327_c2_145 | 566 | 3403 | 1113 | 371 | 1432 | 1.10E-146 | Bacillus stearothermophilus | P21873 | pdhApyruvate dehydrogenase (lipoamide)B. stearothermophilus pdhA, pdhB, pdhC, pdhD genes for pyruvatedehydrogenase multienzyme complex (E.C. numbers 1.2.4.1, 2.3.1.12,1.8.1.4).pyruvate dehydrogenase (lipoamide) alpha chainE1 alpha subunit |
| Contig329D | 23695900_c2_139 | 567 | 3404 | 1551 | 517 | 1349 | 6.90E-138 | Bacillus subtilis | P00497 | purFphosphoribosylpyrophosphate amidotransferaseB.subtilis pur operon encoding purine biosynthesis enzymes, 12genes.amidophosphoribosyltransferase phosphoribosylpyrophosphate amidotransferase |
| Contig329D | 23730340_c2_147 | 568 | 3405 | 1422 | 474 | 2270 | 1.70E-235 | Staphylococcus aureus | g48874 | pdhDdihydrolipoamide dehydrogenaseS.aureus pdhB, pdhC and pdhD genes for pyruvate decarboxylase,dihydrolipoamide acetyltransferase and dihydrolipoamidededehydrogenase.dihydro lipoamide dehydrogenase |
| Contig329D | 23834680_c3_162 | 569 | 3406 | 210 | 70 | | | | | |
| Contig329D | 24025253_f1_34 | 570 | 3407 | 321 | 107 | 198 | 1.10E-14 | Clostridium paraputrificum | d1024701 | chiBchitinase BClostridium paraputrificum gene for chitinase B, complete cds. |
| Contig329D | 24256551_c3_160 | 571 | 3408 | 1071 | 357 | 938 | 2.50E-94 | Bacillus subtilis | P12043 | purMphosphoribosylaminoimidazole synthetaseB.subtilis pur operon encoding purine biosynthesis enzymes, 12genes.phosphoribosylformylglycinamidine cyclo-ligasephosphoribosyl aminoimidazole synthetase (PUR-M) |

| | | | | | | | | |
|---|---|---|---|---|---|---|---|---|
| Contig329D | 24314067_c1_129 | 572 | 3409 | 957 | 319 | 382 | 2.00E-35 | Bacillus subtilis | e334771 | ylbCYlbC proteinBacillus subtilis genomic DNA 23.9kB fragment.similar to hypothetical proteins from B. subtilis |
| Contig329D | 24415885_c1_128 | 573 | 3410 | 1227 | 409 | 651 | 6.40E-64 | Bacillus subtilis | O07639 | ylaOcell-division protein homolog ylaOBacillus subtilis complete genome (section 8 of 21)similar to cell-division protein |
| Contig329D | 24484828_c3_172 | 574 | 3411 | 552 | 184 | 169 | 7.60E-13 | Methanobacterium thermoautotrophicum | g2621742 | MTH659epoxidaseMethanobacterium thermoautotrophicum from bases 587310 to 597778(section 52 of 148) of the complete genome.Function Code |
| Contig329D | 24485950_c1_122 | 575 | 3412 | 537 | 179 | | | | | |
| Contig329D | 24610885_f3_69 | 576 | 3413 | 423 | 141 | | | | | |
| Contig329D | 24642042_c1_131 | 577 | 3414 | 228 | 76 | 118 | 1.90E-07 | Bacillus subtilis | e334782 | ylbNYlbN proteinBacillus subtilis genomic DNA 23.9kB fragment. |
| Contig329D | 24643836_c3_168 | 578 | 3415 | 633 | 211 | 227 | 5.40E-19 | Bacillus subtilis | g1377834 | ykrCunknownBacillus subtilis ampS-nprE gene region.similar to Orf5 encoded by GenBank Accession |
| Contig329D | 24652178_c3_180 | 579 | 3416 | 477 | 159 | 174 | 2.20E-13 | Bacillus subtilis | e1185386 | yozBconserved hypothetical protein yozBBacillus subtilis complete genome (section 11 of 21)similar to hypothetical proteins |
| Contig329D | 24730340_c3_167 | 580 | 3417 | 672 | 224 | 731 | 2.10E-72 | Bacillus subtilis | P39760 | ykqBorf4Bacillus subtilis genes for ampS, mreBH, orf1, kinC, orf3, orf4 andorf5.similar to product of orf4 encoded by GenBank |
| Contig329D | 24801713_c1_118 | 581 | 3418 | 1314 | 438 | 1906 | 6.50E-197 | Staphylococcus aureus | Q59821 | pdhCdihydrolipoamide acetyltransferaseS.aureus pdhB, pdhC and pdhD genes for pyruvate decarboxylase,dihydrolipoamide acetyltransferase and dihydrolipoamidedehydrogenase.dihydro lipoamide acetyltransferase |
| Contig329D | 24851577_c2_156 | 582 | 3419 | 564 | 188 | 405 | 7.50E-38 | Bacillus subtilis | e334776 | ylbIYlbH proteinBacillus subtilis genomic DNA 23.9kB fragment.similar to hypothetical proteins |
| Contig329D | 25509640_f1_22 | 583 | 3420 | 240 | 80 | | | | | |
| Contig329D | 25604677_c3_181 | 584 | 3421 | 450 | 150 | 322 | 4.70E-29 | Bacillus subtilis | e334774 | ylbFYlbF proteinBacillus subtilis genomic DNA 23.9kB fragment.similar to hypothetical proteins |

| | | | | | | | | |
|---|---|---|---|---|---|---|---|---|
| Contig329D | 25685000_c3_170 | 585 | 3422 | 903 | 301 | 1224 | 1.20E-124 | Bacillus subtilis | g143378 | pdhBpyruvate decarboxylase (E-1) beta subunitB.subtilis pyruvate dehydrogenase complex genes, complete cds;PAL-related lipoprotein (slp) gene, complete cds. lysinedecarboxylase (cad) gene, partial cds.similar to pyruvate decarboxylase (E-1) beta |
| Contig329D | 25939030_f2_53 | 586 | 3423 | 183 | 61 | | | | |
| Contig329D | 26354550_c3_183 | 587 | 3424 | 192 | 64 | | | | |
| Contig329D | 26828187_f3_74 | 588 | 3425 | 504 | 168 | 187 | 9.40E-15 | Bacillus subtilis | e1185072 | ylaLhypothetical protein ylaLBacillus subtilis complete genome (section 8 of 21) |
| Contig329D | 2868785_f1_28 | 589 | 3426 | 339 | 113 | 99 | 8.50E-05 | Vigna unguiculata | S54157 | extensin-like protein |
| Contig329D | 29319086_c3_182 | 590 | 3427 | 519 | 173 | 467 | 2.00E-44 | Bacillus subtilis | e334777 | ylbIYlbI proteinBacillus subtilis genomic DNA 23.9kB fragment.similar to lipopolysaccharide core biosynthesis |
| Contig329D | 29384818_c3_179 | 591 | 3428 | 3465 | 1155 | 3900 | 0 | Bacillus subtilis | e1185076 | pycApyruvate carboxylaseBacillus subtilis complete genome (section 8 of 21)alternate gene name |
| Contig329D | 30663955_c2_136 | 592 | 3429 | 1152 | 384 | 767 | 3.30E-76 | Bacillus subtilis | P12045 | purKphosphoribosylaminoimidazole carboxylase IIB.subtilis pur operon encoding purine biosynthesis enzymes, 12genes.phosphoribosylaminoimidazole carboxylase carbon dioxide-fixation chainphosphoribosyl aminoimidazole carboxylase II |
| Contig329D | 30745680_f2_67 | 593 | 3430 | 2007 | 669 | 2279 | 1.90E-236 | Bacillus subtilis | P34956 | QOXBquinol oxidaseBacillus subtilis AA3-600 quinol oxidase (QOXA, QOXB, QOXC, QOXD)genes, complete cds.cytochrome-c oxidase chain Ialternate gene name |
| Contig329D | 32242890_f2_51 | 594 | 3431 | 1701 | 567 | 1986 | 2.20E-205 | Bacillus subtilis | Q45493 | ykqCunknownBacillus subtilis ampS-nprE gene region.similar aminopeptidase AMPS with Swiss-Prot |
| Contig329D | 32756_f2_44 | 595 | 3432 | 1401 | 467 | 748 | 3.40E-74 | Oryza sativa | g2231132 | OsNramp1integral membrane proteinOryza Sativa integral membrane protein (OsNramp) mRNA,putative |

| | | | | | | | | |
|---|---|---|---|---|---|---|---|---|
| Contig329D | 33153_c3_173 | 596 | 3433 | 900 | 300 | 451 | 1.00E-42 | Borrelia burgdorferi | g2688563 | BB0641spermidine/putrescine ABC transporter, permeaseBorrelia burgdorferi (section 51 of 70) of the complete genome.similar to GB |
| Contig329D | 33594187_c2_151 | 597 | 3434 | 303 | 101 | 150 | 5.90E-10 | Lactobacillus rhamnosus | g2668605 | unknownLactobacillus rhamnosus 6-phospho-beta-glucosidase homolog gene,partial cds; GNTR transcriptional regulator homolog and surfacelocated protein genes, complete cds.3.0E-ORF-1 |
| Contig329D | 34175686_c1_109 | 598 | 3435 | 513 | 171 | 502 | 3.90E-48 | Bacillus subtilis | P12044 | purEphosphoribosylaminoimidazole carboxylase IB.subtilis pur operon encoding purine biosynthesis enzymes.12genes.phosphoribosylaminoimidazole carboxylase catalytic chainphosphoribosyl aminoimidazole carboxylase I |
| Contig329D | 35272200_f2_49 | 599 | 3436 | 222 | 74 | 94 | 6.70E-05 | Saccharomyces cerevisiae | g791116 | ODP2unknownS.cerevisiae PMS1, TPM1, MKS1, YMK1, MSK1, ODP2, YL9A & FKH2 genes.N2375, len |
| Contig329D | 35947191_c3_174 | 600 | 3437 | 1155 | 385 | 149 | 5.30E-07 | Kaposi's sarcoma-associated herpes-like virus | g1633572 | Kaposi's sarcoma-associated herpes-like virus ORF73 homolog gene,complete cds.Herpesvirus saimiri ORF73 homolog |
| Contig329D | 36129451_c1_115 | 601 | 3438 | 288 | 96 | 408 | 3.60E-38 | Staphylococcus carnosus | P23534 | ptsHHistidine-containing protein (HPr)S.carnosus ptsH gene for histidine-containing protein (HPr),phosphotransferase system phosphohistidine-containing protein |
| Contig329D | 36142817_c2_148 | 602 | 3439 | 1149 | 383 | 925 | 5.90E-93 | Borrelia burgdorferi | g2688562 | BB0642spermidine/putrescine ABC transporter,Borrelia burgdorferi (section 51 of 70) of the complete genome.similar to GB |
| Contig329D | 36219187_c3_159 | 603 | 3440 | 2208 | 736 | 2062 | 1.90E-213 | Bacillus subtilis | P12042 | purQphosphoribosylformylglycinamidine synthetase IB.subtilis pur operon encoding purine biosynthesis enzymes.12genes.phosphoribosylformylglycinamidine synthase component IIphosphoribosylformyl glycinamidine synthetase II |

| | | | | | | | | |
|---|---|---|---|---|---|---|---|---|
| Contig329D | 36601687_c1_111 | 604 | 3441 | 1260 | 420 | 1016 | 1.30E-102 | Bacillus subtilis | P12039 | purDphosphoribosylglycinamide synthetaseBacillus subtilis phosphoribosylaminoimidazole-carboxamideformyltransferase (purH-J) gene, partial cds,phosphoribosylglycinamide synthetase (purD), YecA (yecA), putativeadenine deaminase (yecB), YecC (yecC), and Yec |
| Contig329D | 3945257_f3_101 | 605 | 3442 | 1176 | 392 | 738 | 3.80E-73 | Bacillus subtilis | e1186316 | qoxAcytochrome aa3 quinol oxidase (subunit II)Bacillus subtilis complete genome (section 20 of 21)alternate gene name |
| Contig329D | 4103438_c2_155 | 606 | 3443 | 255 | 85 | 110 | 1.40E-06 | Bacillus subtilis | e334775 | ylbGYlbG proteinBacillus subtilis genomic DNA 23.9kB fragment.similar to hypothetical proteins |
| Contig329D | 4300332_c1_114 | 607 | 3444 | 1329 | 443 | | | | | |
| Contig329D | 4741010_c1_125 | 608 | 3445 | 846 | 282 | 650 | 8.10E-64 | Bacillus subtilis | g1377843 | yktCunknownBacillus subtilis ampS-nprE gene region.similar to E.coli extragenic suppressor protein |
| Contig329D | 4876542_f1_20 | 609 | 3446 | 633 | 211 | 551 | 2.50E-53 | Bacillus subtilis | g1377833 | yktBunknownBacillus subtilis ampS-nprE gene region.similar to polypeptide deformylase from Mycoplasma |
| Contig329D | 4899187_f1_1 | 610 | 3447 | 1149 | 383 | 402 | 1.60E-37 | Bacillus subtilis | e334781 | ylbMYlbM proteinBacillus subtilis genomic DNA 23.9kB fragment.similar to hypothetical proteins |
| Contig329D | 5117162_c2_144 | 611 | 3448 | 1023 | 341 | 517 | 1.00E-49 | Bacillus subtilis | g2293292 | ythBYthB proteinBacillus subtilis rrnB-dnaB genomic region.similarity to NADH dehydrogenases |
| Contig329D | 5157963_f1_4 | 612 | 3449 | 939 | 313 | 219 | 3.10E-22 | Bacillus subtilis | c1182963 | yhdWhypothetical proteinBacillus subtilis complete genome (section 6 of 21)similar to glycerophosphodiester phosphodiesterase |
| Contig329D | 5974138_f3_77 | 613 | 3450 | 204 | 68 | | | | | |
| Contig329D | 6023593_c2_152 | 614 | 3451 | 288 | 96 | 296 | 2.60E-26 | Bacillus subtilis | e1185074 | ylaNhypothetical proteinylaNBacillus subtilis complete genome (section 8 of 21) |
| Contig329D | 6115700_f3_93 | 615 | 3452 | 1404 | 468 | 356 | 6.50E-64 | Bacillus subtilis | e1181522 | ykoDYkoDBacillus subtilis 168 56 kb DNA fragment between xlyA and ykoR.homologous to cobalt transport ATP binding protein |

| | | | | | | | | | |
|---|---|---|---|---|---|---|---|---|---|
| Contig329D | 632762_f3_104 | 616 | 3453 | 222 | 74 | | | | |
| Contig329D | 6720452_c3_166 | 617 | 3454 | 1356 | 452 | 879 | 4.40E-88 | Bacillus subtilis | g2293293 | ythAYthABacillus subtilis rrnB-dnaB genomic region.similarity to cytochrome oxidase D subunit I |
| Contig329D | 6834687_c3_171 | 618 | 3455 | 309 | 103 | 209 | 4.40E-17 | Bacillus subtilis | g1377841 | yktAunknownBacillus subtilis ampS-nprF. gene region. |
| Contig329D | 7320465_c2_149 | 619 | 3456 | 831 | 277 | 525 | 1.40E-50 | Borrelia burgdorferi | g2688564 | BB0640spermidine/putrescine ABC transporter, permeaseBorrelia burgdorferi (section 51 of 70) of the complete genome.similar to GB |
| Contig329D | 867176_c3_161 | 620 | 3457 | 1512 | 504 | 1090 | 1.90E-110 | Aquifex aeolicus | g2984204 | purHphosphoribosylaminoimidazolecarb oxamidcAquifex aeolicus section 97 of 109 of the complete genome. |
| Contig329D | 968785_f1_8 | 621 | 3458 | 939 | 313 | 749 | 2.60E-74 | Bacillus stearothermophilus | d1011770 | ctaAheme O oxygenaseBacillus stearothermophilus genes for hemc O oxygenase andsynthetase and cytochrome c subunits II, I, III and IV, completeeds. |
| Contig329D | 9925910_c2_140 | 622 | 3459 | 597 | 199 | 430 | 1.70E-40 | Bacillus subtilis | P12040 | purNphosphoribosylglycinamide formyltransferaseB.subtilis pur operon encoding purine biosynthesis enzymes, 12genes,phosphoribosylglycinamide formyltransferasephosphoribosyl glycinamide formyltransferase |
| Contig329D | 9933463_c3_164 | 623 | 3460 | 1188 | 396 | 897 | 5.40E-90 | Bacillus subtilis | P39587 | ipa-19dconserved hypothetical protein ywbDB.subtilis genomic region (325 to 333).alternate gene name |
| Contig333D | 10553125_f2_90 | 624 | 3461 | 810 | 270 | 335 | 1.30E-31 | Gallus gallus | g211700 | type X collagenChicken type X collagen gene. |
| Contig333D | 10665903_c2_226 | 625 | 3462 | 378 | 126 | 151 | 4.90E-10 | Escherichia coli | P37349 | ycgChypothetical protein in trcA 5'regionEscherichia coli K-12 MG1655 section 108 of 400 of the completegenome.f473; 100 pct identical to fragment YCGC_ECOLI SW |
| Contig333D | 10828312_f3_133 | 626 | 3463 | 1617 | 539 | 272 | 9.80E-21 | Bacillus subtilis | e1182674 | yesMtwo-component sensor histidine kinase lYes homolog yesMBacillus subtilis complete genome (section 4 of 21)similar to two-component sensor histidine kinase |

| | | | | | | | | |
|---|---|---|---|---|---|---|---|---|
| Contig333D | 1182765_c1_189 | 627 | 3464 | 7215 | 2405 | 2909 | 0 | | Bacillus licheniformis | g2982196 | bacCbacitracin synthetase 3Bacillus licheniformis bacitracin synthetase operon includingbacitracin synthetase 1 (bacA), 2 (bacB) and 3 (bacC) genes,complete cds,peptide synthetase; BA3; BacC |
| Contig333D | 11895058_c2_206 | 628 | 3465 | 939 | 313 | 164 | 4.20E-10 | Enterococcus faecalis | g43338 | sprEStaphylococcal serine proteinase homologueE.faecalis sprE gene for serine proteinase homologue. |
| Contig333D | 12554627_c1_161 | 629 | 3466 | 216 | 72 | | | | |
| Contig333D | 1367200_f1_55 | 630 | 3467 | 624 | 208 | | | | |
| Contig333D | 1367202_c2_224 | 631 | 3468 | 963 | 321 | 516 | 9.30E-61 | Escherichia coli | g1787450 | hypothetical protein b1200Escherichia coli K-12 MG1655 section 108 of 400 of the completegenome.f366; 35 pct identical (32 gaps) to 355 residues |
| Contig333D | 1367340_c2_193 | 632 | 3469 | 843 | 281 | 250 | 8.20E-31 | Streptococcus pyogenes | e187587 | oppDoligopeptidepermcaseS.pyogenes DNA for oppA, oppB, oppC, oppD, oppF, and dacA genes. |
| Contig333D | 13707008_f2_73 | 633 | 3470 | 231 | 77 | | | | |
| Contig333D | 1385962_c1_185 | 634 | 3471 | 984 | 328 | 1016 | 1.30E-102 | Bacillus subtilis | P53557 | bioBbiotin synthaseBacillus subtilis rrnB-dnaB genomic region. |
| Contig333D | 1411400_f1_37 | 635 | 3472 | 390 | 130 | 131 | 8.10E-09 | Caenorhabditis elegans | g1051338 | T04F8.8Caenorhabditis elegans cosmid T04F8, complete sequence.cDNA EST yk121f1.5 comes from this gene |
| Contig333D | 14492327_c2_222 | 636 | 3473 | 429 | 143 | 495 | 2.20E-47 | Staphylococcus epidermidis | Q03377 | fosBfosfomycin resistance protein BS.epidermidis plasmid pIP1842 fosB gene for FOSB. |
| Contig333D | 14895212_c1_168 | 637 | 3474 | 822 | 274 | 510 | 5.60E-49 | Bacillus subtilis | g143607 | spo0Ksporulation proteinBacillus subtilis spo0K operon. |
| Contig333D | 157625_c2_196 | 638 | 3475 | 930 | 310 | | | | |
| Contig333D | 162550_c1_174 | 639 | 3476 | 198 | 66 | | | | |
| Contig333D | 162578_c2_194 | 640 | 3477 | 984 | 328 | 338 | 9.40E-31 | Bacillus subtilis | e1181925 | ykuTYkuT proteinBacillus subtilis 29KB DNA fragment from ykwC gene to cse15 gene.similar to hypothetical proteins |
| Contig333D | 165902_c1_190 | 641 | 3478 | 627 | 209 | 185 | 1.50E-14 | Bacillus subtilis | P39144 | lpa-14lipopeptide antibiotics iturin AB.subtilis lpa-14 gene encoding lipopeptide antibiotics iturin A. |
| Contig333D | 187561_c2_215 | 642 | 3479 | 879 | 293 | | | | |

| Contig333D | 194010_c1_150 | 643 | 3480 | 1512 | 504 | 1102 | 1.00E-111 | Corynebacterium glutamicum | e1286985 | mqoL-malate dehydrogenase (acceptor)Corynebacterium glutamicum DNA for L-Malate |
|---|---|---|---|---|---|---|---|---|---|---|
| Contig333D | 19773387_f2_88 | 644 | 3481 | 1248 | 416 | | | | | |
| Contig333D | 20585963_f2_97 | 645 | 3482 | 897 | 299 | 657 | 1.50E-64 | Bacillus anthracis | g929972 | Bacillus anthracis Weybridge A toxin plasmid pXO1 right invertedrepeat element (WcyAR) bordering the toxin-encoding region, ORFAand ORFB genes, complete cds.ORFB; similar to B. anthracis SterneL element ORFB; |
| Contig333D | 20704012_f3_135 | 646 | 3483 | 240 | 80 | | | | | |
| Contig333D | 207876_f3_130 | 647 | 3484 | 513 | 171 | 113 | 3.20E-05 | Mus musculus | d1000902 | Mouse putative primordial protein transcript.open reading frame (251 AA) |
| Contig333D | 20979688_c3_231 | 648 | 3485 | 786 | 262 | 369 | 4.90E-34 | Escherichia coli | P33592 | nikCNikCEscherichia coli K-12 MG1655 section 313 of 400 of the completegenome.o277 |
| Contig333D | 212827_f2_62 | 649 | 3486 | 1482 | 494 | 429 | 2.10E-40 | Bacillus subtilis | e1185986 | yubDmultidrug resistance protein homolog yubDBacillus subtilis complete genome (section 16 of 21)similar to multidrug resistance protein |
| Contig333D | 22042337_c3_255 | 650 | 3487 | 1434 | 478 | 981 | 6.80E-99 | Bacillus subtilis | e1182351 | ycnBhomologue of multidrug resistance protein B,Bacillus subtilis complete genome (section 3 of 21)similar to multidrug resistance protein |
| Contig333D | 22664140_f2_87 | 651 | 3488 | 1395 | 465 | 191 | 8.30E-12 | Archaeoglobus fulgidus | g2650395 | AF0246iron (II) transporter (feoB-1)Archaeoglobus fulgidus section 18 of 172 of the complete genome.similar to GB |
| Contig333D | 22664550_c3_232 | 652 | 3489 | 663 | 221 | 275 | 4.40E-24 | Escherichia coli | g1789891 | nikEnikE proteinEscherichia coli K-12 MG1655 section 313 of 400 of the completegenome.unassigned ATP-binding cassette proteinso268 |
| Contig333D | 22853432_c2_207 | 653 | 3490 | 384 | 128 | 152 | 2.00E-10 | Sus scrofa | P18175 | IVLinvolucrinPig involucrin gene, complete cds.involucrininvolucrin |
| Contig333D | 23444425_c2_195 | 654 | 3491 | 846 | 282 | 362 | 2.70E-33 | Bacillus subtilis | e1183056 | yhjKhypothetical proteinBacillus subtilis complete genome (section 6 of 21)similar to hypothetical proteins |

| | | | | | | | | |
|---|---|---|---|---|---|---|---|---|
| Contig333D | 23470290_c3_243 | 655 | 3492 | 915 | 305 | 496 | 1.70E-47 | Bacillus firmus | g1813497 | dppCdipeptide transporter protein dppCBacillus firmus dppABC operon, dipeptide transporter protein dppAgene, partial cds, and dipeptide transporter proteins dppB and dppCgenes, complete cds. |
| Contig333D | 235837_c2_216 | 656 | 3493 | 1425 | 475 | | | | |
| Contig333D | 23601510_c2_223 | 657 | 3494 | 1137 | 379 | 911 | 1.80E-91 | Bacillus stearothermophilus | P32816 | gldglycerol dehydrogenasBacillus stearothermophilus glycerol dehydrogenase (proposed gld)gene, complete cds.lactaldehyde reductase |
| Contig333D | 236477750_f2_81 | 658 | 3495 | 201 | 67 | | | | |
| Contig333D | 23860307_c1_170 | 659 | 3496 | 1218 | 406 | 260 | 1.80E-20 | Synechocystis sp. | d1018569 | norAquinolene resistance protein NorASynechocystis sp. PCC6803 complete genome, 11/27, 1311235-1430418.ORF_ID |
| Contig333D | 24000275_f2_64 | 660 | 3497 | 1026 | 342 | 1033 | 2.10E-104 | Haemophilus influenzae | P44770 | HI0596ornithine carbamoyltransferase (arcB)Haemophilus influenzae from bases 614291 to 624841 (section 56 of163) of the complete genome.ornithine carbamoyltransferasesimilar to GB |
| Contig333D | 24105393_c3_247 | 661 | 3498 | 768 | 256 | 648 | 1.30E-63 | Streptococcus mutans | g2952528 | pflCpyruvate-formate lyase activating enzymeStreptococcus mutans YtqB (ytqB) gene, partial cds; ABC transporter(abcX), putative permease (pcrM), putative hemolysin (hlyX),pyruvate-formate lyase activating enzyme (pflC), D-alanine-D-alanyl carrier protein1 |
| Contig333D | 24225375_c3_236 | 662 | 3499 | 213 | 71 | 97 | 3.20E-05 | Staphylococcus epidermidis | g3212079 | phenol soluble modulin beta 1Staphylococcus epidermidis phenol soluble modulin beta 1 and phenolsoluble modulin beta 2 genes, complete cds.PSM beta 1 |
| Contig333D | 24407677_f2_61 | 663 | 3500 | 234 | 78 | | | | |
| Contig333D | 24650300_c2_219 | 664 | 3501 | 1365 | 455 | 1037 | 8.00E-105 | Lactobacillus delbrueckii | P54104 | brnQbranched-chain amino acid carrierL.delbrueckii brnQ gene for branched-chain amino acid carrier. |
| Contig333D | 24664012_f1_25 | 665 | 3502 | 453 | 151 | | | | |
| Contig333D | 24711588_c3_256 | 666 | 3503 | 225 | 75 | | | | |

| | | | | | | | | | |
|---|---|---|---|---|---|---|---|---|---|
| Contig333D | 24884688_c3_230 | 667 | 3504 | 528 | 176 | 157 | 2.50E-12 | Archaeoglobus fulgidus | g2648784 | AF1767dipeptide ABC transporter, dipeptide-bindingArchaeoglobus fulgidus section 126 of 172 of the complete genome.similar to GP |
| Contig333D | 24886552_c1_164 | 668 | 3505 | 792 | 264 | 585 | 6.30E-57 | Klebsiella pneumoniae | d1013772 | budCmeso-2,3-butanediol dehydrogenase (D-acetoinKlebsiella pneumoniae gene for meso-2,3-butanediol dehydrogenase(D-acetoin forming), complete cds. |
| Contig333D | 25395877_f1_42 | 669 | 3506 | 360 | 120 | 140 | 5.00E-09 | Caenorhabditis elegans | c1188061 | F46B3.cCaenorhabditis elegans cosmid F46B3, complete sequence.protein predicted using Genefinder; preliminary |
| Contig333D | 25429665_c2_228 | 670 | 3507 | 1338 | 446 | 267 | 3.60E-21 | Lactococcus lactis | g1052754 | lmrPLmrP integral membrane proteinL.lactis DNA for LmrP gene. |
| Contig333D | 25894687_c1_160 | 671 | 3508 | 243 | 81 | | | | | |
| Contig333D | 26182681_c1_145 | 672 | 3509 | 528 | 176 | | | | | |
| Contig333D | 26367135_c2_229 | 673 | 3510 | 1473 | 491 | 749 | 2.60E-74 | Staphylococcus epidermidis | g2981225 | geh1lipase precursorStaphylococcus epidermidis lipase precursor (geh1) gene, completecds. |
| Contig333D | 26369027_f1_53 | 674 | 3511 | 984 | 328 | 1350 | 5.40E-138 | Bacillus subtilis | e1182793 | yjfNYjfNBacillus subtilis complete genome (section 5 of 21)similar to hypothetical proteins |
| Contig333D | 26600936_f1_51 | 675 | 3512 | 513 | 171 | 373 | 1.80E-34 | Haemophilus influenzae | P43984 | HI0318H. influenzae predicted coding region HI0318Haemophilus influenzae from bases 345094 to 356754 (section 32 of163) of the complete genome.identified by GeneMark; putative. E. Koonin |
| Contig333D | 26759430_c1_177 | 676 | 3513 | 978 | 326 | 872 | 2.40E-87 | Bacillus subtilis | e1186069 | opuCCglycine betaine/carnitine/choline ABCBacillus subtilis complete genome (section 18 of 21)alternate gene name |
| Contig333D | 26760076_f2_65 | 677 | 3514 | 1578 | 526 | 1550 | 3.50E-159 | Haemophilus influenzae | P44023 | HI0594H. influenzae predicted coding region HI0594Haemophilus influenzae from bases 614291 to 624841 (section 56 of163) of the complete genome.identified by GeneMark; putative. E. Koonin |
| Contig333D | 272593_c1_165 | 678 | 3515 | 879 | 293 | | | | | |

| | | | | | | | | |
|---|---|---|---|---|---|---|---|---|
| Contig333D | 2928437_c2_220 | 679 | 3516 | 921 | 307 | 375 | 1.10E-34 | Archaeoglobus fulgidus | g2649377 | AF1210conserved hypothetical proteinArchaeoglobus fulgidus section 86 of 172 of the complete genome.similar to GP |
| Contig333D | 2929718_c2_211 | 680 | 3517 | 1959 | 653 | 1384 | 1.30E-141 | Staphylococcus aureus | P10335 | GEHtriacylglycerol lipase,S.aureus gch gene encoding lipase (glycerol ester hydrolase),lipase precursor (gch; EC 3.1.1.3) |
| Contig333D | 3003137_f1_31 | 681 | 3518 | 906 | 302 | 294 | 4.30E-26 | Aquifex aeolicus | g2982874 | cobWcobalamin synthesis related protein CobWAquifex aeolicus section 7 of 109 of the complete genome. |
| Contig333D | 30271882_c1_155 | 682 | 3519 | 720 | 240 | 268 | 2.50E-23 | unidentified | g490316 | bioDSynthetic (LORF1) bioD gene. |
| Contig333D | 30351677_c1_147 | 683 | 3520 | 804 | 268 | | | | | |
| Contig333D | 30742307_c3_250 | 684 | 3521 | 669 | 223 | 640 | 9.30E-63 | Bacillus subtilis | g2271392 | opuCDtransmembrane proteinBacillus subtilis osmoprotectant transport system OpuC includingATPase protein (opuCA), transmembrane protein (opuCB), osmoprotectantbinding protein precursor (opuCC) and transmembrane protein (opuCD)genes, complete cds.OpuCD; part of th |
| Contig333D | 3163552_c1_146 | 685 | 3522 | 963 | 321 | 326 | 1.80E-29 | Pyrococcus horikoshii | d1027921 | PHC1I021323aa long hypothetical oligopeptide transportPyrococcus horikoshii OT3 genomic DNA, 695940-732858 nt position,clonesimilar to Swiss_Prot |
| Contig333D | 3174187_f1_35 | 686 | 3523 | 330 | 110 | | | | | |
| Contig333D | 32615677_c3_239 | 687 | 3524 | 1035 | 345 | 510 | 5.60E-49 | Bacillus subtilis | d1023108 | ycdIYcdHBacillus subtilis genomic DNA, 22 to 25 degree region, completecds.homologue of adhesion protein precursor of |
| Contig333D | 32755_f1_22 | 688 | 3525 | 195 | 65 | | | | | |
| Contig333D | 33479716_c1_163 | 689 | 3526 | 1401 | 467 | 409 | 2.80E-38 | Mycobacterium tuberculosis | e264148 | MTCY3G12.01MTCY3G12.01unknownMycobacterium tuberculosis cosmid SCY03G12.MTCY3G12.01, len |

86E780"T00HET60

| | | | | | | | | | | |
|---|---|---|---|---|---|---|---|---|---|---|
| Contig333D | 34429837_f3_113 | 690 | 3527 | 948 | 316 | 769 | 2.00E-76 | Escherichia coli | Q46807 | YQEAhypothetical protein b2874Escherichia coli K-12 MG1655 section 260 of 400 of the completegenome.carbamate kinaseo310; This 310 aa ORF is 45 pct identical (21 gaps) |
| Contig333D | 34631527_f3_136 | 691 | 3528 | 336 | 112 | 304 | 3.80E-27 | Bacillus anthracis | g929968 | Bacillus anthracis Sterne toxin plasmid pXO1 right inverted repeatelement (SterneR) bordering the toxin-encoding region, ORFA andtruncated ORFB genes, complete cds.ORFA; similar to B. anthracis WeyAR element ORFA; |
| Contig333D | 34642135_c1_183 | 692 | 3529 | 246 | 82 | | | | | |
| Contig333D | 34657677_c1_154 | 693 | 3530 | 3552 | 1184 | 423 | 1.70E-38 | Bombyx mori | g457769 | CollagenB.mori mRNA for collagen.unassigned collagens |
| Contig333D | 35312766_f1_5 | 694 | 3531 | 195 | 65 | | | | | |
| Contig333D | 35331905_c1_153 | 695 | 3532 | 318 | 106 | | | | | |
| Contig333D | 36135752_f3_128 | 696 | 3533 | 1128 | 376 | 172 | 1.40E-10 | Bacillus subtilis | P50736 | ypdAthioredoxin reductase homolog ypdABacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypeB, ypfA, y |
| Contig333D | 36601703_c2_213 | 697 | 3534 | 939 | 313 | 294 | 4.30E-26 | Escherichia coli | P33944 | yojLyojL proteinEscherichia coli K-12 MG1655 section 200 of 400 of the completegenome.f351; Residues 1-121 are 100 pct identical to |
| Contig333D | 3939215_f1_47 | 698 | 3535 | 984 | 328 | 377 | 6.90E-35 | Serpulina hyodysenteriae | g2766193 | periplasmic-iron-binding protein ShiBSerpulina hyodysenteriae shi operon, periplasmic-iron-bindingproteins ShiA and ShiB, putative ABC transporter ShiC, and putativepermeases ShiD and ShiE genes, complete cds. |

| | | | | | | | | |
|---|---|---|---|---|---|---|---|---|
| Contig333D | 3948408_c1_178 | 699 | 3536 | 777 | 259 | 315 | 2.60E-28 | Caldicellulosirupt or saccharolyticus | P23553 | XynCacetylxylosidaseCaldicellulosirupt or saccharolyticus putative transport protein(XynG), putative transport protein (XynH), xylanase (XynF),xylanase (XynE), xylanase (XynD), xylanase (XynA), acetylxylosidase(XynC) and xylanase (XynB) genes, complete cds |
| Contig333D | 3954382_c2_197 | 700 | 3537 | 195 | 65 | | | | |
| Contig333D | 4062925_f1_46 | 701 | 3538 | 393 | 131 | 103 | 6.40E-07 | Lactococcus lactis cremoris | g2072447 | epsJEpsJLactococcus lactis cremoris plasmid pNZ4000 insertion sequenceIS982 putative transposase gene and eps gene cluster(epsRXABCDEFGHIJKL), complete cds. |
| Contig333D | 4072680_f3_125 | 702 | 3539 | 774 | 258 | 311 | 6.80E-28 | Bacillus subtilis | c1186097 | yvfRhypothetical proteinBacillus subtilis complete genome (section 18 of 21)similar to ABC transporter (A1P-binding protein) |
| Contig333D | 4094052_f2_76 | 703 | 3540 | 219 | 73 | | | | | |
| Contig333D | 4101063_f3_138 | 704 | 3541 | 396 | 132 | | | | | |
| Contig333D | 4101640_c3_240 | 705 | 3542 | 3054 | 1018 | 680 | 1.60E-66 | Bacillus subtilis | P54524 | yqfGYqfGBacillus subtilis DNA, 283 Kb region containing skin element,similar to NADH-dependent flavin oxidoreductase |
| Contig333D | 429785_f2_79 | 706 | 3543 | 192 | 64 | | | | | |
| Contig333D | 4705053_c3_237 | 707 | 3544 | 1221 | 407 | 454 | 4.80E-43 | Haemophilus influenzae | P44422 | HI1537-keto-8-aminopelargonic acid synthetase (bioF)Haemophilus influenzae from bases 1615141 to 1631528 (section 145of 163) of the complete genome.similar to GB |
| Contig333D | 4765_f1_45 | 708 | 3545 | 321 | 107 | | | | | |
| Contig333D | 4773518_c1_184 | 709 | 3546 | 885 | 295 | 563 | 1.30E-54 | Streptococcus equisimilis | c312302 | lppCCytoplasmic membrane lipoproteinS.equisimilis gapC and lppC genes. |
| Contig333D | 4782963_c2_209 | 710 | 3547 | 1365 | 455 | 1105 | 5.00E-112 | Aquifex aeolicus | g2982887 | bioADAPA aminotransferaseAquifex aeolicus section 8 of 109 of the complete genome. |
| Contig333D | 4791177_c3_248 | 711 | 3548 | 588 | 196 | 308 | 1.40E-27 | Synechocystis sp. | d1011096 | hypothetical proteinSynechocystis sp. PCC6803 complete genome, 22/27, 2755703-2868766.ORF_ID |

| | | | | | | | |
|---|---|---|---|---|---|---|---|
| Contig333D | 4798202_c1_159 | 712 | 3549 | 816 | 272 | | | |
| Contig333D | 4859628_c1_148 | 713 | 3550 | 195 | 65 | | | |
| Contig333D | 4867842_c1_175 | 714 | 3551 | 978 | 326 | 1.90E-46 | Archaeoglobus fulgidus | g2649379 | AF12063-hydroxyacyl-CoA dehydrogenase (hbd-8)Archaeoglobus fulgidus section 86 of 172 of the complete genome.similar to PID |
| Contig333D | 4884812_f2_70 | 715 | 3552 | 1257 | 419 | 7.00E-26 | Escherichia coli | P23908 | argE.acetylornithine deacetylaseEscherichia coli K-12 MG1655 section 360 of 400 of the completegenome.f383; 100 pct identical to ARGE_ECOLI SW |
| Contig333D | 4895061_c3_246 | 716 | 3553 | 2271 | 757 | 5.60E-278 | Escherichia coli | P09373 | pflFormate C-acetyltransferaseEscherichia coli genomic DNA. (20.3 - 20.7 min).f760; 100 pct identical to PFLB_ECOLI SW |
| Contig333D | 4974091_c3_249 | 717 | 3554 | 504 | 168 | | | | |
| Contig333D | 5109785_c1_187 | 718 | 3555 | 255 | 85 | | | | |
| Contig333D | 5113413_c1_176 | 719 | 3556 | 642 | 214 | 2.70E-56 | Bacillus subtilis | g2271390 | opuCBtransmembrane proteinBacillus subtilis osmoprotectant transport system OpuC includingATPase (opuCA), transmembrane protein (opuCB), osmoprotectantbinding protein precursor (opuCC) and transmembrane protein (opuCD)genes, complete cds.OpuCB; part of th |
| Contig333D | 5160925_c2_205 | 720 | 3557 | 192 | 64 | | | | |
| Contig333D | 5189037_c1_156 | 721 | 3558 | 711 | 237 | 3.90E-32 | Methanococcus jannaschii | g1591935 | MJ12976-carboxyhexanoate-CoA ligase (bioW)Methanococcus jannaschii section 112 of 150 of the complete genome.similar to GB |
| Contig333D | 6056567_c2_225 | 722 | 3559 | 579 | 193 | 7.60E-29 | Escherichia coli | g1787449 | hypothetical protein b1199Escherichia coli K-12 MG1655 section 108 of 400 of the completegenome.f210; 30 pct identical (16 gaps) to 181 residues |
| Contig333D | 625262_c2_198 | 723 | 3560 | 228 | 76 | | | | |

| | | | | | | | | | |
|---|---|---|---|---|---|---|---|---|---|
| Contig333D | 6302217_c1_167 | 724 | 3561 | 948 | 316 | 541 | 2.90E-52 | Escherichia coli | g1789888 | nikBnickel transport system permease protein nikBEscherichia coli K-12 MG1655 section 313 of 400 of the completegenome.o314; 99 pct identical amino acid sequence and |
| Contig333D | 7072825_c2_202 | 725 | 3562 | 774 | 258 | 446 | 3.40E-42 | Candida albicans | P87219 | SOU1Sou1pCandida albicans Sou2p (SOU2), Sou1p (SOU1) and Vma8p (VMA8) genes,complete cds.short-chain alcohol dehydrogenase homolog |
| Contig333D | 800300_c2_208 | 726 | 3563 | 585 | 195 | 313 | 4.20E-28 | Saimiri sciureus | e256400 | anti-P.falciparum antigenic polypeptideDNA encoding anti-P.falciparum antigenic polypeptide. |
| Contig333D | 814140_c2_204 | 727 | 3564 | 1422 | 474 | 1168 | 1.00E-118 | Escherichia coli | P13408 | uhpThexosephosphate transport proteinEscherichia coli K-12 MG1655 section 334 of 400 of the completegenome.hexose phosphate transport protein uhpTf463; 99 pct identical amino acid sequence and |
| Contig333D | 816878_c1_166 | 728 | 3565 | 1632 | 544 | 840 | 6.00E-84 | Escherichia coli | P33590 | nikAnickel-binding periplasmic protein precursorEscherichia coli K-12 MG1655 section 313 of 400 of the completegenome.dipeptide transport proteino524; 100 pct identical amino acid sequence and |
| Contig333D | 822150_f1_54 | 729 | 3566 | 516 | 172 | | | | | |
| Contig333D | 875765_c3_235 | 730 | 3567 | 210 | 70 | | | | | |
| Contig333D | 969157_c2_191 | 731 | 3568 | 1026 | 342 | 203 | 9.30E-14 | Escherichia coli | P33590 | nikAnickel-binding periplasmic protein precursorEscherichia coli K-12 MG1655 section 313 of 400 of the completegenome.dipeptide transport proteino524; 100 pct identical amino acid sequence and |
| Contig333D | 9806718_c2_218 | 732 | 3569 | 762 | 254 | 417 | 4.00E-39 | Escherichia coli | P37313 | dppFdipeptide transport ATP-binding protein dppFEscherichia coli K-12 MG1655 section 321 of 400 of the completegenome.inner membrane protein malKf334; 100 pct identical amino acid sequence and |

| | | | | | | | | |
|---|---|---|---|---|---|---|---|---|
| Contig333D | 984686_c2_221 | 733 | 3570 | 1221 | 407 | 1172 | 3.90E-119 | Bacillus subtilis | g2271389 | opuCAATPaseBacillus subtilis osmoprotectant transport system OpuC includingATPase (opuCA), transmembrane protein (opuCB), osmoprotectantbinding protein precursor (opuCC) and transmembrane protein (opuCD)genes, complete cds.OpuCA; part of the osmoprotectan |
| Contig333D | 9970167_f2_96 | 734 | 3571 | 861 | 287 | 219 | 2.40E-25 | Bacillus subtilis | e1182675 | yesNtwo-component response regulator [YesMBacillus subtilis complete genome (section 4 of 21)similar to two-component response regulator [YesM |
| Contig334D | 1017_f1_54 | 735 | 3572 | 255 | 85 | | | | | |
| Contig334D | 10666068_c3_256 | 736 | 3573 | 330 | 110 | 196 | 1.00E-15 | Bacillus subtilis | P25955 | comG3ComGCBacillus subtilis (clone pED4) comG-(1,2,3,4,5,6,and 7) proteins incomG operon. complete cds. |
| Contig334D | 10969050_c2_201 | 737 | 3574 | 1596 | 532 | 1815 | 2.90E-187 | Bacillus subtilis | P37949 | lepAYqeQBacillus subtilis DNA, 283 Kb region containing skin element.alternate gene name |
| Contig334D | 10970258_f3_122 | 738 | 3575 | 1011 | 337 | 1197 | 8.80E-122 | Bacillus subtilis | e1183983 | yrvNconserved hypothetical protein yrvNBacillus subtilis complete genome (section 14 of 21)similar to hypothetical proteins |
| Contig334D | 11194067_c3_240 | 739 | 3576 | 747 | 249 | 431 | 1.30E-40 | Bacillus subtilis | P54458 | yqeMYqeMBacillus subtilis DNA, 283 Kb region containing skin element.similar to hypothetical proteins |
| Contig334D | 11720090_c3_241 | 740 | 3577 | 525 | 175 | 588 | 3.00E-57 | Staphylococcus aureus | P45556 | HRCAORF37Staphylococcus aureus genes for ORF37; HSP20; HSP40; ORF35.complete cds. |
| Contig334D | 1218750_c1_150 | 741 | 3578 | 681 | 227 | 336 | 1.50E-30 | Streptococcus pneumoniae | g3211753 | celAcompetence proteinStreptococcus pneumoniae competence protein (celA) and competenceprotein (celB) genes, complete cds; and unknown gene. |
| Contig334D | 136068_f3_99 | 742 | 3579 | 1404 | 468 | 1201 | 3.30E-122 | Mycobacterium tuberculosis | e315164 | glySGlySMycobacterium tuberculosis cosmid Y27.MTCY27.23, glyS, len |
| Contig334D | 14259631_c1_135 | 743 | 3580 | 1068 | 356 | 1207 | 7.70E-123 | Bacillus subtilis | e1184021 | queAS-adenosylmethionine tRNA ribosyltransferaseBacillus subtilis complete genome (section 15 of 21) |

| | | | | | | | | |
|---|---|---|---|---|---|---|---|---|
| Contig334D | 14508567_c3_230 | 744 | 3581 | 276 | 92 | 184 | 2.00E-14 | Bacillus subtilis | e1184019 | yrbFconserved hypothetical protein yrbFBacillus subtilis complete genome (section 15 of 21)similar to hypothetical proteins |
| Contig334D | 14881687_c3_254 | 745 | 3582 | 993 | 331 | 1448 | 2.20E-148 | Staphylococcus xylosus | g666116 | glkAglucose kinaseS.xylosus glucose kinase gene. |
| Contig334D | 15728386_c3_229 | 746 | 3583 | 1143 | 381 | 1542 | 2.40E-158 | Bacillus subtilis | e1184020 | tgtitRNA-guanine transglycosylaseBacillus subtilis complete genome (section 15 of 21) |
| Contig334D | 16828175_c1_163 | 747 | 3584 | 606 | 202 | 800 | 1.00E-79 | Bacillus subtilis | d1013186 | sodAYqgDBacillus subtilis DNA, 283 Kb region containing skin element.alternate gene name |
| Contig334D | 189203_c3_243 | 748 | 3585 | 762 | 254 | 550 | 3.20E-53 | Bacillus subtilis | P54461 | yqeUYqeUBacillus subtilis DNA, 283 Kb region containing skin element.similar to hypothetical proteins |
| Contig334D | 19540931_c2_199 | 749 | 3586 | 2220 | 740 | 647 | 1.70E-63 | Bacillus subtilis | P39695 | COMEChypothetical protein 3 (comE operon)Bacillus subtilis comE operon encoding ORF1, ORF2, ORF3 andReverse-ORF genes, complete cds. |
| Contig334D | 20006377_c1_160 | 750 | 3587 | 732 | 244 | 432 | 1.00E-40 | Bacillus subtilis | P54471 | yqfNYqfNBacillus subtilis DNA, 283 Kb region containing skin element.similar to hypothetical proteins |
| Contig334D | 20791068_c3_235 | 751 | 3588 | 273 | 91 | | | | | |
| Contig334D | 21667676_c1_139 | 752 | 3589 | 888 | 296 | 590 | 1.90E-57 | Bacillus subtilis | e1184002 | yrvMconserved hypothetical protein yrvMBacillus subtilis complete genome (section 15 of 21)similar to hypothetical proteins |
| Contig334D | 21759427_c1_170 | 753 | 3590 | 1350 | 450 | 1396 | 7.20E-143 | Bacillus subtilis | P54376 | yqhIYqhIBacillus subtilis DNA, 283 Kb region containing skin element.similar to glycine dehydrogenase |
| Contig334D | 2195307_c1_167 | 754 | 3591 | 1095 | 365 | 348 | 8.20E-32 | Bacillus subtilis | P25954 | comG2ComGBBacillus subtilis (clone pED4) comG-(1,2,3,4,5,6,and 7) proteins incomG operon, complete cds. |
| Contig334D | 2227312_c1_138 | 755 | 3592 | 1782 | 594 | 2019 | 6.90E-209 | Bacillus subtilis | e1184003 | aspSaspartyl-tRNA synthetaseBacillus subtilis complete genome (section 15 of 21) |
| Contig334D | 23470327_c3_253 | 756 | 3593 | 1461 | 487 | 446 | 3.40E-42 | Staphylococcus xylosus | g666115 | ugllhypothetical protein IS.xylosus glucose kinase gene.orf1 upstream of glucose kinase |

| | | | | | | | | |
|---|---|---|---|---|---|---|---|---|
| Contig334D | 23470452_c2_193 | 757 | 3594 | 441 | 147 | 209 | 4.40E-17 | Aquifex aeolicus | g2983771 | accBbiotin carboxyl carrier proteinAquifex aeolicus section 68 of 109 of the complete genome. |
| Contig334D | 23476676_c3_246 | 758 | 3595 | 369 | 123 | 227 | 5.40E-19 | Bacillus subtilis | g902055 | dgkdiacylglycerol kinaseBacillus subtilis PhoH (phoH) gene, partial cds, diacylglycerolkinase (dgk) gene, complete cds, and cytidine deaminase (cdd) gene.partial cds. |
| Contig334D | 23595137_c2_195 | 759 | 3596 | 558 | 186 | 522 | 3.00E-50 | Bacillus subtilis | P54452 | yqeGYqeGBacillus subtilis DNA, 283 Kb region containing skin element.similar to hypothetical proteins |
| Contig334D | 23642942_c2_209 | 760 | 3597 | 696 | 232 | 132 | 2.10E-06 | Caenorhabditis elegans | g1255425 | C33G8.2Caenorhabditis elegans cosmid C33G8. |
| Contig334D | 23703452_c2_224 | 761 | 3598 | 1509 | 503 | 1808 | 1.60E-186 | Bacillus subtilis | P54377 | yqhKYqhKBacillus subtilis DNA, 283 Kb region containing skin element.similar to glycine dehydrogenase |
| Contig334D | 2381885_c1_145 | 762 | 3599 | 1272 | 424 | 1066 | 6.70E-108 | Bacillus subtilis | e1182373 | yesGbranched chain amino acids transporter homolog yesGBacillus subtilis complete genome (section 3 of 21)alternate gene name |
| Contig334D | 23850302_c3_234 | 763 | 3600 | 2694 | 898 | 2695 | 1.60E-280 | Bacillus subtilis | e1183970 | alaSalanyl-tRNA synthetaseBacillus subtilis complete genome (section 14 of 21) |
| Contig334D | 24042212_c1_168 | 764 | 3601 | 498 | 166 | | | | | |
| Contig334D | 24071068_f3_91 | 765 | 3602 | 399 | 133 | 308 | 1.40E-27 | Bacillus subtilis | P54510 | yqhLYqhLBacillus subtilis DNA, 283 Kb region containing skin element.similar to hypothetical proteins |
| Contig334D | 24094090_c1_144 | 766 | 3603 | 957 | 319 | 927 | 3.60E-93 | Bacillus subtilis | e1183965 | yrrNproteinase homolog yrrNBacillus subtilis complete genome (section 14 of 21)similar to protease |
| Contig334D | 24229805_c3_238 | 767 | 3604 | 1386 | 462 | 1133 | 5.30E-115 | Bacillus subtilis | d1013248 | accCYqhXBacillus subtilis DNA, 283 Kb region containing skin element.alternate gene name |
| Contig334D | 24260061_c3_226 | 768 | 3605 | 348 | 116 | 214 | 1.30E-17 | Bacillus subtilis | P26942 | ysxBconserved hypothetical protein ysxBB.subtilis spolVFA, spolVFB, L20, ortX and L24 genes.ORF X |
| Contig334D | 24275927_12_76 | 769 | 3606 | 189 | 63 | | | | | |
| Contig334D | 24306263_c2_222 | 770 | 3607 | 297 | 99 | | | | | |

150

| | | | | | | | | | |
|---|---|---|---|---|---|---|---|---|---|
| Contig334D | 24470317_c2_208 | 771 | 3608 | | 340 | 1246 | 5.70E-127 | Bacillus subtilis | P54466 | yqfAYqfABacillus subtilis DNA, 283 Kb region containing skin element. |
| Contig334D | 24486330_c1_142 | 772 | 3609 | 693 | 231 | 321 | 5.90E-29 | Bacillus subtilis | e1183978 | yrrBconserved hypothetical protein yrrBBacillus subtilis complete genome (section 14 of 21)similar to hypothetical proteins |
| Contig334D | 24610877_c2_223 | 773 | 3610 | 519 | 173 | 226 | 6.90E-19 | Lactococcus lactis | P43906 | aroKshikimate kinaseL.lactis tyrA, aroA, aroK and pheA genes.shikimate kinase |
| Contig334D | 24640937_c3_257 | 774 | 3611 | 498 | 166 | | | | | |
| Contig334D | 24658562_f3_121 | 775 | 3612 | 276 | 92 | 233 | 4.00E-19 | Bacillus subtilis | e1183983 | yrvNconserved hypothetical protein yrvNBacillus subtilis complete genome (section 14 of 21)similar to hypothetical proteins |
| Contig334D | 24823311_c1_169 | 776 | 3613 | 210 | 70 | | | | | |
| Contig334D | 24886587_c2_186 | 777 | 3614 | 2448 | 816 | 1981 | 1.90E-207 | Bacillus subtilis | e1183977 | yrrCconjugation transfer protein homolog.yrrCBacillus subtilis complete genome (section 14 of 21)similar to conjugation transfer protein |
| Contig334D | 25413126_f2_62 | 778 | 3615 | 189 | 63 | | | | | |
| Contig334D | 2542188_c2_218 | 779 | 3616 | 270 | 90 | | | | | |
| Contig334D | 25502217_c2_176 | 780 | 3617 | 615 | 205 | 410 | 2.20E-38 | Bacillus subtilis | e1184023 | ruvAHolliday junction DNA helicaseBacillus subtilis complete genome (section 15 of 21) |
| Contig334D | 25595186_c2_188 | 781 | 3618 | 651 | 217 | 736 | 6.30E-73 | Bacillus subtilis | e1183963 | udkuridine kinaseBacillus subtilis complete genome (section 14 of 21) |
| Contig334D | 25672337_c2_213 | 782 | 3619 | 780 | 260 | 367 | 7.90E-34 | Bacillus subtilis | P42095 | yqxNYqfIBacillus subtilis DNA, 283 Kb region containing skin element,alternate gene name |
| Contig334D | 25680218_c3_244 | 783 | 3620 | 726 | 242 | 425 | 5.70E-40 | Bacillus subtilis | P54465 | yqeZYqeZBacillus subtilis DNA, 283 Kb region containing skin element. |
| Contig334D | 26203942_c1_158 | 784 | 3621 | 630 | 210 | 636 | 2.50E-62 | Bacillus subtilis | e1185791 | yqzBconserved hypothetical protein yqzBBacillus subtilis complete genome (section 13 of 21)similar to hypothetical proteins |
| Contig334D | 26209425_c2_216 | 785 | 3622 | 1068 | 356 | 1672 | 4.10E-172 | Staphylococcus aureus | P26766 | plaCsigma factorS.aureus sigma factor (plaC) gene, complete cds.transcription initiation factor sigma 43 |

| | | | | | | | | | |
|---|---|---|---|---|---|---|---|---|---|
| Contig334D | 26212501_c1_162 | 786 | 3623 | 852 | 284 | 454 | 4.80E-43 | Bacillus subtilis | dl023110 | yceAYceABacillus subtilis genomic DNA, 22 to 25 degree region, completecds,homologue of a hypothetical 32.8 kDa protein in |
| Contig334D | 26251577_c1_149 | 787 | 3624 | 354 | 118 | 372 | 2.30E-34 | Bacillus subtilis | P54457 | yqeLYqeLBacillus subtilis DNA, 283 Kb region containing skin element,similar to hypothetical proteins |
| Contig334D | 26754750_c2_185 | 788 | 3625 | 1164 | 388 | 895 | 8.90E-90 | Bacillus subtilis | e1183981 | yrvONifS protein homolog homolog yrvOBacillus subtilis complete genome (section 14 of 21),similar to NifS protein homolog |
| Contig334D | 26772135_c1_151 | 789 | 3626 | 996 | 332 | 555 | 9.50E-54 | Bacillus subtilis | P54459 | yqeNYqeNBacillus subtilis DNA, 283 Kb region containing skin element,similar to hypothetical proteins |
| Contig334D | 29468751_c1_172 | 790 | 3627 | 1173 | 391 | 855 | 1.50E-85 | Bacillus subtilis | P54518 | yqhTYqhTBacillus subtilis DNA, 283 Kb region containing skin element,similar to Xaa-Pro dipeptidase |
| Contig334D | 29494055_c2_206 | 791 | 3628 | 942 | 314 | 1248 | 3.50E-127 | Staphylococcus aureus | P45557 | PRMAORf35Staphyloococcus aureus genes for ORF37; HSP20; HSP70; HSP40; ORF35,complete cds. |
| Contig334D | 29845127_c2_190 | 792 | 3629 | 636 | 212 | 588 | 3.00E-57 | Clostridium perfringens | e303881 | putative transposaseC.perfringens uapC, cpe, and nadC genes. |
| Contig334D | 29958512_c3_236 | 793 | 3630 | 372 | 124 | 181 | 4.10E-14 | Bacillus subtilis | e1183968 | yrzBhypothetical protein yrzBJBacillus subtilis complete genome (section 14 of 21) |
| Contig334D | 30366652_c3_232 | 794 | 3631 | 897 | 299 | 1137 | 2.00E-115 | Staphylococcus aureus | g2580435 | lytHN-acetylmuramoyl-L-alanine amidaseStaphylococcus aureus gene for histidyl-tRNA synthetase, ppGpphydrolase, lytic enzyme, complete cds,partially similar to the LytC protein of Bacillus |
| Contig334D | 3125378_c2_219 | 795 | 3632 | 2097 | 699 | 1425 | 6.10E-146 | Bacillus subtilis | P54488 | pbpAYqgFBacillus subtilis DNA, 283 Kb region containing skin element,alternate gene name |
| Contig334D | 31527312_c3_251 | 796 | 3633 | 438 | 146 | 700 | 4.10E-69 | Staphylococcus epidermidis | P54204 | FurS.epidermidis genes fur and sod (partial),putative |

151

| Contig334D | 32212_c2_181 | 797 | 3634 | 1317 | 439 | 1921 | 1.70E-198 | Staphylococcus aureus | g2580436 | hisShistidyl-tRNA synthetaseStaphylococcus aureus gene for histidyl-tRNA synthetase, ppGpphydrolase, lytic enzyme, complete cds.putative; similar to the hisS gene of E.coli |
|---|---|---|---|---|---|---|---|---|---|---|
| Contig334D | 32244050_c2_198 | 798 | 3635 | 465 | 155 | 550 | 3.20E-53 | Bacillus subtilis | P32393 | comEBComEBBacillus subtilis comE operon encoding ORF1, ORF2, ORF3 andReverse-ORF genes, complete cds.alternate gene name |
| Contig334D | 32422015_c2_215 | 799 | 3636 | 1803 | 601 | 2059 | 4.00E-213 | Staphylococcus aureus | O05338 | dnaGStaphylococcus aureus DNA for sigma70 operon, complete cds. |
| Contig334D | 32459627_c1_166 | 800 | 3637 | 630 | 210 | 403 | 1.20E-37 | Bacillus subtilis | P54501 | yqgXYqgXBacillus subtilis DNA, 283 Kb region containing skin element.similar to hypothetical proteins |
| Contig334D | 33409385_c2_225 | 801 | 3638 | 852 | 284 | 917 | 4.10E-92 | Bacillus subtilis | e1185721 | yqhMconserved hypothetical protein yqhMBacillus subtilis complete genome (section 13 of 21)similar to hypothetical proteins from B. subtilis |
| Contig334D | 33711505_c1_147 | 802 | 3639 | 357 | 119 | 316 | 2.00E-28 | Bacillus subtilis | P54454 | yqeIYqeIBacillus subtilis DNA, 283 Kb region containing skin element.similar to dihydrodipicolinate reductase |
| Contig334D | 34002212_c1_143 | 803 | 3640 | 447 | 149 | 437 | 3.00E-41 | Bacillus subtilis | e1183969 | yrrKconserved hypothetical protein yrrKBacillus subtilis complete genome (section 14 of 21)similar to hypothetical proteins |
| Contig334D | 34021937_c1_161 | 804 | 3641 | 822 | 274 | 432 | 1.00E-40 | Methanobacterium thermoautotrophicum | g2621685 | MTH605ABC transporterMethanobacterium thermoautotrophicum from bases 535779 to 549251 (section 48 of 148) of the complete genome.Function Code |
| Contig334D | 34166088_c2_173 | 805 | 3642 | 321 | 107 | 382 | 2.00E-35 | Bacillus subtilis | P26908 | L20ribosomal protein L21 (1L20)B.subtilis spoIVFA, spoIVFB, L20, orfX and L24 genes,Escherichia coli ribosomal protein L21homolog of E.coli ribosomal protein L21 |
| Contig334D | 34181643_c1_146 | 806 | 3643 | 702 | 234 | 579 | 2.70E-56 | Escherichia coli | P24247 | pfsPfs proteinEscherichia coli K-12 MG1655 section 15 of 400 of the completegenome.i232; 100 pct identical to PFS_ECOLI SW |

| | | | | | | | | | |
|---|---|---|---|---|---|---|---|---|---|
| Contig334D | 34376512_f2_80 | 807 | 3644 | 1080 | 360 | 814 | 3.40E-81 | Bacillus subtilis | d1020093 | yddNconserved hypothetical protein yddNBacillus subtilis genome sequence, 148 kb sequence of the regionbetween 35 and 47 degree.SIMILAR TO AlKANAL MONOOXYGENASE ALPHA CHAIN. |
| Contig334D | 34417217_c2_189 | 808 | 3645 | 492 | 164 | 531 | 3.30E-51 | Bacillus subtilis | e1183962 | greAtranscription elongation factorBacillus subtilis complete genome (section 14 of 21) |
| Contig334D | 34610925_c2_204 | 809 | 3646 | 1851 | 617 | 2792 | 8.50E-291 | Staphylococcus aureus | P45554 | DNAKHSP70Staphylococcus aureus genes for ORF37; HSP20; HSP70; HSP40; ORF35,complete cds. |
| Contig334D | 34642127_f2_57 | 810 | 3647 | 237 | 79 | | | | | |
| Contig334D | 35319157_c1_154 | 811 | 3648 | 675 | 225 | 724 | 1.20E-71 | Staphylococcus aureus | P45553 | GRPEHSP20Staphylococcus aureus genes for ORF37; HSP20; HSP70; HSP40; ORF35,complete cds. |
| Contig334D | 35334680_c2_187 | 812 | 3649 | 699 | 233 | 377 | 6.90E-35 | Bacillus subtilis | e1183966 | yrrMcaffeoyl-CoA O-methyltransferase homolog yrrMBacillus subtilis complete genome (section 14 of 21)similar to caffeoyl-CoA O-methyltransferase |
| Contig334D | 35343875_c3_228 | 813 | 3650 | 1026 | 342 | 1044 | 1.40E-105 | Escherichia coli | P08577 | ruvBHolliday junction DNA helicase RuvB,E.coli genomic DNA, Kohara clone #337(41.9-42.3 min.),ruvB proteinORF_ID |
| Contig334D | 35444067_c3_248 | 814 | 3651 | 837 | 279 | 1206 | 9.80E-123 | Staphylococcus aureus | d1020251 | orf30Staphylococcus aureus DNA for sigma70 operon, complete cds. |
| Contig334D | 35975077_c3_250 | 815 | 3652 | 891 | 297 | 1175 | 1.90E-119 | Bacillus subtilis | P54476 | yqfSYqfSBacillus subtilis DNA, 283 Kb region containing skin element,similar to endonuclease IV |
| Contig334D | 36125057_c3_249 | 816 | 3653 | 1368 | 456 | 1039 | 4.90E-105 | Bacillus subtilis | P54475 | yqfRYqfRBacillus subtilis DNA, 283 Kb region containing skin element,similar to ATP-dependent RNA helicase |
| Contig334D | 36225626_c2_180 | 817 | 3654 | 537 | 179 | 839 | 7.60E-84 | Staphylococcus aureus | g2580432 | aptadenine phosphoribosyltransferaseStaphylococcus aureus gene for histidyl-tRNA synthetase, ppGpphydrolase, lytic enzyme, complete cds,putative; similar to the apt gene of E.coli |

154

| | | | | | | | | | |
|---|---|---|---|---|---|---|---|---|---|
| Contig334D | 36573502_c3_231 | 818 | 3655 | 2211 | 737 | 3507 | 0 | Staphylococcus aureus | g2580433 | relppGpp hydrolaseStaphylococcus aureus gene for histidyl-tRNA synthetase, ppGpphydrolase, lytic enzyme, complete cds.putative; similar to the relA and spoT genes of |
| Contig334D | 3916011_c2_214 | 819 | 3656 | 207 | 69 | | | | | |
| Contig334D | 3916578_c1_137 | 820 | 3657 | 501 | 167 | 619 | 1.60E-60 | Staphylococcus aureus | g2580434 | Staphylococcus aureus gene for histidyl-tRNA synthetase, ppGpphydrolase, lytic enzyme, complete cds.ORF1 |
| Contig334D | 3941262_c1_153 | 821 | 3658 | 465 | 155 | 609 | 1.80E-59 | Bacillus subtilis | P37949 | lepAYqeQBacillus subtilis DNA, 283 Kb region containing skin element.alternate gene name |
| Contig334D | 3945937_c2_207 | 822 | 3659 | 1371 | 457 | 1764 | 7.30E-182 | Bacillus subtilis | P54462 | yqeVYqeVBacillus subtilis DNA, 283 Kb region containing skin element.similar to hypothetical proteins |
| Contig334D | 4015702_c2_211 | 823 | 3660 | 468 | 156 | 416 | 5.10E-39 | Bacillus subtilis | P46347 | yqfGYqfGBacillus subtilis DNA, 283 Kb region containing skin element.similar to hypothetical proteins |
| Contig334D | 4023415_f3_125 | 824 | 3661 | 240 | 80 | | | | | |
| Contig334D | 41088_c3_255 | 825 | 3662 | 987 | 329 | 517 | 1.00E-49 | Bacillus subtilis | P25953 | comG1ComGABacillus subtilis (clone pED4) comG-(1,2,3,4,5,6,and 7) proteins incomG operon, complete cds.late competence gene |
| Contig334D | 4152203_c2_174 | 826 | 3663 | 300 | 100 | 426 | 4.40E-40 | Bacillus subtilis | P05657 | rpmAL27 ribosomal proteinBacillus subtilis ribosomal protein L27 gene, upstream of spo0Blocus, complete cds.Escherichia coli ribosomal protein L27polypeptide homologous to E. coli ribosomal protein |
| Contig334D | 4172025_c2_191 | 827 | 3664 | 744 | 248 | 456 | 1.30E-45 | Bacillus subtilis | P42967 | ycsJurea amidolyaseBacillus subtilis genome around 39 degrees region encoding 17 ORFs,complete cds.similar to allophanate hydrolase |
| Contig334D | 4176557_c3_237 | 828 | 3665 | 1302 | 434 | 1676 | 1.50E-172 | Bacillus subtilis | e1183964 | yrrOproteinase homolog yrrOBacillus subtilis complete genome (section 14 of 21)similar to protease |
| Contig334D | 42132_f1_51 | 829 | 3666 | 288 | 96 | | | | | |

| | | | | | | | | | |
|---|---|---|---|---|---|---|---|---|---|
| Contig334D | 4336693_c1_141 | 830 | 3667 | 1131 | 377 | 1158 | 1.20E-117 | Bacillus subtilis | c1183979 | yrrAconserved hypothetical protein yrrABacillus subtilis complete genome (section 14 of 21)similar to hypothetical proteins |
| Contig334D | 4406502_c1_157 | 831 | 3668 | 939 | 313 | 1033 | 2.10E-104 | Bacillus subtilis | P42182 | bexYqfHBacillus subtilis DNA, 283 Kb region containing skin element,similar to Era, an essential small G-protein in E. |
| Contig334D | 4459380_c2_178 | 832 | 3669 | 207 | 69 | | | | | |
| Contig334D | 4492268_c2_203 | 833 | 3670 | 489 | 163 | 614 | 5.30E-60 | Staphylococcus aureus | P45556 | HRCAORF37Staphylococcus aureus genes for ORF37; HSP20; HSP70; HSP40; ORF35,complete cds. |
| Contig334D | 4564137_f1_1 | 834 | 3671 | 633 | 211 | 125 | 2.60E-06 | Borrelia burgdorferi | g466482 | OspFouter surface protein FBorrelia burgdorferi outer surface protein F (OspF) gene, complete cds,putative |
| Contig334D | 4693812_c3_258 | 835 | 3672 | 1116 | 372 | 970 | 1.00E-97 | Bacillus subtilis | P54378 | yqhIYqhIBacillus subtilis DNA, 283 Kb region containing skin element,similar to aminomethyltransferase |
| Contig334D | 4704678_c1_165 | 836 | 3673 | 210 | 70 | 115 | 4.00E-07 | Bacillus subtilis | P54494 | yqgQYqgQBacillus subtilis DNA, 283 Kb region containing skin element. |
| Contig334D | 4798143_c3_233 | 837 | 3674 | 432 | 144 | 305 | 2.90E-27 | Bacillus subtilis | c1183982 | yrzCConserved hypothetical protein yrzCBacillus subtilis complete genome (section 14 of 21)similar to hypothetical proteins |
| Contig334D | 4822177_c2_220 | 838 | 3675 | 330 | 110 | 476 | 2.20E-45 | Staphylococcus xylosus | e147899 | dglAS.xylosus glucose kinase gene.orf2 downstream of glucose kinase |
| Contig334D | 4859677_c2_210 | 839 | 3676 | 939 | 313 | 974 | 3.80E-98 | Bacillus subtilis | P46343 | phoIIYqfEBacillus subtilis DNA, 283 Kb region containing skin element.alternate gene name |
| Contig334D | 4860942_c3_239 | 840 | 3677 | 594 | 198 | 356 | 1.20E-32 | Bacillus subtilis | P54455 | yqeJYqeJBacillus subtilis DNA, 283 Kb region containing skin element,similar to hypothetical proteins |
| Contig334D | 4884675_c2_217 | 841 | 3678 | 1104 | 368 | 612 | 8.70E-60 | Bacillus subtilis | e1185784 | yqfOconserved hypothetical protein yqfOBacillus subtilis complete genome (section 13 of 21)similar to hypothetical proteins |

| | | | | | | | | | |
|---|---|---|---|---|---|---|---|---|---|
| Contig334D | 4892200_c2_196 | 842 | 3679 | 1101 | 367 | 1012 | 3.50E-102 | Bacillus subtilis | P54453 | yqcHYqcHBacillus subtilis DNA, 283 Kb region containing skin element.similar to hypothetical proteins |
| Contig334D | 4892942_c2_194 | 843 | 3680 | 768 | 256 | 660 | 7.10E-65 | Bordetella pertussis | g2290993 | unknownBordetella pertussis D-3-phosphoglycerate dehydrogenase homolog(serA) and Brg1 (brg1) genes, complete cds.orf7; similar to B. subtilis YcsF |
| Contig334D | 4900381_c2_179 | 844 | 3681 | 2298 | 766 | 1335 | 2.10E-136 | Bacillus subtilis | e1184010 | yrvEsingle-strand DNA-specific exonuclease homolog yrvEBacillus subtilis complete genome (section 15 of 21)similar to single-strand DNA-specific exonuclease |
| Contig334D | 4939377_c2_175 | 845 | 3682 | 480 | 160 | 277 | 2.70E-24 | Bacillus subtilis | P21204 | pheBchorismate mutaseBacillus subtilis sporulation protein (spoOB), GTP-binding protein(obg), phenylalanine biosynthesis associated protein (pheB), andmonofunctional prephenate dehydratase (pheA) genes, complete cds. |
| Contig334D | 5078786_c2_182 | 846 | 3683 | 189 | 63 | | | | | |
| Contig334D | 5100002_c1_155 | 847 | 3684 | 285 | 95 | 268 | 2.50E-23 | Bacillus subtilis | d1013149 | rpsUYqeXBacillus subtilis DNA, 283 Kb region containing skin element.alternate gene name |
| Contig334D | 5115876_f1_4 | 848 | 3685 | 270 | 90 | | | | | |
| Contig334D | 5136062_c2_197 | 849 | 3686 | 825 | 275 | 543 | 1.80E-52 | Bacillus subtilis | P54374 | aroDAroDBacillus subtilis DNA, 283 Kb region containing skin element. |
| Contig334D | 5269011_c2_192 | 850 | 3687 | 1014 | 338 | 491 | 5.70E-47 | Pyrococcus horikoshii | d1028099 | PHAF014331aa long hypothetical proteinPyrococcus horikoshii OT3 genomic DNA, 886755-916062 nt position,clonesimilar to Swiss_Prot |
| Contig334D | 5875257_c2_205 | 851 | 3688 | 1158 | 386 | 1741 | 2.00E-179 | Staphylococcus aureus | P45555 | DNAJHSP40Staphylococcus aureus genes for ORF37; HSP20; HSP70; HSP40; ORF35,complete cds. |
| Contig334D | 6041018_c2_177 | 852 | 3689 | 2301 | 767 | 1547 | 7.20E-159 | Bacillus subtilis | e1184013 | secFprotein-export membrane proteinBacillus subtilis complete genome (section 15 of 21) |
| Contig334D | 6048177_c2_202 | 853 | 3690 | 1176 | 392 | 948 | 2.10E-95 | Bacillus subtilis | d1013140 | hemNYqeRBacillus subtilis DNA, 283 Kb region containing skin element.alternate gene name |

156

| | | | | | | | | | |
|---|---|---|---|---|---|---|---|---|---|
| Contig334D | 6058468_c2_212 | 854 | 3691 | 417 | 139 | 332 | 4.10E-30 | Bacillus subtilis | P19079 | cddCddBacillus subtilis DNA, 283 Kb region containing skin element. |
| Contig334D | 6719077_c3_260 | 855 | 3692 | 558 | 186 | 700 | 4.10E-69 | Bacillus subtilis | P49778 | efpYqhUBacillus subtilis DNA, 283 Kb region containing skin element.alternate gene name |
| Contig334D | 6759838_f1_24 | 856 | 3693 | 264 | 88 | 160 | 6.80E-12 | Bacillus subtilis | dl013135 | rpsTYqeOBacillus subtilis DNA, 283 Kb region containing skin element.alternate gene name |
| Contig334D | 6925012_c3_227 | 857 | 3694 | 1320 | 440 | 1527 | 9.50E-157 | Bacillus subtilis | P20964 | obgGTP-binding proteinBacillus subtilis sporulation protein (spoOB), GTP-binding protein(obg), phenylalanine biosynthesis associated protein (pheB), andmonofunctional prephenate dehydratase (pheA) genes, complete cds.spo0B 3'-region GTP-binding proteinTh |
| Contig334D | 7273457_c3_252 | 858 | 3695 | 570 | 190 | 299 | 1.30E-26 | Streptococcus mutans | dl029655 | Streptococcus mutans gene for glucose-1-phosphateuridylyltransferase, complete cds.hypothetical protein |
| Contig334D | 812817_c1_148 | 859 | 3696 | 612 | 204 | 367 | 7.90E-34 | Bacillus subtilis | P54456 | yqeKYqeKBacillus subtilis DNA, 283 Kb region containing skin element.similar to hypothetical proteins |
| Contig334D | 820452_c1_171 | 860 | 3697 | 270 | 90 | 105 | 1.20E-05 | Staphylococcus haemolyticus | gl022725 | unknownStaphylococcus haemolyticus IS1272 ORF1 and ORF2 genes, completecds.ORF2 |
| Contig336D | 12690706_f1_1 | 861 | 3698 | 231 | 77 | | | | | |
| Contig336D | 14552215_f1_2 | 862 | 3699 | 192 | 64 | | | | | |
| Contig336D | 14901578_f1_5 | 863 | 3700 | 461 | 154 | 323 | 3.60E-29 | Bacillus subtilis | dl020044 | ydbOconserved hypothetical protein ydbOBacillus subtilis genome sequence, 148 kb sequence of the regionbetween 35 and 47 degree.FUNCTION UNKNOWN, SIMILAR PRODUCT IN B. SUBTILIS |
| Contig336D | 20413202_c3_14 | 864 | 3701 | 1152 | 384 | 961 | 9.00E-97 | Escherichia coli | P23524 | yhaDhypothetical 42.1 kD protein in rnpB-sohAEscherichia coli K-12 MG1655 section 284 of 400 of the completegenome.J408; 100 pct identical amino acid sequence and |

| | | | | | | | | | |
|---|---|---|---|---|---|---|---|---|---|
| Contig336D | 23600412_c2_12 | 865 | 3702 | 1242 | 414 | 546 | 8.50E-53 | Bacillus subtilis | d1020154 | ydgKbicyclomycin resistance protein homolog. ydgKBacillus subtilis genome sequence, 148 kb sequence of the regionbetween 35 and 47 degree.SIMILAR TO BICYCLOMYCIN RESISTANCE PROTEIN. |
| Contig336D | 34585317_f3_8 | 866 | 3703 | 1491 | 497 | | | | | |
| Contig336D | 4098518_c3_15 | 867 | 3704 | 711 | 237 | 121 | 4.90E-08 | Plasmodium falciparum | P04931 | Ag319asparagine-rich proteinPlasmodium falciparum asparagine-rich protein (ARP), partial cds. |
| Contig336D | 4392767_f2_6 | 868 | 3705 | 435 | 145 | 145 | 2.70E-10 | Actinobacillus actinomycetemcomitans | d1020420 | Actinobacillus actinomycetemcomitans DNA (or glycosyltransferase, lytic transglycosylase, dTDP-4-rhamnose reductase, complete cds.unnamed protein product |
| Contig337D | 1180328_c3_35 | 869 | 3706 | 816 | 272 | 372 | 2.30E-34 | Bacillus subtilis | g2293147 | ytxMYtxMBacillus subtilis rrnB-dnaB genomic region.similarity with 2-hydroxy-6-oxo-2,4-heptadienoate |
| Contig337D | 11924012_c1_25 | 870 | 3707 | 225 | 75 | | | | | |
| Contig337D | 13848387_f2_19 | 871 | 3708 | 240 | 80 | 131 | 8.10E-09 | Synechocystis sp. | d1011491 | clpPhypothetical proteinSynechocystis sp. PCC6803 complete genome, 25/27, 3138604-3270709.ORF_ID |
| Contig337D | 16683437_f1_1 | 872 | 3709 | 1023 | 341 | 571 | 1.90E-55 | Bacillus subtilis | e1184942 | ykrPconserved hypothetical protein ykrPBacillus subtilis complete genome (section 8 of 21)similar to hypothetical proteins |
| Contig337D | 20739037_c1_28 | 873 | 3710 | 426 | 142 | 690 | 4.70E-68 | Staphylococcus epidermidis | g2267243 | putative transcriptional regulator AtlRStaphylococcus epidermidis autolysin AtlE and putativetranscriptional regulator AtlR genes, complete cds. |
| Contig337D | 21524191_c1_24 | 874 | 3711 | 540 | 180 | 529 | 5.40E-51 | Staphylococcus haemolyticus | g1022725 | unknownStaphylococcus haemolyticus IS1272 ORF1 and ORF2 genes, completecds.ORF2 |
| Contig337D | 22703588_f2_16 | 875 | 3712 | 954 | 318 | 803 | 5.00E-80 | Bacillus subtilis | P39582 | ipa-6dlhypothetical proteinB.subtilis genomic region (325 to 333).alternate gene name |

| | | | | | | | | |
|---|---|---|---|---|---|---|---|---|
| Contig337D | 23625637_c2_30 | 876 | 3713 | 183 | 61 | | | |
| Contig337D | 24072175_f3_20 | 877 | 3714 | 780 | 260 | 1321 | 6.40E-135 | Staphylococcus epidermidis | g2267239 | Staphylococcus epidermidis autolysin AtlE and putativetranscriptional regulator AtlR genes, complete cds.ORF1 |
| Contig337D | 24105342_c1_27 | 878 | 3715 | 831 | 277 | 1242 | 1.50E-126 | Bacillus subtilis | g2293148 | menBdihydroxynaphthoate synthaseBacillus subtilis rrnB-dnaB genomic region. |
| Contig337D | 24416702_f2_9 | 879 | 3716 | 4008 | 1336 | 7001 | 0 | Staphylococcus epidermidis | g2267242 | autolysin AtlEStaphylococcus epidermidis autolysin AtlE and putativetranscriptional regulator AtlR genes, complete cds,primary attachment to a polystyrene surface |
| Contig337D | 26775637_c1_26 | 880 | 3717 | 1389 | 463 | 599 | 2.10E-58 | Bacillus subtilis | P23973 | menFisochorismate synthaseBacillus subtilis rrnB-dnaB genomic region.based on similarity to E. coli EntC, A. hydrophila |
| Contig337D | 33710968_f2_8 | 881 | 3718 | 453 | 151 | 742 | 1.40E-73 | Staphylococcus epidermidis | g2267241 | Staphylococcus epidermidis autolysin AtlE and putativetranscriptional regulator AtlR genes, complete cds.ORF3 |
| Contig337D | 3394540_f2_17 | 882 | 3719 | 312 | 104 | | | | | |
| Contig337D | 4181312_c2_31 | 883 | 3720 | 606 | 202 | | | | | |
| Contig337D | 5115927_c2_32 | 884 | 3721 | 1680 | 560 | 340 | 1.10E-59 | Synechocystis sp. | d1011017 | menD2-succinyl-6-hydroxy-2,Synechocystis sp. PCC6803 complete genome, 21/27. 2644795-2755702.ORF_ID |
| Contig337D | 6688757_f2_7 | 885 | 3722 | 507 | 169 | 823 | 3.80E-82 | Staphylococcus epidermidis | g2267240 | Staphylococcus epidermidis autolysin AtlE and putativetranscriptional regulator AtlR genes, complete cds.ORF2 |
| Contig337D | 978436_f2_10 | 886 | 3723 | 1188 | 396 | 875 | 1.20E-87 | Bacillus subtilis | C33496 | hisC homolog |
| Contig338D | 12142768_c3_17 | 887 | 3724 | 300 | 100 | 110 | 3.50E-06 | Pyrococcus horikoshii | d1027343 | PIIBW01623 5aa long hypothetical proteinPyrococcus horikoshii OT3 genomic DNA, 180023-216005 nt position,clone |
| Contig338D | 12531558_c2_13 | 888 | 3725 | 351 | 117 | | | | | |
| Contig338D | 14849093_f1_1 | 889 | 3726 | 294 | 98 | 127 | 2.10E-08 | Mitochondrion Chondrus crispus | e138028 | putative orf79.1C.crispus complete mitochondrial genome.unique orf |
| Contig338D | 23870801_f1_2 | 890 | 3727 | 240 | 80 | | | | | |

| | | | | | | | | |
|---|---|---|---|---|---|---|---|---|
| Contig338D | 30265640_f1_5 | 891 | 3728 | 1080 | 360 | 485 | 2.50E-46 | Treponema pallidum | g1354775 | pfoS/RpfoS/R Treponema pallidum methyl-accepting chemotaxis protein (mcp-1)gene, complete cds, and potential regulatory molecule (pfoS/R)gene, partial cds.potential regulatory molecule; pfoS/R-like |
| Contig338D | 32680_f1_4 | 892 | 3729 | 936 | 312 | 776 | 3.60E-77 | Staphylococcus aureus | P04188 | glutamyl endopeptidase, precursorStaphylococcus aureus V8 serine protease gene.staphylococcal serine proteinasepreproenzyme (AA -68 to 268) |
| Contig338D | 3361326_f3_6 | 893 | 3730 | 207 | 69 | | | | | |
| Contig338D | 10605337_c2_54 | 894 | 3731 | 747 | 249 | 706 | 9.50E-70 | Bacillus subtilis | P39456 | ORF3putative ATP binding subunitB.subtilis putative amino acid transporter gene.inner membrane protein malKpotential ABC-transport system |
| Contig339D | 1207938_c3_64 | 895 | 3732 | 828 | 276 | 250 | 2.00E-21 | Bacillus subtilis | g1934611 | yrhGformate dehydrogenaseBacillus subtilis cysteine synthase (yrhA), cystathioninegamma-lyase (yrhB), YrhC (yrhC), YrhD (yrhD), formate dehydrogenasechain A (yrhE), YrhF (yrhF), formate dehydrogenase (yrhG), YrhH(yrhH), regulatory protein (yrhI), cytochro |
| Contig339D | 13843910_c1_50 | 896 | 3733 | 216 | 72 | 258 | 3.20E-22 | Staphylococcus carnosus | g2529402 | narTnitrate transporterStaphylococcus carnosus nitrate transporter (narT) gene, completecds.NarT |
| Contig339D | 14454083_f2_14 | 897 | 3734 | 471 | 157 | 259 | 2.20E-22 | Bacillus subtilis | e1181515 | ykmAYkmABacillus subtilis 168 56 kb DNA fragment between xlyA and ykoR.similar to hypothetical proteins |
| Contig339D | 15711457_f3_28 | 898 | 3735 | 201 | 67 | | | | | |
| Contig339D | 164715_c3_66 | 899 | 3736 | 951 | 317 | 424 | 3.00E-42 | Bacillus subtilis | P42437 | nasBES-adenosyl-L-methionineBacillus subtilis DNA around narB region (nasB operon and nasAgene).alternate gene name |
| Contig339D | 20524067_c1_41 | 900 | 3737 | 639 | 213 | 231 | 2.00E-19 | Bacillus subtilis | e1186036 | yvgVconserved hypothetical protein yvgVBacillus subtilis complete genome (section 18 of 21)similar to hypothetical proteins |

161

| | | | | | | | | | |
|---|---|---|---|---|---|---|---|---|---|
| Contig339D | 22299205_c3_60 | 901 | 3738 | 312 | 104 | 152 | 1.20E-10 | Bacillus subtilis | d1020044 | ydb6Oconserved hypothetical protein ydbOBacillus subtilis genome sequence, 148 kb sequence of the regionbetween 35 and 47 degree.FUNCTION UNKNOWN, SIMILAR PRODUCT IN B. SUBTILIS |
| Contig339D | 22345265_f1_9 | 902 | 3739 | 189 | 63 | | | | | |
| Contig339D | 24250177_c1_47 | 903 | 3740 | 714 | 238 | 159 | 8.70E-12 | Bacillus subtilis | P42178 | narJRespiratory nitrate reductaseB.subtilis narGlIJI genes.gamma subunit |
| Contig339D | 24353392_c2_57 | 904 | 3741 | 2409 | 803 | 2267 | 3.60E-235 | Bacillus subtilis | P42435 | nasBCsubunit of nitrite reductaseBacillus subtilis DNA around narB region (nasB operon and nasAgene),alternate gene name |
| Contig339D | 24416068_c1_43 | 905 | 3742 | 549 | 183 | 528 | 6.90E-51 | Bacillus subtilis | g2293246 | ylmIYlmIBacillus subtilis rrnB-dnaB genomic region,similar to a hypothetical 19 kD protein from B. |
| Contig339D | 24648377_c3_71 | 906 | 3743 | 1146 | 382 | 1301 | 8.40E-133 | Staphylococcus carnosus | g2529402 | narTnitrate transporterStaphylococcus carnosus nitrate transporter (narT) gene, completecds.NarT |
| Contig339D | 24855337_c2_59 | 907 | 3744 | 693 | 231 | 577 | 4.40E-56 | Bacillus subtilis | P42177 | narInitrate reductase gamma subunitB.subtilis narJ[G,I,I,I,J,K |
| Contig339D | 29532827_f2_21 | 908 | 3745 | 243 | 81 | | | | | |
| Contig339D | 3007827_c2_53 | 909 | 3746 | 789 | 263 | 605 | 4.80E-59 | Bacillus subtilis | e1182313 | yckKhomologue of glutamine-binding periplasmicBacillus subtilis complete genome (section 2 of 21),similar to glutamine ABC transporter |
| Contig339D | 34033563_c1_46 | 910 | 3747 | 327 | 109 | 261 | 1.40E-22 | Bacillus subtilis | P42436 | nasBDsubunit of nitrite reductaseBacillus subtilis DNA around narB region (nasB operon and nasAgene),alternate gene name |
| Contig339D | 34194002_c2_52 | 911 | 3748 | 711 | 237 | 657 | 1.50E-64 | Zymomonas mobilis | P30798 | pgmphosphoglyceromutaseZymomonas mobilis phosphoglyceromutase (pgm) gene, complete cds,and 2-hydroxyacid dehydrogenase homologue (ddh) gene, 5' end.phosphoglycerate mutase |
| Contig339D | 34385012_f2_18 | 912 | 3749 | 1362 | 454 | 364 | 4.90E-40 | Methanosarcina barkeri | e212291 | orf4hypothetical protein 4M.barkeri fmdE, fmdF, fmdA, fmdC, fmdD, fmdB, orf4, orf3, orf2, andorf1 genes. |
| Contig339D | 34430428_c2_56 | 913 | 3750 | 375 | 125 | | | | | |
| Contig339D | 4069643_c3_63 | 914 | 3751 | 480 | 160 | | | | | |

| | | | | | | | | |
|---|---|---|---|---|---|---|---|---|
| Contig339D | 4100453_c3_70 | 915 | 3752 | 1044 | 348 | 329 | 8.40E-30 | Bacillus brevis | P54663 | degSprotein kinaseBacillus brevis protein kinase (degS) gene, complete cds;transcriptional activator protein (degU) gene, complete cds.regulatory protein degSputative |
| Contig339D | 4720317_f2_20 | 916 | 3753 | 1257 | 419 | 1460 | 1.20E-149 | Staphylococcus simulans | g2072412 | liflysostaphin immunity factorStaphylococcus simulans lysostaphin (lss) and lysostaphin immunity factor (lif) genes, complete cds, insertion sequence IS1293,complete sequence, and IS257-1 transposase (tnp-1) gene, completecds.similar to FemA and FemB of St |
| Contig339D | 4737550_c3_65 | 917 | 3754 | 759 | 253 | 187 | 9.40E-15 | Bacillus subtilis | e332188 | ylnEYlnE proteinBacillus subtilis pyrE to ylo/A gene region.similar to hypothetical proteins |
| Contig339D | 4777217_c3_68 | 918 | 3755 | 1569 | 523 | 1883 | 1.80E-194 | Bacillus subtilis | P42176 | narHnitrate reductase beta subunitB.subtilis narf[G,H,I,J,K |
| Contig339D | 4980378_c1_49 | 919 | 3756 | 537 | 179 | 328 | 1.10E-29 | Bacillus subtilis | P13800 | degUtranscriptional regulator of degradationB.subtilis icp gene encoding a protease production enhancerprotein, complete cds, and SacU enhancer protein gene, 3' end.regulatory protein com/Aicp protein |
| Contig339D | 595260_c2_58 | 920 | 3757 | 3780 | 1260 | 4084 | 0 | Bacillus subtilis | P42175 | narGRespiratory nitrate reductaseB.subtilis narGHJI genes.alpha subunit |
| Contig339D | 6132893_c3_69 | 921 | 3758 | 462 | 154 | | | | | |
| Contig339D | 7039051_c3_61 | 922 | 3759 | 750 | 250 | 585 | 6.30E-57 | Bacillus subtilis | P42200 | ORF2putative membrane spanning subunitB.subtilis putative amino acid transporter gene.potential ABC-transport system |
| Contig339D | 995300_f1_10 | 923 | 3760 | 204 | 68 | | | | | |
| Contig340D | 10548383_f1_1 | 924 | 3761 | 237 | 79 | | | | | |
| Contig340D | 1209417_c3_85 | 925 | 3762 | 1704 | 568 | 797 | 2.20E-79 | Bacillus subtilis | P23545 | phoRsignal transduction protein kinaseBacillus subtilis rnB-dnaB genomic region. |
| Contig340D | 13001537_f3_53 | 926 | 3763 | 249 | 83 | | | | | |
| Contig340D | 13722338_c3_78 | 927 | 3764 | 507 | 169 | 505 | 1.90E-48 | Bacillus subtilis | g2293238 | yigIYigIBacillus subtilis rrnB-dnaB genomic region.similarity to tagD protein from V.cholerae |

| | | | | | | | | |
|---|---|---|---|---|---|---|---|---|
| Contig340D | 13723318_c3_80 | 928 | 3765 | 1149 | 383 | 1215 | 1.10E-123 | Bacillus stearothermophilus | P17557 | alanine dehydrogenase,B.stearothermophilus alanine dehydrogenase gene, complete cds.alanine dehydrogenasealanine dehydrogenase (EC 1.4.1.1) |
| Contig340D | 14877316_f1_19 | 929 | 3766 | 378 | 126 | 311 | 6.80E-28 | Escherichia coli | d1016364 | YKL069W, YKL340hypothetical protein b1832E.coli genomic DNA, Kohara clone #335(40.9-41.3 min.),ORF_ID |
| Contig340D | 19770437_c2_69 | 930 | 3767 | 1332 | 444 | 1018 | 8.20E-103 | Bacillus subtilis | g2293258 | ytolYtolBacillus subtilis rrnB-dnaB genomic region.similarity with hypothetical protein 3 from |
| Contig340D | 20901713_c3_76 | 931 | 3768 | 1707 | 569 | 613 | 6.80E-60 | Bacillus subtilis | g2293228 | ytwPYtwPBacillus subtilis rrnB-dnaB genomic region.similarity to fcrA protein precursor from |
| Contig340D | 21158812_f2_38 | 932 | 3769 | 1113 | 371 | 843 | 2.90E-84 | Bacillus subtilis | e1184976 | ykvYXaa-Pro dipeptidase homolog ykvY1Bacillus subtilis complete genome (section 8 of 21)similar to Xaa-Pro dipeptidase |
| Contig340D | 21491462_c1_63 | 933 | 3770 | 1161 | 387 | 1188 | 7.90E-121 | Bacillus subtilis | g2293267 | citZcitrate synthase subunit IIIBacillus subtilis rrnB-dnaB genomic region.alternate gene name |
| Contig340D | 21897118_f3_46 | 934 | 3771 | 1371 | 457 | 1309 | 1.20E-133 | Escherichia coli | P39312 | cycAd-serine/d-alanine/glycine transporterEscherichia coli K-12 MG1655 section 382 of 400 of the completegenome.o470: 100 pct identical amino acid sequence and |
| Contig340D | 22277327_c3_91 | 935 | 3772 | 1371 | 457 | 496 | 1.70E-47 | Bacillus subtilis | P07908 | dnaBDnaBBacillus subtilis rrnB-dnaB genomic region.The part of the protein encoded by 634-693 binds to |
| Contig340D | 23485443_c1_54 | 936 | 3773 | 1239 | 413 | 931 | 1.40E-93 | Bacillus subtilis | g2293230 | yitbJYtbJBacillus subtilis rrnB-dnaB genomic region.similar to hypothetical protein MG372 from M. |
| Contig340D | 23489090_c2_72 | 937 | 3774 | 1038 | 346 | 1033 | 2.10E-104 | Bacillus subtilis | g2293264 | pfk6-phosphofructokinaseBacillus subtilis rrnB-dnaB genomic region. |
| Contig340D | 23555302_f2_40 | 938 | 3775 | 387 | 129 | | | | | |
| Contig340D | 23603375_f2_37 | 939 | 3776 | 417 | 139 | 139 | 1.10E-09 | Methanococcus jannaschii | Q57997 | MJ0577conserved hypothetical proteinMethanococcus jannaschii section 48 of 150 of the complete genome.hypothetical protein b0607similar to SP |
| Contig340D | 23651567_c3_87 | 940 | 3777 | 888 | 296 | 387 | 4.30E-41 | Thermus thermophilus | d1025814 | mutMThermus thermophilus MutM gene, complete cds. |

| | | | | | | | | | |
|---|---|---|---|---|---|---|---|---|---|
| Contig340D | 24017890_c2_75 | 941 | 3778 | 1428 | 476 | 1242 | 1.50E-126 | Escherichia coli | g1788480 | lysP|ysPlysine-specific permeaseEscherichia coli K-12 MG1655 section 195 of 400 of the completegenome.arginine permeasef489: 100 pct identical to LYSP_ECOLI SW |
| Contig340D | 24407577_c1_65 | 942 | 3779 | 738 | 246 | 833 | 3.30E-83 | Bacillus subtilis | P13792 | phoPB.subtilis phoP gene. |
| Contig340D | 24407765_c1_55 | 943 | 3780 | 795 | 265 | 413 | 1.10E-38 | 'Pseudomonas denitrificans' | P29942 | hypothetical protein 9P.denitrificans cobN, cobO, cobP, cobQ, cobW, and ORF6-9 genes,complete cds.ORF9 |
| Contig340D | 24508552_c3_92 | 944 | 3781 | 1953 | 651 | 2471 | 8.80E-257 | Bacillus subtilis | P18255 | thrShreonine tRNA synthetaseBacillus subtilis rrnB-dnaB genomic region.threonine--tRNA ligase(thrSv) (EC 6.1.1.3) |
| Contig340D | 24662915_c3_86 | 945 | 3782 | 2718 | 906 | 2572 | 1.70E-267 | Bacillus subtilis | g2293272 | polADNA-polymerase IBacillus subtilis rrnB-dnaB genomic region. |
| Contig340D | 24726077_c3_89 | 946 | 3783 | 1026 | 342 | 1088 | 3.10E-110 | Bacillus subtilis | g2293277 | gapBglyceraldehyde-3-P-dehydrogenaseBacillus subtilis rrnB-dnaB genomic region. |
| Contig340D | 25398425_c2_67 | 947 | 3784 | 1167 | 389 | 731 | 2.10E-72 | Bacillus subtilis | g2293229 | nifS2NifS2Bacillus subtilis rrnB-dnaB genomic region.similar to R.sphaeroides nitrogenase stabilizer |
| Contig340D | 25667217_c3_88 | 948 | 3785 | 627 | 209 | 405 | 7.50E-38 | Bacillus subtilis | g2293275 | ytaGYtaGBacillus subtilis rrnB-dnaB genomic region.similar to hypothetical protein H10890 from H. |
| Contig340D | 26181551_c2_71 | 949 | 3786 | 948 | 316 | 1016 | 1.30E-102 | Bacillus subtilis | g2293263 | accAacetyl-CoA carboxylase subunitBacillus subtilis rrnB-dnaB genomic region. |
| Contig340D | 26188891_f1_7 | 950 | 3787 | 210 | 70 | | | | | |
| Contig340D | 3140917_c3_83 | 951 | 3788 | 189 | 63 | | | | | |
| Contig340D | 33209677_c2_70 | 952 | 3789 | 972 | 324 | 764 | 6.80E-76 | Bacillus subtilis | g2293259 | ytqlYtqlBacillus subtilis rrnB-dnaB genomic region.similarity to MGPA protein from M.genitalium |
| Contig340D | 33985077_c1_61 | 953 | 3790 | 1230 | 410 | 1529 | 5.80E-157 | Bacillus subtilis | g2293261 | ytsJYtsJBacillus subtilis rrnB-dnaB genomic region.similarity to malate dehydrogenase (NADP+) from |
| Contig340D | 34177127_c1_62 | 954 | 3791 | 1806 | 602 | 1853 | 2.70E-191 | Bacillus licheniformis | P51181 | PYKPyruvate KinaseBacillus licheniformis gene for pyruvate kinase, complete cds.pyruvate kinase |
| Contig340D | 34181551_c2_74 | 955 | 3792 | 924 | 308 | 618 | 2.00E-60 | Bacillus subtilis | P06567 | dnaIDnaIBacillus subtilis rrnB-dnaB genomic region.44K dnaA protein homologORF 311 (AA 1-311) |

| | | | | | | | | |
|---|---|---|---|---|---|---|---|---|
| Contig340D | 35360932_c3_79 | 956 | 3793 | 1278 | 426 | 1493 | 3.80E-153 | Bacillus subtilis | P37877 | ackAacetate kinaseBacillus subtilis rrnB-dnaB genomic region.acetate kinase |
| Contig340D | 4459380_c1_57 | 957 | 3794 | 207 | 69 | | | | |
| Contig340D | 4693800_f2_39 | 958 | 3795 | 570 | 190 | 191 | 3.50E-15 | Methanobacterium thermoautotrophicum | g2621993 | MTH898conserved proteinMethanobacterium thermoautotrophicum from bases 808939 to 820180(section 71 of 148) of the complete genome.Function Code |
| Contig340D | 5135265_c3_90 | 959 | 3796 | 504 | 168 | 434 | 6.30E-41 | Bacillus subtilis | g2293279 | ytcGYtcGBacillus subtilis rrnB-dnaB genomic region.similar to hypothetical protein HI0943 from H. |
| Contig340D | 5882753_c3_84 | 960 | 3797 | 273 | 91 | | | | | |
| Contig340D | 6125262_c2_73 | 961 | 3798 | 192 | 64 | | | | | |
| Contig340D | 6906300_c2_68 | 962 | 3799 | 1014 | 338 | 519 | 6.20E-50 | Bacillus subtilis | g2293239 | ytxKYtxKBacillus subtilis rrnB-dnaB genomic region.similarity to modification metilase AccI |
| Contig340D | 7066588_c1_60 | 963 | 3800 | 3204 | 1068 | 1849 | 4.20E-212 | Bacillus subtilis | g2293260 | dnaEDNA-polymerase III alpha-chainBacillus subtilis rrnB-dnaB genomic region. |
| Contig340D | 7244012_c1_64 | 964 | 3801 | 1287 | 429 | 1768 | 2.70E-182 | Bacillus israeli | e320380 | isocitrate dehyrogenaseBacillus israeli isocitrate dehydrogenase gene. |
| Contig340D | 803393_c3_81 | 965 | 3802 | 732 | 244 | 536 | 9.80E-52 | Archaeoglobus fulgidus | g2649315 | AF1265conserved hypothetical proteinArchaeoglobus fulgidus section 90 of 172 of the complete genome.similar to GB |
| Contig340D | 824086_c3_82 | 966 | 3803 | 882 | 294 | 859 | 5.80E-86 | Bacillus subtilis | g2293262 | yitIacetyl-CoA carboxylase subunitBacillus subtilis rrnB-dnaB genomic region.similar to acetyl-CoA carboxylase |
| Contig341D | 125880_f3_28 | 967 | 3804 | 309 | 103 | | | | | |
| Contig341D | 13678452_c2_47 | 968 | 3805 | 1263 | 421 | 438 | 2.40E-41 | Bacillus subtilis | P55340 | ecsBhypothetical EcsB proteinB.subtilis ecsA, ecsB, and ecsC genes,alternate gene name |
| Contig341D | 14656327_c3_55 | 969 | 3806 | 624 | 208 | 799 | 1.30E-79 | Staphylococcus aureus | g1916729 | cadDCadDStaphylococcus aureus plasmid pRW001, cadmium resistance CadD(cadD) gene, complete cds.contains 5 transmembrane domains; confers low level |
| Contig341D | 16533442_c1_33 | 970 | 3807 | 522 | 174 | 546 | 8.50E-53 | Bacillus subtilis | g1381681 | cspRCspRBacillus subtilis methylase homolog (cspR) gene, complete cds.methylase homolog |

| | | | | | | | |
|---|---|---|---|---|---|---|---|
| Contig341D | 165908_f1_3 | 971 | 3808 | 507 | 169 | 182 | 3.20E-14 | Bacillus subtilis | P38049 | yhgCHypothetical proteinBacillus subtilis penicillin-binding protein (pbpF) gene, 5' end,product unknown |
| Contig341D | 19922162_c2_41 | 972 | 3809 | 1161 | 387 | 517 | 1.00E-49 | Bacillus subtilis | e1182980 | yheBhypothetical proteinBacillus subtilis complete genome (section 6 of 21) |
| Contig341D | 20706557_c2_43 | 973 | 3810 | 1254 | 418 | 592 | 1.10E-57 | Bacillus subtilis | e1182993 | yhaOHypothetical proteinBacillus subtilis complete genome (section 6 of 21)similar to hypothetical proteins |
| Contig341D | 21645967_f1_7 | 974 | 3811 | 993 | 331 | 363 | 2.10E-33 | Bacillus subtilis | P24327 | prsA33kDa lipoproteinB.subtilis prsA gene for a 33kDa lipoprotein.See Swiss Prot P24327 |
| Contig341D | 23694052_f3_27 | 975 | 3812 | 603 | 201 | | | | | |
| Contig341D | 2380342_c1_36 | 976 | 3813 | 636 | 212 | 463 | 5.30E-44 | Bacillus subtilis | e1182922 | yhcZhypothetical proteinBacillus subtilis complete genome (section 5 of 21)similar to two-component response regulator [YhcY |
| Contig341D | 24025463_c3_53 | 977 | 3814 | 2952 | 984 | 1357 | 9.80E-139 | Staphylococcus aureus | g710421 | unknownStaphylococcus aureus cmp-binding-factor 1 (cbf1) and ORF X genes,complete cds.ORF X |
| Contig341D | 24120262_c1_32 | 978 | 3815 | 993 | 331 | 451 | 1.00E-42 | Bacillus subtilis | P54536 | yqiYYqiYBacillus subtilis DNA, 283 Kb region containing skin element.similar to amino acid ABC transporter (permease) |
| Contig341D | 24296943_f1_15 | 979 | 3816 | 261 | 87 | 93 | 8.60E-05 | Pyrococcus horikoshii | d1027256 | PHBN033139aa long hypothetical proteinPyrococcus horikoshii OT3 genomic DNA, 85072-124749 nt position,clone |
| Contig341D | 24490702_c3_51 | 980 | 3817 | 405 | 135 | | | | | |
| Contig341D | 24744077_c1_34 | 981 | 3818 | 183 | 61 | | | | | |
| Contig341D | 2538252_c3_56 | 982 | 3819 | 981 | 327 | 988 | 1.20E-99 | Bacillus subtilis | P32396 | hemHferrochelataseBacillus subtilis penicillin binding protein 1A (ponA) gene;uroporphyrinogen decarboxylase (hemE) gene; ferrochelatase (hemH)gene complete cds. (hemY) gene, complete cds; ORFA, complete cds;ORFB 5' end,alternate gene name |
| Contig341D | 30114637_c2_39 | 983 | 3820 | 1167 | 389 | 1177 | 1.20E-119 | Bacillus subtilis | e1182880 | yhbAhypothetical 48.5 kd proteinBacillus subtilis complete genome (section 5 of 21)allernate gene name |

| | | | | | | | | | |
|---|---|---|---|---|---|---|---|---|---|
| Contig341D | 33647577_c1_35 | 984 | 3821 | 1386 | 462 | 1586 | 5.30E-163 | Bacillus subtilis | e1249821 | citGfumarase protein, CitGBacillus subtilis 42.7kB DNA fragment from yvsA to yvqA. |
| Contig341D | 33831512_f3_30 | 985 | 3822 | 234 | 78 | | | | | |
| Contig341D | 34272752_c2_44 | 986 | 3823 | 963 | 321 | 1413 | 1.10E-144 | Staphylococcus aureus | g710422 | cbfIcmp-binding-factor 1Staphylococcus aureus cmp-binding-factor 1 (cbf1) and ORF X genes,complete cds. |
| Contig341D | 34617017_c2_46 | 987 | 3824 | 696 | 232 | 708 | 5.80E-70 | Bacillus subtilis | P55339 | ecsAputative ATP-binding protein of ABC-typeB.subtilis ecsA, ecsB, and ecsC genes.alternate gene name |
| Contig341D | 3906642_c2_50 | 988 | 3825 | 600 | 200 | 244 | 8.60E-21 | Bacillus subtilis | d1020114 | ydeNhypothetical protein ydeNBacillus subtilis genome sequence, 148 kb sequence of the regionbetween 35 and 47 degree.FUNCTION UNKNOWN. |
| Contig341D | 4073892_c2_49 | 989 | 3826 | 1458 | 486 | 1083 | 1.10E-109 | Bacillus subtilis | P32397 | hemYprotoporphyrinogen IX and coproporphyrinogen IIIBacillus subtilis penicillin binding protein 1A (ponA) gene;uroporphyrinogen decarboxylase (hemE) gene; ferrochelatase (hemH)gene complete cds, (hemY) gene, complete cds; ORFA, complete cds;ORFB 5' end.a |
| Contig341D | 4173427_c1_37 | 990 | 3827 | 474 | 158 | | | | | |
| Contig341D | 4345967_f3_25 | 991 | 3828 | 441 | 147 | 368 | 6.20E-34 | Bacillus subtilis | e1183005 | hitHit-like proteinBacillus subtilis complete genome (section 6 of 21)alternate gene name |
| Contig341D | 4568761_c2_48 | 992 | 3829 | 1116 | 372 | 1257 | 3.90E-128 | Bacillus subtilis | P32395 | hemEuroporphyrinogen decarboxylaseBacillus subtilis penicillin binding protein 1A (ponA) gene;uroporphyrinogen decarboxylase (hemE) gene; ferrochelatase (hemI)gene complete cds, (hemY) gene, complete cds; ORFA, complete cds;ORFB 5' end.see Swiss Prot P323 |
| Contig341D | 4876718_c3_52 | 993 | 3830 | 1143 | 381 | 810 | 9.00E-81 | Bacillus subtilis | e1182921 | yhcYhypothetical proteinBacillus subtilis complete genome (section 5 of 21)similar to two-component sensor histidine kinase |

| | | | | | | | | |
|---|---|---|---|---|---|---|---|---|
| Contig341D | 4882963_f1_10 | 994 | 3831 | 834 | 278 | 457 | 2.30E-43 | Bacillus subtilis | P54604 | yhcThypothetical proteinB.subtilis chromosomal DNA (region 75 degrees)Similarity to DRAP deaminase from Saccharomyces |
| Contig341D | 5132078_c2_38 | 995 | 3832 | 729 | 243 | 752 | 1.30E-74 | Archaeoglobus fulgidus | g2649950 | AF0680glutamine ABC transporter, ATP binding proteinArchaeoglobus fulgidus section 49 of 172 of the complete genome.similar to GB |
| Contig341D | 6689717_c2_40 | 996 | 3833 | 615 | 205 | | | | | |
| Contig341D | 6929651_c2_42 | 997 | 3834 | 366 | 122 | 289 | 1.50E-25 | Bacillus subtilis | e1182981 | yhcAhypothetical proteinBacillus subtilis complete genome (section 6 of 21) |
| Contig341D | 817555_f3_26 | 998 | 3835 | 447 | 149 | | | | | |
| Contig342D | 10193763_c1_46 | 999 | 3836 | 186 | 62 | | | | | |
| Contig342D | 10360902_f1_6 | 1000 | 3837 | 183 | 61 | | | | | |
| Contig342D | 1063753_c1_50 | 1001 | 3838 | 1374 | 458 | 2070 | 2.70E-214 | Staphylococcus aureus | g2271510 | murDUDP-N-acetylmuramoyl-L-alanine Staphylococcus aureus UDP-N-acetylmuramoyl-L-alanine MurD |
| Contig342D | 11806512_f1_17 | 1002 | 3839 | 207 | 69 | | | | | |
| Contig342D | 1209682_c1_41 | 1003 | 3840 | 2409 | 803 | 1984 | 3.50E-205 | Bacillus subtilis | e1184112 | pheTphenylalanyl-tRNA synthetase (beta subunit)Bacillus subtilis complete genome (section 15 of 21)phenylalanyl-tRNA synthetase beta subunit |
| Contig342D | 14644066_c1_47 | 1004 | 3841 | 189 | 63 | | | | | |
| Contig342D | 14664012_f3_34 | 1005 | 3842 | 468 | 156 | 341 | 4.50E-31 | Bacillus subtilis | e334785 | ylbP proteinBacillus subtilis genomic DNA 23.9kB fragment. |
| Contig342D | 19957802_c3_73 | 1006 | 3843 | 1896 | 632 | 1972 | 6.60E-204 | Bacillus subtilis | P14951 | uvrBdeoxyribodipyrimidine photolyaseBacillus subtilis thioredoxin (trx), uvrB and aspartokinase IIgenes, complete cds.excinuclease ABC, chain Calternate gene name |
| Contig342D | 20502217_c2_64 | 1007 | 3844 | 1626 | 542 | 718 | 5.10E-71 | Bacillus subtilis | e1185102 | yllAhypothetical protein yllABacillus subtilis complete genome (section 8 of 21) |
| Contig342D | 211677_c2_63 | 1008 | 3845 | 702 | 234 | 436 | 3.90E-41 | Bacillus subtilis | e1182712 | yfnBYfnBBacillus subtilis complete genome (section 4 of 21)similar to hypothetical proteins |

169

| | | | | | | | | | |
|---|---|---|---|---|---|---|---|---|---|
| Contig342D | 21656327_c3_78 | 1009 | 3846 | 936 | 312 | 1464 | 4.50E-150 | Staphylococcus aureus | g2149891 | yllCunknownStaphylococcus aureus strain ATCC 8325-4 cell wall/cell divisiongene cluster, yllB, yllC, yllD, pbpA, mraY, murD, div1B, ftsA andftsZ genes, complete cds. |
| Contig342D | 22542567_c1_40 | 1010 | 3847 | 759 | 253 | 562 | 1.70E-54 | Bacillus subtilis | e1184114 | ysgAhypothetical proteinBacillus subtilis complete genome (section 15 of 21)similar to rRNA methylase |
| Contig342D | 23438887_c3_71 | 1011 | 3848 | 300 | 100 | 196 | 1.00E-15 | Bacillus subtilis | e1184110 | yshAhypothetical proteinBacillus subtilis complete genome (section 15 of 21)unknown function; putative |
| Contig342D | 23572178_c1_43 | 1012 | 3849 | 846 | 282 | 1070 | 2.50E-108 | Bacillus subtilis | g143527 | sdhBsuccinate dehydrogenase (iron-sulfur protein)B.subtilis succinate dehydrogenase complex encoding cytochromeb-558 subunit, complete cds, and flavoprotein subunit, 5' end.iron-sulfur protein |
| Contig342D | 24025467_c1_45 | 1013 | 3850 | 522 | 174 | 238 | 3.70E-20 | Bacillus subtilis | P94559 | ysnBhypothetical proteinBacillus subtilis complete genome (section 15 of 21)similar to hypothetical proteins |
| Contig342D | 24245437_c3_80 | 1014 | 3851 | 1005 | 335 | 1471 | 8.10E-151 | Staphylococcus aureus | d1023423 | mraYMRAYStaphylococcus aureus genes for penicillin-binding protein 1, MraY,MurD, partial and complete cds. |
| Contig342D | 24330337_f1_15 | 1015 | 3852 | 957 | 319 | 555 | 9.50E-54 | Bacillus subtilis | e1184111 | ysgBhypothetical proteinBacillus subtilis complete genome (section 15 of 21)similar to hypothetical proteins |
| Contig342D | 24642817_c1_44 | 1016 | 3853 | 810 | 270 | 1197 | 8.80E-122 | Staphylococcus haemolyticus | P52974 | dgaglutamate racemaseStaphylococcus haemolyticus Y176 glutamate racemase (dga) gene,complete cds. |
| Contig342D | 25425202_c3_72 | 1017 | 3854 | 522 | 174 | 196 | 1.00E-15 | Bacillus subtilis | e1184109 | yshBhypothetical proteinBacillus subtilis complete genome (section 15 of 21)unknown function; putative |
| Contig342D | 25475250_c2_61 | 1018 | 3855 | 1827 | 609 | 2503 | 3.60E-260 | Bacillus subtilis | A27763 | sdhAsuccinate dehydrogenase, flavoproteinfumarate reductase flavoprotein |
| Contig342D | 26597077_f1_51 | 1019 | 3856 | 1398 | 466 | 1113 | 7.00E-113 | Staphylococcus aureus | g2149896 | div1Bcell division proteinStaphylococcus aureus strain ATCC 8325-4 cell wall/cell divisiongene cluster, yllB, yllC, yllD, pbpA, mraY, murD, div1B, ftsA andftsZ genes, complete cds. |

| Contig342D | 33651636_c2_58 | 1020 | 3857 | 1776 | 592 | 1528 | 7.40E-157 | Bacillus subtilis | e1184108 | yshC Hypothetical protein Bacillus subtilis complete genome (section 15 of 21) similar to DNA polymerase beta |
| --- | --- | --- | --- | --- | --- | --- | --- | --- | --- | --- |
| Contig342D | 34644125_c1_52 | 1021 | 3858 | 1170 | 390 | 1559 | 3.90E-160 | Staphylococcus aureus | g2149897 | ftsA cell division protein Staphylococcus aureus strain ATCC 8325-4 cell wall/cell division gene cluster, yllB, yllC, yllD, pbpA, mraY, murD, divIB, ftsA and ftsZ genes, complete cds. |
| Contig342D | 34646937_c2_60 | 1022 | 3859 | 336 | 112 | 334 | 2.50E-30 | Bacillus subtilis | g142520 | trx thioredoxin Bacillus subtilis thioredoxin (trx), uvrB and aspartokinase II genes, complete cds, thioredoxin putative |
| Contig342D | 36147150_c3_75 | 1023 | 3860 | 609 | 203 | 492 | 4.50E-47 | Bacillus subtilis | e1184085 | ysnA hypothetical protein Bacillus subtilis complete genome (section 15 of 21) similar to hypothetical proteins |
| Contig342D | 36520302_c1_48 | 1024 | 3861 | 189 | 63 | 250 | 2.00E-21 | Staphylococcus aureus | O07319 | yllB unknown Staphylococcus aureus strain ATCC 8325-4 cell wall/cell division gene cluster, yllB, yllC, yllD, pbpA, mraY, murD, divIB, ftsA and ftsZ genes, complete cds. |
| Contig342D | 4067342_c2_57 | 1025 | 3862 | 1086 | 362 | 1267 | 3.40E-129 | Bacillus subtilis | P17921 | pheS Phenylalanyl-tRNA synthetase (alpha subunit) Bacillus subtilis complete genome (section 15 of 21) phenylalanyl-tRNA synthetase beta subunit |
| Contig342D | 4306562_c3_77 | 1026 | 3863 | 306 | 102 | 469 | 1.20E-44 | Staphylococcus aureus | O07319 | yllB unknown Staphylococcus aureus strain ATCC 8325-4 cell wall/cell division gene cluster, yllB, yllC, yllD, pbpA, mraY, murD, divIB, ftsA and ftsZ genes, complete cds. |
| Contig342D | 4330275_c2_53 | 1027 | 3864 | 297 | 99 | 94 | 6.70E-05 | Human papillomavirus | P06460 | E5A protein Genital human papillomavirus type 6b (HPV6b), papillomavirus E5 protein open reading frame E5a |
| Contig342D | 4457788_f3_39 | 1028 | 3865 | 1716 | 572 | 266 | 7.40E-20 | Plasmodium reichenowi | g535260 | STARP antigen P. reichenowi STARP gene for STARP antigen. |
| Contig342D | 4532967_c2_59 | 1029 | 3866 | 2358 | 786 | 1882 | 2.30E-194 | Bacillus subtilis | e1184107 | yshD hypothetical protein Bacillus subtilis complete genome (section 15 of 21) similar to DNA mismatch repair protein |

| Contig342D | 4696068_c3_69 | 1030 | 3867 | 186 | 62 | 237 | 4.70E-20 | BACILLUS STEAROTHERMOPHILUS | P07840 | RPMFribosomal protein BL3750S RIBOSOMAL PROTEIN L32 (RIBOSOMAL PROTEIN l) (BL37)Bacillus stearothermophilus ribosomal protein BL37 |
|---|---|---|---|---|---|---|---|---|---|---|
| Contig342D | 4725415_c1_49 | 1031 | 3868 | 2337 | 779 | 3205 | 0 | Staphylococcus aureus | d1023422 | pbpApenicillin-binding protein 1Staphylococcus aureus genes for penicillin-binding protein 1, MraY,MurD, partial and complete cds. |
| Contig342D | 6131693_c3_79 | 1032 | 3869 | 414 | 138 | 574 | 9.20E-56 | Staphylococcus aureus | d1023421 | ylIDcell division proteinStaphylococcus aureus genes for penicillin-binding protein 1, MraY,MurD, partial and complete cds.unnamed protein product |
| Contig342D | 968811_c3_74 | 1033 | 3870 | 651 | 217 | 599 | 2.10E-58 | Bacillus subtilis | P08064 | sdhC succinate dehydrogenase (cytochrome b558B.subtilis succinate dehydrogenase complex encoding cytochromeb-558 subunit, complete cds, and flavoprotein subunit, 5' end.succinate dehydrogenase cytochrome b558succinate dehydrogenase cytochrome b-558 subunit |
| Contig342D | 10580443_c2_74 | 1034 | 3871 | 237 | 79 | 246 | 5.30E-21 | Escherichia coli | P33014 | yecDhypothetical 8.1 kD protein in sbcB 3 regionE.coli genomic DNA, Kohara clone #349(44.6-45.0 min.),ORF_ID |
| Contig343D | 1417338_c3_81 | 1035 | 3872 | 228 | 76 | 289 | 1.50E-25 | Bacillus subtilis | e1182570 | ydiBconserved hypothetical protein ydiBBacillus subtilis complete genome (section 4 of 21)similar to hypothetical proteins |
| Contig343D | 14493812_c2_71 | 1036 | 3873 | 465 | 155 | 123 | 5.70E-08 | Bacillus subtilis | P37252 | ilvNacetolactate synthase small subunitBacillus subtilis ilvB, ilvN and ilvC genes, complete ilv-leuoperon.acetolactate synthase (acetohydroxy-acid synthase) |
| Contig343D | 1461637_f1_11 | 1037 | 3874 | 249 | 83 | 127 | 2.10E-08 | Mitochondrion Chondrus crispus | e138028 | putative orf79.1C.crispus complete mitochondrial genome.unique orf |
| Contig343D | 14849093_c1_45 | 1038 | 3875 | 294 | 98 | 1161 | 3.60E-128 | LACTOCOCCUS LACTIS | Q02145 | ILVAprobable threonine dehydratase,DEAMINASE)threonine dehydratase |
| Contig343D | 14897837_f3_41 | 1039 | 3876 | 1275 | 425 | | | | | |

| | | | | | | | | |
|---|---|---|---|---|---|---|---|---|
| Contig343D | 16453328_f3_37 | 1040 | 3877 | 339 | 113 | 1.80E-05 | Chloroplast Marchantia polymorpha | P12221 | 5S rRNAhypothetical protein 1068Liverwort Marchantia polymorpha chloroplast genome DNA.ORF1068 |
| Contig343D | 1702_f1_2 | 1041 | 3878 | 522 | 174 | | | | |
| Contig343D | 19564128_c3_89 | 1042 | 3879 | 315 | 105 | | | | |
| Contig343D | 19564400_c3_92 | 1043 | 3880 | 321 | 107 | 6.50E-07 | Kinetoplast Trypanosoma brucei | g501027 | Trypanosoma brucei EATRO 164 kinetoplast (CR4) mRNA, complete cds.ORF2 |
| Contig343D | 20422318_f2_20 | 1044 | 3881 | 417 | 139 | 1.80E-05 | Bacillus subtilis | e1183973 | glnHglutamine ABC transporter (glutamine-bindingBacillus subtilis complete genome (section 14 of 21) |
| Contig343D | 22441907_f1_10 | 1045 | 3882 | 1869 | 623 | 1924 | 8.10E-199 | Bacillus subtilis | P51785 | ilvDdihydroxy-acid dehydrataseBacillus subtilis (YAC10-9 clone) DNA region between the serA andkdg loci.51.0% identity with the Escherichia coli |
| Contig343D | 22939705_c2_79 | 1046 | 3883 | 402 | 134 | | | | |
| Contig343D | 23478463_f2_31 | 1047 | 3884 | 1755 | 585 | 1667 | 1.40E-171 | Bacillus subtilis | e1184080 | ilvBacetolactate synthase (acetohydroxy-acidBacillus subtilis complete genome (section 15 of 2 )acetolactate synthase (acetohydroxy-acid synthase) |
| Contig343D | 23626577_c1_62 | 1048 | 3885 | 210 | 70 | | | | |
| Contig343D | 23867325_f1_15 | 1049 | 3886 | 570 | 190 | 561 | 2.20E-54 | Lactococcus lactis | Q02144 | leuDLeuDLactococcus lactis unknown gene, partial cds, and HisC (hisC),unknown, HisG (hisG), unknown, HisB (hisB), unknown, HisH (hisH),HisA (hisA), HisF (hisF), HisIE (hisIE), unknown, unknown, LeuA(leuA), LeuB (leuB), LeuC (leuC), LeuD (leuD), unknown, I |
| Contig343D | 24343813_c2_73 | 1050 | 3887 | 1119 | 373 | 1075 | 7.50E-109 | Escherichia coli | P33015 | yceEhypothetical 38.1 kD protein in sbcB 3'regionE.coli genomic DNA, Kohara clone #349(44.6-45.0 min.).ORF_ID |
| Contig343D | 24640625_c3_91 | 1051 | 3888 | 960 | 320 | 954 | 5.00E-96 | Staphylococcus xylosus | e264641 | scrRsucrose repressorS.xylosus scrB and scrR genes. |

| | | | | | | | | | | |
|---|---|---|---|---|---|---|---|---|---|---|
| Contig343D | 24642202_c3_94 | 1052 | 3889 | 648 | 216 | 822 | 4.80E-82 | Staphylococcus aureus | g2689554 | Staphylococcus aureus toxic shock syndrome toxin-1 (tst),enterotoxin (ent), and integrase (int) genes, complete cds.orf7 |
| Contig343D | 24646962_c2_78 | 1053 | 3890 | 210 | 70 | | | | | |
| Contig343D | 24814812_f2_29 | 1054 | 3891 | 1950 | 650 | 1516 | 1.40E-155 | Bacillus subtilis | e1182574 | ydiFABC transporter (ATP-binding protein) homolog ydiFBacillus subtilis complete genome (section 4 of 21)similar to ABC transporter (ATP-binding protein) |
| Contig343D | 24823588_f1_14 | 1055 | 3892 | 1386 | 462 | 1633 | 5.50E-168 | Lactococcus lactis | Q02142 | leuCLeuCLactococcus lactis unknown gene, partial cds, and HisC (hisC),unknown, HisG (hisG), unknown, HisB (hisB), unknown, HisH (hish),HisA (hisA), HisF (hisF), HisIE (hisIE), unknown, unknown, LeuA(leuA), LeuB (leuB), LeuC (leuC), LeuD (leuD), unknown, I |
| Contig343D | 25665687_c1_63 | 1056 | 3893 | 876 | 292 | 322 | 4.70E-29 | Staphylococcus aureus | g2689560 | Staphylococcus aureus toxic shock syndrome toxin-1 (tst),enterotoxin (ent), and integrase (int) genes, complete cds.orf13 |
| Contig343D | 25900300_c1_61 | 1057 | 3894 | 312 | 104 | 297 | 2.10E-26 | Staphylococcus aureus | g2689561 | Staphylococcus aureus toxic shock syndrome toxin-1 (tst),enterotoxin (ent), and integrase (int) genes, complete cds.orf14 |
| Contig343D | 26615912_c1_56 | 1058 | 3895 | 1479 | 493 | 1943 | 7.80E-201 | Staphylococcus xylosus | Q05936 | scrBbeta-fructofuranosidaseS.xylosus scrB and scrR genes. |
| Contig343D | 2866090_f1_1 | 1059 | 3896 | 1254 | 418 | 1250 | 2.10E-127 | Staphylococcus aureus | g2689564 | intintegraseStaphylococcus aureus toxic shock syndrome toxin-1 (tst),enterotoxin (ent), and integrase (int) genes, complete cds.similar to staphylococcal phage integrase |
| Contig343D | 31680342_f2_21 | 1060 | 3897 | 546 | 182 | 173 | 8.00E-12 | Kaposi's sarcoma-associated herpes-like virus | g1633572 | Kaposi's sarcoma-associated herpes-like virus ORF73 homolog gene,complete cds.Herpesvirus saimiri ORF73 homolog |
| Contig343D | 3361326_c3_82 | 1061 | 3898 | 207 | 69 | | | | | |

174

| | | | | | | | | |
|---|---|---|---|---|---|---|---|---|
| Contig343D | 34257878_f1_13 | 1062 | 3899 | 1065 | 355 | 894 | 1.10E-89 | Lactococcus lactis | Q02143 | leuBLeuBLactococcus lactis unknown gene, partial cds, and llisC (hisC),unknown, HisG (hisG), unknown, HisB (hisB), unknown, HisH (hish),HisA (hisA), HisF (hisF), HisE (hisE), unknown, unknown, LeuA(leuA), LeuB (leuB), LeuC (leuC), LeuD (leuD), unknown,1 |
| Contig343D | 344112750_c1_57 | 1063 | 3900 | 966 | 322 | 1031 | 3.40E-104 | Staphylococcus aureus | g46512 | hypothetical protein 7S.aureus agrA, agrB and hld genes,orf 7 |
| Contig343D | 35428187_c2_80 | 1064 | 3901 | 438 | 146 | | | | | |
| Contig343D | 35598750_f2_19 | 1065 | 3902 | 849 | 283 | 112 | 3.30E-06 | Streptococcus thermophilus bacteriophage TP-J34 | g2897106 | repressorStreptococcus thermophilus bacteriophage lysogeny module, integraschomolog (int), putative host cell surface-exposed lipoprotein,putative metallo-proteinase, repressor, Cro-like regulatoryprotein, and P1-antirepressor homolog genes, complete cds. |
| Contig343D | 36132937_f1_8 | 1066 | 3903 | 1641 | 547 | 273 | 8.00E-20 | Streptococcus pneumoniae | P10564 | hexAmismatch repair proteinS.pneumoniae mismatch repair protein (hexA) gene, complete cds. |
| Contig343D | 36206502_c1_51 | 1067 | 3904 | 483 | 161 | 340 | 5.80E-31 | Bacillus subtilis | e1182572 | ydiDribosomal-protein-alanine N-acetyltransfer homolog ydiDBacillus subtilis complete genome (section 4 of 21)similar to ribosomal-protein-alanine |
| Contig343D | 36441292_f2_34 | 1068 | 3905 | 210 | 70 | 101 | 3.60E-05 | Pyrococcus horikoshii | d1027343 | PHBW01623Saa long hypothetical proteinPyrococcus horikoshii OT3 genomic DNA, 180023-216005 nt position,clone |
| Contig343D | 36601678_c3_93 | 1069 | 3906 | 1728 | 576 | | | | | |
| Contig343D | 4707506_c3_90 | 1070 | 3907 | 1314 | 438 | 1156 | 2.00E-117 | Bacillus subtilis | Q07429 | nrgAmembrane-associated proteinBacillus subtilis operon membrane-associated protein (nrgA), andPII-like protein (nrgB) genes, complete cds.putative |

| | | | | | | | | |
|---|---|---|---|---|---|---|---|---|
| Contig343D | 4958387_c2_72 | 1071 | 3908 | 537 | 179 | 305 | 2.90E-27 | Bacillus subtilis | e1182571 | ydiCglycoprotein endopeptidase homolog ydiCBacillus subtilis complete genome (section 4 of 21)similar to glycoprotein endopeptidase |
| Contig343D | 5359438_c3_88 | 1072 | 3909 | 1107 | 369 | 1096 | 4.50E-111 | Bacillus subtilis | e1182573 | ydiEglycoprotein endopeptidase homolog ydiEBacillus subtilis complete genome (section 4 of 21)similar to glycoprotein endopeptidase |
| Contig343D | 5909428_c1_55 | 1073 | 3910 | 750 | 250 | 568 | 4.00E-55 | Bacillus subtilis | e1182576 | ydiHHypothetical protein ydiHBacillus subtilis complete genome (section 4 of 21) |
| Contig343D | 860790_f2_32 | 1074 | 3911 | 1593 | 531 | 1391 | 2.40E-142 | Lactococcus lactis | g2565151 | leuALeuALactococcus lactis unknown gene, partial cds, and HisC (hisC),unknown, HisG (hisG), unknown, HisB (hisB), unknown, HisH (hish),HisA (hisA), HisF (hisF), HisE (hisE), unknown, unknown, LeuA(leuA), LeuB (leuB), LeuC (leuC), LeuD (leuD), unknown, I |
| Contig343D | 9843800_f3_39 | 1075 | 3912 | 192 | 64 | | | | |
| Contig343D | 995451_f1_12 | 1076 | 3913 | 1020 | 340 | 1139 | 1.20E-115 | Bacillus subtilis | P37253 | ilvCketol-acid reductoisomeraseBacillus subtilis ilvB, ilvN and ilvC genes, complete ilv-leuoperon.ketol-acid reductoisomerase (acetohydroxy-acid |
| Contig344D | 10410638_c2_202 | 1077 | 3914 | 330 | 110 | 267 | 3.10E-23 | Staphylococcus aureus | g1595809 | spsAtype-I signal peptidase SpsAStaphylococcus aureus type-I signal peptidase SpsA (spsA) gene, andtype-I signal peptidase SpsB (spsB) gene, complete cds.inactive signal peptidase homologue; protein lacks |
| Contig344D | 10646950_c2_238 | 1078 | 3915 | 1221 | 407 | 1151 | 6.60E-117 | Bacillus subtilis | g1934606 | yrhBcystathionine gamma-lyaseBacillus subtilis cysteine synthase (yrhA), cystathionine gamma-lyase (yrhB), YrhC (yrhC), YrhD (yrhD), formate dehydrogenasechain A (yrhE), YrhF (yrhF), formate dehydrogenase (yrhG), YrhI(yrhH), regulatory protein (yrhH), cyto |

| | | | | | | | | |
|---|---|---|---|---|---|---|---|---|
| Contig344D | 10760378_c1_200 | 1079 | 3916 | 210 | 70 | | | |
| Contig344D | 10948587_c2_225 | 1080 | 3917 | 822 | 274 | 706 | 9.50E-70 | Bacillus subtilis | e1183364 | ykoYtoxic anion resistance protein homolog ykoYBacillus subtilis complete genome (section 7 of 21)similar to toxic anion resistance protein |
| Contig344D | 11062_f3_152 | 1081 | 3918 | 1128 | 376 | 218 | 1.70E-15 | Rhodobacter capsulatus | g3128293 | hypothetical proteinRhodobacter capsulatus strain SB1003, partial genome. |
| Contig344D | 1171892_f3_142 | 1082 | 3919 | 261 | 87 | 110 | 2.50E-06 | Kinetoplast Bodo saltans | g3037018 | ND5NADH dehydrogenase subunit 5Bodo saltans NADH dehydrogenase subunit 5 (ND5) mRNA, kinetoplastigene encoding kinetoplast protein, partial cds,partially edited mRNA |
| Contig344D | 1178785_c1_198 | 1083 | 3920 | 939 | 313 | 731 | 2.10E-72 | Bacillus subtilis | g1934605 | yrhAcysteine synthaseBacillus subtilis cysteine synthase (yrhA), cystathioninegamma-lyase (yrhB), YrhC (yrhC), YrhD (yrhD), formate dehydrogenasechain A (yrhE), YrhF (yrhF), formate dehydrogenase (yrhG), YrhH(yrhH), regulatory protein (yrhI), cytochrome P |
| Contig344D | 11931540_f2_63 | 1084 | 3921 | 825 | 275 | 786 | 3.20E-78 | Staphylococcus xylosus | e352090 | transcriptional regulator from the LysR-typeStaphylococcus xylosus lacR, lacP, lacH genes and 2 ORF's,ORF1 |
| Contig344D | 12603166_f2_59 | 1085 | 3922 | 303 | 101 | 100 | 1.60E-05 | Pyrococcus horikoshii | d1027339 | PHBW012106aa long hypothetical proteinPyrococcus horikoshii OT3 genomic DNA, 180023-216005 nt position,clone |
| Contig344D | 126068_f3_122 | 1086 | 3923 | 555 | 185 | 119 | 2.60E-06 | Escherichia coli | P05530 | MCBGmcbG proteinE. coli genes mcbE, mcbF and mcbG for microcin B17 immunity onwildtype plasmid pMccB17.McbG gene product (AA 1-187) |
| Contig344D | 12681510_f2_100 | 1087 | 3924 | 825 | 275 | 702 | 2.50E-69 | Bacillus subtilis | e261990 | putative orfYitUB.subtilis nprB gene,similar to hypothetical proteins |
| Contig344D | 12750290_c2_207 | 1088 | 3925 | 1122 | 374 | 1233 | 1.40E-125 | Bacillus subtilis | e1183166 | oppDoligopeptide ABC transporter (ATP binding)Bacillus subtilis complete genome (section 7 of 21)alternate gene name |

177

| | | | | | | | | | |
|---|---|---|---|---|---|---|---|---|---|
| Contig344D | 13089052_f2_80 | 1089 | 3926 | 240 | 80 | 112 | | Staphylococcus aureus | g295834 | replication protein REPS.aureus plasmid pOX2000.ORF 154 |
| Contig344D | 13678300_c3_273 | 1090 | 3927 | 1233 | 411 | 1393 | 1.50E-142 | Bacillus subtilis | e1182288 | yciChomologues to nitrile hydratase regionBacillus subtilis complete genome (section 2 of 21)similar to hypothetical proteins |
| Contig344D | 14271068_f3_124 | 1091 | 3928 | 261 | 87 | | | | | |
| Contig344D | 1445930_f1_16 | 1092 | 3929 | 621 | 207 | | | | | |
| Contig344D | 14460882_c2_230 | 1093 | 3930 | 1695 | 565 | 1304 | 4.00E-133 | Staphylococcus haemolyticus | g1022726 | unknownStaphylococcus haemolyticus IS1272 ORF1 and ORF2 genes, completecds.ORF1 |
| Contig344D | 15022153_f3_135 | 1094 | 3931 | 189 | 63 | | | | | |
| Contig344D | 15900305_f3_115 | 1095 | 3932 | 789 | 263 | | | | | |
| Contig344D | 16196963_f1_13 | 1096 | 3933 | 192 | 64 | | | | | |
| Contig344D | 16257665_f3_118 | 1097 | 3934 | 192 | 64 | | | | | |
| Contig344D | 16281286_c1_197 | 1098 | 3935 | 1359 | 453 | 1059 | 3.70E-107 | Bacillus subtilis | e1182948 | yhdHhypothetical proteinBacillus subtilis complete genome (section 6 of 21)similar to sodium-dependent transporter |
| Contig344D | 16832562_f3_150 | 1099 | 3936 | 804 | 268 | 320 | 3.70E-36 | Bacillus subtilis | e1183175 | yjbHhypothetical protein yjbHBacillus subtilis complete genome (section 7 of 21) |
| Contig344D | 187683_c2_218 | 1100 | 3937 | 228 | 76 | 256 | 1.10E-23 | Staphylococcus aureus | P20384 | BIN3Staphylococcus aureus plasmid pi9789 DNA with binR and bin3 genes,derived from transposon TN552.bin3 product |
| Contig344D | 19547938_c3_261 | 1101 | 3938 | 372 | 124 | 224 | 6.10E-18 | LEUCONOSTOC MESENTEROIDES | P11411 | ZWFGLUCOSE-6-PHOSPHATE 1-DEHYDROGENASE. (G6PD) |
| Contig344D | 1960952_c3_249 | 1102 | 3939 | 906 | 302 | 575 | 7.20E-56 | Bacillus subtilis | e1183077 | yisKYisKBacillus subtilis complete genome (section 6 of 21)similar to 5-oxo-1,2,5-tricarboxilic-3-penten acid |
| Contig344D | 19610442_f3_148 | 1103 | 3940 | 246 | 82 | 132 | 6.30E-09 | Bacillus anthracis | g929968 | Bacillus anthracis Sterne toxin plasmid pXO1 right inverted repeatelement (SterneR) bordering the toxin-encoding region, ORFA andtruncated ORFB genes, complete cds.ORFA; similar to B. anthracis WeyAR element ORFA; |

| | | | | | | | | |
|---|---|---|---|---|---|---|---|---|
| Contig344D | 197712762_c3_288 | 1104 | 3941 | | | 813 | 4.30E-81 | Bacillus subtilis | P24277 | recRrecombination proteinB. subtilis DNA, 180 kilobase region of replication origin,alternate gene name |
| Contig344D | 197790902_c3_257 | 1105 | 3942 | 813 | 271 | 919 | 2.50E-92 | Bacillus subtilis | e1183181 | yjbNconserved hypothetical protein yjbNBacillus subtilis complete genome (section 7 of 21)similar to hypothetical proteins |
| Contig344D | 199660162_c2_236 | 1106 | 3943 | 2631 | 877 | 1785 | 4.30E-184 | Bacillus subtilis | e1182118 | ybcDhypothetical protein ybcDBacillus subtilis complete genome (section 1 of 21) |
| Contig344D | 20093_c1_190 | 1107 | 3944 | 306 | 102 | | | | | |
| Contig344D | 20314005_c3_283 | 1108 | 3945 | 4590 | 1530 | 4186 | 0 | Bacillus subtilis | e1183503 | gltAglutamate synthase (large subunit)Bacillus subtilis complete genome (section 10 of 21) |
| Contig344D | 205170062_c3_252 | 1109 | 3946 | 1002 | 334 | 961 | 9.00E-97 | Bacillus subtilis | e1183136 | yjaX3-oxoacyl- acyl-carrier protein synthase homolog yjaXBacillus subtilis complete genome (section 6 of 21)similar to 3-oxoacyl- acyl-carrier protein |
| Contig344D | 20602262_c2_245 | 1110 | 3947 | 543 | 181 | | | | | |
| Contig344D | 20602263_c3_274 | 1111 | 3948 | 1512 | 504 | 1414 | 8.90E-145 | Bacillus subtilis | P39755 | ndhFNADH dehydrogenase subunit 5Bacillus subtilis NADH dehydrogenase subunit 5 (ndhF) gene,complete cds,alternate gene name |
| Contig344D | 2125903_f2_88 | 1112 | 3949 | 1239 | 413 | 197 | 5.20E-13 | Pyrococcus horikoshii | d1027783 | PHLA010413aa long hypothetical proteinPyrococcus horikoshii OT3 genomic DNA, 588982-607168 nt position,clone |
| Contig344D | 2142316_f2_76 | 1113 | 3950 | 213 | 71 | | | | | |
| Contig344D | 21525051_f1_11 | 1114 | 3951 | 309 | 103 | | | | | |
| Contig344D | 21594202_f1_23 | 1115 | 3952 | 1176 | 392 | 591 | 1.50E-57 | Bacillus subtilis | P54166 | ypfPcell wall synthesis homolog ypfPBacillus subtilis (YAC10-9 clone) DNA region between the serA andkdg loci,putative |
| Contig344D | 21753125_c3_253 | 1116 | 3953 | 1194 | 398 | 664 | 1.60E-79 | Bacillus subtilis | e1181495 | dppCDppCBacillus subtilis 168 56 kb DNA fragment between xlyA and ykoR,alternate gene name |
| Contig344D | 22305342_f2_75 | 1117 | 3954 | 543 | 181 | 156 | 5.20E-10 | Kaposi's sarcoma- associated herpes-like virus | g1633572 | Kaposi's sarcoma-associated herpes-like virus ORF73 homolog gene,complete cds.Herpesvirus saimiri ORF73 homolog |

| | | | | | | | | | |
|---|---|---|---|---|---|---|---|---|---|
| Contig344D | 23484678_c2_246 | 1118 | 3955 | 1731 | 577 | 1263 | 9.00E-129 | Bacillus subtilis | P09122 | dnaH DNA polymerase III subunitB. subtilis DNA, 180 kilobase region of replication origin,alternate gene name |
| Contig344D | 23556500_f3_116 | 1119 | 3956 | 282 | 94 | | | | | |
| Contig344D | 23634641_c2_206 | 1120 | 3957 | 1248 | 416 | 1475 | 3.10E-151 | Bacillus subtilis | e1183137 | yjaY 3-oxoacyl- acyl-carrier protein synthase homolog yjaY Bacillus subtilis complete genome (section 6 of 21) similar to 3-oxoacyl- acyl-carrier protein |
| Contig344D | 23678800_c1_172 | 1121 | 3958 | 399 | 133 | 395 | 8.60E-37 | Bacillus subtilis | e261991 | putative orfYitWB.subtilis nprB gene.similar to hypothetical proteins |
| Contig344D | 23861318_f3_155 | 1122 | 3959 | 210 | 70 | | | | | |
| Contig344D | 24016916_c3_285 | 1123 | 3960 | 1044 | 348 | 396 | 6.70E-37 | Escherichia coli | P33019 | yeiH Hypothetical 36.9 kD protein in lysP-nfoEscherichia coli K-12 MG1655 section 195 of 400 of the completegenome.o349; 100 pct identical to YEIH_ECOLI SW |
| Contig344D | 24022191_f1_45 | 1124 | 3961 | 222 | 74 | 97 | 3.20E-05 | Bacillus subtilis | e1183130 | yjzD hypothetical protein yjzDBacillus subtilis complete genome (section 6 of 21)unnamed protein product |
| Contig344D | 24024142_c3_260 | 1125 | 3962 | 315 | 105 | 93 | 8.60E-05 | Bacillus firmus | g2654481 | hypothetical 10.1 kDa proteinBacillus firmus hypothetical 34.0 kDa protein, hypothetical 8.9 kDaprotein, hypothetical 10.1 kDa protein. hypothetical 21.0 kDaprotein, putative thiosulfate sulfurtransferase, hypothetical 16.1kDa transcriptional regulator an |
| Contig344D | 24272337_f2_74 | 1126 | 3963 | 432 | 144 | | | | | |
| Contig344D | 24391885_f2_65 | 1127 | 3964 | 183 | 61 | | | | | |
| Contig344D | 24409428_c2_227 | 1128 | 3965 | 258 | 86 | 357 | 9.10E-33 | Staphylococcus aureus | g1731452 | prerecombination proteinStaphylococcus aureus chloramphenicol resistance plasmid pKH7,complete sequence. |
| Contig344D | 24412517_c1_181 | 1129 | 3966 | 393 | 131 | 213 | 9.90E-17 | Bacillus subtilis | P54547 | yqjJ YqjJBacillus subtilis DNA, 283 Kb region containing skin element.similar to glucose-6-phosphate 1-dehydrogenase |

179

180

| | | | | | | | | |
|---|---|---|---|---|---|---|---|---|
| Contig344D | 24415632_c2_203 | 1130 | 3967 | 579 | 193 | 827 | 1.40E-82 | Staphylococcus aureus | g1595810 | spsBtype-1 signal peptidase SpsBStaphylococcus aureus type-1 signal peptidase SpsA (spsA) gene, andtype-1 signal peptidase SpsB (spsB) gene, complete cds.signal peptidase, leader peptidase, serine |
| Contig344D | 24646886_c1_185 | 1131 | 3968 | 1557 | 519 | 285 | 3.00E-22 | Helicobacter pylori | g2313187 | HP0104(2,3'-cyclic-nucleotide 2'-phosphodiesterase)Helicobacter pylori section 10 of 134 of the complete genome.similar to EGAD |
| Contig344D | 24648412_c2_211 | 1132 | 3969 | 642 | 214 | 683 | 2.60E-67 | Bacillus subtilis | e1183180 | yjbMGTP pyrophosphokinase homolog yjbMBacillus subtilis complete genome (section 7 of 21)similar to GTP pyrophosphokinase |
| Contig344D | 24664802_c2_237 | 1133 | 3970 | 747 | 249 | 380 | 3.30E-35 | Bacillus subtilis | e1186050 | yvaKcarboxylesterase homolog yvaKBacillus subtilis complete genome (section 18 of 21)similar to carboxylesterase |
| Contig344D | 24804677_c1_187 | 1134 | 3971 | 366 | 122 | 117 | 1.20E-06 | Pseudomonas syringae | g2541936 | Pseudomonas syringae phaseolotoxin operonORF6; similar to Pseudomonas syringae fatty acid |
| Contig344D | 25392826_f1_26 | 1135 | 3972 | 1146 | 382 | 557 | 5.80E-54 | Bacillus subtilis | e1184257 | yueFconserved hypothetical protein yueFBacillus subtilis complete genome (section 17 of 21)similar to hypothetical proteins |
| Contig344D | 25429512_c1_184 | 1136 | 3973 | 1392 | 464 | 1130 | 1.10E-114 | Bacillus subtilis | e1184940 | ykrMNa+-transporting ATP synthase homolog ykrMBacillus subtilis complete genome (section 8 of 21)similar to Na+-transporting ATP synthase |
| Contig344D | 25586693_c3_287 | 1137 | 3974 | 333 | 111 | 374 | 1.40E-34 | Bacillus subtilis | P24281 | yaaKunknownB. subtilis DNA, 180 kilobase region of replication origin.ORF107 |
| Contig344D | 256468_c2_242 | 1138 | 3975 | 330 | 110 | | | | | |
| Contig344D | 26212787_f2_91 | 1139 | 3976 | 612 | 204 | 308 | 1.40E-27 | Bacillus subtilis | e1183178 | yjbKhypothetical protein yjbK.Bacillus subtilis complete genome (section 7 of 21) |
| Contig344D | 26377340_c3_256 | 1140 | 3977 | 999 | 333 | 208 | 3.90E-15 | Lactococcus lactis | e257629 | transcription factorL.lactis ORF; genes homologous to vsf-1 and pepF2 and gene encodingprotein homologous to methyltransferase.weak homology with vsf-1 gene (X73635) |

| | | | | | | | | |
|---|---|---|---|---|---|---|---|---|
| Contig344D | 26460887_f3_117 | 1141 | 3978 | 1524 | 508 | 366 | 5.90E-32 | Bacillus subtilis | P13484 | tagEUDP-glucoseBacillus subtilis rodC operon.rodD (gtaA) polypeptide (AA 1-673) |
| Contig344D | 26564012_c3_251 | 1142 | 3979 | 2616 | 872 | 2649 | 1.20E-275 | Lactococcus lactis subsp. cremoris | g3150046 | clpBClpB chaperone homologLactococcus lactis cremoris ClpB chaperone homolog (clpB) andphosphoribosylformylglycinamide cyclo-ligase (pur5) genes, completecds; and phosphoribosylglycinamide formyltransferase (pur3) gene,partial cds. |
| Contig344D | 26604662_c3_259 | 1143 | 3980 | 630 | 210 | | | | |
| Contig344D | 26776562_c1_194 | 1144 | 3981 | 399 | 133 | | | | |
| Contig344D | 289802_f1_41 | 1145 | 3982 | 189 | 63 | | | | |
| Contig344D | 2922260_c1_178 | 1146 | 3983 | 384 | 128 | 174 | 2.20E-13 | Bacillus subtilis | e1183179 | yjbLhypothetical protein yjbLBacillus subtilis complete genome (section 7 of 21) |
| Contig344D | 30265952_c3_280 | 1147 | 3984 | 387 | 129 | 118 | 1.90E-07 | Methanobacterium thermoautotrophicum | g2621161 | MTH122mutator MutT related proteinMethanobacterium thermoautotrophicum from bases 68653 to 79584(section 7 of 148) of the complete genome:Function Code |
| Contig344D | 30664130_f3_120 | 1148 | 3985 | 258 | 86 | | | | |
| Contig344D | 30682802_c1_196 | 1149 | 3986 | 261 | 87 | | | | |
| Contig344D | 32062875_c2_228 | 1150 | 3987 | 291 | 97 | 333 | 3.20E-30 | Staphylococcus aureus | g1731452 | prerecombination proteinStaphylococcus aureus chloramphenicol resistance plasmid pKH7,complete sequence. |
| Contig344D | 32067937_f1_53 | 1151 | 3988 | 1365 | 455 | 1790 | 1.30E-184 | Staphylococcus aureus | g2792490 | coenzyme A disulfide reductaseStaphylococcus aureus coenzyme A disulfide reductase gene, completecds.CoADR; flavoenzyme (FAD); single catalytic cysteine |
| Contig344D | 32457312_c3_262 | 1152 | 3989 | 495 | 165 | 233 | 1.30E-19 | Clostridium perfringens | e303881 | putative transposaseC.perfringens uapC, cpe, and nadC genes. |
| Contig344D | 32635937_c2_224 | 1153 | 3990 | 1503 | 501 | 895 | 8.90E-90 | Bacillus subtilis | Q03523 | murEUDP-N-acetylmuramoylalanine-D-glutamate-2,6-B.subtilis genes spoVD, murE, mraY, murD. |

| | | | | | | | |
|---|---|---|---|---|---|---|---|
| Contig344D | 33364067_c2_226 | 1154 | 3991 | 1782 | 594 | 542 | 2.30E-52 | Streptococcus pneumoniae | g2109443 | sphuraputative serine proceaseStreptococcus pneumoniae R801 tRNA-Arg gene, partial sequence, andputative serine protease (sphtra), SPSpoJ (spspoJ), initiatorprotein (spdnaa) and beta subunit of DNA polymerase III (spdnan)genes, complete cds.SPHtra |
| Contig344D | 33399055_c3_275 | 1155 | 3992 | 393 | 131 | 419 | 2.40E-39 | Bacillus subtilis | e1182121 | ybclhypothetical protein ybclBacillus subtilis complete genome (section 1 of 21) |
| Contig344D | 3371067_c3_254 | 1156 | 3993 | 954 | 318 | 1033 | 2.10E-104 | Bacillus subtilis | g143608 | spo0KEsporulation proteinBacillus subtilis spo0K operon,inner membrane protein malK |
| Contig344D | 34062930_c2_229 | 1157 | 3994 | 273 | 91 | 290 | 1.10E-25 | Plasmid pI181 | P03864 | Plasmid pI181, complete genome.Pre protein (plasmid recombination) |
| Contig344D | 34073552_c3_266 | 1158 | 3995 | 1545 | 515 | 1235 | 8.30E-126 | Dichelobacter nodosus | P39883 | prfCprfC/RF3Dichelobacter nodosus A198 LpsA (lpsA), putative peptide releasefactor 3 (prfC), and putative amino acid binding protein (aabA)genes, complete cds.peptide release factor 3 (putative) |
| Contig344D | 34163562_f2_89 | 1159 | 3996 | 486 | 162 | 329 | 8.40E-30 | Bacillus subtilis | e209890 | adhBNAD alcohol dehydrogenaseB.subtilis 23.9kb fragment from map position 233 degrees on thechromosome. |
| Contig344D | 34407625_c1_189 | 1160 | 3997 | 354 | 118 | 587 | 3.90E-57 | Staphylococcus lugdunensis | g1658281 | CadXStaphylococcus lugdunensis strain 995 cadmium resistance plasmidpLUG10, complete sequence. |
| Contig344D | 34407888_c1_177 | 1161 | 3998 | 729 | 243 | 288 | 1.60E-37 | Bacillus firmus | g2952027 | mecAMecA homologBacillus firmus MecA homolog (mecA) and cardiolipin synthase (cls)genes, complete cds. |
| Contig344D | 35158177_c2_213 | 1162 | 3999 | 1407 | 469 | 855 | 1.50E-85 | Bacillus subtilis | e1181529 | ykoKYkoKBacillus subtilis 168 56 kb DNA fragment between xlyA and ykoR.homologous to magnesium transporters |
| Contig344D | 35937827_c3_264 | 1163 | 4000 | 510 | 170 | 343 | 2.80E-31 | Bacillus subtilis | e1183205 | yjcGhypothetical protein yjcGBacillus subtilis complete genome (section 7 of 21) |
| Contig344D | 36134717_c2_208 | 1164 | 4001 | 1647 | 549 | 889 | 3.80E-89 | Plasmid pAD1 | g388269 | traCpheromone cAD1 binding protein precursorPlasmid pAD1 (from Enterococcus faecalis strain |

| | | | | | | | | |
|---|---|---|---|---|---|---|---|---|
| Contig344D | 36227142_c2_240 | 1165 | 4002 | 993 | 331 | 409 | 2.80E-38 | Bacillus subtilis | P54421 | papQphosphatase-associated proteinBacillus subtilis phosphatase-associated protein (papQ) gene,complete cds.Muralytic when cloned in E.coli; Iap60 homolog; |
| Contig344D | 36229625_f2_81 | 1166 | 4003 | 204 | 68 | 195 | 1.30E-15 | Bacillus subtilis | e1184971 | ykvShypothetical protein ykvSBacillus subtilis complete genome (section 8 of 21) |
| Contig344D | 36568828_c3_272 | 1167 | 4004 | 1050 | 350 | 984 | 3.30E-99 | Clostridium perfringens | A43577 | regulatory protein pfoR |
| Contig344D | 36593802_c3_278 | 1168 | 4005 | 867 | 289 | 454 | 4.80E-43 | Pasteurella haemolytica | Q08868 | PLPAlipoproteinPasteurella haemolytica lipoprotein gene, complete cds.lipoprotein-28precursor |
| Contig344D | 36611062_c1_170 | 1169 | 4006 | 420 | 140 | 174 | 2.20E-13 | Bacillus subtilis | e1183078 | yisLYisLBacillus subtilis complete genome (section 6 of 21) putative |
| Contig344D | 3944143_c1_188 | 1170 | 4007 | 627 | 209 | 971 | 7.80E-98 | Staphylococcus aureus | g1916729 | cadDCadDStaphylococcus aureus plasmid pRW001, cadmium resistance CadD(cadD) gene, complete cds.contains 5 transmembrane domains; confers low level |
| Contig344D | 3954718_c2_204 | 1171 | 4008 | 3489 | 1163 | 1331 | 5.60E-136 | Bacillus subtilis | P23477 | addAATP-dependent nucleaseBacillus subtilis ATP-dependent nuclease (addA) and (addB), andopen reading frame 3, partial cds.TTG start; see ref [3 |
| Contig344D | 4019193_c2_219 | 1172 | 4009 | 783 | 261 | 749 | 2.60E-74 | Bacillus subtilis | e1183192 | yjbWenoyl- acyl-carrier protein reductase homolog yjbWBacillus subtilis complete genome (section 7 of 21)similar to enoyl- acyl-carrier protein reductase |
| Contig344D | 4064818_c2_239 | 1173 | 4010 | 675 | 225 | 533 | 2.00E-51 | Escherichia coli | P31547 | yaeEhypothetical 23.3 kd proteinEscherichia coli K-12 MG1655 section 19 of 400 of the completegenome.f218; 100 pct identical to YAEE_ECOLI SW |
| Contig344D | 4070151_c3_248 | 1174 | 4011 | 447 | 149 | 165 | 2.00E-12 | Bacillus subtilis | e1173495 | AddAB.subtilis 54kb genomic DNA fragment. |
| Contig344D | 4080443_c2_214 | 1175 | 4012 | 1854 | 618 | 1574 | 9.90E-162 | Bacillus subtilis | e1183184 | yjbQNa+/H+ antiporter homolog yjbQBacillus subtilis complete genome (section 7 of 21)similar to Na+/H+ antiporter |

183

| | | | | | | | | |
|---|---|---|---|---|---|---|---|---|
| Contig344D | 4082828_c1_195 | 1176 | 4013 | 702 | 234 | 207 | 7.10E-17 | Helicobacter pylori | g2313985 | HP0851conserved hypothetical integral membraneHelicobacter pylori section 74 of 134 of the complete genome,similar to EGAD |
| Contig344D | 4088962_c3_265 | 1177 | 4014 | 279 | 93 | | | | |
| Contig344D | 4094433_f3_154 | 1178 | 4015 | 999 | 333 | 1184 | 2.10E-120 | Bacillus subtilis | P21656 | trpStryptophanyl-tRNA synthetaseB.subtilis trpS gene encoding tryptophanyl-tRNA synthetase,complete cds.tryptophan--tRNA ligasetryptophanyl-tRNA synthetase (EC 6.1.1.2) |
| Contig344D | 40957_c2_212 | 1179 | 4016 | 858 | 286 | 513 | 2.70E-49 | Bacillus subtilis | e1183182 | yjbOconserved hypothetical protein yjbOBacillus subtilis complete genome (section 7 of 21)similar to hypothetical proteins |
| Contig344D | 4173410_c3_263 | 1180 | 4017 | 792 | 264 | 485 | 2.50E-46 | Bacillus subtilis | e1183206 | yjcHhypothetical protein yjcHBacillus subtilis complete genome (section 7 of 21) |
| Contig344D | 4322752_f3_121 | 1181 | 4018 | 207 | 69 | 93 | 8.60E-05 | Pyrococcus horikoshii | d1028459 | PHAU021101aa long hypothetical proteinPyrococcus horikoshii OT3 genomic DNA, 1195819-1238496 nt position,clone |
| Contig344D | 4328468_c2_243 | 1182 | 4019 | 1473 | 491 | 1279 | 1.80E-130 | Bacillus subtilis | e1183502 | gltBglutamate synthase (small subunit)Bacillus subtilis complete genome (section 10 of 21) |
| Contig344D | 4344011_f3_104 | 1183 | 4020 | 252 | 84 | | | | |
| Contig344D | 4687518_c3_269 | 1184 | 4021 | 585 | 195 | 179 | 6.60E-14 | Bacillus subtilis | P40396 | comKcompetence transcription factor (CTF)Bacillus subtilis complete genome (section 6 of 21)This sequence comes from Fig. 3. |
| Contig344D | 4703512_c1_193 | 1185 | 4022 | 486 | 162 | 335 | 2.00E-30 | Bacillus subtilis | e1184521 | ywqNunknownBacillus subtilis complete genome (section 19 of 21)similar to hypothetical proteins |
| Contig344D | 4726010_c2_217 | 1186 | 4023 | 2304 | 768 | 1777 | 3.10E-183 | Streptomyces peucetius | g1196907 | drrCdaunorubicin resistance proteinStreptomyces peucetius daunorubicin resistance protein (drrC) gene,complete cds. |
| Contig344D | 4781275_f1_29 | 1187 | 4024 | 249 | 83 | | | | |
| Contig344D | 4812675_c2_216 | 1188 | 4025 | 321 | 107 | 273 | 2.60E-23 | Bacillus subtilis | P54547 | yqjJYqjIBacillus subtilis DNA, 283 Kb region containing skin element,similar to glucose-6-phosphate 1-dehydrogenase |

| | | | | | | | | | |
|---|---|---|---|---|---|---|---|---|---|
| Contig344D | 4882806_c3_270 | 1189 | 4026 | 522 | 174 | 399 | 3.20E-37 | Bacillus subtilis | e1183088 | yistUYistU Bacillus subtilis complete genome (section 6 of 21)similar to hypothetical proteins |
| Contig344D | 5165711_f2_92 | 1190 | 4027 | 447 | 149 | 338 | 9.40E-31 | Bacillus subtilis | e1183176 | yjbhhypothetical protein yjblBacillus subtilis complete genome (section 7 of 21) |
| Contig344D | 5250258_c2_209 | 1191 | 4028 | 1839 | 613 | 1741 | 2.00E-179 | Bacillus licheniformis | d1014255 | Pz-peptidaseBacillus licheniformis DNA for Pz-peptidase, complete cds. |
| Contig344D | 5265643_f1_7 | 1192 | 4029 | 1122 | 374 | | | | | |
| Contig344D | 5343760_f1_12 | 1193 | 4030 | 267 | 89 | | | | | |
| Contig344D | 5860927_f1_14 | 1194 | 4031 | 189 | 63 | | | | | |
| Contig344D | 6057943_c3_268 | 1195 | 4032 | 999 | 333 | 990 | 7.60E-100 | Bacillus subtilis | e1183027 | yrhFhypothetical proteinBacillus subtilis complete genome (section 6 of 21)similar to lipoate-protein ligase |
| Contig344D | 6760887_f3_114 | 1196 | 4033 | 924 | 308 | 333 | 3.20E-30 | Bacillus subtilis | P20668 | gltCtranscriptional regulator (LysR family)Bacillus subtilis complete genome (section 10 of 21) |
| Contig344D | 6921877_c2_215 | 1197 | 4034 | 219 | 73 | 192 | 1.90E-14 | Bacillus subtilis | P54547 | yqjYqjJBacillus subtilis DNA, 283 Kb region containing skin element.similar to glucose-6-phosphate 1-dehydrogenase |
| Contig344D | 7081712_f3_140 | 1198 | 4035 | 234 | 78 | | | | | |
| Contig344D | 7145260_f2_93 | 1199 | 4036 | 243 | 81 | | | | | |
| Contig344D | 7228438_c3_247 | 1200 | 4037 | 3231 | 1077 | 1793 | 6.20E-185 | Bacillus subtilis | P23478 | addBATP-dependent nucleaseBacillus subtilis ATP-dependent nuclease (addA) and (addB), andopen reading frame 3, partial cds.alternate gene name |
| Contig344D | 7308375_c1_173 | 1201 | 4038 | 942 | 314 | 791 | 9.30E-79 | Bacillus subtilis | e1183164 | oppBoligopeptide ABC transporter (permease)Bacillus subtilis complete genome (section 7 of 21)alternate gene name |
| Contig344D | 782816_c2_205 | 1202 | 4039 | 1857 | 619 | 776 | 3.10E-116 | Bacillus subtilis | g1934616 | yrhLhypothetical protein YrhL Bacillus subtilis cysteine synthase (yrhA), cystathioninegamma-lyase (yrhB), YrhC (yrhC), YrhD (yrhD), formate dehydrogenasechain A (yrhE), YrhF (yrhF), formate dehydrogenase (yrhG), YrhH(yrhH), regulatory protein (yrhI), cyto |
| Contig344D | 819056_f1_55 | 1203 | 4040 | 189 | 63 | | | | | |
| Contig344D | 859838_f2_98 | 1204 | 4041 | 384 | 128 | | | | | |

| | | | | | | | | |
|---|---|---|---|---|---|---|---|---|
| Contig344D | 984703_c3_277 | 1205 | 4042 | 1026 | 342 | 763 | 8.60E-76 | Escherichia coli | P30750 | abcATP-binding proteinEscherichia coli K-12 MG1655 section 19 of 400 of the completegenome.malK protein homology1343: 98 pct identical to fragment (231 aa) |
| Contig344D | 985887_c1_175 | 1206 | 4043 | 435 | 145 | 570 | 2.40E-55 | Bacillus subtilis | e1183170 | yjbDconserved hypothetical protein yjbDBacillus subtilis complete genome (section 7 of 21)similar to hypothetical proteins |
| Contig344D | 12697136_c3_28 | 1207 | 4044 | 873 | 291 | 1519 | 6.70E-156 | Staphylococcus epidermidis | g1161381 | icaBIcaBStaphylococcus epidermidis operon mediating intercellular adhesion |
| Contig345D | 15126592_c1_19 | 1208 | 4045 | 1086 | 362 | 1831 | 5.80E-189 | Staphylococcus epidermidis | g1161382 | icaCIcaCStaphylococcus epidermidis operon mediating intercellular adhesion |
| Contig345D | 23445387_f2_5 | 1209 | 4046 | 195 | 65 | | | | | |
| Contig345D | 24406542_c1_18 | 1210 | 4047 | 339 | 113 | 513 | 2.70E-49 | Staphylococcus epidermidis | g2914128 | icaDIcaDStaphylococcus epidermidis operon mediating intercellular adhesion |
| Contig345D | 24421937_f2_6 | 1211 | 4048 | 1269 | 423 | 778 | 2.20E-77 | Bacillus subtilis | e1182844 | ythlantibiotic resistance protein homolog ythIBacillus subtilis complete genome (section 5 of 21)similar to antibiotic resistance protein |
| Contig345D | 25675155_c3_24 | 1212 | 4049 | 1521 | 507 | | | | | |
| Contig345D | 33203385_12_4 | 1213 | 4050 | 597 | 199 | 967 | 2.10E-97 | Staphylococcus epidermidis | g2978430 | icaRIcaRStaphylococcus epidermidis operon mediating intercellular adhesion |
| Contig345D | 35995316_c2_21 | 1214 | 4051 | 1257 | 419 | 2160 | 7.90E-224 | Staphylococcus epidermidis | g1161380 | icaAIcaAStaphylococcus epidermidis operon mediating intercellular adhesion |
| Contig345D | 4004643_c1_11 | 1215 | 4052 | 201 | 67 | | | | | |
| Contig345D | 53413_c3_25 | 1216 | 4053 | 1602 | 534 | 424 | 7.20E-40 | Helicobacter pylori | g2313187 | HP01042'3',5'-cyclic-nucleotide 2'-phosphodiesteraseIclicobacter pylori section 10 of 134 of the complete genome.similar to EGAD |
| Contig345D | 6350031_f1_1 | 1217 | 4054 | 2100 | 700 | 3598 | 0 | Staphylococcus epidermidis | g2981225 | geh1lipase precursorStaphylococcus epidermidis lipase precursor (geh1) gene, completecds. |
| Contig346D | 10317307_f1_38 | 1218 | 4055 | 267 | 89 | | | | | |

| | | | | | | | | |
|---|---|---|---|---|---|---|---|---|
| Contig346D | 10626525_f3_105 | 1219 | 4056 | 1023 | 341 | 810 | 9.00E-81 | Bacillus subtilis | e1183034 | yhfPhypothetical proteinBacillus subtilis complete genome (section 6 of 21)similar to hypothetical proteins |
| Contig346D | 10662763_c1_136 | 1220 | 4057 | 1089 | 363 | 688 | 7.60E-68 | Bacillus subtilis | Q06754 | yacI,unknownB. subtilis DNA, 180 kilobase region of replication origin,similar to hypothetical proteins |
| Contig346D | 10928_c1_131 | 1221 | 4058 | 1242 | 414 | 230 | 1.00E-16 | Rhodobacter capsulatus | g3128293 | hypothetical proteinRhodobacter capsulatus strain SB1003, partial genome. |
| Contig346D | 10976625_c3_190 | 1222 | 4059 | 888 | 296 | 870 | 4.00E-87 | Bacillus subtilis | e1183045 | yfxDhypothetical proteinBacillus subtilis complete genome (section 6 of 21)similar to ribitol dehydrogenase |
| Contig346D | 11114677_f3_87 | 1223 | 4060 | 204 | 68 | | | | | |
| Contig346D | 11740778_f1_21 | 1224 | 4061 | 216 | 72 | | | | | |
| Contig346D | 1207250_c1_122 | 1225 | 4062 | 480 | 160 | | | | | |
| Contig346D | 13695125_c1_140 | 1226 | 4063 | 603 | 201 | 117 | 7.80E-06 | Clostridium acetobutylicum | g3025463 | sigXSigXClostridium acetobutylicum pho-sigX gene region, phoP, phoR, sigX,orf36, and orf18 genes, complete cds,proposed ECF subfamily RNA polymerase sigmafactor |
| Contig346D | 14644018_f3_98 | 1227 | 4064 | 969 | 323 | 324 | 2.90E-29 | Staphylococcus epidermidis | g2196513 | epiHputative membrane proteinStaphylococcus epidermidis plasmid pTue32 putative ABC transportersubunits (epiG), (epiF), and (epiF), putative membrane protein(epiH), EpiT'' (epiT') and EpiT''' (epiT'') genes, complete cds.EpiH |
| Contig346D | 14656952_f1_24 | 1228 | 4065 | 633 | 211 | | | | | |
| Contig346D | 15035952_f1_23 | 1229 | 4066 | 477 | 159 | | | | | |
| Contig346D | 15117317_c3_176 | 1230 | 4067 | 2184 | 728 | 953 | 2.00E-102 | Bacillus subtilis | P13485 | tagFCDP-glycerolBacillus subtilis rodC operon,rodC (tag3) polypeptide (AA 1-746) |
| Contig346D | 15136562_c3_179 | 1231 | 4068 | 1500 | 500 | 1307 | 1.90E-133 | Escherichia coli | P33940 | yojHyojH proteinE.coli genomic DNA, Kohara clone #373(49.5-49.9 min.),ORF_ID |
| Contig346D | 15804076_f2_61 | 1232 | 4069 | 1557 | 519 | 903 | 1.30E-90 | Bacillus subtilis | P94524 | araBL-ribulokinaseBacillus subtilis complete genome (section 15 of 21)homology to araB of Escherichia coli:identified on |
| Contig346D | 15829135_c3_173 | 1233 | 4070 | 204 | 68 | 105 | 8.40E-06 | Bacillus subtilis | e1182361 | ycnIhypothetical protein ycnIBacillus subtilis complete genome (section 3 of 21) |

| | | | | | | | | |
|---|---|---|---|---|---|---|---|---|
| Contig346D | 16681687_c3_192 | 1234 | 4071 | 1029 | 343 | 694 | | | Bacillus subtilis | P37570 | yacIunknownB. subtilis DNA, 180 kilobase region of replication origin.similar to creatine kinase |
| Contig346D | 16836012_c1_130 | 1235 | 4072 | 519 | 173 | | | | |
| Contig346D | 16972575_f2_48 | 1236 | 4073 | 186 | 62 | | | | |
| Contig346D | 174218_c2_153 | 1237 | 4074 | 1989 | 663 | 1225 | 9.50E-125 | Bacillus subtilis | e1182890 | yhcAmultidrug resistance protein homolog yhcABacillus subtilis complete genome (section 5 of 21)similar to multidrug resistance protein |
| Contig346D | 179653_c2_162 | 1238 | 4075 | 666 | 222 | | | | |
| Contig346D | 1970178_f1_19 | 1239 | 4076 | 219 | 73 | | | | |
| Contig346D | 19742962_c3_187 | 1240 | 4077 | 1026 | 342 | 267 | 3.10E-23 | Acinetobacter calcoaceticus | P05149 | MROaldose 1-epimerase,Acinetobacter calcoaceticus gene for mutarotase (EC 5.1.3.3),precursor (aa -20 to 381) |
| Contig346D | 20500938_f3_100 | 1241 | 4078 | 228 | 76 | | | | |
| Contig346D | 20580443_c1_120 | 1242 | 4079 | 333 | 111 | 165 | 2.00E-12 | Bacillus sphaericus | P39044 | Xgene X proteinB.sphaericus gene for ribosomal protein S14 homologue. |
| Contig346D | 20897125_c2_155 | 1243 | 4080 | 975 | 325 | 504 | 2.40E-48 | Bacillus subtilis | e1182790 | yfjQYfjQBacillus subtilis complete genome (section 5 of 21)similar to divalent cation transport protein |
| Contig346D | 20980262_c1_135 | 1244 | 4081 | 2472 | 824 | 2959 | 0 | Bacillus subtilis | P37571 | mecBclpA/clpB familyB. subtilis DNA, 180 kilobase region of replication origin.ATP-dependent Clp proteinase chain Aalternate gene name |
| Contig346D | 22277215_f1_15 | 1245 | 4082 | 1164 | 388 | 109 | 1.20E-05 | Plasmodium falciparum | C44863 | R45 antigen |
| Contig346D | 22455213_f2_68 | 1246 | 4083 | 687 | 229 | 411 | 1.70E-38 | Thermotoga maritima | gi1575577 | drrADNA-binding response regulatorThermotoga maritima DNA-binding response regulator (drrA) andhistidine protein kinase (hpkA) genes, complete cds.thymidne/pyrimidine phosphorylase homolog gene, partial cds.complete cds.DrrA; OmpR/PhoB subfamily response |
| Contig346D | 22689067_f2_54 | 1247 | 4084 | 1221 | 407 | 1218 | 5.30E-124 | Bacillus subtilis | P39141 | nupCpyrimidine nucleoside transport proteinBacillus subtilis genome sequence between the tol and hut operon,partial and complete cds. |

189

| | | | | | | | | | |
|---|---|---|---|---|---|---|---|---|---|
| Contig346D | 22867942_c3_188 | 1248 | 4085 | 711 | 237 | 411 | 1.70E-38 | Pyrococcus horikoshii | d1024727 | PIIAA004229aa long hypothetical ribose 5-phosphatePyrococcus horikoshii OT3 PHAA001-PHAA055 genes, complete cds,similar to PIR |
| Contig346D | 22869687_c2_144 | 1249 | 4086 | 438 | 146 | 143 | 4.30E-10 | Escherichia coli | g1788146 | hypothetical protein b1841Escherichia coli K-12 MG1655 section 168 of 400 of the completegenome.f124; This 124 aa ORF is 39 pct identical (6 gaps) |
| Contig346D | 23556552_c3_174 | 1250 | 4087 | 405 | 135 | 123 | 5.70E-08 | Chloroplast Porphyra purpurea | P51192 | ORF174hypothetical protein 174Porphyra purpurea chloroplast, complete genome. |
| Contig346D | 23601557_f2_58 | 1251 | 4088 | 201 | 67 | | | | | |
| Contig346D | 23601577_f1_17 | 1252 | 4089 | 186 | 62 | | | | | |
| Contig346D | 23704678_f3_95 | 1253 | 4090 | 216 | 72 | | | | | |
| Contig346D | 23839193_c2_147 | 1254 | 4091 | 1614 | 538 | 1324 | 3.10E-135 | Bacillus subtilis | e1182258 | lctPL-lactate permeaseBacillus subtilis complete genome (section 2 of 21)alternate gene name |
| Contig346D | 23923412_f3_94 | 1255 | 4092 | 225 | 75 | | | | | |
| Contig346D | 24267567_f2_65 | 1256 | 4093 | 645 | 215 | | | | | |
| Contig346D | 24407327_c3_195 | 1257 | 4094 | 696 | 232 | 892 | 1.80E-89 | Bacillus subtilis | e1182036 | rplAribosomal protein L1 (BL1)Bacillus subtilis complete genome (section 1 of 21) |
| Contig346D | 24407827_c3_185 | 1258 | 4095 | 561 | 187 | | | | | |
| Contig346D | 24412826_c2_161 | 1259 | 4096 | 963 | 321 | 286 | 3.00E-25 | Klebsiella aerogenes | P19452 | HUTCK.aerogenes histidine utilization repressor C (hutC) gene, completecds.histidine utilization repressor G |
| Contig346D | 24415925_c2_154 | 1260 | 4097 | 903 | 301 | 282 | 8.10E-25 | Acinetobacter lwoffii | g1209223 | estesteraseAcinetobacter lwoffii orf1 and esterase (est) genes, complete cds. |
| Contig346D | 245953_c2_164 | 1261 | 4098 | 579 | 193 | 231 | 2.00E-19 | Listeria monocytogenes | g1314295 | Listeria monocytogenes ClpC ATPase (mec) gene, complete cds.ORF2; putative 19 kDa protein |
| Contig346D | 24662825_c1_127 | 1262 | 4099 | 618 | 206 | 538 | 6.00E-52 | Bacillus subtilis | e1184514 | ywrFhypothetical protein ywrFBacillus subtilis complete genome (section 19 of 21) |
| Contig346D | 2470010_c2_146 | 1263 | 4100 | 723 | 241 | 150 | 3.10E-08 | Dictyostelium discoideum | g2952545 | DB10coronin binding proteinDictyostelium discoideum coronin binding protein (DB10) mRNA,complete cds. |

| | | | | | | | | | |
|---|---|---|---|---|---|---|---|---|---|
| Contig346D | 24803386_c2_150 | 1264 | 4101 | 1080 | 360 | 215 | 2.00E-15 | Mycobacterium tuberculosis | Q50735 | MTCY9C4.05cunknownMycobacterium tuberculosis cosmid SCY09C4.MTCY9C4.05c, unknown, len |
| Contig346D | 25527188_c3_189 | 1265 | 4102 | 1137 | 379 | 829 | 8.80E-83 | Bacillus subtilis | g2293256 | hipOputative hippurate hydrolaseBacillus subtilis rrnB-dnaB genomic region. |
| Contig346D | 25551640_c2_157 | 1266 | 4103 | 861 | 287 | | | | | |
| Contig346D | 25579390_f3_101 | 1267 | 4104 | 1194 | 398 | 402 | 7.10E-37 | Streptomyces coelicolor | e1294490 | SC1C3.12putative transferaseStreptomyces coelicolor cosmid 1C3.SC1C3.12, possible transferase, len |
| Contig346D | 25667753_c1_141 | 1268 | 4105 | 564 | 188 | 906 | 6.10E-91 | Staphylococcus carnosus | P36264 | nusGtranscription antitermination factor nusGS.carnosus secE, nusG and rplK genes.transcription antitermination factor nusG |
| Contig346D | 26206687_c3_194 | 1269 | 4106 | 210 | 70 | 278 | 2.10E-24 | Staphylococcus aureus | g2078376 | secESecEStaphylococcus aureus NCTC 8325 SecE (secE), NusG (nusG) and RplK(rplK) genes, complete cds. |
| Contig346D | 26753588_f3_99 | 1270 | 4107 | 1383 | 461 | 344 | 2.20E-31 | Bacillus subtilis | e1182343 | yclKhomologue of alkaline phosphatase synthesisBacillus subtilis complete genome (section 3 of 21)similar to two-component sensor histidine kinase |
| Contig346D | 26854757_c2_167 | 1271 | 4108 | 660 | 220 | 975 | 3.00E-98 | Staphylococcus xylosus | P77985 | cysEserine O-acetyltransferaseS.xylosus cysE gene, genomic region. |
| Contig346D | 29565627_c1_108 | 1272 | 4109 | 879 | 293 | | | | | |
| Contig346D | 31256916_c1_142 | 1273 | 4110 | 507 | 169 | 681 | 4.20E-67 | Staphylococcus carnosus | P36254 | rplKL11 proteinS.carnosus secE, nusG and rplK genes.Escherichia coli ribosomal protein L11 |
| Contig346D | 3134386_f1_2 | 1274 | 4111 | 228 | 76 | | | | | |
| Contig346D | 34199202_c2_145 | 1275 | 4112 | 540 | 180 | 343 | 2.80E-31 | Bacillus subtilis | e1184294 | paiAtranscriptional regulatorBacillus subtilis complete genome (section 17 of 21) |
| Contig346D | 34610667_c1_114 | 1276 | 4113 | 690 | 230 | 465 | 3.30E-44 | Archaeoglobus fulgidus | g2649576 | AF1018ABC transporter, ATP-binding proteinArchaeoglobus fulgidus section 74 of 172 of the complete genome.similar to GB |

| | | | | | | | | |
|---|---|---|---|---|---|---|---|---|
| Contig346D | 35159528_c3_169 | 1277 | 4114 | 732 | 244 | 942 | 9.30E-95 | Staphylococcus xylosus | P51184 | scrAEIIscrS.xylosus scrA gene and unidentified open reading frames.phosphotransferase system sucrose-specific enzyme II. factor IIORF2 |
| Contig346D | 35162800_c2_166 | 1278 | 4115 | 1506 | 502 | 1701 | 3.50E-175 | Bacillus subtilis | P22250 | gltXglutamyl-tRNA synthetaseB. subtilis DNA, 180 kilobase region of replication origin.glutamate--tRNA ligase |
| Contig346D | 36134715_c2_168 | 1279 | 4116 | 771 | 257 | 666 | 1.60E-65 | Bacillus subtilis | Q06753 | yacOunknownB. subtilis DNA, 180 kilobase region of replication origin.similar to hypothetical proteins |
| Contig346D | 36140963_f1_37 | 1280 | 4117 | 1431 | 477 | 226 | 1.60E-15 | Bacillus subtilis | P13485 | tagFCDP-glycerolBacillus subtilis rodC operon.rodC (tag3) polypeptide (AA 1-746) |
| Contig346D | 4062562_c3_186 | 1281 | 4118 | 183 | 61 | | | | | |
| Contig346D | 4382062_f3_91 | 1282 | 4119 | 189 | 63 | | | | | |
| Contig346D | 4496062_c1_109 | 1283 | 4120 | 345 | 115 | 168 | 9.70E-13 | Bacillus subtilis | e1182361 | ycnIhypothetical protein ycnIBacillus subtilis complete genome (section 3 of 21) |
| Contig346D | 4687893_c2_156 | 1284 | 4121 | 1059 | 353 | 523 | 2.30E-50 | Halobacterium sp. NRC-1 | g2822338 | Halobacterium sp. NRC-1 plasmid pNRC100, complete plasmid sequence.ORF H0660; similar to ORF in Sulfolobus |
| Contig346D | 4727217_f3_93 | 1285 | 4122 | 402 | 134 | | | | | |
| Contig346D | 4881588_c3_181 | 1286 | 4123 | 465 | 155 | 134 | 3.90E-09 | Bacillus subtilis | d1020150 | ydgGtranscriptional regulator (MarR family) homolog ydgGBacillus subtilis genome sequence. 148 kb sequence of the regionbetween 35 and 47 degree.FUNCTION UNKNOWN. |
| Contig346D | 5128587_f2_59 | 1287 | 4124 | 696 | 232 | 336 | 1.50E-30 | Bacillus subtilis | e1182755 | yflKYflKBacillus subtilis complete genome (section 5 of 21)similar to hypothetical proteins |
| Contig346D | 5283390_c3_182 | 1288 | 4125 | 1416 | 472 | 131 | 5.60E-05 | Mycoplasma hominis | g587472 | lmp2M.hominis lmp1 and lmp2 genes. |
| Contig346D | 6149152_c2_165 | 1289 | 4126 | 1389 | 463 | 1543 | 1.90E-158 | Bacillus subtilis | P37572 | smsunknownB. subtilis DNA, 180 kilobase region of replication origin.alternate gene name |
| Contig346D | 6443763_c1_138 | 1290 | 4127 | 408 | 136 | 298 | 1.60E-26 | Bacillus subtilis | e1182028 | yazCconserved hypothetical protein yazCBacillus subtilis complete genome (section 1 of 21)similar to hypothetical proteins |

| | | | | | | | | | |
|---|---|---|---|---|---|---|---|---|---|
| Contig346D | 661062_c3_193 | 1291 | 4128 | 1440 | 480 | 1568 | 4.30E-161 | Bacillus subtilis | Q06752 | cysScysteinyl-tRNA synthetaseB. subtilis DNA, 180 kilobase region of replication origin.alternate gene name |
| Contig346D | 6725707_c1_139 | 1292 | 4129 | 552 | 184 | 327 | 1.40E-29 | Bacillus subtilis | P37574 | yacPunknownB. subtilis DNA, 180 kilobase region of replication origin.similar to hypothetical proteins |
| Contig346D | 6930462_c3_183 | 1293 | 4130 | 1227 | 409 | 634 | 4.00E-62 | Bacillus subtilis | d1020154 | ydgKbicyclomycin resistance protein homolog ydgKBacillus subtilis genome sequence, 148 kb sequence of the regionbetween 35 and 47 degree.SIMILAR TO BICYCLOMYCIN RESISTANCE PROTEIN. |
| Contig346D | 7229680_c3_191 | 1294 | 4131 | 492 | 164 | 377 | 6.90E-35 | Bacillus subtilis | P37568 | ctsRunknownB. subtilis DNA, 180 kilobase region of replication origin.alternate gene name |
| Contig346D | 7242812_f2_62 | 1295 | 4132 | 627 | 209 | 373 | 1.80E-34 | Bacillus subtilis | e1186361 | yxiJDNA-3-methyladenine glycosidase homolog yxiJBacillus subtilis complete genome (section 20 of 21)similar to DNA-3-methyladenine glycosidase |
| Contig346D | 804837_f3_106 | 1296 | 4133 | 963 | 321 | 342 | 3.50E-31 | Lactococcus lactis | e327689 | orfAl.actococcus lactis pfl gene (strain DB1341). |
| Contig346D | 814838_c2_152 | 1297 | 4134 | 660 | 220 | 472 | 5.90E-45 | Bacillus subtilis | e1182889 | yhbJhypothetical protein yhbJBacillus subtilis complete genome (section 5 of 21) |
| Contig346D | 837578_c2_163 | 1298 | 4135 | 1233 | 411 | 708 | 5.80E-70 | Borrelia burgdorferi | g2688567 | BB0637Na+/H+ antiporter (nhaC-1)Borrelia burgdorferi (section 51 of 70) of the complete genome.similar to GB |
| Contig346D | 8568_c1_110 | 1299 | 4136 | 429 | 143 | | | | | |
| Contig346D | 901515_c2_159 | 1300 | 4137 | 285 | 95 | | | | | |
| Contig346D | 990952_f2_63 | 1301 | 4138 | 1209 | 403 | 732 | 1.70E-72 | Helicobacter pylori | g2314680 | HP1506glutamate permease (gltS)Helicobacter pylori section 126 of 134 of the complete genome.sodium--glutamate symport carrier proteinsimilar to EGAD |
| Contig346D | 9924055_c1_137 | 1302 | 4139 | 216 | 72 | | | | | |
| Contig346D | 9944132_f3_92 | 1303 | 4140 | 189 | 63 | | | | | |
| Contig347D | 10657925_c1_52 | 1304 | 4141 | 948 | 316 | 573 | 1.20E-55 | Bacillus subtilis | e1184303 | thrBhomoserine kinaseBacillus subtilis complete genome (section 17 of 21)alternate gene name |

193

| | | | | | | | | | |
|---|---|---|---|---|---|---|---|---|---|
| Contig347D | 10975428_f1_5 | 1305 | 4142 | 879 | 293 | | | | nuc thermonuclease S.intermedius nuc gene for thermonuclease. |
| Contig347D | 1212785_f3_33 | 1306 | 4143 | 213 | 71 | | | | |
| Contig347D | 1382052_c1_53 | 1307 | 4144 | 189 | 63 | | | | |
| Contig347D | 14901512_c1_49 | 1308 | 4145 | 552 | 184 | 500 | 6.40E-48 | Staphylococcus intermedius | P43269 |
| Contig347D | 19953281_c1_51 | 1309 | 4146 | 1347 | 449 | 822 | 4.80E-82 | Bacillus subtilis | P19582 | hom homoserine dehydrogenase Bacillus subtilis homoserine dehydrogenase (hom) gene, complete cds, threonine synthase (thrC) gene, 5' end of cds.homoserine dehydrogenase |
| Contig347D | 20370457_c3_71 | 1310 | 4147 | 183 | 61 | | | | |
| Contig347D | 20485875_c1_45 | 1311 | 4148 | 231 | 77 | | | | |
| Contig347D | 20745462_c2_56 | 1312 | 4149 | 1257 | 419 | 862 | 2.80E-86 | Bacillus subtilis | g1750108 | ynbA YnbA Bacillus subtilis SpoVK (spoVK), YnbA (ynbA), YnbB (ynbB), GlnR(glnR), glutamine synthetase (glnA), YnaA (ynaA), YnaB (ynaB), YnaC(ynaC), YnaD (ynaD), YnaE (ynaE), YnaF (ynaF), YnaG (ynaG), YnaH(ynaH), YnaI (ynaI), YnaJ (ynaJ), xylan beta-1,4-xylo |
| Contig347D | 21751938_f2_22 | 1313 | 4150 | 708 | 236 | 183 | 2.50E-14 | Streptococcus thermophilus bacteriophage TP-J34 | g2897104 | putative host cell surface-exposed lipoprotein Streptococcus thermophilus bacteriophage lysogeny module, integrase homolog (int), putative host cell surface-exposed lipoprotein,putative metallo-proteinase, repressor, Cro-like regulatory protein, and P1-antirr |
| Contig347D | 22539812_c2_57 | 1314 | 4151 | 1254 | 418 | 1290 | 1.20E-131 | Bacillus subtilis | g1750109 | ynbB YnbB Bacillus subtilis SpoVK (spoVK), YnbA (ynbA), YnbB (ynbB), GlnR(glnR), glutamine synthetase (glnA), YnaA (ynaA), YnaB (ynaB), YnaC(ynaC), YnaD (ynaD), YnaE (ynaE), YnaF (ynaF), YnaG (ynaG), YnaH(ynaH), YnaI (ynaI), YnaJ (ynaJ), xylan beta-1,4-xylo |

| | | | | | | | | |
|---|---|---|---|---|---|---|---|---|
| Contig347D | 23557807_f1_12 | 1315 | 4152 | 534 | 178 | 506 | 1.50E-48 | Lactococcus lactis | e1172770 | gpoglutathione peroxidaseLactoococcus lactis carB and gpo genes. |
| Contig347D | 24017127_c2_58 | 1316 | 4153 | 405 | 135 | 537 | 7.70E-52 | Staphylococcus aureus | g468509 | glnRglutamine synthetase repressorS.aureus (bb270) glnA and glnR genes. |
| Contig347D | 24078753_c1_41 | 1317 | 4154 | 450 | 150 | 295 | 3.40E-26 | Bacillus subtilis | e1183392 | miaAtRNA isopentenylpyrophosphate transferaseBacillus subtilis complete genome (section 10 of 21) |
| Contig347D | 24352200_f2_21 | 1318 | 4155 | 1095 | 365 | 674 | 2.30E-66 | Leishmania major | g2266911 | L4171-60Leishmania major strain Freidlin chromosome 1 cosmid clone L4171.contains leucine zipper |
| Contig347D | 24412811_c1_40 | 1319 | 4156 | 957 | 319 | 147 | 3.70E-11 | Oryza sativa | g2801536 | LPL1lysophospholipase homologOryza sativa lysophospholipase homolog (LPL1) mRNA, complete cds. |
| Contig347D | 24414187_c1_43 | 1320 | 4157 | 396 | 132 | | | | | |
| Contig347D | 24495928_c2_60 | 1321 | 4158 | 210 | 70 | | | | | |
| Contig347D | 24631637_c1_42 | 1322 | 4159 | 708 | 236 | 236 | 6.00E-20 | Streptococcus thermophilus | g2444107 | ORF28Streptococcus thermophilus bacteriophage 01205 DNA sequence. |
| Contig347D | 24877312_f3_32 | 1323 | 4160 | 1392 | 464 | 1093 | 9.30E-111 | Bacillus subtilis | e1182346 | yclMhomologue of aspartokinase 2 alpha and betaBacillus subtilis complete genome (section 3 of 21)similar to homoserine dehydrogenase |
| Contig347D | 25449061_c2_64 | 1324 | 4161 | 249 | 83 | 191 | 3.50E-15 | Bacillus subtilis | g2619014 | yocGsensor regulatorBacillus subtilis chromosome region between terC and odhAB,similar to B.subtilis Spo0A protein (267 aa) |
| Contig347D | 25626625_c3_74 | 1325 | 4162 | 636 | 212 | | | | | |
| Contig347D | 26205387_f1_2 | 1326 | 4163 | 336 | 112 | | | | | |
| Contig347D | 26369016_c2_61 | 1327 | 4164 | 387 | 129 | 105 | 4.60E-06 | Bacteriophage B1 | e139437 | b1 (sip)scaffolding proteinBacteriophage TP901-1 genomic region,putative |

| | | | | | | | | | |
|---|---|---|---|---|---|---|---|---|---|
| Contig347D | 29509442_c1_38 | 1328 | 4165 | 720 | 240 | 651 | 6.40E-64 | Bacillus subtilis | P18156 | glpF glycerol uptake facilitator Bacillus subtilis antiterminator regulatory protein (glpP), glycerol uptake facilitator (glpF) genes, complete cds, glycerolkinase (glpK) gene, 5' end.glycerol facilitator protein putative |
| Contig347D | 30355313_c2_63 | 1329 | 4166 | 1113 | 371 | 382 | 2.00E-35 | Bacillus subtilis | g2619013 | yocF sensor kinase Bacillus subtilis chromosome region between terC and odhAB.similar to B.subtilis DegS sensor kinase (385 aa) |
| Contig347D | 34070261_c1_47 | 1330 | 4167 | 900 | 300 | 386 | 7.70E-36 | Bacillus subtilis | e1186097 | yvfR hypothetical protein Bacillus subtilis complete genome (section 18 of 21) similar to ABC transporter (ATP-binding protein) |
| Contig347D | 34195135_c3_77 | 1331 | 4168 | 1104 | 368 | 1236 | 6.50E-126 | Bacillus subtilis | P04990 | thrC threonine synthase B. subtilis thrB and thrC genes for homoserine kinase and threoninesynthase (EC 2.7.1.39 and EC 4.2.99.2, respectively).threonine dehydratase allemate gene name |
| Contig347D | 36134401_c3_78 | 1332 | 4169 | 831 | 277 | 315 | 2.60E-28 | Bacillus subtilis | P54947 | yxeI conserved hypothetical protein yxcH Bacillus subtilis complete genome (section 21 of 21) similar to hypothetical proteins |
| Contig347D | 4080342_c1_39 | 1333 | 4170 | 1515 | 505 | 1998 | 1.20E-206 | Bacillus subtilis | P18157 | glpK glycerol kinase B.subtilis glycerol kinase (glpK) and glycerol-3-phosphate dehydrogenase (glpD) genes, complete cds.xylulokinase glycerol kinase (glpK) (EC 2.7.1.30) |
| Contig347D | 48915577_c3_69 | 1334 | 4171 | 582 | 194 | 453 | 6.10E-43 | Bacillus subtilis | e1183392 | miaA tRNA isopentenylpyrophosphate transferase Bacillus subtilis complete genome (section 10 of 21) |
| Contig347D | 51109625_c1_48 | 1335 | 4172 | 372 | 124 | 258 | 2.80E-22 | Bacillus subtilis | e1186094 | yvfU hypothetical protein Bacillus subtilis complete genome (section 18 of 21) similar to two-component response regulator [YvfT |
| Contig347D | 5355012_c2_59 | 1336 | 4173 | 1359 | 453 | 2274 | 6.60E-236 | Staphylococcus aureus | Q59812 | glnA glutamine synthetase S.aureus (bb270) glnA and glnR genes. |

| | | | | | | | | | |
|---|---|---|---|---|---|---|---|---|---|
| Contig347D | 5859568_f1_1 | 1337 | 4174 | 357 | 119 | 315 | 4.70E-28 | | LYSPLYSINE-SPECIFIC PERMEASE |
| Contig347D | 6525_f2_13 | 1338 | 4175 | 1035 | 345 | 729 | 3.50E-72 | Escherichia coli | lysPlysine-specific permeaseEscherichia coli K-12 MG1655 section 195 of 400 of the completegenome.arginine permeasef489: 100 pct identical to LYSP_ECOLI SW |
| Contig347D | 6641963_c1_46 | 1339 | 4176 | 1485 | 495 | 1302 | 6.60E-133 | Bacillus subtilis | ywnEUnknownBacillus subtilis complete genome (section 19 of 21)similar to cardiolipin synthase |
| Contig347D | 6929677_c2_55 | 1340 | 4177 | 258 | 86 | 187 | 9.40E-15 | Bacillus subtilis | ymaIIhost factor-1 protein homolog ymaIBacillus subtilis complete genome (section 10 of 21)similar to host factor-1 protein |
| Contig347D | 869052_c3_68 | 1341 | 4178 | 1677 | 559 | 1700 | 4.40E-175 | Bacillus subtilis | glpDglycerol-3-phosphate dehydrogenaseB.subtilis glycerol kinase (glpK) and glycerol-3-phosphatedehydrogenase (glpD) genes, complete cds.glycerol-3-phosphate dehydrogenase (glpD) (EC |
| Contig347D | 9851507_f2_20 | 1342 | 4179 | 417 | 139 | | | | |
| Contig347D | 995967_c3_72 | 1343 | 4180 | 747 | 249 | 341 | 4.50E-31 | Bacillus subtilis | yvfiShypothetical proteinBacillus subtilis complete genome (section 18 of 21)probable permease |
| Contig348D | 10578392_f2_26 | 1344 | 4181 | 510 | 170 | 525 | 1.40E-50 | Staphylococcus carnosus | YwpF homologStaphylococcus carnosus (3R)-hydroxymyristoyl acyl carrier proteindehydrase homolog (fabZ) gene, partial cds, YwpF homolog,single-strand binding protein homolog (ssb), SceD precursor (sceD),SceA precursor (sceA) and SceE precursor (sceE) genes |
| Contig348D | 10739063_c1_98 | 1345 | 4182 | 693 | 231 | 601 | 1.30E-58 | Staphylococcus carnosus | sceDSceD precursorStaphylococcus carnosus (3R)-hydroxymyristoyl acyl carrier proteindehydrase homolog (fabZ) gene, partial cds, YwpF homolog,single-strand binding protein homolog (ssb), SceD precursor (sceD),SceA precursor (sceA) and SceE precursor (sceE) |
| Contig348D | 12111018_f3_64 | 1346 | 4183 | 426 | 142 | 174 | 2.20E-13 | Azospirillum brasilense | carRA.brasilense carR gene.ORF2 |

197

| | | | | | | | | | |
|---|---|---|---|---|---|---|---|---|---|
| Contig348D | 12142768_f1_23 | 1347 | 4184 | 300 | 100 | 110 | 3.50E-06 | Pyrococcus horikoshii | d1027343 | PHBW01623 5aa long hypothetical proteinPyrococcus horikoshii OT3 genomic DNA, 180023-216005 nt position,clone |
| Contig348D | 1250_c3_151 | 1348 | 4185 | 714 | 238 | 644 | 3.50E-63 | Staphylococcus carnosus | g2735516 | tenA TenA homologStaphylococcus carnosus (3R)-hydroxymyristoyl acyl carrier proteindehydrase homolog (fabZ) gene, partial cds. YwpF homolog,single-strand binding protein homolog (ssb), SceD precursor (sceD),SceA precursor (sceA) and SceE precursor (sceE) g |
| Contig348D | 1292842_c2_110 | 1349 | 4186 | 672 | 224 | 397 | 5.30E-37 | Bacillus subtilis | e1183028 | yhfKhypothetical proteinBacillus subtilis complete genome (section 6 of 21)similar to hypothetical proteins |
| Contig348D | 1366660_c3_136 | 1350 | 4187 | 1215 | 405 | 566 | 6.50E-55 | Mycobacterium tuberculosis | e1251137 | MTV016.05cputative aminohydrolaseMycobacterium tuberculosis sequence v016.MTV016.05c, len |
| Contig348D | 13790952_c2_114 | 1351 | 4188 | 1194 | 398 | 1350 | 5.40E-138 | Bacillus subtilis | d1013330 | drmYqkNBacillus subtilis DNA, 283 Kb region containing skin element,alternate gene name |
| Contig348D | 1415877_c2_109 | 1352 | 4189 | 912 | 304 | 198 | 6.70E-16 | Methanococcus jannaschii | g1499745 | MJ0912conserved hypothetical proteinMethanococcus jannaschii section 77 of 150 of the complete genome.similar to GP |
| Contig348D | 14225327_f1_15 | 1353 | 4190 | 1029 | 343 | 867 | 8.20E-87 | Bacillus subtilis | g1934656 | yrdOcation transport protein YrdOBacillus subtilis aminoglycoside 6-adenylyltransferase (aadK) gene,partial cds. and YrdA (yrdA), YrdB (yrdB), hypothetical proteinYrdC (yrdC), YrdD (yrdD), hypothetical cytochrome P450 protein YrdE(yrdE), ribonuclease inhi |
| Contig348D | 1438927_c1_85 | 1354 | 4191 | 1686 | 562 | 2118 | 2.20E-219 | Bacillus subtilis | P13242 | ctrACTP synthetaseBacillus subtilis spo0F, CTP synthetase (ctrA), andfructose-bisphosphate aldolase (orfY-tsr) genes, complete cds.CTP synthasealternate gene name |
| Contig348D | 14849093_c3_129 | 1355 | 4192 | 294 | 98 | 127 | 2.10E-08 | Mitochondrion Chondrus crispus | e138028 | putative orf79.1C.crispus complete mitochondrial genome,unique orf |

| | | | | | | | | |
|---|---|---|---|---|---|---|---|---|
| Contig348D | 16251305_c3_146 | 1356 | 4193 | 786 | 262 | 724 | 1.20E-71 | Bacillus stearothermophilus | P42010 | ATPBA TPase subunit aBacillus stearothermophilus genes for ATPase subunits a and c,complete cds. |
| Contig348D | 19739675_c3_141 | 1357 | 4194 | 636 | 212 | 638 | 1.50E-62 | Bacillus subtilis | Q03221 | tdkthymidine kinaseBacillus subtilis OrfR, 3' end; OrfQ; transcriptional terminator(rho) gene; ribosomal protein L31; thymidine kinase (tdk) gene,complete cds.thymidine kinaseIncorrect sequence given in Quirk et al. citation. |
| Contig348D | 20156686_c3_144 | 1358 | 4195 | 573 | 191 | 415 | 6.50E-39 | Bacillus subtilis | P39157 | ipc-33dUnknownB.subtilis spoII-R, glyC and upp genes,alternate gene name |
| Contig348D | 20572255_f1_3 | 1359 | 4196 | 207 | 69 | | | | | |
| Contig348D | 21517182_f3_73 | 1360 | 4197 | 375 | 125 | 233 | 1.30E-19 | Bacillus subtilis | e1185384 | yozAtranscriptional regulator (ArsR family) homolog yozABacillus subtilis complete genome (section 11 of 21)similar to transcriptional regulator (ArsR family) |
| Contig348D | 21756937_c1_100 | 1361 | 4198 | 672 | 224 | 401 | 2.00E-37 | Bacillus subtilis | P39594 | ipa-26dthiamine-phosphate pyrophosphorylaseB.subtilis genomic region (325 to 333),thiE proteinalternate gene name |
| Contig348D | 22460882_c3_135 | 1362 | 4199 | 687 | 229 | 612 | 8.70E-60 | Bacillus subtilis | e1191863 | dradeoxyribose-phosphate aldolaseB.subtilis operon contg. dra, nupC and pdp genes. |
| Contig348D | 23439002_c2_111 | 1363 | 4200 | 1404 | 468 | | | | | |
| Contig348D | 23446887_f3_74 | 1364 | 4201 | 1155 | 385 | | | | | |
| Contig348D | 23594057_c1_87 | 1365 | 4202 | 183 | 61 | | | | | |
| Contig348D | 23595137_c3_134 | 1366 | 4203 | 501 | 167 | 423 | 9.20E-40 | Bacillus subtilis | g2293159 | ytkBstress- and starvation-induced gene controlled by sigma-B dpsBacillus subtilis rrnB-dnaB genomic region.similarity to HI1349 from H. influenzae |
| Contig348D | 23625008_c1_80 | 1367 | 4204 | 963 | 321 | 747 | 4.30E-74 | Bacillus subtilis | e1182566 | ydhSmannose-6-phosphate isomerase homolog ydhSBacillus subtilis complete genome (section 4 of 21)similar to mannose-6-phosphate isomerase |
| Contig348D | 23634678_c2_116 | 1368 | 4205 | 1194 | 398 | | | | | |

| | | | | | | | | | |
|---|---|---|---|---|---|---|---|---|---|
| Contig348D | 23634702_c2_128 | 1369 | 4206 | 792 | 264 | 498 | 1.00E-47 | Bacillus subtilis | P39593 | ipa-25dihydroxyethylthiazole kinaseB.subtilis genomic region (325 to 333).hypothetical protein HI041 5alternate gene name |
| Contig348D | 23651702_c1_78 | 1370 | 4207 | 870 | 290 | 255 | 5.90E-22 | Bacillus subtilis | e1184491 | ywfE conserved hypothetical protein ywfE Bacillus subtilis complete genome (section 19 of 21)similar to hypothetical proteins |
| Contig348D | 2379658_12_51 | 1371 | 4208 | 225 | 75 | | | | | |
| Contig348D | 2383253_c2_103 | 1372 | 4209 | 399 | 133 | | | | | |
| Contig348D | 24015687_c2_124 | 1373 | 4210 | 465 | 155 | 119 | 1.50E-07 | thermophilic bacterium PS3 | P09354 | H+-transporting ATP synthase, chain IThermophilic bacterium PS3 TF0F-1 operon for ATP synthase complex.1 protein (AA 1 - 127) |
| Contig348D | 24074137_c3_139 | 1374 | 4211 | 1332 | 444 | 1360 | 4.70E-139 | Bacillus subtilis | g143434 | rhoRho FactorBacillus subtilis OrfR, 3' end; OrfQ; transcriptional terminator(rho) gene; ribosomal protein L31; thymidine kinase (tdk) gene.complete cds. |
| Contig348D | 24228411_c1_97 | 1375 | 4212 | 399 | 133 | 358 | 7.10E-33 | Staphylococcus carnosus | g2735512 | ssbsingle-strand binding protein homologStaphylococcus carnosus (3R)-hydroxymyristoyl acyl carrier proteindehydrase homolog (fabZ) gene, partial cds, YwpF homolog,single-strand binding protein homolog (ssb), SceD precursor (sceD),SceA precursor (sceA) and |
| Contig348D | 24245327_c1_88 | 1376 | 4213 | 714 | 238 | 843 | 2.90E-84 | Bacillus caldolyticus | e258331 | uppuracil phosphoribosyltransferaseB.caldolyticus upp gene. |
| Contig348D | 24254202_c1_91 | 1377 | 4214 | 1512 | 504 | 2050 | 3.60E-212 | Bacillus megaterium | P17674 | ATPAATP synthase alpha subunitB.megaterium ATP synthase i,a,c,b,delta,alpha,gamma,beta andepsilon subunit genes, complete cds, and ORF.H+-transporting ATP synthase alpha chain |
| Contig348D | 24353427_c3_148 | 1378 | 4215 | 543 | 181 | 229 | 3.30E-19 | Bacillus subtilis | P37811 | atpHATP synthase subunit deltaB.subtilis (168) atpase genes for ATP synthase subunits i, a, c ,b, delta, alpha, gamma, beta, epsilon. |
| Contig348D | 24392193_c1_79 | 1379 | 4216 | 204 | 68 | | | | | |

200

| Contig348D | 24406260_c2_120 | 1380 | 4217 | 1296 | 432 | 1258 | 3.00E-128 | Bacillus subtilis | P19670 | murZUDP-N-acetylglucosamineB.subtilis chromosomal DNA (region 320-321 degrees),alternate gene name |
| --- | --- | --- | --- | --- | --- | --- | --- | --- | --- | --- |
| Contig348D | 24415933_c2_112 | 1381 | 4218 | 435 | 145 | | | | | |
| Contig348D | 24508563_c2_122 | 1382 | 4219 | 1092 | 364 | 1226 | 7.50E-125 | Bacillus subtilis | P45872 | prfApeptide chain release factor 1B.subtilis chromosomal DNA (region 320-321 degrees),translation releasing factorgtg start codon |
| Contig348D | 24641687_c2_123 | 1383 | 4220 | 426 | 142 | 237 | 4.70E-20 | Bacillus subtilis | P39155 | ipc-31dUnknownB.subtilis spoII-R, glyC and upp genes.protein-tyrosine-phosphatase, low molecular weightalternate gene name |
| Contig348D | 24647558_c1_82 | 1384 | 4221 | 357 | 119 | | | | | |
| Contig348D | 24665932_c3_142 | 1385 | 4222 | 840 | 280 | 477 | 1.70E-45 | Bacillus subtilis | P45873 | ywkEprotoporphyrinogen oxidase homolog ywkEB.subtilis chromosomal DNA (region 320-321 degrees),product similar to E.coli PRFA2 protein |
| Contig348D | 25413014_c3_149 | 1386 | 4223 | 351 | 117 | 180 | 5.20E-14 | Bacillus subtilis | e1184584 | ywzBhypothetical protein ywzBBacillus subtilis complete genome (section 19 of 21) |
| Contig348D | 25422081_c3_132 | 1387 | 4224 | 204 | 68 | | | | | |
| Contig348D | 26751542_f1_10 | 1388 | 4225 | 492 | 164 | 577 | 4.40E-56 | Helicobacter pylori | g2313188 | HP0105conserved hypothetical proteinHelicobacter pylori section 10 of 134 of the complete genome.similar to EGAD |
| Contig348D | 26757677_c2_106 | 1389 | 4226 | 1377 | 459 | 2163 | 3.80E-224 | Staphylococcus aureus | e283110 | femDS.aureus femD gene. |
| Contig348D | 29695252_c3_143 | 1390 | 4227 | 1098 | 366 | 665 | 2.10E-65 | Bacillus subtilis | P39153 | ipc-29dSimilar to Saccharomyces cerevisiae SUA5B.subtilis spoII-R, glyC and upp genes.alternate gene name |
| Contig348D | 29879407_c2_108 | 1391 | 4228 | 189 | 63 | | | | | |

201

| | | | | | | | | | | |
|---|---|---|---|---|---|---|---|---|---|---|
| Contig348D | 30682816_c1_90 | 1392 | 4229 | 537 | 179 | 376 | 8.80E-35 | Bacillus megaterium | P20601 | ATPF ATP synthase b subunitB.megaterium ATP synthase i,a,c,b,delta,alpha,gamma,beta andepsilon subunit genes, complete cds, and ORF.H+-transporting ATP synthase chain I |
| Contig348D | 31637_c2_104 | 1393 | 4230 | 891 | 297 | 736 | 6.30E-73 | Bacillus subtilis | d1020268 | ybbPYbbPBacillus subtilis DNA for FeuB, FeuA, YbbB, YbbC, YbbD, YbzA, YbbF, YbbF, YbbH, YbbI, YbbJ, YbbK, YbbL, YbbM, YbbP, complete cds,alternate gene name |
| Contig348D | 33412800_c2_118 | 1394 | 4231 | 882 | 294 | 135 | 1.00E-08 | Bacillus subtilis | d1013033 | bltDBltDBacillus subtilis DNA, 283 Kb region containing skin element.alternate gene name |
| Contig348D | 3361326_c2_101 | 1395 | 4232 | 207 | 69 | | | | | |
| Contig348D | 33673776_c2_121 | 1396 | 4233 | 297 | 99 | 296 | 2.60E-26 | Bacillus subtilis | g2293155 | ytiAYtiABacillus subtilis rrnB-dnaB genomic region.homology with the ribosomal protein L31 |
| Contig348D | 33751260_c1_95 | 1397 | 4234 | 471 | 157 | 448 | 2.10E-42 | Bacillus subtilis | e1184543 | ywpBhydroxymyristoyl-(acyl carrier protein) de homolog ywpBBacillus subtilis complete genome (section 19 of 21)similar to hydroxymyristoyl-(acyl carrier protein) |
| Contig348D | 34187702_c2_105 | 1398 | 4235 | 936 | 312 | 328 | 1.20E-29 | Bacillus subtilis | e1182109 | ybbRhypothetical protein ybbRBacillus subtilis complete genome (section 1 of 21) |
| Contig348D | 34589010_c1_81 | 1399 | 4236 | 246 | 82 | | | | | |
| Contig348D | 34611067_f3_67 | 1400 | 4237 | 540 | 180 | 145 | 2.70E-10 | Bacillus subtilis | P06629 | ywjGhypothetical protein ywjGB.subtilis chromosomal DNA (region 320-321 degrees). |
| Contig348D | 34615700_f2_41 | 1401 | 4238 | 819 | 273 | 155 | 2.30E-08 | Caenorhabditis elegans | g1293846 | C42D8.3Caenorhabditis elegans cosmid C42D8.coded for by C. elegans cDNA yk30b3.5; coded for by |

| | | | | | | | | |
|---|---|---|---|---|---|---|---|---|
| Contig348D | 34646926_f2_44 | 1402 | 4239 | 732 | 244 | 585 | 6.30E-57 | Actinobacillus pleuropneumoniae | g1732037 | deoDpurine nucleoside phosphorylaseActinobacillus pleuropneumoniae heat-shock 10 protein GroES (mopB),heat-shock 60 protein GroEL (mopA), purine nucleoside phosphorylase(deoD) genes, complete cds, alcohol dehydrogenase (adhE) gene,partial cds. |
| Contig348D | 35354656_f1_21 | 1403 | 4240 | 228 | 76 | | | | |
| Contig348D | 35647783_f1_19 | 1404 | 4241 | 690 | 230 | 181 | 4.10E-14 | Pyrococcus horikoshii | d1028033 | PHLB00212 8aa long hypothetical proteinPyrococcus horikoshii OT3 genomic DNA, 827700-833735 nt position(complementary strand), clone |
| Contig348D | 36128785_c1_92 | 1405 | 4242 | 888 | 296 | 796 | 2.70E-79 | Bacillus megaterium | P20602 | ATPGATP synthase gamma subunitB.megaterium ATP synthase i,a,c,b,delta,alpha,gamma,beta andepsilon subunit genes, complete cds, and ORF. H+-transporting ATP synthase gamma chain |
| Contig348D | 36225052_c3_147 | 1406 | 4243 | 234 | 78 | 270 | 1.50E-23 | Bacillus firmus | g142570 | atpEATP synthase c subunitBacillus firmus ATP synthase a and c subunit genes, 3' end andcomplete cds.H+-transporting ATP synthase lipid-binding proteinputative |
| Contig348D | 4063202_c3_145 | 1407 | 4244 | 1239 | 413 | 1563 | 1.50E-160 | Bacillus subtilis | P39148 | glyCserine hydroxymethyltransferaseB.subtilis spoII R, glyC and upp genes,glycine hydroxymethyltransferasealternate gene name |
| Contig348D | 40712_f2_45 | 1408 | 4245 | 216 | 72 | | | | | |
| Contig348D | 4072135_c3_138 | 1409 | 4246 | 1467 | 489 | 870 | 4.00E-87 | Mycobacterium tuberculosis | e304956 | MTCY08D5.18aldehyde dehydrogenaseMycobacterium tuberculosis cosmid SCY08D5.MTCY08D5.18, aldehyde dehydrogenase, len |
| Contig348D | 4178218_c1_83 | 1410 | 4247 | 675 | 225 | | | | | |
| Contig348D | 4728558_c2_107 | 1411 | 4248 | 1860 | 620 | 2088 | 3.40E-216 | Bacillus subtilis | g726480 | gcaAL-glutamine-D-fructose-6-phosphateBacillus subtilis L-glutamine-D-fructose-6-pfhosphateamidotransferase (gcaA) gene, complete cds,alternate gene name |

203

| | | | | | | | | | |
|---|---|---|---|---|---|---|---|---|---|
| Contig348D | 476567_c1_84 | 1412 | 4249 | 567 | 189 | 292 | 7.00E-26 | Bacillus subtilis | P12464 | rpoE RNA polymerase delta subunit B.subtilis RNA polymerase delta subunit (rpoE) gene, complete cds.DNA-directed RNA polymerase delta chain rpoE protein (ttg start codon) |
| Contig348D | 4901712_c1_93 | 1413 | 4250 | 1428 | 476 | 1999 | 9.10E-207 | Bacillus subtilis | P37809 | atpD ATP synthase subunit beta B.subtilis (168) atpase genes for ATP synthase subunits i, a, c ,b, delta, alpha, gamma, beta, epsilon.H+-transporting ATP synthase alpha chain |
| Contig348D | 4962802_c2_113 | 1414 | 4251 | 1305 | 435 | 1545 | 1.20E-158 | Bacillus subtilis | P39142 | pdp pyrimidine nucleoside phosphorylase B.subtilis operon contg. dra, nupC and pdp genes. |
| Contig348D | 5078177_c1_89 | 1415 | 4252 | 1062 | 354 | 1169 | 8.20E-119 | Staphylococcus aureus | g1773355 | cap5P Cap5P Staphylococcus aureus capsule gene cluster Cap5A through Cap5P genes, complete cds.putative N-acetylglucosamine 2-epimerase |
| Contig348D | 5131927_f1_17 | 1416 | 4253 | 210 | 70 | | | | | |
| Contig348D | 5319213_c2_127 | 1417 | 4254 | 417 | 139 | 312 | 5.30E-28 | Bacillus subtilis | P37812 | atpC ATP synthase subunit epsilon B.subtilis (168) atpase genes for ATP synthase subunits i, a, c, b, delta, alpha, gamma, beta, epsilon.H+-transporting ATP synthase epsilon chain |
| Contig348D | 5895301_c1_99 | 1418 | 4255 | 948 | 316 | 603 | 7.80E-59 | Haemophilus influenzae | P44697 | HI0416 hypothetical Haemophilus influenzae from bases 436488 to 446714 (section 40 of163) of the complete genome.similar to GB |
| Contig348D | 6454635_c2_119 | 1419 | 4256 | 912 | 304 | 1173 | 3.10E-119 | Bacillus subtilis | P13243 | orfY-tsr fructose-bisphosphate aldolase Bacillus subtilis spo0F, CTP synthetase (ctrA), and fructose-bisphosphate aldolase (orfY-tsr) genes, complete cds.fructose-bisphosphate aldolase II alternate gene name |
| Contig348D | 6906576_c1_94 | 1420 | 4257 | 1296 | 432 | 1429 | 2.30E-146 | Bacillus subtilis | e276830 | murA UDP-N-acetylglucosamine B.subtilis atpC gene. |
| Contig348D | 992291_f2_46 | 1421 | 4258 | 186 | 62 | | | | | |

204

| | | | | | | | | | |
|---|---|---|---|---|---|---|---|---|---|
| Contig349D | 1281557_c2_26 | 1422 | 4259 | 1131 | 377 | 899 | 3.30E-90 | Bacillus subtilis | P96612 | ddl\|APROBABLE D-ALANINE--D-ALANINE LIGASE ABacillus subtilis genome sequence, 148 kb sequence of the regionbetween 35 and 47 degree. |
| Contig349D | 14855051_c3_42 | 1423 | 4260 | 471 | 157 | 409 | 2.80E-38 | Bacillus subtilis | dl020070 | ydcK\|conserved hypothetical protein ydcKBacillus subtilis genome sequence, 148 kb sequence of the regionbetween 35 and 47 degree.FUNCTION UNKNOWN. |
| Contig349D | 19728433_f3_16 | 1424 | 4261 | 1215 | 405 | 691 | 3.70E-68 | Bacillus subtilis | P39604 | ipa-42d\|cell-division protein homolog ywcFB.subtilis genomic region (325 to 333).alternate gene name |
| Contig349D | 20348453_c2_27 | 1425 | 4262 | 1587 | 529 | 1214 | 1.40E-123 | Bacillus subtilis | dl020048 | ydbR\|ATP-dependent RNA helicase homolog ydbRBacillus subtilis genome sequence, 148 kb sequence of the regionbetween 35 and 47 degree.ATP-DEPENDENT RNA HELICASE DEAD HOMOLOG. |
| Contig349D | 20569052_c1_19 | 1426 | 4263 | 327 | 109 | 198 | 6.40E-16 | Bacillus subtilis | e1186040 | yvgZ\|conserved hypothetical protein yvgZBacillus subtilis subtilis complete genome (section 18 of 21)similar to hypothetical proteins |
| Contig349D | 2230303_f1_8 | 1427 | 4264 | 669 | 223 | 346 | 1.30E-31 | Bacillus subtilis | P54168 | ypgQ\|conserved hypothetical protein ypgQBacillus subtilis (YAC10-9 clone) DNA region between the serA andkdg loci.putative |
| Contig349D | 22692137_c1_24 | 1428 | 4265 | 486 | 162 | 688 | 7.60E-68 | Staphylococcus aureus | e279934 | rsbW\|S.aureus sigB gene. |
| Contig349D | 23443803_c2_32 | 1429 | 4266 | 2187 | 729 | 1827 | 1.50E-188 | Staphylococcus aureus | e279936 | ORF6\|S.aureus sigB gene. |
| Contig349D | 23625387_c3_43 | 1430 | 4267 | 219 | 73 | | | | | |
| Contig349D | 23711642_c3_40 | 1431 | 4268 | 1026 | 342 | 1445 | 4.60E-148 | Staphylococcus aureus | e284997 | rsbU\|S.aureus rsbU, rsbV, rsbW & sigB genes. |
| Contig349D | 24235952_c3_41 | 1432 | 4269 | 327 | 109 | 501 | 5.00E-48 | Staphylococcus aureus | e284998 | rsbV\|S.aureus rsbU, rsbV, rsbW & sigB genes. |
| Contig349D | 24625216_f1_7 | 1433 | 4270 | 186 | 62 | | | | | |
| Contig349D | 24642963_c1_20 | 1434 | 4271 | 216 | 72 | | | | | |
| Contig349D | 26173800_c3_37 | 1435 | 4272 | 186 | 62 | | | | | |

205

| Contig349D | 26212756_f3_17 | 1436 | 4273 | 1488 | 496 | 1477 | 1.90E-151 | Bacillus subtilis | e1184565 | ywnEUnknownBacillus subtilis complete genome (section 19 of 21)similar to cardiolipin synthase |
| --- | --- | --- | --- | --- | --- | --- | --- | --- | --- | --- |
| Contig349D | 26360260_c2_29 | 1437 | 4274 | 375 | 125 | 285 | 3.90E-25 | Bacillus subtilis | d1020052 | ydcBholo- acyl-carrier protein synthase homolog ydcBBacillus subtilis genome sequence, 148 kb sequence of the regionbetween 35 and 47 degree.FUNCTION UNKNOWN, SIMILAR PRODUCT IN E. COLI AND |
| Contig349D | 2775462_c3_38 | 1438 | 4275 | 522 | 174 | 171 | 4.70E-13 | Bacillus subtilis | d1020049 | ydbShypothetical protein ydbSBacillus subtilis genome sequence, 148 kb sequence of the regionbetween 35 and 47 degree.FUNCTION UNKNOWN. |
| Contig349D | 30587843_f3_14 | 1439 | 4276 | 276 | 92 | | | | | |
| Contig349D | 338703l2_c2_31 | 1440 | 4277 | 792 | 264 | 1213 | 1.80E-123 | Staphylococcus aureus | e279935 | sigBsigma factor BS.aureus sigB gene. |
| Contig349D | 34062928_c2_30 | 1441 | 4278 | 1083 | 361 | 659 | 9.10E-65 | BACILLUS STEAROTHERM OPHILUS | P10724 | DALALANINE RACEMASE, |
| Contig349D | 34181277_c1_22 | 1442 | 4279 | 501 | 167 | 153 | 3.80E-11 | Bacillus subtilis | d1020049 | ydbShypothetical protein ydbSBacillus subtilis genome sequence, 148 kb sequence of the regionbetween 35 and 47 degree.FUNCTION UNKNOWN. |
| Contig349D | 34250327_c3_39 | 1443 | 4280 | 363 | 121 | 540 | 3.70E-52 | Staphylococcus aureus | e279931 | ORF1S.aureus sigB gene. |
| Contig349D | 35196926_c1_18 | 1444 | 4281 | 837 | 279 | 417 | 4.00E-39 | Bacillus subtilis | P54544 | yqjGYqjGBacillus subtilis DNA, 283 Kb region containing skin element,similar to lipoprotein SpoIIIJ-like |
| Contig349D | 4869213_c2_28 | 1445 | 4282 | 1521 | 507 | 384 | 1.30E-35 | Bacillus subtilis | d1020050 | ydbThypothetical protein ydbTBacillus subtilis genome sequence, 148 kb sequence of the regionbetween 35 and 47 degree.FUNCTION UNKNOWN. |
| Contig349D | 582760_c1_23 | 1446 | 4283 | 207 | 69 | 108 | 2.20E-06 | Staphylococcus aureus | e284995 | S.aureus rsbU, rsbV, rsbW & sigB genes.ORF56 |

206

| | | | | | | | | | |
|---|---|---|---|---|---|---|---|---|---|
| Contig349D | 72406075_c1_21 | 1447 | 4284 | 1374 | 458 | 976 | 2.30E-98 | Bacillus subtilis | d1020047 | ydbQUDP-N-acetylmuramoylalanyl-D-glutamyl-2,6-Bacillus subtilis genome sequence, 148 kb sequence of the regionbetween 35 and 47 degree.PROBABLE UDP-N-ACETYLMURAMOYLALANYL-D-GLUTAMYL-2, |
| Contig350D | 1046885_f1_7 | 1448 | 4285 | 2217 | 739 | 1356 | 1.30E-138 | Acinetobacter calcoaceticus | c245927 | ppkpolyphosphate kinaseA.calcoaceticus ADP1, cysD, cobQ, sodM, syk, rubA, rubB, estB,ORF1, ppk, migA, ORF2 and ORF3 genes,putative; transcription of ppk is induced by |
| Contig350D | 10585432_c1_371 | 1449 | 4286 | 591 | 197 | 171 | 1.90E-18 | Bacillus subtilis | P54422 | gggamma-glutamyltranspeptidaseBacillus subtilis gamma-glutamyltranspeptidase (ggt) gene, completecds.alternate gene name |
| Contig350D | 10601625_c3_502 | 1450 | 4287 | 231 | 77 | | | | | |
| Contig350D | 1063552_f3_217 | 1451 | 4288 | 390 | 130 | | | | | |
| Contig350D | 1074177_c2_464 | 1452 | 4289 | 825 | 275 | 417 | 4.00E-39 | Escherichia coli | g1787043 | hypothetical protein b0822Escherichia coli K-12 MG1655 section 74 of 400 of the completegenome.f271; This 271 aa ORF is 24 pct identical (16 gaps) |
| Contig350D | 10756925_f1_54 | 1453 | 4290 | 1566 | 522 | 793 | 5.70E-79 | Bacillus subtilis | d1020925 | YfinABacillus subtilis genomic DNA 69-70 degree region, partialsequence. |
| Contig350D | 10954127_f3_230 | 1454 | 4291 | 201 | 67 | | | | | |
| Contig350D | 10973385_c1_343 | 1455 | 4292 | 312 | 104 | | | | | |
| Contig350D | 11063801_f1_105 | 1456 | 4293 | 225 | 75 | | | | | |
| Contig350D | 115761_c3_541 | 1457 | 4294 | 1458 | 486 | 799 | 1.30E-79 | Synechocystis sp. | d1018310 | glgPhypothetical proteinSynechocystis sp. PCC6803 complete genome, 9/27. 1056467-1188885.ORF_ID |
| Contig350D | 117150_f1_38 | 1458 | 4295 | 1311 | 437 | 288 | 1.50E-31 | Caenorhabditis elegans | C55729 | hydroxymethylglutaryl-CoA synthase homolog |

| | | | | | | | | |
|---|---|---|---|---|---|---|---|---|
| Contig350D | 1173130_c1_366 | 1459 | 4296 | 2091 | 697 | 2663 | 4.00E-277 | Staphylococcus carnosus | Q57071 | glcA phosphotransferase system enzyme II., glucose-specific, factor IIAS.carnosus glcA gene and glcB gene.phosphotransferase system N-acetylglucosamine-specific enzyme II |
| Contig350D | 1178593_f3_221 | 1460 | 4297 | 1590 | 530 | 1527 | 9.50E-157 | Bacillus subtilis | e1182639 | yerDYerD proteinBacillus subtilis complete genome (section 4 of 21)similar to glutamate synthase (ferredoxin) |
| Contig350D | 1180292_c1_369 | 1461 | 4298 | 1164 | 388 | 1050 | 3.30E-106 | Bacillus subtilis | e1184496 | ywsCcapsular polyglutamate biosynthesis homolog ywsCBacillus subtilis complete genome (section 19 of 21)similar to capsular polyglutamate biosynthesis |
| Contig350D | 11855463_c1_340 | 1462 | 4299 | 747 | 249 | 791 | 9.30E-79 | Bacillus subtilis | e332183 | cysHputative phospho-adenylylsulphateBacillus subtilis pyrE to yloA gene region. |
| Contig350D | 119633_f1_2 | 1463 | 4300 | 1389 | 463 | 494 | 2.80E-47 | Bacillus subtilis | g1762126 | estBintracellular esterase BBacillus subtilis putative orf1 unknown protein, putativetranscriptional regulator (slr), and intracellular esterase B(estB) genes, complete cds.EstB; esterase of the serine hydrolase family |
| Contig350D | 1230437_c1_364 | 1464 | 4301 | 408 | 136 | 201 | 3.10E-16 | Bacillus subtilis | P39591 | ipa-23rhypothetical proteinB.subtilis genomic region (325 to 333).alternate gene name |
| Contig350D | 1281627_c3_569 | 1465 | 4302 | 1293 | 431 | 1106 | 3.90E-112 | Bacillus subtilis | e1185127 | ylmBacetylornithine deacetylase homolog ylmBBacillus subtilis complete genome (section 9 of 21)similar to acetylornithine deacetylase |
| Contig350D | 1298202_f2_204 | 1466 | 4303 | 1986 | 662 | 1779 | 1.90E-183 | Bacillus subtilis | e1183221 | yjdDfructose phosphotransferase system enzyme homolog yjdDBacillus subtilis complete genome (section 7 of 21)similar to fructose phosphotransferase system |
| Contig350D | 13089086_c1_337 | 1467 | 4304 | 1035 | 345 | 120 | 2.50E-05 | Bacillus firmus | g1813493 | hydrophobic proteinBacillus firmus putative hydrophobic protein gene, partial cds.similar to Bacillus subtilis putative protein |

207

| | | | | | | | | |
|---|---|---|---|---|---|---|---|---|
| Contig350D | 13516871_c1_360 | 1468 | 4305 | 906 | 302 | 739 | 3.00E-73 | Staphylococcus aureus | gi644433 | ddhD-specific D-2-hydroxyacid dehydrogenaseStaphylococcus aureus D-specific D-2-hydroxyacid dehydrogenase(ddh) gene, complete cds.36.7 kDa protein; similar to NAD+-linked D-LDH. |
| Contig350D | 13596351_f3_303 | 1469 | 4306 | 471 | 157 | 297 | 2.10E-26 | Bacillus subtilis | e1181514 | ykIAYklABacillus subtilis 168 56 kb DNA fragment between xlyA and ykoR.homologous to OsmC from Escherichia coli |
| Contig350D | 1366012_f1_96 | 1470 | 4307 | 213 | 71 | | | | | |
| Contig350D | 13769261_c3_490 | 1471 | 4308 | 849 | 283 | 438 | 2.40E-41 | Pseudomonas stutzeri | g3127079 | ptxCPtxCPseudomonas stutzeri Orf117 (orf117), Orf86 (orf86) genes, completecds; and ptxABCDE operon, partial sequence;putative inner membrane component of |
| Contig350D | 13835462_c3_504 | 1472 | 4309 | 1449 | 483 | 1161 | 5.80E-118 | Clostridium perfringens | e242289 | arcDarginine ornithine antiporterC.perfringens strain 13 arcABDC, ahrC and colA genes. |
| Contig350D | 13869827_f3_244 | 1473 | 4310 | 2385 | 795 | 2176 | 1.60E-225 | Bacillus subtilis | e1186038 | yvgXheavy metal-transporting ATPase homolog yvgXBacillus subtilis complete genome (section 18 of 21)similar to heavy metal-transporting ATPase |
| Contig350D | 14460882_c3_531 | 1474 | 4311 | 210 | 70 | 264 | 6.50E-23 | Staphylococcus haemolyticus | g1022726 | unknownStaphylococcus haemolyticus IS1272 ORF1 and ORF2 genes, completecds.ORF1 |
| Contig350D | 14495712_c1_393 | 1475 | 4312 | 297 | 99 | 103 | 1.20E-05 | Synechocystis sp. | d1019027 | hypothetical proteinSynechocystis sp. PCC6803 complete genome, 15/27, 184842-1991549.ORF_ID |
| Contig350D | 14534387_f3_299 | 1476 | 4313 | 225 | 75 | | | | | |
| Contig350D | 14626432_c2_398 | 1477 | 4314 | 2421 | 807 | 1387 | 6.50E-142 | Staphylococcus aureus | O06446 | secASecAStaphylococcus aureus NCTC 8325 SecA (secA) gene, complete cds. |
| Contig350D | 14644037_c3_512 | 1478 | 4315 | 1575 | 525 | 401 | 2.40E-40 | Escherichia coli | g1787094 | hypothetical protein b0869Escherichia coli K-12 MG1655 section 78 of 400 of the completegenome.f486; This 486 aa ORF is 21 pct identical (13 gaps) |

208

| | | | | | | | | |
|---|---|---|---|---|---|---|---|---|
| Contig350D | 14650312_c3_505 | 1479 | 4316 | 1170 | 390 | 281 | 1.00E-24 | Bacillus subtilis | e1184494 | ywtBcapsular polyglutamate biosynthesis homolog ywtBBacillus subtilis complete genome (section 19 of 21)similar to capsular polyglutamate biosynthesis |
| Contig350D | 14720378_c3_499 | 1480 | 4317 | 726 | 242 | 292 | 7.00E-26 | Aquifex aeolicus | g2983456 | aq_928putative proteinAquifex aeolicus section 46 of 109 of the complete genome. |
| Contig350D | 14729702_c2_402 | 1481 | 4318 | 2031 | 677 | 266 | 2.20E-19 | Mus musculus | e1288122 | DSPPdentin sialophosphoproteinMus musculus DSPP gene. |
| Contig350D | 14742887_c2_418 | 1482 | 4319 | 606 | 202 | | | | | |
| Contig350D | 14742937_c1_336 | 1483 | 4320 | 1203 | 401 | | | | | |
| Contig350D | 14879667_c2_440 | 1484 | 4321 | 867 | 289 | 735 | 8.00E-73 | Bacillus subtilis | P52998 | panCpantothenate synthetaseBacillus subtilis (clone YAC15-6B) ypiABF genes, qcrABC genes,ypjABCDEFGHI genes, birA gene, panBCD genes, dinG gene, ypmB gene,aspB gene, asnS gene, dnaD gene, nth gene and ypoC gene, completecds.40.8% of identity to the Esch |
| Contig350D | 14880051_f1_20 | 1485 | 4322 | 1971 | 657 | 2450 | 1.50E-254 | Bacillus subtilis | d1011939 | yydEfructose-1,6-bisphosphataseBacillus subtilis 36kb sequence between gntZ and trnY genesencoding 34 ORFs.alternate gene name |
| Contig350D | 14881250_f3_234 | 1486 | 4323 | 999 | 333 | 1407 | 4.90E-144 | Staphylococcus aureus | g1644433 | ddhD-specific D-2-hydroxyacid dehydrogenaseStaphylococcus aureus D-specific D-2-hydroxyacid dehydrogenase(ddh) gene, complete cds.36.7 kDa protein; similar to NAD+-linked D-LDH. |
| Contig350D | 14881908_c1_353 | 1487 | 4324 | 213 | 71 | | | | | |
| Contig350D | 14931501_c2_444 | 1488 | 4325 | 1062 | 354 | 608 | 2.30E-59 | Treponema pallidum | g1354775 | pfoS/RpfoS/RTreponema pallidum methyl-accepting chemotaxis protein (mcp-1)gene, complete cds, and potential regulatory molecule (pfoS/R)gene, partial cds.potential regulatory molecule; pfoS/R-like |

209

210

| | | | | | | | | | |
|---|---|---|---|---|---|---|---|---|---|
| Contig350D | 14961631_f1_32 | 1489 | | | | | | | |
| Contig350D | 14979713_c1_391 | 1490 | 4327 | 483 | 161 | 251 | 1.60E-21 | Listeria monocytogenes | P33385 | ORF7Listeria monocytogenes lecithinase, lactate dehydrogenase (actA)gene complete cds, (plcB) gene complete cds, (ldh) gene completecds.ORFZ |
| Contig350D | 158411_c3_534 | 1491 | 4328 | 993 | 331 | 880 | 3.40E-88 | Bacillus subtilis | A25805 | L-lactate dehydrogenase.L-lactate dehydrogenase |
| Contig350D | 15914762_f1_63 | 1492 | 4329 | 579 | 193 | 534 | 1.60E-51 | Bacillus subtilis | gi524394 | yuaCConserved hypothetical protein yuaCBacillus subtilis gbsAB operon, glycine betaine aldehydedehydrogenase GbsA, alcohol dehydrogenase GbsB genes, complete cds.ORF-2 upstream of gbsAB operon |
| Contig350D | 16798125_c2_473 | 1493 | 4330 | 441 | 147 | 154 | 2.20E-10 | Bacillus subtilis | P42237 | ycbEglucarate dehydrataseBacillus subtilis DNA around 20 degrees region of chromosomecontaining yckA-T genes,similar to glucarate transporter |
| Contig350D | 16838207_f1_22 | 1494 | 4331 | 288 | 96 | 175 | 1.80E-13 | Escherichia coli | P39274 | yjdJhypothetical 10.5 kD protein in deub-lysuEscherichia coli K-12 MG1655 section 375 of 400 of the completegenome.o90a; 100 pct identical amino acid sequence and |
| Contig350D | 170010952_c3_550 | 1495 | 4332 | 864 | 288 | 639 | 1.20E-62 | Bacillus subtilis | e1186383 | yxkDconserved hypothetical protein yxkDBacillus subtilis complete genome (section 20 of 21)similar to hypothetical proteins |
| Contig350D | 179010_c3_547 | 1496 | 4333 | 546 | 182 | 344 | 2.20E-31 | Haemophilus influenzae | P44687 | HI0402methylated-DNA--protein-cysteineHaemophilus influenzae from bases 413366 to 426435 (section 38 of163) of the complete genome.methylated-DNA--protein-cysteine S-methyltransferase homologysimilar to SP |
| Contig350D | 19531436_c3_516 | 1497 | 4334 | 357 | 119 | 96 | 7.30E-05 | Methanococcus jannaschii | Q57859 | MJ0416M. jannaschii predicted coding region MJ0416Methanococcus jannaschii section 35 of 150 of the complete genome.hypothetical protein; identified by GeneMark; |
| Contig350D | 19562805_c3_546 | 1498 | 4335 | 213 | 71 | | | | | |

| Contig | ID | | | | | | | E-value | Organism | Accession | Description |
|---|---|---|---|---|---|---|---|---|---|---|---|
| Contig350D | 19564702_c1_339 | 1499 | 4336 | 477 | 159 | 397 | | 5.30E-37 | Nicotiana sylvestris | P30708 | glutathione peroxidase homologN.sylvestris mRNA for 6P229 polypeptide homologous to animalglutathione peroxidases,glutathione peroxidasehomologous to animal glutathione peroxidases |
| Contig350D | 19585877_c1_349 | 1500 | 4337 | 1212 | 404 | 834 | | 2.60E-83 | Bacillus subtilis | e1183009 | yhaAaminoacylase homolog yhaABacillus subtilis complete genome (section 6 of 21)similar to aminoacylase |
| Contig350D | 19720642_c2_407 | 1501 | 4338 | 1296 | 432 | 253 | | 3.40E-21 | Bacillus subtilis | g2529465 | yokPYokPBacillus subtilis 168 region at 182 min containing the cge genecluster.similar to the succinyl-diaminopimelate |
| Contig350D | 197312_c2_447 | 1502 | 4339 | 873 | 291 | 813 | | 4.30E-81 | Bacillus subtilis | e1182946 | yhdFhypothetical proteinBacillus subtilis complete genome (section 6 of 21)similar to glucose 1-dehydrogenase |
| Contig350D | 19929586_c3_560 | 1503 | 4340 | 198 | 66 | | | | | | |
| Contig350D | 20317_c2_413 | 1504 | 4341 | 2088 | 696 | 431 | | 7.00E-38 | Bacillus subtilis | P13485 | tagFCDP-glycerolBacillus subtilis rodC operon.rodC (tag3) polypeptide (AA 1-746) |
| Contig350D | 20335260_c1_344 | 1505 | 4342 | 1881 | 627 | 1711 | | 3.00E-176 | Escherichia coli | g1790686 | nrdDanaerobic ribonucleoside-triphosphate reductaseEscherichia coli K-12 MG1655 section 385 of 400 of the completegenome.oxygen-sensitive ribonucleoside-triphosphate reductasef712; 99 pct identical amino acid sequence and |
| Contig350D | 20360885_f3_226 | 1506 | 4343 | 1683 | 561 | 906 | | 6.10E-91 | Bacillus subtilis | e1182920 | yhxBhypothetical proteinBacillus subtilis complete genome (section 5 of 21)similar to phosphomannomutase |
| Contig350D | 20433135_c3_549 | 1507 | 4344 | 801 | 267 | 151 | | 1.10E-10 | Enterococcus faecalis | d1011987 | orf8ORF8Enterococcus faecalis plasmid pYI17 genes for BacA, BacB, ORf3,ORF4, ORF5, ORF6, ORF7, ORF8, ORF9, ORF10, ORF11,partial cds. |

212

| | | | | | | | | |
|---|---|---|---|---|---|---|---|---|
| Contig350D | 20507625_c3_487 | 1508 | 4345 | 1011 | 337 | 244 | 8.60E-21 | Pseudomonas stutzeri | g3127078 | ptxBPtxBPseudomonas stutzeri Orf117 (orf117), Orf86 (orf86) genes, completecds; and ptxABCDE operon, partial sequence,putative binding protein component of |
| Contig350D | 20509637_c3_538 | 1509 | 4346 | 1335 | 445 | 218 | 6.70E-15 | Bacillus subtilis | e1186076 | yvbIhypothetical protein yvbJBacillus subtilis complete genome (section 18 of 21) |
| Contig350D | 20509637_c3_564 | 1510 | 4347 | 1545 | 515 | 1655 | 2.60E-170 | Bacillus licheniformis | P46834 | gntKgluconate kinaseBacillus licheniformis DNA for hypothetical protein and Gntproteins.xylulokinase |
| Contig350D | 20589568_c1_317 | 1511 | 4348 | 1557 | 519 | 282 | 9.50E-22 | Bacillus subtilis | P13484 | tagEUDP-glucoseBacillus subtilis rodC operon.rodD (gtaA) polypeptide (AA 1-673) |
| Contig350D | 2068937_f3_282 | 1512 | 4349 | 1539 | 513 | 1041 | 3.00E-105 | Bacillus subtilis | e1182553 | phoBalkaline phosphatase IIIBacillus subtilis complete genome (section 4 of 21)alternate gene name |
| Contig350D | 20822287_c1_386 | 1513 | 4350 | 684 | 228 | 563 | 1.30E-54 | Bacillus subtilis | P10585 | gntRgluconate operon repressorBacillus subtilis genomic DNA, 36 kb region between gnt and ioloperons.PROSITE; PS00043;HTH_GNTR_FAMILY; see SWISS_PROT |
| Contig350D | 210885_f2_169 | 1514 | 4351 | 222 | 74 | | | | | |
| Contig350D | 2113952_f2_214 | 1515 | 4352 | 2835 | 945 | 183 | 1.50E-11 | Vigna unguiculata | S54157 | extensin-like protein |
| Contig350D | 2136712_c3_574 | 1516 | 4353 | 1197 | 399 | 469 | 1.20E-44 | Bacillus subtilis | e1182559 | ydhLchloramphenicol resistance protein homolog ydhLBacillus subtilis complete genome (section 4 of 21)similar to chloramphenicol resistance protein |
| Contig350D | 21515707_f3_242 | 1517 | 4354 | 198 | 66 | | | | | |
| Contig350D | 21517012_c2_412 | 1518 | 4355 | 411 | 137 | 289 | 1.50E-25 | Bacillus subtilis | g2318065 | yeeEYeeEBacillus subtilis strain 168 trpC2 YefA (yefA) gene, partial cds,and YefB (yefB), YefC (yefC) YeeA (yeeA), YeeB (yeeB), YeeC(yeeC), YeeD (yeeD), YeeE (yeeE) and YeeF (yeeF) genes, completecds. |

213

| | | | | | | | | | |
|---|---|---|---|---|---|---|---|---|---|
| Contig350D | 21604040_c1_361 | 1519 | 4356 | 2028 | 676 | 1295 | 3.60E-132 | Methanococcus jannaschii | Q57986 | MJ0566ferrous iron transport protein B (feoB)Methanococcus jannaschii section 47 of 150 of the complete genome.similar to SP |
| Contig350D | 21664126_c2_409 | 1520 | 4357 | 1083 | 361 | 1134 | 4.20E-115 | Lactobacillus sake | e1227705 | arcBornithine transcarbamoylaseLactobacillus sake DNA encoding the arginine-deiminase pathwaygenes. |
| Contig350D | 21687963_c1_328 | 1521 | 4358 | 477 | 159 | 184 | 2.00E-14 | Bacillus subtilis | P17893 | ahrCAhrCB.subtilis ahrC gene, encoding an arginine repressor/activatorprotein.ahrC protein |
| Contig350D | 21759718_f1_41 | 1522 | 4359 | 297 | 99 | | | | | |
| Contig350D | 21774087_c3_539 | 1523 | 4360 | 732 | 244 | 336 | 1.50E-30 | Haemophilus influenzae | P44068 | HI0882H. influenzae predicted coding region HI0882Haemophilus influenzae from bases 932179 to 942337 (section 85 of163) of the complete genome:identified by GeneMark; putative |
| Contig350D | 22380343_f2_206 | 1524 | 4361 | 1983 | 661 | 363 | 1.90E-30 | Enterococcus faecalis | P37710 | bacterial cell wall hydrolaseStreptococcus faecalis bacterial cell wall hydrolase gene, completecds. |
| Contig350D | 2242136_c3_506 | 1525 | 4362 | 684 | 228 | 583 | 1.00E-56 | Clostridium perfringens | e303881 | putative transposassC.perfringens uapC, cpe, and nadC genes. |
| Contig350D | 22460302_c1_357 | 1526 | 4363 | 756 | 252 | 334 | 2.50E-30 | Staphylococcus carnosus | g2735514 | sceASceA precursorStaphylococcus carnosus (3R)-hydroxymyristoyl acyl carrier proteindehydrase homolog (fabZ) gene, partial cds, YwpF homolog,single-strand binding protein homolog (ssb), SceD precursor (sceD),SceA precursor (sceA) and SceF precursor (sceE) |
| Contig350D | 23443751_f2_120 | 1527 | 4364 | 228 | 76 | | | | | |
| Contig350D | 23468942_f1_5 | 1528 | 4365 | 1101 | 367 | 928 | 2.80E-93 | Bacillus subtilis | e184131 | ysdChypothetical proteinBacillus subtilis complete genome (section 15 of 21)similar to endo-1,4-beta-glucanase |
| Contig350D | 23476503_f3_297 | 1529 | 4366 | 189 | 63 | | | | | |

| | | | | | | | | |
|---|---|---|---|---|---|---|---|---|
| Contig350D | 23476702_c1_354 | 1530 | 4367 | 882 | 294 | 595 | 5.50E-58 | Bacillus subtilis | P39592 | ipa-24dhypothetical proteinB.subtilis genomic region (325 to 333),alternate gene name |
| Contig350D | 23479702_c3_509 | 1531 | 4368 | 273 | 91 | | | | |
| Contig350D | 23480467_c1_375 | 1532 | 4369 | 912 | 304 | 862 | 2.80E-86 | Bacillus subtilis | e1185177 | ylpAputative YhaP proteinBacillus subtilis complete genome (section 9 of 21)similar to L-serine dehydratase |
| Contig350D | 23556338_c1_384 | 1533 | 4370 | 303 | 101 | 170 | 6.00E-13 | Bacillus subtilis | e1182354 | ycnI:conserved hypothetical protein ycnEBacillus subtilis complete genome (section 3 of 21)similar to hypothetical proteins |
| Contig350D | 23593800_c1_352 | 1534 | 4371 | 942 | 314 | 141 | 7.00E-08 | Bacillus subtilis | d1020110 | ydeJhypothetical protein ydeJBacillus subtilis genome sequence, 148 kb sequence of the regionbetween 35 and 47 degree.FUNCTION UNKNOWN. |
| Contig350D | 23600752_f1_50 | 1535 | 4372 | 240 | 80 | | | | |
| Contig350D | 23602015_c2_485 | 1536 | 4373 | 687 | 229 | 374 | 1.40E-34 | Escherichia coli | P77279 | YBBI.hypothetical protein b0490Escherichia coli K-12 MG1655 section 45 of 400 of the completegenome.malK protein homologyo225; This 225 aa ORF is 32 pct identical (7 gaps) |
| Contig350D | 23604052_f1_47 | 1537 | 4374 | 318 | 106 | | | | |
| Contig350D | 23631311_c2_454 | 1538 | 4375 | 297 | 99 | | | | |
| Contig350D | 23636343_c1_314 | 1539 | 4376 | 813 | 271 | 409 | 2.80E-38 | Escherichia coli | P16683 | PIINEphnE: proteinE.coli psiD locus containing alkylphosphonate uptake (phn) genes Athrough Q, complete cds.phnE proteinphnE protein |
| Contig350D | 23642942_c3_525 | 1540 | 4377 | 231 | 77 | | | | |
| Contig350D | 23649187_c3_507 | 1541 | 4378 | 2637 | 879 | 209 | 1.30E-12 | Plasmodium chabaudi | g1151158 | repeat organellar proteinPlasmodium chabaudi repeat organellar protein gene, complete cds.ROPE |
| Contig350D | 23672518_f3_232 | 1542 | 4379 | 1011 | 337 | 529 | 5.40E-51 | Bacillus subtilis | e1185017 | moeBmolybdopterin biosynthesis proteinBacillus subtilis complete genome (section 8 of 21) |
| Contig350D | 23680300_f1_87 | 1543 | 4380 | 948 | 316 | | | | |
| Contig350D | 23694162_f2_175 | 1544 | 4381 | 219 | 73 | | | | |
| Contig350D | 23868887_c2_458 | 1545 | 4382 | 189 | 63 | | | | |

215

| | | | | | | | | |
|---|---|---|---|---|---|---|---|---|
| Contig350D | 24015687_c1_347 | 1546 | 4383 | 1521 | 507 | 1701 | 3.50E-175 | Bacillus subtilis | P71016 | gbsAGbsABacillus subtilis gbsAB operon, glycine betaine aldehyde dehydrogenase GbsA, alcohol dehydrogenase GbsB genes, complete cds.glycine betaine aldehyde dehydrogenase |
| Contig350D | 24022177_c1_387 | 1547 | 4384 | 1389 | 463 | 1499 | 8.80E-154 | Bacillus subtilis | P12012 | gntPgluconate permeaseBacillus subtilis genomic DNA, 36 kb region between gnt and ioloperons.homologs are found in E. coli and H. influenzae; |
| Contig350D | 24087760_c3_519 | 1548 | 4385 | 903 | 301 | 665 | 2.10E-65 | Bacillus subtilis | g2293257 | ytnMYtnMBacillus subtilis rrnB-dnaB genomic region.similar to a hypothetical protein |
| Contig350D | 24101701_c1_351 | 1549 | 4386 | 1542 | 514 | 1186 | 1.30E-120 | Corynebacterium glutamicum | e1286985 | mqoL-malate dehydrogenase (acceptor)Corynebacterium glutamicum DNA for L-Malate |
| Contig350D | 24220260_c3_537 | 1550 | 4387 | 1056 | 352 | | | | | |
| Contig350D | 24220290_f2_132 | 1551 | 4388 | 1482 | 494 | 935 | 5.10E-94 | Escherichia coli | d1015750 | aldAAldehyde dehydrogenase (NAD+) (EC 1.2.1.3)E.coli genomic DNA, Kohara clone #269(31.8-32.1 min.).ORF_ID |
| Contig350D | 24226577_c3_563 | 1552 | 4389 | 834 | 278 | 153 | 7.90E-11 | Bacillus sp. | P22853 | merRunknown proteinBacillus sp. mercury resistance (merA) gene, complete cds.ORF1; putative |
| Contig350D | 24261062_c2_421 | 1553 | 4390 | 1773 | 591 | 1994 | 3.10E-206 | Bacillus subtilis | e1186031 | yvgQsulfite reductase homolog yvgQBacillus subtilis complete genome (section 18 of 21)similar to sulfite reductase |
| Contig350D | 24273375_c3_523 | 1554 | 4391 | 600 | 200 | 282 | 2.40E-24 | Escherichia coli | g1788102 | hypothetical protein b1801Escherichia coli K-12 MG1655 section 164 of 400 of the completegenome.o481; UUG start; 29 pct identical (3 gaps) to 447 |
| Contig350D | 24304712_f1_80 | 1555 | 4392 | 1674 | 558 | 1008 | 9.40E-102 | Enterobacter cloacae | P23234 | IPDCindolepyruvate decarboxylase.E. cloacae gene for indolepyruvate decarboxylase.thiamine pyrophosphate-binding domain homologyindolepyruvate decarboxylase |
| Contig350D | 24337791_c3_515 | 1556 | 4393 | 1113 | 371 | | | | | |

216

| | | | | | | | | | |
|---|---|---|---|---|---|---|---|---|---|
| Contig350D | 24337807_c1_341 | 1557 | 4394 | 1890 | 630 | 1795 | 3.80E-185 | Bacillus subtilis | e1186032 | yvgRsulfite reductase homolog yvgRBacillus subtilis complete genome (section 18 of 21)similar to sulfite reductase |
| Contig350D | 24338217_c3_521 | 1558 | 4395 | 597 | 199 | 259 | 2.20E-22 | Haemophilus influenzae | P45080 | HI1155anaerobic ribonucleoside-triphosphate reductaseHaemophilus influenzae from bases 1218795 to 1228832 (section 110of 163) of the complete genome.similar to SP |
| Contig350D | 24351562_f3_298 | 1559 | 4396 | 255 | 85 | | | | | |
| Contig350D | 24353390_c2_479 | 1560 | 4397 | 696 | 232 | 421 | 1.50E-39 | Synechocystis sp. | d1011336 | hypothetical proteinSynechocystis sp. PCC6803 complete genome, 24/27, 3002966-3138603.ribitol dehydrogenaseORF_ID |
| Contig350D | 24406952_c1_330 | 1561 | 4398 | 447 | 149 | 188 | 7.40E-15 | Rhodobacter capsulatus | P31078 | petPprotein of unknown functionR.capsulatus petP, petR, and tbcF genes,part of the petPR operon in front of fbc operon |
| Contig350D | 24407875_c3_524 | 1562 | 4399 | 753 | 251 | 350 | 5.00E-32 | Escherichia coli | d1016320 | Probable carnitine transporter.E.coli genomic DNA, Kohara clone #332(40.4-40.7 min.),ORF_ID |
| Contig350D | 24415887_c2_431 | 1563 | 4400 | 927 | 309 | | | | | |
| Contig350D | 24429663_c1_332 | 1564 | 4401 | 933 | 311 | 326 | 1.80E-29 | Bacillus subtilis | P42422 | B65Fhypothetical proteinBacillus subtilis 15 kb chromosome segment contains the tol operon.homologous to sensor protein BvgC. His protein |
| Contig350D | 24432327_c2_437 | 1565 | 4402 | 1665 | 555 | 1633 | 5.50E-168 | Lactococcus lactis | g473902 | alsalpha-acetolactate synthaseLactococcus lactis alpha-acetolactate synthase (als) gene, completetecds. |
| Contig350D | 24500300_c2_423 | 1566 | 4403 | 1206 | 402 | 1208 | 6.00E-123 | Bacillus subtilis | e332185 | yinBputative sulfate adenylyltransferascBacillus subtilis pyrE to yloA gene region.similar to sulfate adenylyltransferase |
| Contig350D | 245443_c1_374 | 1567 | 4404 | 696 | 232 | 375 | 1.10E-34 | Bacillus subtilis | e1185176 | yloWputative YhaQ proteinBacillus subtilis complete genome (section 9 of 21)similar to phosphoglycerate dehydrogenase |
| Contig350D | 24611567_c2_459 | 1568 | 4405 | 1074 | 358 | 478 | 1.40E-45 | Bacillus anthracis | d1003632 | depORFBacillus anthracis plasmid pTE702 dep gene for ORF, complete cds. |

217

| | | | | | | | | |
|---|---|---|---|---|---|---|---|---|
| Contig350D | 24617262_c1_355 | 1569 | 4406 | 825 | 275 | 690 | 4.70E-68 | Bacillus subtilis | P52996 | panBketopantoate hydroxymethyltransferaseBacillus subtilis (clone YAC15-6B) ypiABF genes, qcrABC genes,ypj(ABCDEFGHI genes, birA gene, panBCD genes, dinG gene, ypmB gene,aspB gene, asnS gene, dnaD gene, nth gene and ypoC gene, completeds.s.47.1% of identi |
| Contig350D | 24641932_c2_417 | 1570 | 4407 | 672 | 224 | 476 | 2.20E-45 | Bacillus subtilis | e1186160 | yvcPhypothetical proteinBacillus subtilis complete genome (section 18 of 21)similar to two-component response regulator [YvcQ] |
| Contig350D | 24643930_c3_548 | 1571 | 4408 | 696 | 232 | 399 | 3.20E-37 | Escherichia coli | P33373 | yohKyohK protein1:scherichia coli K-12 MG1655 section 193 of 400 of the completegenome.yohK protcino231; residues 10295 are 100 pct identical to aa |
| Contig350D | 24646963_c1_338 | 1572 | 4409 | 1350 | 450 | 1703 | 2.10E-175 | Staphylococcus sciuri | e315090 | ORF454S.sciuri mecA1 gene, strain K3(MM2). |
| Contig350D | 24648502_c3_526 | 1573 | 4410 | 468 | 156 | 228 | 4.30E-19 | Bacillus subtilis | P38049 | yhgCHypothetical proteinBacillus subtilis penicillin-binding protein (pbpF) gene, 5' end,product unknown |
| Contig350D | 24665957_c3_551 | 1574 | 4411 | 1494 | 498 | 1335 | 2.10E-136 | Bacillus subtilis | P39211 | xylBxylulose kinaseBacillus subtilis SpoVK (spoVK), YnbA (ynbA), YnbB (ynbB), GlnR(glnR), glutamine synthetase (glnA), YnaA (ynaA), YnaB (ynaB), YnaC(ynaC), YnaD (ynaD), YnaE (ynaE), YnaF (ynaF), YnaG (ynaG), YnaH (ynaH), YnaI (ynaI), YnaJ (ynaJ), xylan be |
| Contig350D | 24722175_c1_370 | 1575 | 4412 | 1101 | 367 | 353 | 2.40E-32 | Bacillus subtilis | e1184494 | ywtBcapsular polyglutamate biosynthesis homolog ywtBBacillus subtilis complete genome (section 19 of 21)similar to capsular polyglutamate biosynthesis |
| Contig350D | 24730438_c2_461 | 1576 | 4413 | 420 | 140 | 276 | 3.50E-24 | Haemophilus influenzae | P44734 | HI0501high affinity ribose transport protein (rbsD)Haemophilus influenzae from bases 515922 to 527487 (section 47 of163) of the complete genome.similar to GB |

| | | | | | | | | |
|---|---|---|---|---|---|---|---|---|
| Contig350D | 24797140_c2_474 | 1577 | 4414 | 900 | 300 | 145 | 6.10E-08 | PSEUDOMONAS FLUORESCENS | P22862 | ARYLESTERASE, (ARYL-ESTER HYDROLASE) |
| Contig350D | 24814838_c2_443 | 1578 | 4415 | 870 | 290 | 350 | 5.00E-32 | Synechocystis sp. | d1019435 | hypothetical proteinSynechocystis sp. PCC6803 complete genome, 26/27, 3270710-3418851.ORF_ID |
| Contig350D | 24817202_c1_358 | 1579 | 4416 | 1809 | 603 | 799 | 1.90E-116 | Bacillus subtilis | g1934616 | yrhI.hypothetical protein YrhI.Bacillus subtilis cysteine synthase (yrhA), cystathioninegamma-lyase (yrhB), YrhC (yrhC), YrhD (yrhD), formate dehydrogenasechain A (yrhE), YrhF (yrhF), formate dehydrogenase (yrhG), YrhH(yrhH). regulatory protein (yrhI), cyto |
| Contig350D | 250178_c3_555 | 1580 | 4417 | 234 | 78 | | | | | |
| Contig350D | 2507950_f1_43 | 1581 | 4418 | 216 | 72 | | | | | |
| Contig350D | 25398426_f1_48 | 1582 | 4419 | 198 | 66 | | | | | |
| Contig350D | 25429700_c2_395 | 1583 | 4420 | 1356 | 452 | 130 | 1.80E-05 | Schistosoma mansoni | g454844 | Schistosoma mansoni p48 eggshell protein gene, complete cds.ORF 3 |
| Contig350D | 25578215_c3_518 | 1584 | 4421 | 543 | 181 | 483 | 4.00E-46 | Staphylococcus sciuri | e316582 | ORF141S.sciuri mecA gene, strain K11 (792). |
| Contig350D | 2557962_f2_172 | 1585 | 4422 | 1377 | 459 | 953 | 6.30E-96 | Enterococcus faecalis | P37061 | noxNADH oxidaseS.faecalis nox gene for NADH oxidase. |
| Contig350D | 25600015_c3_527 | 1586 | 4423 | 1632 | 544 | 1561 | 2.40E-160 | Bacillus subtilis | g2293232 | ytcIYtcIBacillus subtilis rmB-dnaB genomic region.putative acetate CoA-ligase |
| Contig350D | 25961087_f1_23 | 1587 | 4424 | 813 | 271 | 399 | 3.20E-37 | Bacillus subtilis | P54721 | yfiEunknownBacillus subtilis complete genome (section 5 of 21)similar to hypothetical proteins from B. subtilis |
| Contig350D | 26179777_c1_379 | 1588 | 4425 | 1818 | 606 | 522 | 3.00E-50 | Synechocystis sp. | d1011128 | hypothetical proteinSynechocystis sp. PCC6803 complete genome, 22/27, 2755703-2868766.ORF_ID |
| Contig350D | 26353411_c1_316 | 1589 | 4426 | 576 | 192 | | | | | |
| Contig350D | 26380265_c3_503 | 1590 | 4427 | 1263 | 421 | 1190 | 4.90E-121 | Lactobacillus sake | e1227704 | arcAarginine deiminaseLactobacillus sake DNA encoding the arginine-deiminase pathway genes. |

219

| | | | | | | | | | |
|---|---|---|---|---|---|---|---|---|---|
| Contig350D | 26383512_c1_356 | 1591 | 4428 | 1398 | 466 | 1195 | 1.40E-121 | Bacillus subtilis | d1020148 | ydgFamino acid ABC transporter (permease) homolog ydgFBacillus subtilis genome sequence, 148 kb sequence of the regionbetween 35 and 47 degree.PROBABLE AMINO ACID TRANSPORT PERMIASE. |
| Contig350D | 26571937_f2_128 | 1592 | 4429 | 789 | 263 | 838 | 9.70E-84 | Bacillus subtilis | e1183189 | yjbTthiamin biosynthesis homolog yjbTBacillus subtilis complete genome (section 7 of 21)similar to thiamin biosynthesis |
| Contig350D | 26595641_f2_129 | 1593 | 4430 | 621 | 207 | 416 | 5.10E-39 | Lactococcus lactis | Q48630 | aplalkaline phosphatase like proteinL.lactis (MG1363) apl gene for alkaline phosphatase like protein. |
| Contig350D | 26605001_c3_571 | 1594 | 4431 | 825 | 275 | 686 | 1.20E-67 | Bacillus subtilis | P46331 | yxbGprobable oxidoreductaseBacillus subtilis genomic DNA, 36 kb region between gnt and ioloperons.conserved universally |
| Contig350D | 26672512_c1_377 | 1595 | 4432 | 192 | 64 | | | | | |
| Contig350D | 273452_c2_452 | 1596 | 4433 | 1278 | 426 | 800 | 1.00E-79 | Archaeoglobus fulgidus | g2648815 | AF17363-hydroxy-3-methylglutaryl-coenzyme A reductaseArchaeoglobus fulgidus section 124 of 172 of the complete genome.similar to SP |
| Contig350D | 2739050_c2_453 | 1597 | 4434 | 927 | 309 | 583 | 1.00E-56 | Bacillus subtilis | P39592 | ipa-24dhypothetical proteinB.subtilis genomic region (325 to 333),alternate gene name |
| Contig350D | 2739561_f1_14 | 1598 | 4435 | 1440 | 480 | 1505 | 2.00E-154 | Bacillus subtilis | P37948 | glpTglycerol 3-phosphate permeaseB.subtilis glpT and glpQ genes for glycerol 3-phosphate permeaseand glycerophosphoryl diester phosphodiesterase.hexose phosphate transport protein uhpTaltermate gene name |
| Contig350D | 2760930_f1_21 | 1599 | 4436 | 189 | 63 | | | | | |
| Contig350D | 2790936_f2_205 | 1600 | 4437 | 954 | 318 | 834 | 2.60E-83 | Streptococcus mutans | Q59935 | pmiMannosephosphate IsomeraseS.mutans pmi gene for mannosephosphate isomerase (complete cds) andscrK gene for fructokinase (partial cds). |

| | | | | | | | | |
|---|---|---|---|---|---|---|---|---|
| Contig350D | 2823562_c3_533 | 1601 | 4438 | 1365 | 455 | 909 | 2.90E-91 | Pyrococcus horikoshii | d1028608 | PHCC050438aa long hypothetical aminotransferasePyrococcus horikoshii OT3 genomic DNA, 1300517-1338254 nt position.clonecontains aminotransferases class-III |
| Contig350D | 2867961_c2_469 | 1602 | 4439 | 963 | 321 | 410 | 2.20E-38 | Bacillus subtilis | d1023108 | ycdHYcdHBacillus subtilis genomic DNA, 22 to 25 degree region. completecds.homologue of adhesion protein precursor of |
| Contig350D | 29352312_c3_514 | 1603 | 4440 | 765 | 255 | 617 | 2.60E-60 | Bacillus subtilis | P42423 | B65Fihypothetical proteinBacillus subtilis 15 kb chromosome segment contains the iol operon.homologous to cell division protein FtsE of E. |
| Contig350D | 29400332_c1_385 | 1604 | 4441 | 417 | 139 | 309 | 1.10E-27 | Bacillus subtilis | d1020028 | ydaThypothetical protein ydaTBacillus subtilis genome sequence, 148 kb sequence of the regionbetween 35 and 47 degree.FUNCTION UNKNOWN. |
| Contig350D | 29695327_c3_517 | 1605 | 4442 | 750 | 250 | | | | | |
| Contig350D | 30133562_c1_318 | 1606 | 4443 | 1191 | 397 | 306 | 2.30E-27 | Bacillus subtilis | P37498 | yybFunknownB. subtilis DNA, 180 kilobase region of replication origin.similar to antibiotic resistance protein |
| Contig350D | 30470325_c3_561 | 1607 | 4444 | 1953 | 651 | 425 | 6.80E-38 | Bacillus subtilis | e1186043 | yvaCconserved hypothetical protein yvaCBacillus subtilis complete genome (section 18 of 21)similar to hypothetical proteins |
| Contig350D | 30651577_c3_552 | 1608 | 4445 | 612 | 204 | | | | | |
| Contig350D | 31693_c2_410 | 1609 | 4446 | 699 | 233 | 128 | 6.00E-08 | Streptococcus pyogenes | JH0364 | hypothetical protein 176 (SAGP 5' region) |
| Contig350D | 31720942_f2_200 | 1610 | 4447 | 576 | 192 | | | | | |
| Contig350D | 32221012_c1_383 | 1611 | 4448 | 471 | 157 | 114 | 7.60E-06 | Homo sapiens | g2062692 | NPT4sodium phosphate transporterHuman sodium phosphate transporter (NPT4) mRNA, complete cds. |
| Contig350D | 32664093_f2_127 | 1612 | 4449 | 627 | 209 | 142 | 5.50E-10 | Aquifex aeolicus | g2983767 | thiE1thiamine phosphate synthaseAquifex aeolicus section 68 of 109 of the complete genome. |

221

| | | | | | | | | | |
|---|---|---|---|---|---|---|---|---|---|
| Contig350D | 33211092_f3_256 | 1613 | 4450 | 471 | 157 | | | | |
| Contig350D | 33241093_c2_448 | 1614 | 4451 | 1557 | 519 | 1634 | 4.30E-168 | Bacillus subtilis | e1822273 | ycgN 68% identity protein to Bacillus subtilis complete genome (section 2 of 21) similar to 1-pyrroline-5-carboxylate dehydrogenase |
| Contig350D | 33242842_c1_388 | 1615 | 4452 | 2871 | 957 | 315 | 1.70E-24 | Saccharomyces cerevisiae | g914990 | YDR332W Ydr332wp Saccharomyces cerevisiae chromosome IV cosmid 9798. Similar to DEAD box family helicases |
| Contig350D | 33359381_c2_401 | 1616 | 4453 | 210 | 70 | | | | | |
| Contig350D | 33391337_c2_484 | 1617 | 4454 | 864 | 288 | | | | | |
| Contig350D | 33620176_c3_528 | 1618 | 4455 | 858 | 286 | 494 | 2.80E-47 | Staphylococcus aureus | d1020251 | orf30 Staphylococcus aureus DNA for sigma70 operon, complete cds. |
| Contig350D | 3402312_c1_365 | 1619 | 4456 | 1761 | 587 | 1316 | 2.20E-134 | Bacillus subtilis | d1020024 | ydaP Bacillus subtilis genome sequence, 148 kb sequence of the region between 35 and 47 degree. SIMILAR TO PYRUVATE OXIDASE AND ACETOLACTATE |
| Contig350D | 34197318_f3_258 | 1620 | 4457 | 903 | 301 | 1117 | 2.70E-113 | Staphylococcus carnosus | Q07159 | fda fructose-bisphosphate aldolase S.carnosus fda gene. |
| Contig350D | 34410843_c2_399 | 1621 | 4458 | 1431 | 477 | | | | | |
| Contig350D | 34412952_c3_573 | 1622 | 4459 | 783 | 261 | 580 | 2.10E-56 | Escherichia coli | P77307 | YBBM hypothetical protein b0491 Escherichia coli K-12 MG1655 section 45 of 400 of the complete genome. o268: This 268 aa ORF is 27 pct identical (9 gaps) |
| Contig350D | 34617937_f3_296 | 1623 | 4460 | 525 | 175 | 223 | 1.10E-17 | Dictyostelium discoideum | g2952545 | DB10 coronin binding protein Dictyostelium discoideum coronin binding protein (DB10) mRNA, complete cds. |
| Contig350D | 34647150_c1_331 | 1624 | 4461 | 1356 | 452 | 274 | 1.40E-23 | Litomosoides sigmodontis | g2570198 | shp3 microfilarial sheath protein SHP3 Litomosoides sigmodontis microfilarial sheath proteins SHP3a(shp3a) and SHP3 (shp3) genes, complete cds. structural protein; similar to shp3 genes from |
| Contig350D | 35193950_c2_451 | 1625 | 4462 | 489 | 163 | | | | | |

222

| | | | | | | | | |
|---|---|---|---|---|---|---|---|---|
| Contig350D | 35317188_c2_396 | 1626 | 4463 | 6414 | 2138 | 1445 | 2.20E-149 | Caenorhabditis elegans | g1707247 | K06A9.1Caenorhabditis elegans cosmid K06A9.partial CDS; coded for by C. elegans cDNA yk50c7.5 |
| Contig350D | 35433438_f3_231 | 1627 | 4464 | 1137 | 379 | 420 | 1.90E-39 | Bacillus subtilis | e1183187 | yjbKsarcosine oxidase homolog yjbRBacillus subtilis complete genome (section 7 of 21)similar to sarcosine oxidase |
| Contig350D | 35993802_c2_397 | 1628 | 4465 | 1584 | 528 | | | | | |
| Contig350D | 36127302_c2_476 | 1629 | 4466 | 888 | 296 | 1058 | 4.70E-107 | Bacillus subtilis | Q05852 | gtaBUDP-glucose pyrophosphorylaseBacillus subtilis UDP-glucose pyrophosphorylase (gtaB) gene,complete cds.Escherichia coli UTP-glucose-1-phosphate uridylyltransferasesimilar to UDP-glucose pyrophosphorylase of |
| Contig350D | 36151692_c2_466 | 1630 | 4467 | 681 | 227 | 671 | 4.80E-66 | Bacillus subtilis | e1182773 | yfkOYfkOBacillus subtilis complete genome (section 5 of 21)similar to NAD(P)H-flavin oxidoreductase |
| Contig350D | 36205285_c2_411 | 1631 | 4468 | 780 | 260 | 284 | 5.00E-25 | Caldicellulosiruptor saccharolyticus | P23553 | XynCacetylxylosidaseCaldicellulosirupt or saccharolyticus putative transport protein(XynG), putative transport protein (XynH), xylanase (XynF),xylanase (XynE), xylanase (XynD), xylanase (XynA), acetylxylosidase(XynC) and xylanase (XynB) genes, complete cds |
| Contig350D | 36225250_c2_408 | 1632 | 4469 | 1542 | 514 | 2622 | 8.70E-273 | Staphylococcus epidermidis | P43148 | SepP1proteaseS.epidermis gene for protease. |
| Contig350D | 36617832_c2_422 | 1633 | 4470 | 801 | 267 | 758 | 2.90E-75 | Bacillus megaterium | P29928 | COBAS-adenosyl-L-methionineBacillus megaterium S-adenosy-L-methionineATCC #1078 |
| Contig350D | 3909376_c2_394 | 1634 | 4471 | 396 | 132 | 244 | 8.60E-21 | Helicobacter pylori | g2314761 | HP1576ABC transporter, ATP-binding protein (abc)Helicobacter pylori section 133 of 134 of the complete genome.malK protein homologysimilar to EGAD |
| Contig350D | 3910675_f3_293 | 1635 | 4472 | 234 | 78 | | | | | |
| Contig350D | 3923842_c2_460 | 1636 | 4473 | 891 | 297 | 442 | 8.90E-42 | Bacillus megaterium | P40419 | hypothetical 30.5K chainB. megaterium glucose dehydrogenase (EC 1.1.1.47) and ORFs.ORF2 |

223

| | | | | | | | | | |
|---|---|---|---|---|---|---|---|---|---|
| Contig350D | 3941078_f1_19 | 1637 | 4474 | 324 | 108 | 110 | 1.40E-06 | Bacillus subtilis | e1183188 | yjbShypothetical protein yjbSBacillus subtilis complete genome (section 7 of 21) |
| Contig350D | 3945818_f3_216 | 1638 | 4475 | 1485 | 495 | 1215 | 1.10E-123 | Bacillus subtilis | e1182164 | ybeCamino acid transporter homolog ybeCBacillus subtilis complete genome (section 2 of 21)similar to amino acid transporter |
| Contig350D | 3953400_f1_82 | 1639 | 4476 | 195 | 65 | | | | | |
| Contig350D | 4003431_f2_195 | 1640 | 4477 | 204 | 68 | | | | | |
| Contig350D | 4079552_f2_171 | 1641 | 4478 | 630 | 210 | | | | | |
| Contig350D | 4079626_f1_88 | 1642 | 4479 | 192 | 64 | | | | | |
| Contig350D | 4094703_c1_333 | 1643 | 4480 | 2022 | 674 | 224 | 3.10E-21 | Bacillus subtilis | g2293178 | ytsDYtsDBacillus subtilis rrnB-dnaB genomic region.similarity to NADH dehydrogenase |
| Contig350D | 40966_c3_495 | 1644 | 4481 | 1626 | 542 | | | | | |
| Contig350D | 4100938_c2_472 | 1645 | 4482 | 534 | 178 | 291 | 1.60E-25 | Bacillus subtilis | P42237 | ycbEglucarate dehydrataseBacillus subtilis DNA around 20 degrees region of chromosomecontaining yckA-T genes.similar to glucarate transporter |
| Contig350D | 4148428_f1_33 | 1646 | 4483 | 1149 | 383 | 528 | 6.90E-51 | Alcaligenes eutrophus | P14940 | ADHalcohol dehydrogenase.A.eutrophus alcohol dehydrogenase (ADH) gene, complete cds.alcohol dehydrogenasealcohol dehydrogenase (EC 1.1.1.1) |
| Contig350D | 4167842_f2_112 | 1647 | 4484 | 201 | 67 | | | | | |
| Contig350D | 4303377_f2_142 | 1648 | 4485 | 270 | 90 | | | | | |
| Contig350D | 4303927_c1_381 | 1649 | 4486 | 312 | 104 | | | | | |
| Contig350D | 4329453_c1_367 | 1650 | 4487 | 336 | 112 | 220 | 3.00E-18 | Bacillus subtilis | d1020138 | ydfQthioredoxin homolog ydfQBacillus subtilis genome sequence, 148 kb sequence of the regionbetween 35 and 47 degree.SIMILAR TO THIOREDOXIN. |
| Contig350D | 4336088_c1_342 | 1651 | 4488 | 624 | 208 | 283 | 6.30E-25 | Bacillus subtilis | e332189 | yInFYInF proteinBacillus subtilis pyrE to yloA gene region.similar to uroporphyrin III C-methyltransferase |
| Contig350D | 4459375_f2_207 | 1652 | 4489 | 207 | 69 | | | | | |
| Contig350D | 4491713_f2_113 | 1653 | 4490 | 1542 | 514 | 416 | 5.10E-39 | Helicobacter pylori | g2313368 | HP0278guanosine pentaphosphate phosphohydrolaseHelicobacter pylori section 24 of 134 of the complete genome.similar to EGAD |

| | | | | | | | | |
|---|---|---|---|---|---|---|---|---|
| Contig350D | 4574012_f1_46 | 1654 | 4491 | 1080 | 360 | 600 | 1.60E-58 | Drosophila melanogaster | JN0500 | dhodIdihydroorotate oxidase., mitochondrialdihydroorotate oxidase |
| Contig350D | 4662_f2_168 | 1655 | 4492 | 318 | 106 | | | | | |
| Contig350D | 4687752_c1_359 | 1656 | 4493 | 1185 | 395 | 773 | 7.50E-77 | Bacillus subtilis | e1184948 | ykrVaspartate aminotransferase homolog ykrVBacillus subtilis complete genome (section 8 of 21)similar to aspartate aminotransferase |
| Contig350D | 4713377_f2_144 | 1657 | 4494 | 447 | 149 | | | | | |
| Contig350D | 4719775_c3_562 | 1658 | 4495 | 744 | 248 | 434 | 6.30E-41 | Bacillus subtilis | P39583 | ipa-7dGTP-pyrophosphokinase homolog ywaCB.subtilis genomic region (325 to 333),alternate gene name |
| Contig350D | 4723510_c2_430 | 1659 | 4496 | 2661 | 887 | 2374 | 1.70E-246 | CLOSTRIDIUM SYMBIOSUM | P22983 | PPDKIDIKINASE) |
| Contig350D | 4727187_c2_403 | 1660 | 4497 | 2889 | 963 | 617 | 6.20E-58 | Lactococcus lactis | P49022 | pipLactoccocus lactis pip and gerC2 genes, complete cds's, and rrgene, 5' end of cds.GTG start codon |
| Contig350D | 4787807_f3_218 | 1661 | 4498 | 210 | 70 | | | | | |
| Contig350D | 4870907_f1_42 | 1662 | 4499 | 231 | 77 | | | | | |
| Contig350D | 4876932_c2_416 | 1663 | 4500 | 249 | 83 | | | | | |
| Contig350D | 4882893_c3_493 | 1664 | 4501 | 1209 | 403 | 241 | 2.40E-26 | Aquifex aeolicus | g2982812 | secYpreprotein translocase SecYAquifex aeolicus section 4 of 109 of the complete genome. |
| Contig350D | 4891002_c2_462 | 1665 | 4502 | 1116 | 372 | 671 | 4.80E-66 | Clostridium perfringens | A43577 | regulatory protein pfoR |
| Contig350D | 5117137_c2_457 | 1666 | 4503 | 459 | 153 | 499 | 8.20E-48 | Bacillus subtilis | e1184495 | ywtAcapsular polyglutamate biosynthesis homolog ywtABacillus subtilis complete genome (section 19 of 21)similar to capsular polyglutamate biosynthesis |
| Contig350D | 5128425_f2_203 | 1667 | 4504 | 1878 | 626 | 477 | 1.70E-45 | Bacillus subtilis | e1183220 | yjdCtranscriptional antiterminator (BglG family) homolog yjdCBacillus subtilis complete genome (section 7 of 21)similar to transcriptional antiterminator (BglG |
| Contig350D | 5133562_f2_160 | 1668 | 4505 | 222 | 74 | 180 | 5.20E-14 | Bacillus subtilis | e1186039 | yvgYmercuric transport protein homolog yvgYBacillus subtilis complete genome (section 18 of 21)similar to mercuric transport protein |

224

225

| Contig350D | 5136002_c2_400 | 1669 | 4506 | 366 | 122 | 136 | 2.40E-09 | Bacillus subtilis | g2618844 | yvlAYvlABacillus subtilis 300-304 degree genomic sequence. |
| --- | --- | --- | --- | --- | --- | --- | --- | --- | --- | --- |
| Contig350D | 5250087_f2_213 | 1670 | 4507 | 783 | 261 | 152 | 3.40E-09 | Mus musculus | d1000902 | Mouse putative primordial protein transcript.open reading frame (251 AA) |
| Contig350D | 5281568_f3_235 | 1671 | 4508 | 504 | 168 | 330 | 6.60E-30 | Escherichia coli | d1015799 | Phosphinothricin acetyltransferase (ECE.coli genomic DNA, Kohara clone #273(32.5-32.8 min.),ORF ID |
| Contig350D | 5290675_c3_536 | 1672 | 4509 | 405 | 135 | 411 | 1.70E-38 | Bacillus subtilis | P52999 | panDaspartate 1-decarboxylaseBacillus subtilis (clone YAC15-6B) ypjABF genes, qcrABC genes,ypjABCDEFGHI genes, birA gene, panBCD genes, dinG gene, ypmB gene,aspB gene, asnS gene, dnaD gene, nth gene and ypoC gene, completecds.48.3% of identity to the Es |
| Contig350D | 5314077_c1_335 | 1673 | 4510 | 1593 | 531 | 1036 | 1.00E-104 | Escherichia coli | P31448 | yidKhypothetical 62.1 kD protein in ilvo-ibpbEscherichia coli K-12 MG1655 section 335 of 400 of the completegenome.t571; 100 pct identical to YIDK_ECOLI SW |
| Contig350D | 5369212_c3_567 | 1674 | 4511 | 1509 | 503 | 425 | 1.60E-39 | Bacillus subtilis | P13484 | tagEUDP-glucoseBacillus subtilis rodC operon.rodD (gtaA) polypeptide (AA 1-673) |
| Contig350D | 56693_c1_324 | 1675 | 4512 | 792 | 264 | 778 | 2.20E-77 | Bos taurus | g2058476 | acetoin reductaseBos taurus acetoin reductase mRNA, complete cds.similar to acetoin reductase of Klebsiella |
| Contig350D | 5915653_f2_197 | 1676 | 4513 | 183 | 61 |  |  |  |  |  |
| Contig350D | 6047827_c2_438 | 1677 | 4514 | 705 | 235 | 569 | 3.10E-55 | Lactococcus lactis | g2565161 | aldBAldBLactococcus lactis unknown gene, partial cds, and HisC (hisC),unknown, HisG (hisG), unknown, HisB (hisB), unknown, HisH (hish),HisA (hisA), HisF (hisF), HisIE (hisIE), unknown, unknown, LeuA(leuA), LeuB (leuB), LeuC (leuC), LeuD (leuD), unknown, I |
| Contig350D | 6070938_c1_348 | 1678 | 4515 | 1773 | 591 | 1342 | 3.80E-137 | Escherichia coli | P17444 | betAcholine dehydrogenaseEscherichia coli K-12 MG1655 section 28 of 400 of the completegenome.alcohol oxidasef556; 100 pct identical to BETA_ECOLI SW |

226

| | | | | | | | | |
|---|---|---|---|---|---|---|---|---|
| Contig350D | 6136050_c2_449 | 1679 | 4516 | 246 | 82 | | | |
| Contig350D | 6136527_c2_424 | 1680 | 4517 | 615 | 205 | 618 | 2.00E-60 | Bacillus subtilis | e332186 | ylnC putative adenosine 5-phosphosulfate kinase Bacillus subtilis pyrE to yloA gene region.similar to adenylylsulfate kinase |
| Contig350D | 6369688_f2_125 | 1681 | 4518 | 915 | 305 | 119 | 2.90E-05 | Methanococcus jannaschii | Q57819 | MJ0374 lipoprotein B (lppB) Methanococcus jannaschii section 32 of 150 of the complete genome.similar to GB |
| Contig350D | 6442202_f3_233 | 1682 | 4519 | 1050 | 350 | 310 | 8.70E-28 | Bacillus subtilis | P37520 | yyaD unknown B. subtilis DNA, 180 kilobase region of replication origin.unnamed protein product |
| Contig350D | 6678507_f3_267 | 1683 | 4520 | 207 | 69 | | | | |
| Contig350D | 6829812_c1_372 | 1684 | 4521 | 948 | 316 | 592 | 1.10E-57 | Haemophilus influenzae | P44331 | HI0505 ribokinase (rbsK) Haemophilus influenzae from bases 515922 to 527487 (section 47 of 163) of the complete genome.ribokinases similar to GB |
| Contig350D | 6837938_f1_103 | 1685 | 4522 | 3561 | 1187 | 198 | 1.80E-14 | Homo sapiens | P51861 | CDR1 cerebellar degeneration-related protein I luman cerebellar-degeneration-related antigen (CDR34) gene.complete cds.cerebellar-degeneration-related antigen (CDR34) |
| Contig350D | 6844012_c3_522 | 1686 | 4523 | 1344 | 448 | 589 | 2.40E-57 | Escherichia coli | P04539 | dcuA anaerobic c4-dicarboxylate transporter dcuaEscherichia coli K-12 MG1655 section 376 of 400 of the completegenome.dicarboxylate membrane-transporter protein Af433; 100 pct identical amino acid sequence and |
| Contig350D | 6928_c1_373 | 1687 | 4524 | 843 | 281 | | | | |
| Contig350D | 7227175_c3_508 | 1688 | 4525 | 189 | 63 | | | | |
| Contig350D | 7228517_c3_568 | 1689 | 4526 | 411 | 137 | 191 | 3.50E-15 | Mycobacterium tuberculosis | e317133 | mutT MutT Mycobacterium tuberculosis cosmid I65.MTCI65.27, mutT. len |
| Contig350D | 7234627_c1_389 | 1690 | 4527 | 210 | 70 | | | | |
| Contig350D | 7245377_c1_368 | 1691 | 4528 | 1002 | 334 | 258 | 2.80E-22 | Acinetobacter lwoffii | gl209223 | estesteraseAcinetobacter lwoffii orf1 and esterase (est) genes, complete cds. |

| | | | | | | | | |
|---|---|---|---|---|---|---|---|---|
| Contig350D | 7301078_c3_488 | 1692 | 4529 | 465 | 155 | 340 | 5.80E-31 | Pseudomonas stutzeri | g3114664 | htxDATPase component HtxDPseudomonas stutzeri putative alpha-ketoglutarate-dependenthypophosphite dioxygenase (htxA), binding protein component HtxB(htxB), inner membrane component HtxC (htxC), ATPase component HtxD(htxD), inner membrane component HtxE (h |
| Contig350D | 787677_f2_152 | 1693 | 4530 | 483 | 161 | 246 | 5.30E-21 | Staphylococcus carnosus | g2735506 | sceBSceB precursorStaphylococcus carnosus N5,N10-methylenetetrahydromethanopterinreductase homolog, SceB precursor (sceB) and putative transmembraneprotein genes, complete cds, and putative Na+/H+ antiporter NhaC(nhaC) gene, partial cds.major secreted pro |
| Contig350D | 823518_f1_35 | 1694 | 4531 | 225 | 75 | | | | | |
| Contig350D | 860425_c3_553 | 1695 | 4532 | 258 | 86 | 106 | 3.60E-06 | Paramecium bursaria Chlorella virus 1 | g624122 | a56LParamecium bursaria Chlorella virus 1. complete genome.contains type 1 hydrophobic transmembrane region |
| Contig350D | 86088_f2_211 | 1696 | 4533 | 369 | 123 | 154 | 3.00E-11 | Staphylococcus carnosus | g2735504 | Staphylococcus carnosus N5,N10-methylenetetrahydromethanopterinreductase homolog, SceB precursor (sceB) and putative transmembraneprotein genes, complete cds, and putative Na+/H+ antiporter NhaC(nhaC) gene, partial cds.Orf1 |
| Contig350D | 860917_f2_191 | 1697 | 4534 | 201 | 67 | | | | | |
| Contig350D | 895253_c3_497 | 1698 | 4535 | 510 | 170 | 302 | 6.10E-27 | Helicobacter pylori | g2313314 | HP0224peptide methionine sulfoxide reductase (msrA)Helicobacter pylori section 20 of 134 of the complete genome.similar to EGAD |
| Contig350D | 901377_c2_441 | 1699 | 4536 | 327 | 109 | | | | | |
| Contig350D | 953142_f1_51 | 1700 | 4537 | 954 | 318 | 228 | 4.30E-19 | Mycobacterium tuberculosis | Q50648 | MTCY227.28cunknownMycobacterium tuberculosis cosmid Y227.MTCY227.28c, unknown, len |
| Contig350D | 961562_c1_319 | 1701 | 4538 | 186 | 62 | | | | | |
| Contig350D | 968800_c2_446 | 1702 | 4539 | 804 | 268 | 1031 | 3.40E-104 | Staphylococcus aureus | e244971 | S.aureus orfs 1,2,3 & 4.ORF1 |
| Contig350D | 978965_c3_511 | 1703 | 4540 | 213 | 71 | | | | | |

| | | | | | | | | | |
|---|---|---|---|---|---|---|---|---|---|
| Contig350D | 9875333_c1_376 | 1704 | 4541 | 1533 | 511 | 1134 | 4.20E-115 | Vibrio cholerae | P23240 | aldAaldehyde dehydrogenaseVibrio cholerae pathogenicity island, putative transposase,aldehyde dehydrogenase (aldA), toxR-activated gene A protein(tagA), putative inner membrane protein, and putative zincmetalloprotease genes, complete cds; and toxR-activa |
| Contig351D | 15055313_c3_16 | 1705 | 4542 | 444 | 148 | 726 | 7.20E-72 | Staphylococcus aureus | e1237897 | ORF142hypothetical proteinStaphylococcus aureus mecA, mecR1, mecI genes and ORF168, ORF142,ORF44, ORF145 and ORF224,ORF142 |
| Contig351D | 21644175_c3_12 | 1706 | 4543 | 273 | 91 | | | | | |
| Contig351D | 24407812_c3_15 | 1707 | 4544 | 771 | 257 | 738 | 3.80E-73 | Staphylococcus aureus | g48713 | hypothetical proteinS. aureus hypervariable region, 3' to mecA gene.orf145 |
| Contig351D | 29320127_c3_14 | 1708 | 4545 | 390 | 130 | 139 | 5.40E-09 | Bacillus subtilis | P40830 | pksGunknownBacillus subtilis W168 polyketide synthase (pksX and pksorfx6)genes, complete cds.pksorfx2; similar to hamster |
| Contig351D | 29500687_c3_11 | 1709 | 4546 | 1191 | 397 | | | | | |
| Contig351D | 34016880_f2_3 | 1710 | 4547 | 2028 | 676 | 3469 | 0 | Staphylococcus epidermidis | g46994 | mecApenicillin-binding protein mecA, low-affinityS. epidermidis mecA gene for PBP2' (penicillin binding protein 2'),PBP2' (AA 1 - 668) |
| Contig351D | 6828125_c1_10 | 1711 | 4548 | 252 | 84 | | | | | |
| Contig351D | 6929686_f1_1 | 1712 | 4549 | 693 | 231 | 1200 | 4.20E-122 | Staphylococcus aureus | P19380 | putative transposaseS. aureus IS431mec gene associated with methicillin resistance,putative transposase (AA 1 - 224) |
| Contig352D | 10320337_c3_135 | 1713 | 4550 | 192 | 64 | | | | | |
| Contig352D | 10359688_f3_74 | 1714 | 4551 | 198 | 66 | | | | | |
| Contig352D | 1071002_f3_54 | 1715 | 4552 | 411 | 137 | | | | | |
| Contig352D | 10727217_f1_23 | 1716 | 4553 | 270 | 90 | 212 | 2.10E-17 | Bacillus subtilis | d1020027 | ydaSconserved hypothetical protein ydaSBacillus subtilis genome sequence. 148 kb sequence of the regionbetween 35 and 47 degree.FUNCTION UNKNOWN. |
| Contig352D | 111592_c2_117 | 1717 | 4554 | 243 | 81 | | | | | |

| | | | | | | | | | |
|---|---|---|---|---|---|---|---|---|---|
| Contig352D | 1205000_f1_12 | 1718 | 4555 | 555 | 185 | 314 | 3.30E-28 | Bacillus subtilis | dl020012 | ydaFacetyltransferase homolog ydaFBacillus subtilis genome sequence. 148 kb sequence of the regionbetween 35 and 47 degree.PROBABLE ACETYLTRANSFERASE. |
| Contig352D | 12536337_f2_38 | 1719 | 4556 | 327 | 109 | | | | | |
| Contig352D | 134677_f2_45 | 1720 | 4557 | 1101 | 367 | 1373 | 2.00E-140 | Bacillus subtilis | P37518 | yyaFunknownB. subtilis DNA, 180 kilobase region of replication origin.similar to hypothetical proteins |
| Contig352D | 14220027_f3_55 | 1721 | 4558 | 1143 | 381 | 190 | 2.50E-12 | Enterococcus faecalis | dl025733 | bacGEnterococcus faecalis plasmid pPD1 bacA, bacB, bacC, bacD, bacE,bacF, bacG, bacI and bacJ genes, complete cds. |
| Contig352D | 14547556_f1_29 | 1722 | 4559 | 453 | 151 | | | | | |
| Contig352D | 14728382_f1_21 | 1723 | 4560 | 300 | 100 | 336 | 1.50E-30 | Bacillus subtilis | P21468 | rpsFribosomal protein S6B. subtilis DNA, 180 kilobase region of replication origin.Escherichia coli ribosomal protein S6 |
| Contig352D | 14881552_f1_14 | 1724 | 4561 | 216 | 72 | | | | | |
| Contig352D | 15052318_f2_30 | 1725 | 4562 | 1395 | 465 | 1606 | 4.00E-165 | Bacillus subtilis | P25811 | tdhFthiophen and furan oxidationB. subtilis DNA, 180 kilobase region of replication origin.homologous to E.coli 50K |
| Contig352D | 15752213_f1_5 | 1726 | 4563 | 270 | 90 | | | | | |
| Contig352D | 16432963_c1_88 | 1727 | 4564 | 1116 | 372 | 972 | 6.10E-98 | Bacillus subtilis | e1183207 | yjcIcystathionine gamma-synthase homolog yjcIBacillus subtilis complete genome (section 7 of 21)similar to cystathionine gamma-synthase |
| Contig352D | 19548192_c3_136 | 1728 | 4565 | 765 | 255 | | | | | |
| Contig352D | 1960300_f1_11 | 1729 | 4566 | 201 | 67 | | | | | |
| Contig352D | 20517318_f1_17 | 1730 | 4567 | 1200 | 400 | 1171 | 5.00E-119 | Thermoanaerobacterium thermosaccharolyticum | e281310 | thlAacetyl coenzyme A acetyltransferase (thiolase)C.thermosaccharolyticum etfB, etfA, hbd, thlA and actA genes. |
| Contig352D | 2148468_f2_34 | 1731 | 4568 | 2073 | 691 | 1498 | 1.10E-153 | Staphylococcus aureus | P10335 | GEHtriacylglycerol lipase.S.aureus geh gene encoding lipase (glycerol ester hydrolase).lipase precursor (geh); EC 3.1.1.3 |

230

| | | | | | | | | | |
|---|---|---|---|---|---|---|---|---|---|
| Contig352D | 21506575_c1_85 | 1732 | 4569 | 897 | 299 | 331 | 5.20E-30 | Bacteriophage phig1e | e257764 | LyslysinLactobacillus bacteriophage phig1e DNA for Rorf162, Holin, Lysin,and Rorf175 genes,gtg start codon |
| Contig352D | 23462762_c3_128 | 1733 | 4570 | 1527 | 509 | 2298 | 1.90E-238 | Staphylococcus aureus | g1916317 | ahpFalkyl hydroperoxide reductase subunit FStaphylococcus aureus alkyl hydroperoxide reductase subunit C(aphC) and subunit F (aphF) genes, complete cds.AhpF |
| Contig352D | 23634786_f3_56 | 1734 | 4571 | 1200 | 400 | 692 | 2.90E-68 | Enterococcus faecalis | d1025735 | bacIEnterococcus faecalis plasmid pPD1 bacA, bacB, bacC, bacD, bacE,bacF, bacG, bacH and bacI genes, complete cds. |
| Contig352D | 23860812_f2_37 | 1735 | 4572 | 603 | 201 | 534 | 1.60E-51 | Staphylococcus aureus | g1595810 | spsBtype-I signal peptidase SpsBStaphylococcus aureus type-I signal peptidase SpsA (spsA) gene, andtype-I signal peptidase SpsB (spsB) gene, complete cds.signal peptidase, leader peptidase, serine |
| Contig352D | 24220062_c3_129 | 1736 | 4573 | 285 | 95 | | | | | |
| Contig352D | 24406338_c3_138 | 1737 | 4574 | 186 | 62 | | | | | |
| Contig352D | 24431502_c3_137 | 1738 | 4575 | 846 | 282 | 297 | 2.10E-26 | Archaeoglobus fulgidus | g2649574 | AF1021ABC transporter, ATP-binding proteinArchaeoglobus fulgidus section 74 of 172 of the complete genome.similar to GB |
| Contig352D | 24647142_c2_116 | 1739 | 4576 | 645 | 215 | 575 | 7.20E-56 | Staphylococcus xylosus | e352094 | orf5hypothetical proteinStaphylococcus xylosus lacR, lacP, lacI I genes and 2 ORF's. |
| Contig352D | 24665811_c3_127 | 1740 | 4577 | 486 | 162 | 166 | 1.60E-12 | Anolis pulchellus | g1197667 | vitellogeninAnolis pulchellus vitellogenin mRNA, partial cds.ApVtg5; similar to chicken and Xenopus phosvitin |
| Contig352D | 25548452_f1_20 | 1741 | 4578 | 915 | 305 | 354 | 1.90E-32 | Bacillus subtilis | e1181925 | ykuTYkuT proteinBacillus subtilis 29kB DNA fragment from ykwC gene to cse15 gene.similar to hypothetical proteins |
| Contig352D | 25554012_c2_109 | 1742 | 4579 | 213 | 71 | | | | | |

231

| | | | | | | | | | |
|---|---|---|---|---|---|---|---|---|---|
| Contig352D | 25667767_c3_131 | 1743 | 4580 | 1191 | 397 | 907 | 4.70E-91 | Bacillus subtilis | e1183208 | yjcJcystathionine beta-lyase homolog yjcJBacillus subtilis complete genome (section 7 of 21)similar to cystathionine beta-lyase |
| Contig352D | 25679712_f3_59 | 1744 | 4581 | 660 | 220 | 153 | 1.40E-09 | Schizosaccharomyces pombe | e317491 | SPBC3D6.14cunknownS.pombe chromosome II cosmid c3D6.SPBC3D6.14c, unknown; partial; serine rich. |
| Contig352D | 26198535_c3_133 | 1745 | 4582 | 765 | 255 | 117 | 7.10E-07 | Mycobacterium tuberculosis | e1253947 | MTV048.03hypothetical protein MTV048.03Mycobacterium tuberculosis sequence v048.MTV048.03, len |
| Contig352D | 26214002_f3_64 | 1746 | 4583 | 870 | 290 | 627 | 2.20E-61 | Bacillus subtilis | P26497 | spo0Jstage 0 sporultionB. subtilis DNA, 180 kilobase region of replication origin. |
| Contig352D | 26365911_f1_3 | 1747 | 4584 | 561 | 187 | 203 | 1.90E-16 | Bacillus subtilis | d1020119 | ydeStranscriptional regulator (TetR/AcrR famil) homolog ydeSBacillus subtilis genome sequence, 148 kb sequence of the regionbetween 35 and 47 degrec.PROBABLE TRANSCRIPTIONAL REGULATOR. SIMILAR TO |
| Contig352D | 26600015_f1_1 | 1748 | 4585 | 354 | 118 | 280 | 1.30E-24 | Bacillus subtilis | P25814 | rnpAprotein component of ribonuclease PB. subtilis DNA, 180 kilobase region of replication origin. |
| Contig352D | 26756660_c2_121 | 1749 | 4586 | 651 | 217 | | | | | |
| Contig352D | 2745462_c1_81 | 1750 | 4587 | 642 | 214 | | | | | |
| Contig352D | 29860902_c3_132 | 1751 | 4588 | 2277 | 759 | 1816 | 2.20E-187 | Bacillus subtilis | e1181518 | metCMetCBacillus subtilis 168 56 kb DNA fragment between xlyA and ykoR. |
| Contig352D | 30080255_f1_7 | 1752 | 4589 | 384 | 128 | | | | | |
| Contig352D | 31443827_f2_46 | 1753 | 4590 | 510 | 170 | 563 | 1.30E-54 | Bacillus subtilis | P37455 | ssbsingle strand DNA binding proteinB. subtilis DNA, 180 kilobase region of replication origin..single-stranded DNA-binding protein homology |
| Contig352D | 32062762_c2_123 | 1754 | 4591 | 183 | 61 | | | | | |

| | | | | | | | | | |
|---|---|---|---|---|---|---|---|---|---|
| Contig352D | 32423410_c1_91 | 1755 | 4592 | 210 | 70 | 167 | 1.20E-12 | Archaeoglobus fulgidus | g2648767 | AF1793repressor proteinArchaeoglobus fulgidus section 128 of 172 of the complete genome.similar to GB |
| Contig352D | 3320317_f3_65 | 1756 | 4593 | 237 | 79 | 150 | 7.80E-11 | Streptococcus pneumoniae | g2109447 | Streptococcus pneumoniae R801 tRNA-Arg gene, partial sequence, andputative serine protease (spltra), SPSpoJ (spspoJ), initiatorprotein (spdnaa) and beta subunit of DNA polymerase III (spdnan)genes, complete cds.ORFX |
| Contig352D | 33228180_f1_16 | 1757 | 4594 | 243 | 81 | | | | | |
| Contig352D | 34180340_f2_33 | 1758 | 4595 | 711 | 237 | 609 | 1.80E-59 | Enterococcus faecalis | d1025734 | bacH:Enterococcus faecalis plasmid pPD1 bacA, bacB, bacC, bacD, bacE,bacF, bacG, bacH and bacI genes, complete cds. |
| Contig352D | 34182952_f3_58 | 1759 | 4596 | 402 | 134 | | | | | |
| Contig352D | 34414012_f1_22 | 1760 | 4597 | 273 | 91 | 336 | 1.50E-30 | Bacillus subtilis | d1005761 | rpsR:ribosomal protein S18B. subtilis DNA, 180 kilobase region of replication origin.Escherichia coli ribosomal protein S18 |
| Contig352D | 34414187_c1_82 | 1761 | 4598 | 399 | 133 | 152 | 4.80E-11 | Bacillus subtilis | d1020108 | ydcI:hypothetical protein ydeHBacillus subtilis genome sequence, 148 kb sequence of the regionbetween 35 and 47 degree.FUNCTION UNKNOWN. |
| Contig352D | 34417552_f3_53 | 1762 | 4599 | 381 | 127 | | | | | |
| Contig352D | 34580342_c1_94 | 1763 | 4600 | 771 | 257 | 802 | 6.40E-80 | Bacillus subtilis | g2293177 | ytsC:transporterBacillus subtilis rrnB-dnaB genomic region.similar to ABC transporter (ATP-binding protein) |
| Contig352D | 34643751_c1_79 | 1764 | 4601 | 591 | 197 | 910 | 2.30E-91 | Staphylococcus aureus | g1916316 | ahpC:alkyl hydroperoxide reductase subunit CStaphylococcus aureus alkyl hydroperoxide reductase subunit C(aphC) and subunit F (aphF) genes, complete cds.AhpC |
| Contig352D | 34664700_f2_32 | 1765 | 4602 | 861 | 287 | 617 | 2.60E-60 | Bacillus subtilis | P37524 | yyaA:DNA binding protein (probable)B. subtilis DNA, 180 kilobase region of replication origin.unnamed protein product |
| Contig352D | 35343807_f1_27 | 1766 | 4603 | 237 | 79 | | | | | |
| Contig352D | 35978127_f3_73 | 1767 | 4604 | 777 | 259 | 559 | 3.60E-54 | Bacillus subtilis | P39605 | ipa-43d:hypothetical proteinB.subtilis genomic region (325 to 333).allernate gene name |

233

| | | | | | | | | | |
|---|---|---|---|---|---|---|---|---|---|
| Contig352D | 36228126_f2_31 | 1768 | 4605 | 1896 | 632 | 2407 | 5.30E-250 | Bacillus subtilis | P25812 | gidAunknownB. subtilis DNA, 180 kilobase region of replication origin.gidA proteinhomologous to E.coli gidA |
| Contig352D | 36522507_f1_2 | 1769 | 4606 | 741 | 247 | 740 | 2.40E-73 | Bacillus subtilis | P25813 | gidBunknownB. subtilis DNA, 180 kilobase region of replication origin.gidB proteinhomologous to E.coli gidB |
| Contig352D | 4335750_f1_4 | 1770 | 4607 | 600 | 200 | 158 | 1.70E-11 | Clostridium perfringens | g853809 | hypothetical protein 3C.perfringens nanI gene & ORF1,2,3 & 4.ORF3 |
| Contig352D | 4725385_f1_24 | 1771 | 4608 | 675 | 225 | 366 | 1.00E-33 | Bacillus subtilis | e1183940 | yrhPdihydrodipicolinate reductase homolog yrhPBacillus subtilis complete genome (section 14 of 21)similar to dihydrodipicolinate reductase |
| Contig352D | 4957943_f3_68 | 1772 | 4609 | 600 | 200 | 205 | 6.00E-16 | Caenorhabditis elegans | Q21122 | K02B2.1Caenorhabditis elegans cosmid K02B2.Similar to 6-phosphofructo-2-kinase. |
| Contig352D | 5313316_c2_118 | 1773 | 4610 | 1413 | 471 | 245 | 6.90E-38 | Sulfolobus solfataricus | c283949 | orf c01010sugar transporterS.solfataricus 100 kbp DNA fragment. |
| Contig352D | 57217_c1_95 | 1774 | 4611 | 207 | 69 | | | | | |
| Contig352D | 582777_c2_103 | 1775 | 4612 | 1476 | 492 | 1405 | 8.00E-144 | Bacillus subtilis | P54596 | yhcLhypothetical proteinB.subtilis chromosomal DNA (region 75 degrees)similarity to the proton/sodium-glutamate symport |
| Contig352D | 6644537_f1_9 | 1776 | 4613 | 258 | 86 | | | | | |
| Contig352D | 6715_c3_139 | 1777 | 4614 | 510 | 170 | | | | | |
| Contig352D | 6728578_c2_120 | 1778 | 4615 | 1893 | 631 | 678 | 8.80E-67 | Bacillus subtilis | g2293178 | ytsDYtsDBacillus subtilis rmB-dnaB genomic region.similarity to NADH dehydrogenase |
| Contig352D | 7297338_f1_15 | 1779 | 4616 | 213 | 71 | | | | | |
| Contig352D | 9773385_c1_78 | 1780 | 4617 | 816 | 272 | 303 | 4.80E-27 | Escherichia coli | g2695682 | hpcG2-oxo-hept-4-ene-1,7-dioate hydrataseE.escherichia coli 2-oxo-hept-4-ene-1,7-dioate hydratase (hpcG) gene,complete cds.OHED hydratase |
| Contig352D | 9792842_c1_89 | 1781 | 4618 | 1851 | 617 | 1480 | 9.10E-152 | Bacillus subtilis | e1183103 | yidYItdIBacillus subtilis complete genome (section 6 of 21)similar to hypothetical proteins |
| Contig352D | 9854643_f2_52 | 1782 | 4619 | 237 | 79 | | | | | |

| Contig353D | 11886592_f3_38 | 1783 | 4620 | 654 | 218 | 481 | 6.60E-46 | Haemophilus influenzae | P44434 | HI0475phosphoribosyl-AMP cyclohydrolase (hisIE)Haemophilus influenzae from bases 492332 to 505971 (section 45 of163) of the complete genome.hisI bifunctional enzymesimilar to SP |
|---|---|---|---|---|---|---|---|---|---|---|
| Contig353D | 1207287_f3_36 | 1784 | 4621 | 621 | 207 | 365 | 1.30E-33 | Lactococcus lactis | Q02129 | hisGHisILactococcus lactis unknown gene, partial cds, and HisC (hisC),unknown, HisG (hisG), unknown, HisB (hisB), unknown, HisH (hish),HisA (hisA), HisF (hisF), HisIE (hisIE), unknown, unknown, LeuA(leuA), LeuB (leuB), LeuC (leuC), LeuD (leuD), unknown, I |
| Contig353D | 14480312_f2_15 | 1785 | 4622 | 1308 | 436 | 588 | 3.00E-57 | Bacillus subtilis | e1182798 | acoCacetoin dehydrogenase E2 componentBacillus subtilis complete genome (section 5 of 21)alternate gene name |
| Contig353D | 14662577_f1_7 | 1786 | 4623 | 537 | 179 | | | | | |
| Contig353D | 14725887_c2_53 | 1787 | 4624 | 183 | 61 | | | | | |
| Contig353D | 14851551_c3_64 | 1788 | 4625 | 993 | 331 | 1143 | 4.70E-116 | Lactococcus lactis | g2565150 | unknownLactococcus lactis unknown gene, partial cds, and HisC (hisC),unknown, HisG (hisG), unknown, HisB (hisB), unknown, HisH (hish),HisA (hisA), HisF (hisF), HisIE (hisIE), unknown, unknown, LeuA(leuA), LeuB (leuB), LeuC (leuC), LeuD (leuD), unknown, II |
| Contig353D | 14851713_f3_27 | 1789 | 4626 | 966 | 322 | 941 | 1.20E-94 | Bacillus subtilis | g2957146 | acoATPP-dependent acetoin dehydrogenase, E1Bacillus subtilis acetoin dehydrogenase enzyme system gene cluster,ribosomal protein L6-like protein gene, partial cds. TPP-dependentacetoin dehydrogenase, E1 alpha-subunit (acoA), TPP-dependentacetoin dehydrogen |

234

| | | | | | | | | | |
|---|---|---|---|---|---|---|---|---|---|
| Contig353D | 16689067_f2_23 | 1790 | 4627 | 597 | 199 | 470 | 9.70E-45 | Lactococcus lactis | Q02134 | hisBHisBLactococcus lactis unknown gene, partial cds, and HisC (hisC),unknown, HisG (hisG), unknown, HisB (hisB), unknown, HisH (hish),HisA (hisA), HisF (hisF), HisIE (hisIE), unknown, unknown, LeuA(leuA), LeuB (leuB), LeuC (leuC), LeuD (leuD), unknown,1 |
| Contig353D | 21563751_c2_54 | 1791 | 4628 | 237 | 79 | | | | | |
| Contig353D | 22656300_c1_41 | 1792 | 4629 | 1542 | 514 | 1225 | 9.50E-125 | Escherichia coli | P33940 | yojHyojH proteinE.coli genomic DNA, Kohara clone #373(49.5-49.9 min.),ORF_ID |
| Contig353D | 24070155_c1_40 | 1793 | 4630 | 495 | 165 | 279 | 1.70E-24 | Bacillus subtilis | e1183223 | yjdFhypothetical protein yjdFBacillus subtilis complete genome (section 7 of 21) |
| Contig353D | 24269812_c3_62 | 1794 | 4631 | 627 | 209 | 210 | 3.40E-17 | Helicobacter pylori | g2314454 | HP1286conserved hypothetical secreted proteinl[elicobacter pylori section 111 of 134 of the complete genome,similar to EGAD |
| Contig353D | 24640910_f3_28 | 1795 | 4632 | 519 | 173 | | | | | |
| Contig353D | 24652312_c3_65 | 1796 | 4633 | 1617 | 539 | 1125 | 3.80E-114 | Bacillus subtilis | P54417 | opuDputative transporterBacillus subtilis rrnB-dnaB genomic region,alternate gene name |
| Contig353D | 24797900_f2_20 | 1797 | 4634 | 213 | 71 | | | | | |
| Contig353D | 25510293_f2_12 | 1798 | 4635 | 972 | 324 | 877 | 7.20E-88 | Bacillus subtilis | e1184489 | ywtGmetabolite transport protein homolog ywtGBacillus subtilis complete genome (section 19 of 21)similar to metabolite transport protein |
| Contig353D | 25666427_c2_60 | 1799 | 4636 | 306 | 102 | | | | | |
| Contig353D | 26385928_c1_46 | 1800 | 4637 | 1437 | 479 | 1441 | 1.20E-147 | Bacillus subtilis | e1182747 | yflSyflSBacillus subtilis complete genome (section 5 of 21)similar to 2-oxoglutarate/malate translocator |
| Contig353D | 26600425_c2_50 | 1801 | 4638 | 792 | 264 | 220 | 3.00E-18 | Mus musculus | P50294 | NATlarylamine N-acetyltransferaseMus musculus arylamine N-acetyltransferase (NAT1) gene, completecds. |

| | | | | | | | | |
|---|---|---|---|---|---|---|---|---|
| Contig353D | 2266877_c1_39 | 1802 | 4639 | 450 | 150 | 285 | 3.90E-25 | Bacillus subtilis | d1020015 | ydalBacillus subtilis genome sequence, 148 kb sequence of the regionbetween 35 and 47 degree.PROBABLE TRANSCRIPTIONAL REGULATOR, SIMILAR TO LEU |
| Contig353D | 26751431_f1_4 | 1803 | 4640 | 1062 | 354 | 1037 | 8.00E-105 | Bacillus subtilis | g2245638 | acoBTPP-dependent acetoin dehydrogenase, E1Bacillus subtilis acetoin dehydrogenase enzyme system gene cluster,ribosomal protein L6-like protein gene, partial cds, TPP-dependentacetoin dehydrogenase, E1 alpha-subunit (acoA), TPP-dependentacetoin dehydrogen |
| Contig353D | 2819803_f1_2 | 1804 | 4641 | 363 | 121 | 192 | 2.80E-15 | Pseudomonas fluorescens | e308975 | FC2.2hypothetical proteinP.fluorescens FC2.1, FC2.2, FC2.3c, FC2.4 and FC2.5c open readingframes.similar to E. coli RarD (SP |
| Contig353D | 3009382_f1_1 | 1805 | 4642 | 531 | 177 | | | | | |
| Contig353D | 30360925_c1_47 | 1806 | 4643 | 642 | 214 | 204 | 1.60E-16 | Haemophilus influenzae | P44658 | III0357thiamine-repressed protein (nmt1) Haemophilus influenzae from bases 378525 to 389412 (section 35 of163) of the complete genome.similar to GP |
| Contig353D | 33988778_c1_43 | 1807 | 4644 | 660 | 220 | 636 | 2.50E-62 | Staphylococcus aureus | g790573 | peppyrrolidone carboxyl peptidaseStaphylococcus aureus pyrrolidone carboxyl peptidase (pcp) gene,complete cds.pyrase |
| Contig353D | 35449093_f3_35 | 1808 | 4645 | 831 | 277 | | | | | |
| Contig353D | 36214052_f1_6 | 1809 | 4646 | 999 | 333 | 169 | 1.10E-10 | Sulfolobus acidocaldarius | P46218 | Sulfolobus acidocaldarius RNA polymerase subunit homolog gene.complete cds.homologous to Swiss-Prot Accession Number P20435 |
| Contig353D | 36228252_f1_11 | 1810 | 4647 | 777 | 259 | 678 | 8.80E-67 | Bacillus subtilis | g2618870 | hisFcyclaseBacillus subtilis 300-304 degree genomic sequence.HisF protein |

| Contig353D | 36366326_f3_26 | 1811 | 4648 | 771 | 257 | 409 | 2.80E-38 | Bacillus subtilis | g3169320 | yojDYojDBacillus subtilis YojA (yojA), YojB (yojB), YojC (yojC), YojD(yojD), YojE (yojE), YojF (yojF), YojG (yojG), YojH (yojH), YojI (yojI), YojJ (yojJ), YojK (yojK), YojL (yojL), YojM (yojM), YojN(yojN), and YojO (yojO) genes, complete cds; and OdhA (odh |
|---|---|---|---|---|---|---|---|---|---|---|
| Contig353D | 4110712_f2_16 | 1812 | 4649 | 591 | 197 | | | | | |
| Contig353D | 4719827_f1_8 | 1813 | 4650 | 417 | 139 | | | | | |
| Contig353D | 4728187_f2_22 | 1814 | 4651 | 234 | 78 | | | | | |
| Contig353D | 5203452_f1_10 | 1815 | 4652 | 579 | 193 | 398 | 4.10E-37 | Lactococcus lactis | Q02132 | hishHisHLactococcus lactis unknown gene, partial cds, and HisC (hisC),unknown, HisG (hisG), unknown, HisB (hisB), unknown, HisH (hish),HisA (hisA), HisF (hisF), HisE (hisIE), unknown, unknown, LeuA(leuA), LeuB (leuB), LeuC (leuC), LeuD (leuD), unknown, 1 |
| Contig353D | 5963300_c1_45 | 1816 | 4653 | 504 | 168 | 114 | 7.40E-06 | Pyrococcus horikoshii | d1027672 | PHCK021192aa long hypothetical proteinPyrococcus horikoshii OT3 genomic DNA, 478722-509861 nt position,clone |
| Contig353D | 651527_f2_24 | 1817 | 4654 | 732 | 244 | 359 | 5.60E-33 | Synechocystis sp. | P74561 | hisAphosphoribosilformimino-5-amino-Synechocystis sp. PCC6803 complete genome, 26/27, 3270710-3418851.ORF_ID |
| Contig353D | 6745250_f3_30 | 1818 | 4655 | 207 | 69 | | | | | |
| Contig353D | 7243832_f3_25 | 1819 | 4656 | 1722 | 574 | 249 | 2.00E-18 | Methanococcus jannaschii | g1500527 | MJ1628M. jannaschii predicted coding region MJ1628Methanococcus jannaschii section 145 of 150 of the complete genome.hypothetical protein; identified by GeneMark; |
| Contig353D | 784387_f1_3 | 1820 | 4657 | 1425 | 475 | 769 | 2.00E-76 | Clostridium magnum | g472330 | dihydrolipoamide dehydrogenaseClostridium magnum acoR gene, complete cds; 1PP-dependent acetoindehydrogenase alpha and beta subunit (acoAB) genes, complete cds;acoX gene, complete cds,and dihydrolipoamide acetyltransferase (acoCI), genes,complete cds. |

237

238

| | | | | | | | | | |
|---|---|---|---|---|---|---|---|---|---|
| Contig353D | 798838_f1_9 | 1821 | 4658 | 1260 | 420 | 845 | 1.80E-84 | Aquifex aeolicus | g2983343 | hisDhistidinol dehydrogenaseAquifex aeolicus section 39 of 109 of the complete genome. |
| Contig354D | 10240925_c3_196 | 1822 | 4659 | 252 | 84 | | | | | |
| Contig354D | 10553827_c1_151 | 1823 | 4660 | 216 | 72 | 128 | 1.70E-08 | Bacillus subtilis | e1182777 | yfkKYfkKBacillus subtilis complete genome (section 5 of 21) |
| Contig354D | 11125052_c2_173 | 1824 | 4661 | 1497 | 499 | 1715 | 1.10E-176 | Bacillus subtilis | e1184252 | yueKnicotinate phosphoribosyltransferase homolog yueKBacillus subtilis complete genome (section 17 of 21)similar to nicotinate phosphoribosyltransferase |
| Contig354D | 11755317_c1_148 | 1825 | 4662 | 759 | 253 | 135 | 3.70E-07 | Bacillus subtilis | e1249815 | yvqFYvqF proteinBacillus subtilis 42.7kB DNA fragment from yvsA to yvqA. |
| Contig354D | 117687_c2_175 | 1826 | 4663 | 1377 | 459 | 1704 | 1.70E-175 | Bacillus subtilis | P12047 | purBadenylosuccinate lyaseB.subtilis pur operon encoding purine biosynthesis enzymes, 12genes.fumarate hydrataseadenylosuccinate lyase (PUR-B) |
| Contig354D | 1214075_f2_59 | 1827 | 4664 | 507 | 169 | 309 | 1.10E-27 | Haemophilus influenzae | P43707 | HI1384ferritin like protein (rsgA)Haemophilus influenzae from bases 1479577 to 1492547 (section 134of 163) of the complete genome.similar to SP |
| Contig354D | 12603166_f2_51 | 1828 | 4665 | 303 | 101 | 100 | 1.60E-05 | Pyrococcus horikoshii | d1027339 | PHBW01210 6aa long hypothetical proteinPyrococcus horikoshii OT3 genomic DNA, 180023-216005 nt position,clone |
| Contig354D | 1287557_f3_98 | 1829 | 4666 | 213 | 71 | | | | | |
| Contig354D | 13678131_f2_83 | 1830 | 4667 | 840 | 280 | 299 | 1.30E-26 | Bacillus subtilis | e1182580 | ydiLhypothetical protein ydiLBacillus subtilis complete genome (section 4 of 21)transmembrane |
| Contig354D | 1377337_c1_152 | 1831 | 4668 | 840 | 280 | 602 | 9.90E-59 | Staphylococcus aureus | g310603 | Staphylococcus aureus DNA sequence encoding three ORFs, completeds; prophage phi-11 sequence homology, 5' flank. |
| Contig354D | 13837927_c3_206 | 1832 | 4669 | 1155 | 385 | 621 | 9.60E-61 | Staphylococcus aureus | P06696 | tnpAtnpA proteinStaphylococcus aureus transposon Tn554(aa 1-361) |

239

| | | | | | | | | |
|---|---|---|---|---|---|---|---|---|
| Contig354D | 13851088_c1_128 | 1833 | 4670 | 1089 | 363 | 185 | 5.10E-14 | Caenorhabditis elegans | g1947171 | E03H12.5Caenorhabditis elegans cosmid E03H12.coded for by C. elegans cDNA yk170g3.5 |
| Contig354D | 1385927_c2_176 | 1834 | 4671 | 711 | 237 | 851 | 4.10E-85 | Staphylococcus aureus | Q53726 | pcrAperB proteinStaphylococcus aureus helicase required for T181 replication (pcrA)gene, complete cds. |
| Contig354D | 1414005_c2_191 | 1835 | 4672 | 579 | 193 | 324 | 2.90E-29 | Bacillus subtilis | e1182857 | ygaChypothetical 12.2 kd proteinBacillus subtilis complete genome (section 5 of 21) |
| Contig354D | 14581306_f2_76 | 1836 | 4673 | 303 | 101 | 115 | 4.00E-07 | Bacillus subtilis | e1183598 | yolDunknownBacillus subtilis complete genome (section 12 of 21)similar to hypothetical proteins from B. subtilis |
| Contig354D | 14714077_c2_177 | 1837 | 4674 | 1209 | 403 | 715 | 1.10E-70 | Bacillus subtilis | e1182643 | yerHYerH proteinBacillus subtilis complete genome (section 4 of 21) |
| Contig354D | 14883592_c2_168 | 1838 | 4675 | 2076 | 692 | 600 | 1.60E-58 | Clostridium butyricum | g436133 | hypothetical proteinC.butyricum transposon containing tbcC gene.product is similar to TnpB of transposon Tn554 from |
| Contig354D | 15044130_c3_220 | 1839 | 4676 | 249 | 83 | | | | | |
| Contig354D | 15121077_c2_178 | 1840 | 4677 | 1476 | 492 | 1626 | 3.10E-167 | Bacillus subtilis | e1182648 | yetMamidase homolog yerMBacillus subtilis complete genome (section 4 of 21)alternate gene name |
| Contig354D | 16219007_f2_74 | 1841 | 4678 | 921 | 307 | 1319 | 1.00E-134 | Enterococcus faecalis | P00807 | blaZbeta-lactamaseE.faecalis beta-lactamase mRNA, complete cds.beta-lactamase Ibeta-lactamase (aa 1-281) |
| Contig354D | 16677343_c2_162 | 1842 | 4679 | 447 | 149 | 111 | 1.10E-06 | Methanococcus jannaschii | Q57803 | MJ0357M_jannaschii predicted coding region MJ0357Methanococcus jannaschii section 31 of 150 of the complete genome.hypothetical protein; identified by GeneMark; |
| Contig354D | 16695300_f2_54 | 1843 | 4680 | 1113 | 371 | 586 | 4.90E-57 | Bacillus subtilis | e1182859 | ygaEhypothetical 40.7 kd proteinBacillus subtilis complete genome (section 5 of 21) |
| Contig354D | 19536693_c1_143 | 1844 | 4681 | 318 | 106 | 232 | 1.60E-19 | Bacillus subtilis | g2589194 | gatCGlu-tRNAGln amidotransferase subunit CBacillus subtilis Glu-tRNAGln amidotransferase subunits C (gatC), A(gatA) and B (gatB) genes, complete cds.similar to Synechocystis sp. hypothetical protein. |

| Contig354D | 1958183_f3_119 | 1845 | 4682 | 648 | 216 | 943 | 7.30E-95 | Staphylococcus epidermidis | g2981297 | agrBAgrBStaphylococcus epidermidis agr system including response regulator(agrA), histidine kinase (agrC), AgrD (agrD), AgrB (agrB) and deltatoxin (hld) genes, complete cds.required for peptide pheromone production; similar |
|---|---|---|---|---|---|---|---|---|---|---|
| Contig354D | 1972278_f2_53 | 1846 | 4683 | 300 | 100 | 316 | 2.00E-28 | Bacillus subtilis | e1182860 | gsaBglutamate-1-semialdehyde aminotransferaseBacillus subtilis complete genome (section 5 of 21) |
| Contig354D | 1988811_c1_154 | 1847 | 4684 | 1083 | 361 | 779 | 1.70E-77 | Bacillus subtilis | e1182852 | yfhQYfhQBacillus subtilis complete genome (section 5 of 21).similar to A/G-specific adenine glycosylase |
| Contig354D | 19957567_c3_222 | 1848 | 4685 | 291 | 97 | 94 | 7.30E-05 | Mitochondrion Cepaea nemoralis | g881925 | NADH dehydrogenase subunit 6Cepaea nemoralis complete mitochondrial genome.followed by putative incomplete stop codon 'TA' |
| Contig354D | 20344411_c3_198 | 1849 | 4686 | 336 | 112 | 440 | 1.50E-41 | Staphylococcus epidermidis | P48227 | hsp10heat shock protein 10Staphylococcus epidermidis 9759 heat shock protein 10 (hsp10) andheat shock protein 60 (hsp60) genes, complete cds. |
| Contig354D | 2037838_f1_29 | 1850 | 4687 | 249 | 83 | 122 | 7.30E-08 | Pyrococcus horikoshii | d1027966 | PHA1.027134aa long hypothetical proteinPyrococcus horikoshii OT3 genomic DNA, 734966-774775 nt position,clone |
| Contig354D | 20706500_f1_40 | 1851 | 4688 | 339 | 113 | 158 | 1.10E-11 | Kinetoplast Bodo saltans | g3037018 | ND5NADH dehydrogenase subunit 5Bodo saltans NADH dehydrogenase subunit 5 (ND5) mRNA, kinetoplastigene encoding kinetoplast protein, partial cds,partially edited mRNA |
| Contig354D | 20735686_f3_108 | 1852 | 4689 | 957 | 319 | 853 | 2.50E-85 | Bacillus subtilis | P37487 | yybQunknownB. subtilis DNA, 180 kilobase region of replication origin,similar to hypothetical proteins |
| Contig354D | 20881510_c3_199 | 1853 | 4690 | 492 | 164 | 213 | 1.70E-17 | Bacillus subtilis | g2293169 | ytrAtranscription regulatorBacillus subtilis rrnB-dnaB genomic region.similar to transcriptional regulator (GntR family) |

| | | | | | | | | |
|---|---|---|---|---|---|---|---|---|
| Contig354D | 21616078_c2_174 | 1854 | 4691 | 192 | 64 | 135 | 3.00E-09 | Bacillus subtilis | g2239294 | yebGiunknownBacillus subtilis CotA (cotA), GabP (gabP), YeaB (yeaB), YeaC(yeaC), YebA (ycbA), GMP synthetase (guaA) genes, complete cds, and AIR carboxylase I (purE) gene, partial cds.yebG |
| Contig354D | 21676433_c1_138 | 1855 | 4692 | 1137 | 379 | 192 | 2.80E-12 | Streptomyces coelicolor | e1292355 | SC1A6.07chypothetical protein SC1A6.07cStreptomyces coelicolor cosmid 1A6.SC1A6.07c, unknown, len |
| Contig354D | 22289077_c3_203 | 1856 | 4693 | 546 | 182 | | | | | |
| Contig354D | 23438461_c2_163 | 1857 | 4694 | 687 | 229 | | | | | |
| Contig354D | 23495437_f1_39 | 1858 | 4695 | 1305 | 435 | 1004 | 2.50E-101 | Bacillus circulans | e216734 | aspATAspartate aminotransferaseB.circulans aspartate aminotransferase gene. |
| Contig354D | 23572125_c3_224 | 1859 | 4696 | 534 | 178 | 393 | 1.40E-36 | Bacillus subtilis | P49851 | YKHABacillus subtilis hmp DNA for 7 ORI's, complete cds.low homology to P14 protein of Heamophilus |
| Contig354D | 23595386_c2_193 | 1860 | 4697 | 627 | 209 | 271 | 1.20E-23 | Bacillus subtilis | e1186156 | yvcIglycerate dehydrogenase homolog yvcTBacillus subtilis complete genome (section 18 of 21)similar to glycerate dehydrogenase |
| Contig354D | 23629202_c2_170 | 1861 | 4698 | 381 | 127 | 598 | 2.60E-58 | Staphylococcus aureus | P18415 | blaIbeta-lactamase repressorS.aureus Tn552 transposable element.regulatory protein blaIblaI protein (AA 1-126) |
| Contig354D | 23672562_c2_161 | 1862 | 4699 | 297 | 99 | | | | | |
| Contig354D | 23727212_f1_12 | 1863 | 4700 | 303 | 101 | | | | | |
| Contig354D | 23727250_f2_72 | 1864 | 4701 | 1395 | 465 | 1167 | 1.30E-118 | Bacillus subtilis | P39616 | ipa-58raldehyde dehydrogenase homolog ywdHB.subtilis genomic region (325 to 333).alternate gene name |
| Contig354D | 23850907_f3_116 | 1865 | 4702 | 201 | 67 | | | | | |
| Contig354D | 24218791_f3_107 | 1866 | 4703 | 588 | 196 | 525 | 1.40E-50 | Bacillus subtilis | e1184253 | yueJpyrazinamidase/nicotinamidase homolog yueJBacillus subtilis complete genome (section 17 of 21)similar to pyrazinamidase/nicotinamidase |

241

242

| | | | | | | | | |
|---|---|---|---|---|---|---|---|---|
| Contig354D | 24257827_c3_200 | 1867 | 4704 | 387 | 129 | | | |
| Contig354D | 24353382_c1_127 | 1868 | 4705 | 1623 | 541 | 2592 | 1.30E-269 | Staphylococcus epidermidis | g535342 | hsp60heat shock protein 60Staphylococcus epidermidis 9759 heat shock protein 10 (hsp10) andheat shock protein 60 (hsp60) genes, complete cds. |
| Contig354D | 24407787_c2_192 | 1869 | 4706 | 354 | 118 | | | |
| Contig354D | 24415942_c3_205 | 1870 | 4707 | 840 | 280 | | | |
| Contig354D | 24429688_c2_158 | 1871 | 4708 | 327 | 109 | | | |
| Contig354D | 24885938_c1_140 | 1872 | 4709 | 642 | 214 | 302 | 6.10E-27 | Bacillus subtilis | g2229293 | yebFunknownBacillus subtilis CotA (cotA), GabP (gabP), YeaB (yeaB), YcaC(yeaC), YebA (yebA), GMP synthetase (guaA) genes, complete cds, andAIR carboxylase I (purE) gene, partial cds.yebF |
| Contig354D | 25428507_c2_182 | 1873 | 4710 | 576 | 192 | | | |
| Contig354D | 25595387_f3_111 | 1874 | 4711 | 432 | 144 | 111 | 1.10E-06 | Bacillus subtilis | e1183598 | yoIDunknownBacillus subtilis complete genome (section 12 of 21)similar to hypothetical proteins from B. subtilis |
| Contig354D | 25603388_f3_120 | 1875 | 4712 | 1293 | 431 | 2112 | 9.70E-219 | Staphylococcus epidermidis | g2981295 | agrChistidine kinaseStaphylococcus epidermidis agr system including response regulator(agrA), histidine kinase (agrC), AgrD (agrD), AgrB (agrB) and deltatoxin (hld) genes, complete cds.AgrC; similar to S. aureus and S. lugdunensis AgrC |
| Contig354D | 256265_c3_221 | 1876 | 4713 | 1092 | 364 | 538 | 6.00E-52 | Bacillus subtilis | e1249816 | yvqFYvqE proteinBacillus subtilis 42.7kB DNA fragment from yvsA to yvqA.similar to two-component sensor histidine kinase |
| Contig354D | 25678438_c3_230 | 1877 | 4714 | 474 | 158 | 334 | 2.50E-30 | Aquifex aeolicus | g2983147 | aq_495hypothetical proteinAquifex aeolicus section 24 of 109 of the complete genome. |
| Contig354D | 25781392_f3_97 | 1878 | 4715 | 1029 | 343 | 225 | 4.80E-17 | Bacillus subtilis | e1182859 | ygaIhypothetical 40.7 kd proteinBacillus subtilis complete genome (section 5 of 21) |

| | | | | | | | | |
|---|---|---|---|---|---|---|---|---|
| Contig354D | 25790718_c3_211 | 1879 | 4716 | 315 | 105 | 349 | 6.40E-32 | Bacillus subtilis | g2465565 | yecDYecDBacillus subtilis phosphoribosylaminoimidazole-carboxamideformyltransferase (purH) gene, partial cds,phosphoribosylglycinamide synthetase (purD), YecA (yecA), putativeadenine deaminase (yecB), YecC (yecC), and YecD (yecD) genes,complete cds, and |
| Contig354D | 26177163_c2_185 | 1880 | 4717 | 1272 | 424 | 971 | 7.80E-98 | Bacillus subtilis | P39762 | ampSaminopeptidaseBacillus subtilis ampS-nprE gene region.similar to ampS gene with GenBank Accession Number |
| Contig354D | 26209577_f2_69 | 1881 | 4718 | 1068 | 356 | 892 | 1.80E-89 | Bacillus subtilis | e1182753 | yflMYflMBacillus subtilis complete genome (section 5 of 21)similar to nitric-oxide synthase |
| Contig354D | 26212875_c1_130 | 1882 | 4719 | 318 | 106 | | | | | |
| Contig354D | 26354787_c3_194 | 1883 | 4720 | 744 | 248 | | | | | |
| Contig354D | 26593808_f1_5 | 1884 | 4721 | 981 | 327 | 753 | 9.90E-75 | Bacillus subtilis | e1182851 | yfhPYfhPBacillus subtilis complete genome (section 5 of 21) |
| Contig354D | 26689703_c1_157 | 1885 | 4722 | 453 | 151 | 562 | 1.70E-54 | Bacillus subtilis | e1182862 | ygaGhypothetical 16.4 kd proteinBacillus subtilis complete genome (section 5 of 21)similar to transcriptional regulator (Fur family) |
| Contig354D | 26756500_c1_147 | 1886 | 4723 | 777 | 259 | 721 | 2.40E-71 | Bacillus subtilis | e1182759 | yflGYflGBacillus subtilis complete genome (section 5 of 21)similar to methionine aminopeptidase |
| Contig354D | 26757312_f2_58 | 1887 | 4724 | 1197 | 399 | 543 | 1.80E-52 | Bacillus subtilis | e1182780 | yfkHYfkHBacillus subtilis complete genome (section 5 of 21)similar to transporter |
| Contig354D | 2939187_f3_90 | 1888 | 4725 | 198 | 66 | | | | | |
| Contig354D | 2992943_c2_166 | 1889 | 4726 | 624 | 208 | 324 | 2.90E-29 | Bacillus subtilis | g2293170 | ytrBtransporterBacillus subtilis rmB-dnaB genomic region.similar to ABC transporter (ATP-binding protein) |
| Contig354D | 32037826_c2_180 | 1890 | 4727 | 1476 | 492 | 1119 | 1.60E-113 | Bacillus subtilis | e1182653 | yetARNA methyltransferase homolog yetABacillus subtilis complete genome (section 4 of 21)alternate gene name |
| Contig354D | 3251577_c1_141 | 1891 | 4728 | 2190 | 730 | 3095 | 0 | Staphylococcus aureus | Q53727 | pcrAhelicaseStaphylococcus aureus helicase required for T181 replication (pcrA)gene, complete cds. |

243

| | | | | | | | | |
|---|---|---|---|---|---|---|---|---|
| Contig354D | 32689162_f2_85 | 1892 | 4729 | 807 | 269 | 1384 | 1.30E-141 | Staphylococcus epidermidis | g2981299 | orf5unknownStaphylococcus epidermidis agr system including response regulator(agrA), histidine kinase (agrC), AgrD (agrD), AgrB (agrB) and deltatoxin (hld) genes, complete cds.similar to S. aureus and S. lugdunensis orf5 |
| Contig354D | 32696088_c3_228 | 1893 | 4730 | 1749 | 583 | 1899 | 3.60E-196 | Bacillus subtilis | e1182858 | ygaDunidentified transporter-ATP bindingBacillus subtilis complete genome (section 5 of 21)similar to ABC transporter (ATP-binding protein) |
| Contig354D | 33631292_c2_183 | 1894 | 4731 | 414 | 138 | | | | | |
| Contig354D | 3392952_c2_160 | 1895 | 4732 | 591 | 197 | 195 | 1.30E-15 | Bacteriophage phig1e | e247149 | Rorf172Lactobacillus bacteriophage phig1e complete genomic DNA. |
| Contig354D | 34275325_c3_227 | 1896 | 4733 | 1521 | 507 | 238 | 4.20E-17 | Bacillus subtilis | P42954 | tagHATP-binding proteinBacillus subtilis 168 highly hydrophobic integral membrane protein(tagG) gene and ATP-binding protein (tagH) gene, complete cds. |
| Contig354D | 34383400_c1_131 | 1897 | 4734 | 582 | 194 | | | | | |
| Contig354D | 34572177_c3_202 | 1898 | 4735 | 735 | 245 | 147 | 1.20E-08 | Staphylococcus epidermidis | g459263 | membrane spanning protein (putative)S.epidermidis (968) genes for potential ABC transporter andpotential membrane spanning protein. |
| Contig354D | 34652177_c1_149 | 1899 | 4736 | 648 | 216 | 546 | 8.50E-53 | Bacillus subtilis | e1249817 | yvqCYvqC proteinBacillus subtilis 42.7kB DNA fragment from yvsA to yvqA.similar to two-component response regulator [YvqE |
| Contig354D | 35443785_c3_219 | 1900 | 4737 | 207 | 69 | | | | | |
| Contig354D | 35885_f2_78 | 1901 | 4738 | 504 | 168 | | | | | |
| Contig354D | 36119093_c1_142 | 1902 | 4739 | 2001 | 667 | 2102 | 1.10E-217 | Bacillus subtilis | e1182642 | yerGDNA ligase homolog yerGBacillus subtilis complete genome (section 4 of 21)similar to DNA ligase |

245

| | | | | | | | | |
|---|---|---|---|---|---|---|---|---|
| Contig354D | 36195250_f2_70 | 1903 | 4740 | 822 | 274 | 375 | 1.10E-34 | Methanococcus jannaschii | Q58054 | MJ0637 chorismate mutase/prephenate dehydratase (pheA) Methanococcus jannaschii section 53 of 150 of the complete genome. prephenate dehydratase homology similar to SP |
| Contig354D | 36219692_c1_145 | 1904 | 4741 | 561 | 187 | 133 | 2.00E-08 | Streptococcus sobrinus | d1003084 | parrepressor protein Streptococcus sobrinus gene for repressor protein of surfaceprotein antigen gene (pag), complete cds. This ORF2 starts at the GTG codon (position 1162) |
| Contig354D | 36220000_c3_207 | 1905 | 4742 | 1047 | 349 | 557 | 5.80E-54 | Bacillus subtilis | e1181502 | ykgBYkg3Bacillus subtilis 168 56 kb DNA fragment between xlyA and ykoR.similar to hypothetical proteins |
| Contig354D | 36367302_c1_123 | 1906 | 4743 | 564 | 188 | 122 | 2.30E-06 | Methanococcus jannaschii | Q57805 | MJ0359M. jannaschii predicted coding region MJ0359 Methanococcus jannaschii section 31 of 150 of the complete genome. hypothetical protein; identified by GeneMark; |
| Contig354D | 36522175_f3_102 | 1907 | 4744 | 1557 | 519 | 2240 | 2.60E-232 | Staphylococcus aureus | g2565311 | putPhigh affinity proline permease Staphylococcus aureus high affinity proline permease (putP) gene, complete cds. |
| Contig354D | 39077_f1_42 | 1908 | 4745 | 717 | 239 | 1223 | 1.60E-124 | Staphylococcus epidermidis | g2981294 | agrAresponse regulator Staphylococcus epidermidis agr system including response regulator(agrA), histidine kinase (agrC), AgrD (agrD), AgrB (agrB) and deltatoxin (hld) genes, complete cds.AgrA; similar to S. aureus and S. lugdunensis AgrA |
| Contig354D | 3939013_c3_225 | 1909 | 4746 | 210 | 70 | 109 | 1.70E-06 | Bacillus subtilis | e1182787 | yfjfYfjfBacillus subtilis complete genome (section 5 of 21) |
| Contig354D | 3942015_c2_187 | 1910 | 4747 | 528 | 176 | 790 | 1.20E-78 | Staphylococcus aureus | g310602 | Staphylococcus aureus DNA sequence encoding three ORFs, complete cds; prophage phi-11 sequence homology, 5' flank. |
| Contig354D | 4021888_c1_129 | 1911 | 4748 | 669 | 223 | | | | | |
| Contig354D | 4062500_c3_197 | 1912 | 4749 | 1401 | 467 | 488 | 9.70E-46 | Staphylococcus aureus | g397526 | clumping factorS.aureus gene for clumping factor. |
| Contig354D | 4089763_f3_95 | 1913 | 4750 | 501 | 167 | 358 | 7.10E-33 | Bacillus subtilis | e1182778 | yfkJYfkJBacillus subtilis complete genome (section 5 of 21) similar to protein-tyrosine phosphatase |

246

| | | | | | | | | | |
|---|---|---|---|---|---|---|---|---|---|
| Contig354D | 4095277_c1_135 | 1914 | 4751 | 1827 | 609 | 2760 | 2.10E-287 | Staphylococcus aureus | g152966 | blaR1bla regulator protein blaR1Staphylococcus aureus blaZ gene, 5' end; blaR1 gene, complete cds;blaI gene, complete cds; and binR gene, 5' end,beta-lactamase OXA2 homology |
| Contig354D | 4101517_f3_113 | 1915 | 4752 | 1068 | 356 | | | | | |
| Contig354D | 4179637_c1_133 | 1916 | 4753 | 387 | 129 | 207 | 7.10E-17 | Staphylococcus aureus | P06698 | tnpC pol. tnpC proteinStaphylococcus aureus transposon Tn554.(aa 1-125) |
| Contig354D | 430325_c2_181 | 1917 | 4754 | 1383 | 461 | 522 | 3.00E-50 | Synechocystis sp. | d1019130 | hypothetical proteinSynechocystis sp. PCC6803 complete genome, 16/27, 1991550-2137258.ORF_ID |
| Contig354D | 4689130_f1_43 | 1918 | 4755 | 306 | 102 | | | | | |
| Contig354D | 4722265_c2_188 | 1919 | 4756 | 858 | 286 | 416 | 5.10E-39 | Bacillus subtilis | c1182842 | yfhGYfhGBacillus subtilis complete genome (section 5 of 21) |
| Contig354D | 4726566_f1_18 | 1920 | 4757 | 582 | 194 | 155 | 2.30E-11 | Aquifex aeolicus | g2983450 | dnaQDNA polymerase III epsilon subunitAquifex aeolicus section 46 of 109 of the complete genome. |
| Contig354D | 4728377_f1_10 | 1921 | 4758 | 1146 | 382 | 544 | 1.40E-52 | Bacillus subtilis | c1182785 | yfkBYfkBBacillus subtilis complete genome (section 5 of 21) |
| Contig354D | 4900443_c2_179 | 1922 | 4759 | 1440 | 480 | 2460 | 1.30E-255 | Bacillus subtilis | Q45486 | YZIDPET112-like proteinBacillus subtilis PET112-like protein gene, complete cds. |
| Contig354D | 5167268_c1_146 | 1923 | 4760 | 1080 | 360 | 613 | 6.80E-60 | Escherichia coli | Q47155 | dinPhypothetical protein DinPEscherichia coli K-12 MG1655 section 21 of 400 of the completegenome.o351: 100 pct identical to GB |
| Contig354D | 5860052_f2_80 | 1924 | 4761 | 435 | 145 | 107 | 2.80E-06 | Pyrococcus horikoshii | d1028904 | PHCY019133aa long hypothetical proteinPyrococcus horikoshii OT3 genomic DNA, 1552268-1595600 nt position,clone |
| Contig354D | 6053308_c3_210 | 1925 | 4762 | 903 | 301 | 815 | 2.70E-81 | Escherichia coli | P18843 | nadF, efg, ntrL_NH(3)-dependent NAD(+) synthetase (EC 6.3.5.1)E.coli genomic DNA, Kohara clone #326(39.1-39.4 min.).spore outgrowth factor BORF_ID |
| Contig354D | 6147252_c2_189 | 1926 | 4763 | 846 | 282 | 150 | 1.30E-08 | Bacillus subtilis | P42953 | tagGhighly hydrophobic integral membrane proteinBacillus subtilis 168 highly hydrophobic integral membrane protein(tagG) gene and ATP-binding protein (tagH) gene, complete cds. |

| | | | | | | | | |
|---|---|---|---|---|---|---|---|---|
| Contig354D | 632661_c3_218 | 1927 | 4764 | 777 | 259 | 301 | 7.80E-27 | Mycobacterium tuberculosis | e1264573 | MTV025.061hypothetical protein MTV025.061Mycobacterium tuberculosis sequence v025.MTV025.061. len |
| Contig354D | 6682627_c1_125 | 1928 | 4765 | 357 | 119 | 123 | 5.70E-08 | Paramecium bursaria Chlorella virus 1 | g624123 | a58LParamecium bursaria Chlorella virus 1. complete genome.contains Gln-, Gln-rich regions |
| Contig354D | 6829687_c3_201 | 1929 | 4766 | 618 | 206 | 355 | 1.50E-32 | Staphylococcus aureus | g459256 | stpCPotential ABC transporterS.aureus (RN4220) genes for potential ABC transporter and potentialmembrane spanning protein. |
| Contig354D | 6931261_c2_159 | 1930 | 4767 | 537 | 179 | 128 | 1.70E-08 | Staphylococcus aureus | g2689551 | Staphylococcus aureus toxic shock syndrome toxin-1 (tst),enterotoxin (ent), and integrase (int) genes, complete cds.orf4 |
| Contig354D | 7164087_c3_226 | 1931 | 4768 | 333 | 111 | 217 | 6.20E-18 | Bacillus subtilis | e1182843 | yfhHYfhHBacillus subtilis complete genome (section 5 of 21) |
| Contig354D | 7207518_f1_41 | 1932 | 4769 | 375 | 125 | 151 | 6.10E-11 | Glycine max | B27059 | hypothetical protein 2 |
| Contig354D | 799188_f3_118 | 1933 | 4770 | 468 | 156 | 202 | 7.60E-15 | Plasmodium falciparum | g9826 | 11-111-1 polypeptidePlasmodium falciparum 11-1 gene part 1. |
| Contig354D | 820325_f1_3 | 1934 | 4771 | 948 | 316 | 1131 | 8.70E-115 | Bacillus subtilis | P71084 | gsaBglutamate-1-semialdehyde aminotransferaseB.subtilis 25 kb genomic DNA segment (from sspE to katA). |
| Contig354D | 959635_f2_55 | 1935 | 4772 | 294 | 98 | 98 | 7.30E-05 | TRYPANOSOMA BRUCEI BRUCEI | P24499 | MURF4ATP SYNTHASE A CHAIN, (PROTEIN 6) |
| Contig354D | 979712_c2_169 | 1936 | 4773 | 1422 | 474 | | | | | |
| Contig354D | 985678_c1_144 | 1937 | 4774 | 975 | 325 | 889 | 3.80E-89 | Bacillus subtilis | e1182652 | yerQconserved hypothetical protein yerQBacillus subtilis complete genome (section 4 of 21)similar to hypothetical proteins |
| Contig355D | 110972150_c3_125 | 1938 | 4775 | 2055 | 685 | 3024 | 0 | Staphylococcus aureus | d1025491 | recGRecGStaphylococcus aureus recG gene, complete cds. |
| Contig355D | 114626_f3_61 | 1939 | 4776 | 207 | 69 | | | | | |
| Contig355D | 1204567_c2_104 | 1940 | 4777 | 750 | 250 | 481 | 6.60E-46 | Bacillus subtilis | e1185167 | yloOputative PtcI proteinBacillus subtilis complete genome (section 9 of 21)similar to hypothetical proteins |

247

| | | | | | | | | |
|---|---|---|---|---|---|---|---|---|
| Contig355D | 1209638_c1_80 | 1941 | 4778 | 540 | 180 | 642 | 5.70E-63 | Staphylococcus aureus | P31024 | lspprolipoprotein signal peptidaseStaphylococcus aureus prolipoprotein signal peptidase (lsp) gene.complete cds.lipoprotein signal peptidase |
| Contig355D | 13720312_c3_119 | 1942 | 4779 | 240 | 80 | 117 | 2.50E-07 | Bacillus subtilis | e1185160 | yloIputative rpoZ proteinBacillus subtilis complete genome (section 9 of 21) |
| Contig355D | 1376317_c2_98 | 1943 | 4780 | 564 | 188 | 481 | 6.60E-46 | Lactobacillus plantarum | e199384 | pyrRL.plantarum pyrimidine biosynthetic operon (pyrR, pyrB, pyrC,pyrAA, pyrAB, pyrD, pyrF, and pyrE) genes. |
| Contig355D | 19557752_c1_81 | 1944 | 4781 | 912 | 304 | 844 | 2.30E-84 | Bacillus subtilis | P05654 | pyrBaspartate transcarbamylaseB.subtilis pyrB gene encoding aspartate transcarbamoylase, completecds.ornithine carbamoyltransferaseaspartate transcarbamoylase (EC 2.1.3.2) |
| Contig355D | 209840_f1_10 | 1945 | 4782 | 195 | 65 | | | | | |
| Contig355D | 2244938_c3_112 | 1946 | 4783 | 933 | 311 | 1055 | 9.80E-107 | Bacillus subtilis | Q45480 | YLYBBacillus subtilis signal peptidase II (lsp) gene, complete cds.isoleucyl-tRNA synthetase (ileS) and pyrR genes, partial cds.orf-X; hypothetical protein; Method |
| Contig355D | 22461078_c1_79 | 1947 | 4784 | 735 | 245 | 814 | 3.40E-81 | Staphylococcus aureus | g1314301 | OKIunknownStaphylococcus aureus isoleucyl-tRNA synthetase (ileS) gene,partial cds. |
| Contig355D | 22462802_c3_120 | 1948 | 4785 | 1203 | 401 | 1070 | 2.50E-108 | Bacillus subtilis | e1185161 | yloIputative Dfp proteinBacillus subtilis complete genome (section 9 of 21)similar to pantothenate metabolism flavoprotein |
| Contig355D | 23492327_f1_8 | 1949 | 4786 | 204 | 68 | 126 | 2.70E-08 | Synechocystis sp. | d1011491 | clpPhypothetical proteinSynechocystis sp. PCC6803 complete genome, 25/27, 3138604-3270709.ORF_ID |
| Contig355D | 23572253_c1_92 | 1950 | 4787 | 741 | 247 | 623 | 5.90E-61 | Bacillus subtilis | e1185184 | rncSribonuclease IIIBacillus subtilis complete genome (section 9 of 21)alternate gene name |
| Contig355D | 23632962_c2_97 | 1951 | 4788 | 810 | 270 | 270 | 1.50E-23 | Bacillus subtilis | P54721 | yflfunknownBacillus subtilis complete genome (section 5 of 21)similar to hypothetical proteins from B. subtilis |

| | | | | | | | | |
|---|---|---|---|---|---|---|---|---|
| Contig355D | 23642217_c1_88 | 1952 | 4789 | 648 | 216 | 396 | 6.70E-37 | Bacillus subtilis | e1185171 | yloSYloS proteinBacillus subtilis complete genome (section 9 of 21) |
| Contig355D | 23647178_c2_106 | 1953 | 4790 | 633 | 211 | 398 | 4.10E-37 | Bacillus subtilis | e1185179 | ylpCYlpC proteinBacillus subtilis complete genome (section 9 of 21) |
| Contig355D | 23650293_c1_85 | 1954 | 4791 | 627 | 209 | 693 | 2.30E-68 | Bacillus subtilis | e1185159 | yloDputative Gmk proteinBacillus subtilis complete genome (section 9 of 21)similar to guanylate kinase |
| Contig355D | 23836036_c2_100 | 1955 | 4792 | 192 | 64 | 153 | 9.70E-10 | Bacillus caldolyticus | P46537 | PyrAbcarbamoyl-phosphate synthaseB.caldolyticus pyrimidine biosynthesis genes.carbamoyl-phosphate synthase (glutamine-hydrolyzing) large chain |
| Contig355D | 24240676_f3_62 | 1956 | 4793 | 246 | 82 | | | | | |
| Contig355D | 24297217_c1_82 | 1957 | 4794 | 3114 | 1038 | 3756 | 0 | Bacillus caldolyticus | P46537 | PyrAbcarbamoyl-phosphate synthaseB.caldolyticus pyrimidine biosynthesis genes.carbamoyl-phosphate synthase (glutamine-hydrolyzing) large chain |
| Contig355D | 24355342_c1_95 | 1958 | 4795 | 1014 | 338 | 1265 | 5.50E-129 | Bacillus subtilis | P37105 | ffhsignal recognition particleBacillus subtilis complete genome (section 9 of 21) |
| Contig355D | 24406291_c2_105 | 1959 | 4796 | 417 | 139 | 369 | 4.90E-34 | Bacillus subtilis | e1185174 | yloUputative Asp23 proteinBacillus subtilis complete genome (section 9 of 21)similar to alkaline-shock protein |
| Contig355D | 24407327_c3_117 | 1960 | 4797 | 612 | 204 | 623 | 5.90E-61 | Bacillus subtilis | A30492 | pyrEorotate phosphoribosyltransferase,orotate phosphoribosyltransferase |
| Contig355D | 24407936_c2_103 | 1961 | 4798 | 1122 | 374 | 1380 | 3.60E-141 | Bacillus subtilis | e1185166 | yloNYloN proteinBacillus subtilis complete genome (section 9 of 21)similar to hypothetical proteins |
| Contig355D | 24422077_c3_115 | 1962 | 4799 | 1101 | 367 | 1196 | 1.10E-121 | Bacillus caldolyticus | P52557 | PyrAacarbamoyl-phosphate synthaseB.caldolyticus pyrimidine biosynthesis genes.carbamoyl-phosphate synthase (glutamine-hydrolyzing) small chain homology |
| Contig355D | 24424038_c1_89 | 1963 | 4800 | 1692 | 564 | 1538 | 6.50E-158 | Bacillus subtilis | e1185175 | yloVYloV proteinBacillus subtilis complete genome (section 9 of 21)similar to hypothetical proteins |
| Contig355D | 24609637_c3_108 | 1964 | 4801 | 798 | 266 | 445 | 4.30E-42 | Bacillus subtilis | e1185129 | ylmDconserved hypothetical protein ylmDBacillus subtilis complete genome (section 9 of 21)similar to hypothetical proteins |

250

| | | | | | | | | | |
|---|---|---|---|---|---|---|---|---|---|
| Contig355D | 24633827_c1_86 | 1965 | 4802 | 963 | 321 | 917 | 4.10E-92 | Bacillus subtilis | e1185164 | fmtmethionyl-tRNA formyltransferaseBacillus subtilis complete genome (section 9 of 21)alternate gene name |
| Contig355D | 24645025_c3_114 | 1966 | 4803 | 1284 | 428 | 1287 | 2.60E-131 | Bacillus caldolyticus | P46538 | PyrCdihydroorotaseB.caldolyticus pyrimidine biosynthesis genes.Bacillus dihydroorotase |
| Contig355D | 24648412_c1_94 | 1967 | 4804 | 402 | 134 | 302 | 6.10E-27 | Bacillus subtilis | P37104 | ylxMORF1Bacillus subtilis complete genome (section 9 of 21)similar to hypothetical proteins |
| Contig355D | 25635962_c3_111 | 1968 | 4805 | 486 | 162 | 274 | 5.70E-24 | Staphylococcus aureus | e244971 | S.aureus orfs 1,2,3 & 4.ORF1 |
| Contig355D | 25816552_c3_109 | 1969 | 4806 | 777 | 259 | 468 | 1.60E-44 | Bacillus subtilis | gl518679 | ylmIIcell-division protein homolog ylmIIBacillus subtilis minicell-associated protein (divIVA) gene,complete cds, and isoleucyl-tRNA-synthetase (ilcS) gene, partialcds.orf' |
| Contig355D | 26423305_c1_78 | 1970 | 4807 | 336 | 112 | 226 | 6.90E-19 | Bacillus subtilis | e1185132 | ylmGconserved hypothetical protein ylmGBacillus subtilis complete genome (section 9 of 21)similar to hypothetical proteins |
| Contig355D | 26598402_c3_113 | 1971 | 4808 | 1314 | 438 | 1251 | 1.70E-127 | Bacillus caldolyticus | P41006 | pyrPuracil permeaseB.caldolyticus (DSM405)pyrR, pyrP and pyrB (partial) genes. |
| Contig355D | 26614167_c1_91 | 1972 | 4809 | 240 | 80 | 238 | 3.70E-20 | Bacillus subtilis | P80643 | acpAacyl carrier proteinBacillus subtilis complete genome (section 9 of 21)acyl carrier proteinalternate gene name |
| Contig355D | 29320217_f2_32 | 1973 | 4810 | 207 | 69 | | | | | |
| Contig355D | 30656300_c3_122 | 1974 | 4811 | 1353 | 451 | 912 | 1.40E-91 | Bacillus subtilis | e1185165 | yloMputative Fmu proteinBacillus subtilis complete genome (section 9 of 21)alternate gene name |
| Contig355D | 3314128_f2_23 | 1975 | 4812 | 234 | 78 | | | | | |
| Contig355D | 34017812_f3_63 | 1976 | 4813 | 1722 | 574 | 1369 | 5.20E-140 | Bacillus subtilis | e332190 | yloAputative fibronectin-binding proteinBacillus subtilis pyrE to yloA gene region.protein A-like |
| Contig355D | 34642213_c2_96 | 1977 | 4814 | 615 | 205 | 328 | 1.10E-29 | Bacillus subtilis | e1185131 | ylmFconserved hypothetical protein ylmFBacillus subtilis complete genome (section 9 of 21)similar to hypothetical proteins |
| Contig355D | 34650452_c1_83 | 1978 | 4815 | 225 | 75 | | | | | |

251

| | | | | | | | | | |
|---|---|---|---|---|---|---|---|---|---|
| Contig355D | 35978392_c1_87 | 1979 | 4816 | 2007 | 669 | 949 | 1.70E-95 | Bacillus subtilis | e1185168 | yloPputative Pkn2 proteinBacillus subtilis complete genome (section 9 of 21)similar to protein kinase |
| Contig355D | 3614 l893_c3_127 | 1980 | 4817 | 1248 | 416 | 1166 | 1.70E-118 | Bacillus subtilis | e1185186 | ftsYsignal recognition particle (docking protein)Bacillus subtilis complete genome (section 9 of 21)alternate gene name |
| Contig355D | 3912890_f3_57 | 1981 | 4818 | 222 | 74 | 246 | 5.30E-21 | BACILLUS STEAROTHERM OPHILUS | P23374 | RPMBribosomal protein L2850S RIBOSOMAL PROTEIN L28 |
| Contig355D | 4509661_c1_84 | 1982 | 4819 | 411 | 137 | | | | | |
| Contig355D | 4725000_c1_93 | 1983 | 4820 | 3636 | 1212 | 2426 | 5.10E-252 | Bacillus subtilis | e1185185 | smcchromosome segregation SMC protein homologBacillus subtilis complete genome (section 9 of 21)alternate gene name |
| Contig355D | 4741703_c2_102 | 1984 | 4821 | 2418 | 806 | 2153 | 4.40E-223 | Bacillus subtilis | e1185162 | priAprimosomal replication factor Y (primosomal)Bacillus subtilis complete genome (section 9 of 21)alternate gene name |
| Contig355D | 4875055_f1_3 | 1985 | 4822 | 225 | 75 | | | | | |
| Contig355D | 4875452_c3_124 | 1986 | 4823 | 645 | 215 | 518 | 7.90E-50 | Bacillus subtilis | e1185170 | yloRputative CfxE proteinBacillus subtilis complete genome (section 9 of 21)similar to ribulose-5-phosphate 3-epimerase |
| Contig355D | 4877203_c1_90 | 1987 | 4824 | 936 | 312 | 661 | 5.60E-65 | Bacillus subtilis | e1185181 | fabDmalonyl CoA-acyl carrier protein transacylaseBacillus subtilis complete genome (section 9 of 21)alternate gene name |
| Contig355D | 4970462_c2_107 | 1988 | 4825 | 750 | 250 | 837 | 1.20E-83 | Bacillus subtilis | e1185182 | fabG3-ketoacyl-acyl carrier protein reductaseBacillus subtilis complete genome (section 9 of 21)alternate gene name |
| Contig355D | 5096012_f3_64 | 1989 | 4826 | 231 | 77 | | | | | |
| Contig355D | 5276712_c3_116 | 1990 | 4827 | 708 | 236 | 659 | 9.10E-65 | Lactococcus lactis | P50924 | pyrFOMP decarboxylaseL.lactis pyrD and pyrF genes. |
| Contig355D | 5978453_c3_121 | 1991 | 4828 | 492 | 164 | 261 | 1.40E-22 | Bacillus subtilis | P94462 | defpolypeptide deformylaseB.subtilis priA, def, fmt, sun genes.alternate gene name |
| Contig355D | 6072125_c1_77 | 1992 | 4829 | 672 | 224 | 591 | 1.50E-57 | Bacillus subtilis | e1185130 | ylmEconserved hypothetical protein ylmEBacillus subtilis complete genome (section 9 of 21)similar to hypothetical proteins |

252

| | | | | | | | | | |
|---|---|---|---|---|---|---|---|---|---|
| Contig355D | 6149077_c3_123 | 1993 | 4830 | 891 | 297 | 708 | 5.80E-70 | Bacillus subtilis | e1185169 | yloQYloQ proteinBacillus subtilis complete genome (section 9 of 21)similar to hypothetical proteins |
| Contig355D | 642_c3_110 | 1994 | 4831 | 2784 | 928 | 4356 | 0 | Staphylococcus aureus | P41972 | ileSisoleucyl-tRNA synthetaseS.aureus gene for isoleucyl-tRNA synthetase. |
| Contig355D | 7225000_c3_126 | 1995 | 4832 | 1026 | 342 | 898 | 4.30E-90 | Bacillus subtilis | e1185180 | plsXputative PlsX proteinBacillus subtilis complete genome (section 9 of 21)alternate gene name |
| Contig355D | 892141_f2_44 | 1996 | 4833 | 396 | 132 | 208 | 5.60E-17 | Pyrococcus horikoshii | d1027160 | PHBC037103aa long hypothetical proteinPyrococcus horikoshii OT3 genomic DNA, 1-37345 and 1737608-1738505nt position (complementary strand), clone |
| Contig355D | 990702_c1_76 | 1997 | 4834 | 1185 | 395 | 1801 | 8.70E-186 | Staphylococcus aureus | P45498 | ftsZFtsZStaphylococcus aureus SA4 FtsZ (ftsZ) gene, complete cds.cell division protein ftsZ |
| Contig355D | 9954640_f3_67 | 1998 | 4835 | 228 | 76 | 117 | 2.50E-07 | Enterococcus faecalis | g2196686 | pyrAbpyrimidine biosynthesis protein AbEnterococcus faecalis plasmid pKV48 pyrimidine biosynthesis proteinAb (pyrAb) gene, partial cds. |
| Contig355D | 10719452_c2_53 | 1999 | 4836 | 684 | 228 | 371 | 3.00E-34 | Bacillus subtilis | P54175 | yplQhemolysin III homolog homolog yplQBacillus subtilis (YAC10-9 clone) DNA region between the serA andkdg loci.20.2% identity with NADH dehydrogenase of the |
| Contig356D | 10752342_c1_40 | 2000 | 4837 | 981 | 327 | 773 | 7.50E-77 | Bacillus subtilis | e1182740 | yfmEYfmEBacillus subtilis complete genome (section 5 of 21)similar to ferrichrome ABC transporter (permease) |
| Contig356D | 10928_c2_61 | 2001 | 4838 | 414 | 138 | | | | | |
| Contig356D | 12142768_f2_12 | 2002 | 4839 | 300 | 100 | 110 | 3.50E-06 | Pyrococcus horikoshii | d1027343 | PHBW01623Saa long hypothetical proteinPyrococcus horikoshii OT3 genomic DNA, 180023-216005 nt position,clone |
| Contig356D | 12578885_f3_36 | 2003 | 4840 | 366 | 122 | | | | | |
| Contig356D | 12603166_f3_28 | 2004 | 4841 | 303 | 101 | 110 | 1.40E-06 | Pyrococcus horikoshii | d1027339 | PHBW01210 6aa long hypothetical proteinPyrococcus horikoshii OT3 genomic DNA, 180023-216005 nt position,clone |

| | | | | | | | | |
|---|---|---|---|---|---|---|---|---|
| Contig356D | 13680468_c1_43 | 2005 | 4842 | 1080 | 360 | 1133 | 5.30E-115 | Bacillus subtilis | P50863 | rec233 unknown B.subtilis cwlD, rec223 and gerD genes.alternate gene name |
| Contig356D | 14064055_c1_46 | 2006 | 4843 | 603 | 201 | 565 | 8.30E-55 | Bacillus subtilis | P37528 | yaaI unknown B. subtilis DNA, 180 kilobase region of replication origin.similar to hypothetical proteins |
| Contig356D | 14849093_c2_59 | 2007 | 4844 | 294 | 98 | 127 | 2.10E-08 | Mitochondrion Chondrus crispus | e138028 | putative orf79.1C.crispus complete mitochondrial genome.unique orf |
| Contig356D | 14900826_c2_58 | 2008 | 4845 | 351 | 117 | 188 | 7.40E-15 | artificial sequence | g208931 | Synthetic E.coli ORF16/lacZ fusion protein, partial cds.ORF16-lacZ fusion protein |
| Contig356D | 157750_c2_54 | 2009 | 4846 | 195 | 65 | | | | | |
| Contig356D | 19730052_c3_66 | 2010 | 4847 | 1479 | 493 | 990 | 7.60E-100 | Bacillus subtilis | e1182251 | ycnBhomologue of multidrug resistance protein B.Bacillus subtilis complete genome (section 3 of 21).similar to multidrug resistance protein |
| Contig356D | 20363762_c2_52 | 2011 | 4848 | 1215 | 405 | 533 | 2.00E-51 | Arabidopsis thaliana | g2033397 | F19I3.25Arabidopsis thaliana chromosome II BAC F19I3 genomic sequence.complete sequence.unknown protein |
| Contig356D | 23460931_f3_31 | 2012 | 4849 | 429 | 143 | | | | | |
| Contig356D | 23642761_f2_18 | 2013 | 4850 | 228 | 76 | | | | | |
| Contig356D | 2379658_f3_23 | 2014 | 4851 | 225 | 75 | | | | | |
| Contig356D | 24244012_c2_51 | 2015 | 4852 | 546 | 182 | 280 | 1.30E-24 | Bacillus subtilis | e1249789 | yvsGYvsG proteinBacillus subtilis 42.7kB DNA fragment from yvsA to yvqA.similar to hypothetical proteins |
| Contig356D | 24273450_f3_20 | 2016 | 4853 | 1365 | 455 | 749 | 2.60E-74 | Bacillus subtilis | d1020112 | ydeLtranscriptional regulator (GntR family) / homolog ydeL.Bacillus subtilis genome sequence, 148 kb sequence of the regionbetween 35 and 47 degree.SIMILAR TO THE RHIZOPINE CATABOLISM (MOCR) GENE OF |
| Contig356D | 24339718_c1_42 | 2017 | 4854 | 483 | 161 | | | | | |
| Contig356D | 24490930_c2_60 | 2018 | 4855 | 912 | 304 | 1220 | 3.20E-124 | Bacillus subtilis | P37527 | yaaDunknownB. subtilis DNA, 180 kilobase region of replication origin.similar to hypothetical proteins |
| Contig356D | 24641927_c3_63 | 2019 | 4856 | 1380 | 460 | 978 | 1.40E-98 | Bacillus firmus | P30267 | hypothetical protein AB.firmus ORF A and ORF B, complete cds.ORF A; putative |

253

| | | | | | | | | | |
|---|---|---|---|---|---|---|---|---|---|
| Contig356D | 24855303_c2_47 | 2020 | 4857 | 1047 | 349 | 784 | 5.10E-78 | Bacillus subtilis | e1182741 | yfmDYfmDBacillus subtilis complete genome (section 5 of 21)similar to ferrichrome ABC transporter (permease) |
| Contig356D | 277312_c3_65 | 2021 | 4858 | 1353 | 451 | 423 | 9.20E-40 | Bacillus subtilis | e1184366 | yusPmultidrug-efflux transporter homolog yusPBacillus subtilis complete genome (section 17 of 21)similar to multidrug-efflux transporter |
| Contig356D | 285808_f3_25 | 2022 | 4859 | 225 | 75 | | | | | |
| Contig356D | 29376066_c3_62 | 2023 | 4860 | 183 | 61 | 109 | 8.70E-06 | Bacillus subtilis | e1182742 | yfmCYfmCBacillus subtilis complete genome (section 5 of 21)similar to ferrichrome ABC transporter (binding |
| Contig356D | 3361326_c1_44 | 2024 | 4861 | 207 | 69 | | | | | |
| Contig356D | 35348182_f3_29 | 2025 | 4862 | 231 | 77 | | | | | |
| Contig356D | 4100327_f1_6 | 2026 | 4863 | 360 | 120 | 133 | 5.00E-09 | Bacillus subtilis | e1182694 | yetGhypothetical protein yetGBacillus subtilis complete genome (section 4 of 21) |
| Contig356D | 6854675_f2_17 | 2027 | 4864 | 279 | 93 | 119 | 1.50E-07 | Bacillus subtilis | e1183408 | ynzGhypothetical protein ynzGBacillus subtilis complete genome (section 10 of 21) |
| Contig356D | 7797308_f3_37 | 2028 | 4865 | 189 | 63 | | | | | |
| Contig357D | 10439005_f2_28 | 2029 | 4866 | 516 | 172 | 143 | 4.30E-10 | Pyrococcus horikoshii | d1028459 | PHAU021101aa long hypothetical proteinPyrococcus horikoshii OT3 genomic DNA, 1195819-1238496 nt position.clone |
| Contig357D | 11728376_c1_51 | 2030 | 4867 | 249 | 83 | 241 | 1.80E-20 | Bacillus subtilis | e1184298 | yuzBhypothetical protein yuzBBacillus subtilis complete genome (section 17 of 21) |
| Contig357D | 14538202_c2_54 | 2031 | 4868 | 762 | 254 | 1034 | 1.70E-104 | Bacillus subtilis | e1184349 | yurYABC transporter (ATP-binding protein) homolog yurYBacillus subtilis complete genome (section 17 of 21)similar to ABC transporter (ATP-binding protein) |
| Contig357D | 14970251_f3_29 | 2032 | 4869 | 294 | 98 | | | | | |
| Contig357D | 21681702_c3_73 | 2033 | 4870 | 198 | 66 | 163 | 1.80E-11 | Bacillus subtilis | e1184289 | yumBNADH dehydrogenaseBacillus subtilis complete genome (section 17 of 21)similar to NADH dehydrogenase |
| Contig357D | 21883512_c2_56 | 2034 | 4871 | 225 | 75 | | | | | |

255

| | | | | | | | | | |
|---|---|---|---|---|---|---|---|---|---|
| Contig357D | 22462926_c3_68 | 2035 | 4872 | 783 | 261 | 669 | 7.90E-66 | Bacillus subtilis | e1184308 | yutFN-acetyl-glucosamine catabolism homolog yutFBacillus subtilis complete genome (section 17 of 21)similar to N-acetyl-l-glucosamine catabolism |
| Contig357D | 23475892_c3_67 | 2036 | 4873 | 1362 | 454 | 707 | 7.40E-70 | Bacillus subtilis | e1184316 | yunDconserved hypothetical protein yunDBacillus subtilis complete genome (section 17 of 21)similar to hypothetical proteins |
| Contig357D | 23728412_c2_53 | 2037 | 4874 | 699 | 233 | 726 | 7.20E-72 | Bacillus subtilis | e1184352 | yusBconserved hypothetical protein yusBBacillus subtilis complete genome (section 17 of 21)similar to hypothetical proteins |
| Contig357D | 24033567_c1_47 | 2038 | 4875 | 450 | 150 | 207 | 7.10E-17 | Bacillus subtilis | e1184309 | yutEhypothetical protein yutEBacillus subtilis complete genome (section 17 of 21) |
| Contig357D | 24242285_c2_57 | 2039 | 4876 | 1056 | 352 | 414 | 8.30E-39 | Borrelia burgdorferi | g2688091 | BB0202hemolysin, putativeBorrelia burgdorferi (section 16 of 70) of the complete genome.similar to PID |
| Contig357D | 24415930_f3_31 | 2040 | 4877 | 1068 | 356 | 977 | 1.80E-98 | Bacillus subtilis | e1184299 | yutJNADH dehydrogenase homolog yutJBacillus subtilis complete genome (section 17 of 21)similar to NADH dehydrogenase |
| Contig357D | 24803332_c1_40 | 2041 | 4878 | 840 | 280 | 712 | 2.20E-70 | Bacillus subtilis | e1184351 | yusAconserved hypothetical protein yusABacillus subtilis complete genome (section 17 of 21)similar to hypothetical proteins |
| Contig357D | 26190785_c1_41 | 2042 | 4879 | 1287 | 429 | 1408 | 3.90E-144 | Bacillus subtilis | e1184347 | yurWNifS protein homolog homolog yurWBacillus subtilis complete genome (section 17 of 21)similar to NifS protein homolog |
| Contig357D | 26360663_c2_63 | 2043 | 4880 | 1176 | 392 | 877 | 7.20E-88 | Bacillus subtilis | e1184289 | yumBNADH dehydrogenaseBacillus subtilis complete genome (section 17 of 21)similar to NADH dehydrogenase |
| Contig357D | 26376077_c3_64 | 2044 | 4881 | 192 | 64 | 101 | 1.20E-05 | Bacillus subtilis | e276829 | ywmHunknownB.subtilis apcC gene. |
| Contig357D | 26594050_c2_61 | 2045 | 4882 | 243 | 81 | 378 | 5.40E-35 | Staphylococcus aureus | d1013748 | dltCD-alanyl carrier proteinStaphylococcus aureus gene for unkown function and dlt operon dltA,dltB, dltC and dltD genes,complete cds.Sequence homologous to the dltC genes of |

| | | | | | | | | |
|---|---|---|---|---|---|---|---|---|
| Contig357D | 30198587_f1_1 | 2046 | 4883 | 258 | 86 | 306 | 2.30E-27 | Bacillus subtilis | e1184301 | yutUNifU protein homolog homolog yutIBacillus subtilis complete genome (section 17 of 21)similar to NifU protein homolog |
| Contig357D | 30265692_c2_60 | 2047 | 4884 | 1050 | 350 | 675 | 1.80E-66 | Pyrococcus horikoshii | d1027703 | PHAB011376aa long hypothetical dehydrogenasePyrococcus horikoshii OT3 genomic DNA, 512441-547109 nt position(complementary strand), clonecontains ATP/GTP-binding site motif A (P-loop); |
| Contig357D | 31876563_c3_69 | 2048 | 4885 | 1239 | 413 | 1924 | 8.10E-199 | Staphylococcus aureus | d1013747 | dltBhypothethecal membrane transporterStaphylococcus aureus gene for unkown function and dlt operon dltA,dltB, dltC and dltD genes,complete cds.Sequence homologous to the dltB genes of |
| Contig357D | 33628441_f1_5 | 2049 | 4886 | 255 | 85 | | | | | |
| Contig357D | 33645967_f2_19 | 2050 | 4887 | 282 | 94 | | | | | |
| Contig357D | 34069680_c3_70 | 2051 | 4888 | 213 | 71 | | | | | |
| Contig357D | 34242162_c2_55 | 2052 | 4889 | 489 | 163 | 529 | 5.40E-51 | Bacillus subtilis | e1184346 | yurVNifU protein homolog homolog yurVBacillus subtilis complete genome (section 17 of 21)similar to NifU protein homolog |
| Contig357D | 34251887_c1_49 | 2053 | 4890 | 1266 | 422 | 1047 | 6.90E-106 | Staphylococcus aureus | d1013749 | dltDextramembranal proteinStaphylococcus aureus gene for unkown function and dlt operon dltA,dltB, dltC and dltD genes,complete cds.putative |
| Contig357D | 36563_c1_39 | 2054 | 4891 | 1074 | 358 | 908 | 3.70E-91 | Bacillus subtilis | e1184353 | yusCABC transporter (ATP-binding protein) homolog yusCBacillus subtilis complete genome (section 17 of 21)similar to ABC transporter (ATP-binding protein) |
| Contig357D | 3944001_c1_52 | 2055 | 4892 | 1524 | 508 | 684 | 2.00E-67 | Bacillus subtilis | e1184284 | yuiEleucyl aminopeptidase homolog yuiEBacillus subtilis complete genome (section 17 of 21)similar to leucyl aminopeptidase |
| Contig357D | 3948587_f3_37 | 2056 | 4893 | 873 | 291 | 295 | 3.40E-26 | Borrelia burgdorferi | g2688692 | BB0759B.burgdorferi predicted coding region BB0759Borrelia burgdorferi (section 61 of 70) of the complete genome.hypothetical protein; identified by GeneMark; |

| | | | | | | | | |
|---|---|---|---|---|---|---|---|---|
| Contig357D | 4101643_c1_46 | 2057 | 4894 | 399 | 133 | 304 | 3.80E-27 | Bacillus subtilis | e1184310 | yutDHypothetical protein yutDBacillus subtilis complete genome (section 17 of 21) |
| Contig357D | 4330390_c2_58 | 2058 | 4895 | 876 | 292 | 787 | 2.50E-78 | Bacillus subtilis | e1184318 | yunFhypothetical protein yunFBacillus subtilis complete genome (section 17 of 21) |
| Contig357D | 4687843_c1_50 | 2059 | 4896 | 330 | 110 | 242 | 1.40E-20 | Bacillus subtilis | e1184300 | yuzDhypothetical protein yuzDBacillus subtilis complete genome (section 17 of 21) |
| Contig357D | 4709575_c1_42 | 2060 | 4897 | 354 | 118 | | | | | |
| Contig357D | 5117793_c3_74 | 2061 | 4898 | 273 | 91 | 197 | 8.20E-16 | Vibrio parahaemolyticus | P46231 | ORF3Vibrio parahaemolyticus BB22 RNase T (rnt) gene and flagellar motorcomponent (motY) gene, complete cds. |
| Contig357D | 6023915_c1_45 | 2062 | 4899 | 969 | 323 | 1144 | 3.60E-116 | Bacillus subtilis | e1184312 | yutBlipoic acid synthetase homolog yutBBacillus subtilis complete genome (section 17 of 21)similar to lipoic acid synthetase |
| Contig357D | 6057338_c2_59 | 2063 | 4900 | 840 | 280 | 622 | 7.50E-61 | Bacillus subtilis | e1184317 | yunEhypothetical protein yunEBacillus subtilis complete genome (section 17 of 21) |
| Contig357D | 6423376_f1_13 | 2064 | 4901 | 197 | 66 | | | | | |
| Contig357D | 6695968_c1_48 | 2065 | 4902 | 1470 | 490 | 1365 | 1.40E-139 | Staphylococcus aureus | d1013746 | dltAD-alanine-D-alanyl carrier protein ligaseStaphylococcus aureus gene for unkown function and dlt operon dltA,dltB, dltC and dltD genes,complete cds.Sequence homologous to the dltA genes of |
| Contig357D | 6836088_c3_65 | 2066 | 4903 | 1320 | 440 | 1260 | 1.90E-128 | Bacillus subtilis | e1184348 | yurXconserved hypothetical protein yurXBacillus subtilis complete genome (section 17 of 21)similar to hypothetical proteins |
| Contig357D | 6929512_c3_66 | 2067 | 4904 | 1416 | 472 | 2098 | 2.90E-217 | Bacillus subtilis | e1184345 | yurUconserved hypothetical protein yurUBacillus subtilis complete genome (section 17 of 21)similar to hypothetical proteins |
| Contig357D | 9890010_c3_72 | 2068 | 4905 | 408 | 136 | 371 | 3.00E-34 | Bacillus subtilis | e1184295 | yutMconserved hypothetical protein yutMBacillus subtilis complete genome (section 17 of 21)similar to hypothetical proteins |
| Contig358D | 10025277_f1_12 | 2069 | 4906 | 396 | 132 | 101 | 3.70E-05 | Aquifex aeolicus | g2982842 | aq_106putative proteinAquifex aeolicus section 5 of 109 of the complete genome. |

| | | | | | | | | | |
|---|---|---|---|---|---|---|---|---|---|
| Contig358D | 10553766_f3_73 | 2070 | 4907 | 195 | 65 | | | | |
| Contig358D | 1058463_c2_138 | 2071 | 4908 | 2121 | 707 | 2472 | 6.90E-257 | Bacillus subtilis | P50849 | pnpApolynucleotide phosphorylaseBacillus subtilis ribosomal protein RpsO (rpsO) gene, partial cds;and polynucleotide phosphorylase (pnpA) gene, complete cds.alternate gene name |
| Contig358D | 1074090_c3_146 | 2072 | 4909 | 906 | 302 | 697 | 8.50E-69 | Bacillus subtilis | P39776 | codVCodVBacillus subtilis JH642 dipeptide permease operon regulators, codV,codW, codX, and codY genes, complete cds. |
| Contig358D | 1183337_c1_110 | 2073 | 4910 | 447 | 149 | 303 | 4.80E-27 | Bacillus subtilis | P32727 | ORF2transcription termination-antitermination factor nusA homologB.subtilis infB-nusA operon. |
| Contig358D | 11930317_c2_136 | 2074 | 4911 | 336 | 112 | 251 | 1.60E-21 | Bacillus subtilis | P32729 | ORF4hypothetical protein 2 (infB 5' region)B.subtilis infB-nusA operon.alternate gene name |
| Contig358D | 19735887_c3_165 | 2075 | 4912 | 1581 | 527 | 1924 | 8.10E-199 | Bacillus subtilis | e1185292 | ymcBconserved hypothetical protein ymcBBacillus subtilis complete genome (section 9 of 21)similar to hypothetical proteins |
| Contig358D | 20423127_c2_143 | 2076 | 4913 | 2676 | 892 | 2302 | 7.10E-239 | Bacillus subtilis | e1185295 | mutSDNA mismatch repair (recognition) mutSBacillus subtilis complete genome (section 9 of 21) |
| Contig358D | 20504512_c1_119 | 2077 | 4914 | 1758 | 586 | 685 | 3.40E-79 | Halobacterium halobium | g43498 | ferredoxin oxidoreductaseH.halobium gene for pyruvatealpha-subunit; pyruvate synthase |
| Contig358D | 205327_c1_106 | 2078 | 4915 | 1332 | 444 | 1679 | 7.40E-173 | Bacillus subtilis | e1185204 | gidglucose-inhibited division proteinBacillus subtilis complete genome (section 9 of 21)alternate gene name |
| Contig358D | 21912535_f2_56 | 2079 | 4916 | 420 | 140 | | | | | |
| Contig358D | 22368803_c1_115 | 2080 | 4917 | 2397 | 799 | 1659 | 9.70E-171 | Bacillus subtilis | P21458 | spoIIIEDNA translocaseBacillus subtilis complete genome (section 9 of 21) |
| Contig358D | 222444075_c2_127 | 2081 | 4918 | 873 | 291 | 381 | 2.60E-35 | Bacillus subtilis | e1185202 | smfDNA processing Smf protein homologBacillus subtilis complete genome (section 9 of 21) |
| Contig358D | 22470463_c2_142 | 2082 | 4919 | 810 | 270 | 881 | 2.70E-88 | Bacillus subtilis | e1185288 | ymdBconserved hypothetical protein ymdBBacillus subtilis complete genome (section 9 of 21)similar to hypothetical proteins |

259

| | | | | | | | | | |
|---|---|---|---|---|---|---|---|---|---|
| Contig358D | 22850885_c3_163 | 2083 | 4920 | 1596 | 532 | 1799 | 1.40E-185 | Bacillus subtilis | e1185287 | ymdAconserved hypothetical protein ymdABacillus subtilis complete genome (section 9 of 21)similar to hypothetical proteins |
| Contig358D | 23445463_c2_130 | 2084 | 4921 | 801 | 267 | 1002 | 4.10E-101 | Bacillus subtilis | e1185240 | rpsBribosomal protein S2Bacillus subtilis complete genome (section 9 of 21) |
| Contig358D | 23472175_c2_137 | 2085 | 4922 | 417 | 139 | 360 | 4.40E-33 | Bacillus subtilis | P32731 | ORF6ribosome-binding factor AB.subtilis infB-nusA operon.Escherichia coli protein P15Balternate gene name |
| Contig358D | 23554760_f1_6 | 2086 | 4923 | 255 | 85 | | | | | |
| Contig358D | 23632758_c3_145 | 2087 | 4924 | 258 | 86 | | | | | |
| Contig358D | 23633467_c1_113 | 2088 | 4925 | 987 | 329 | 659 | 9.10E-65 | Bacillus subtilis | e269877 | ribCFMN adenylyltransferaseB.subtilis ribC, rpsO and pnpA genes.riboflavin kinase |
| Contig358D | 23650250_c3_147 | 2089 | 4926 | 546 | 182 | 667 | 1.30E-65 | Bacillus subtilis | P39070 | codWCodWBacillus subtilis JI1642 dipeptide permease operon regulators, codV, codW, codX, and codY genes, complete cds.alternate gene name |
| Contig358D | 24033217_c1_112 | 2090 | 4927 | 930 | 310 | 720 | 3.10E-71 | Bacillus subtilis | e1185257 | truBtRNA pseudouridine 55 synthaseBacillus subtilis complete genome (section 9 of 21)alternate gene name |
| Contig358D | 24267941_c3_158 | 2091 | 4928 | 726 | 242 | 304 | 3.80E-27 | Bacillus subtilis | e1185272 | ymfCtranscriptional regulator (GntR family) homolog ymfCBacillus subtilis complete genome (section 9 of 21)similar to transcriptional regulator (GntR family) |
| Contig358D | 24414818_c3_153 | 2092 | 4929 | 870 | 290 | 952 | 8.10E-96 | Bacillus subtilis | e1185251 | nusAtranscription termination nusABacillus subtilis complete genome (section 9 of 21) |
| Contig358D | 24492827_f2_63 | 2093 | 4930 | 2601 | 867 | 1069 | 3.20E-108 | Bacillus subtilis | e1182850 | ythOYfhOBacillus subtilis complete genome (section 5 of 21) |
| Contig358D | 24792776_c1_109 | 2094 | 4931 | 528 | 176 | 371 | 3.00E-34 | Bacillus subtilis | P32726 | ORF1protein P15A homologB.subtilis infB-nusA operon.nus operon 15K protein alternate gene name |
| Contig358D | 24886550_c3_156 | 2095 | 4932 | 288 | 96 | 350 | 5.00E-32 | Bacillus subtilis | e269878 | rpsOribosomal protein S15B.subtilis ribC, rpsO and pnpA genes. |

260

| | | | | | | | | | |
|---|---|---|---|---|---|---|---|---|---|
| Contig358D | 24886677_c2_134 | 2096 | 4933 | 1722 | 574 | 1885 | 1.10E-194 | Bacillus subtilis | e1185248 | proSprolyl-tRNA synthetaseBacillus subtilis complete genome (section 9 of 21) |
| Contig358D | 24900332_c1_124 | 2097 | 4934 | 981 | 327 | 935 | 5.10E-94 | Bacillus subtilis | P49850 | mutL,MutLBacillus subtilis spore coat protein (cotE) gene, partial cds, andmismatch repair recognition proteins (mutS) and (mutL) genes,complete cds. |
| Contig358D | 25587942_c2_126 | 2098 | 4935 | 786 | 262 | 556 | 7.40E-54 | Bacillus subtilis | e1185197 | rnhribonuclease HBacillus subtilis complete genome (section 9 of 21) |
| Contig358D | 25665937_c2_132 | 2099 | 4936 | 558 | 186 | 841 | 4.70E-84 | Staphylococcus aureus | g2645713 | frrribosome recycling factorStaphylococcus aureus ribosome recycling factor (frr) gene,complete cds. |
| Contig358D | 26257806_c2_144 | 2100 | 4937 | 984 | 328 | 707 | 7.40E-70 | Bacillus subtilis | P49850 | mutL,MutLBacillus subtilis spore coat protein (cotE) gene, partial cds, andmismatch repair recognition proteins (mutS) and (mutL) genes,complete cds. |
| Contig358D | 26306257_c1_105 | 2101 | 4938 | 2073 | 691 | 2490 | 8.50E-259 | Bacillus subtilis | P39814 | topADNA topoisomerase IBacillus subtilis (smf) gene, 3' end, DNA topisomerase gene, completecds, (gid) gene, 5' end,alternate gene name |
| Contig358D | 26353417_c3_164 | 2102 | 4939 | 294 | 98 | 141 | 7.00E-10 | Clostridium perfringens | g498839 | hypothetical protein 2Clostridium perfringens JIR4025 extracellular toxin productionregulatory locus ORF1 and ORF3 genes, partial cds, and ORF2,ORF10c, virR, virS, and ORF4 genes, complete cds.ORF2 |
| Contig358D | 26370703_c2_125 | 2103 | 4940 | 285 | 95 | | | | | |
| Contig358D | 26460951_c1_108 | 2104 | 4941 | 792 | 264 | 917 | 4.10E-92 | Bacillus subtilis | e1185242 | smbAuridylate kinaseBacillus subtilis complete genome (section 9 of 21) |
| Contig358D | 275427_c3_157 | 2105 | 4942 | 1722 | 574 | 1379 | 4.60E-141 | Bacillus subtilis | e1185269 | ymfAconserved hypothetical protein ymfABacillus subtilis complete genome (section 9 of 21)similar to hypothetical proteins |
| Contig358D | 30656317_c1_107 | 2106 | 4943 | 822 | 274 | 858 | 7.40E-86 | Bacillus subtilis | P39779 | codYCodYBacillus subtilis JI1642 dipeptide permease operon regulators, codV,codW, codX, and codY genes, complete cds. |
| Contig358D | 31552_c3_166 | 2107 | 4944 | 522 | 174 | | | | | |

261

| | | | | | | | | | |
|---|---|---|---|---|---|---|---|---|---|
| Contig358D | 31697151_c1_101 | 2108 | 4945 | 315 | 105 | 441 | 1.10E-41 | Bacillus subtilis | e1185195 | rplSribosomal protein L19Bacillus subtilis complete genome (section 9 of 21) |
| Contig358D | 3257827_c1_116 | 2109 | 4946 | 705 | 235 | 356 | 1.20E-32 | Bacillus subtilis | e1185278 | ymfI3-oxoacyl- acyl-carrier protein reductase homolog ymfIBacillus subtilis complete genome (section 9 of 21)similar to 3-oxoacyl- acyl-carrier protein |
| Contig358D | 32611557_c2_131 | 2110 | 4947 | 294 | 98 | 316 | 2.00E-28 | Bacillus subtilis | e1185241 | tsfelongation factor TsBacillus subtilis complete genome (section 9 of 21) |
| Contig358D | 33283167_c2_140 | 2111 | 4948 | 1338 | 446 | 967 | 2.10E-97 | Bacillus subtilis | e1185277 | ymfHprocessing proteinase homolog ymfHBacillus subtilis complete genome (section 9 of 21)similar to processing protease |
| Contig358D | 33800901_f2_41 | 2112 | 4949 | 318 | 106 | 127 | 2.10E-08 | Leishmania tarentolae | S51910 | cryptogene protein G4 |
| Contig358D | 34571877_c3_159 | 2113 | 4950 | 1275 | 425 | 372 | 2.30E-34 | Bacillus subtilis | e1185276 | ymfGprocessing proteinase homolog ymfGBacillus subtilis complete genome (section 9 of 21)similar to processing protease |
| Contig358D | 34663177_c1_118 | 2114 | 4951 | 1167 | 389 | 641 | 1.70E-65 | Bacillus subtilis | gi1842440 | cinACinABacillus subtilis tRNA-Ala, phosphatidylglycerophosphate synthase(pgsA) and CinA (cinA) genes, complete cds, and RecA (recA) gene,partial cds. |
| Contig358D | 35370318_c1_104 | 2115 | 4952 | 930 | 310 | 1274 | 6.10E-130 | Bacillus subtilis | e1185201 | sucDsuccinyl-CoA synthetase (alpha subunit)Bacillus subtilis complete genome (section 9 of 21) |
| Contig358D | 36220061_c2_129 | 2116 | 4953 | 1425 | 475 | 1399 | 3.50E-143 | Bacillus subtilis | P39778 | codXCodXBacillus subtilis JI1642 dipeptide permease operon regulators, codV, codW, codX, and codY genes, complete cds.alternate gene name |
| Contig358D | 36225938_c1_103 | 2117 | 4954 | 1185 | 395 | 1557 | 6.30E-160 | Bacillus subtilis | e1185200 | sucCsuccinyl-CoA synthetase (beta subunit)Bacillus subtilis complete genome (section 9 of 21) |
| Contig358D | 40686_c3_152 | 2118 | 4955 | 4089 | 1363 | 6425 | 0 | Staphylococcus aureus | d1013849 | DNA polymerase IIIStaphylococcus aureus DNA for DNA polymerase III, complete cds. |
| Contig358D | 4093818_c1_117 | 2119 | 4956 | 591 | 197 | 436 | 3.90E-41 | Bacillus subtilis | P46322 | pgsIAPgsABacillus subtilis pgsIA gene for phosphatidylglycerophosphatesynthase, complete cds.PgsA |

262

| | | | | | | | | | |
|---|---|---|---|---|---|---|---|---|---|
| Contig358D | 4095286_c1_123 | 2120 | 4957 | 375 | 125 | 246 | 5.30E-21 | Bacillus subtilis | e1185293 | ymcAconserved hypothetical protein ymcABacillus subtilis complete genome (section 9 of 21)similar to hypothetical proteins |
| Contig358D | 4336636_c3_154 | 2121 | 4958 | 315 | 105 | 211 | 2.70E-17 | Bacillus subtilis | P32728 | ORF3conserved hypothetical protein ylxRB.subtilis infB-nusA operon.alternate gene name |
| Contig358D | 4425068_f3_100 | 2122 | 4959 | 2613 | 871 | 880 | 3.40E-88 | Bacillus subtilis | e1182850 | yihOYihOBacillus subtilis complete genome (section 5 of 21) |
| Contig358D | 4572162_c2_133 | 2123 | 4960 | 1290 | 430 | 932 | 1.10E-93 | Bacillus subtilis | e1185247 | yluCConserved hypothetical protein yluCBacillus subtilis complete genome (section 9 of 21)similar to hypothetical proteins |
| Contig358D | 5195328_c3_ | 2124 | 4961 | 393 | 131 | 142 | 1.90E-09 | Bacillus subtilis | gl842438 | unknownBacillus subtilis tRNA-Ala, phosphatidylglycerophosphate synthase(pgsA) and CinA (cinA) genes, complete cds, and RecA (recA) gene,partial cds.ORF307; hypothetical 34.7 kd protein |
| Contig358D | 5198557_c3_149 | 2125 | 4962 | 801 | 267 | 691 | 3.70E-68 | Bacillus subtilis | e1185244 | yluAconserved hypothetical protein yluABacillus subtilis complete genome (section 9 of 21)similar to hypothetical proteins |
| Contig358D | 5212776_c1_102 | 2126 | 4963 | 867 | 289 | 839 | 7.60E-84 | Bacillus subtilis | e1185196 | ylqFconserved hypothetical protein ylqFBacillus subtilis complete genome (section 9 of 21)similar to hypothetical proteins |
| Contig358D | 6678140_c2_135 | 2127 | 4964 | 348 | 116 | 328 | 3.10E-28 | Staphylococcus aureus | g642270 | DNA polymerase IIIS.aureus gene for DNA polymerase III. |
| Contig358D | 6688126_c3_162 | 2128 | 4965 | 1074 | 358 | 1661 | 6.00E-171 | Staphylococcus aureus | Q02350 | recAStaphylococcus aureus recA gene, complete cds,putative |
| Contig358D | 6837812_c3_150 | 2129 | 4966 | 786 | 262 | 611 | 1.10E-59 | Bacillus subtilis | e1185245 | cdsAphosphatidate cytidylyltransferaseBacillus subtilis complete genome (section 9 of 21) |
| Contig358D | 6933390_c3_167 | 2130 | 4967 | 552 | 184 | 402 | 1.60E-37 | Bacillus subtilis | P30300 | glpPregulatory proteinBacillus subtilis antiterminator regulatory protein (glpP),glycerol uptake facilitator (glpF) genes, complete cds, glycerolkinase (glpK) gene, 5' end.see EMBL M99611 and Swiss Prot P30300. |

263

| | | | | | | | | |
|---|---|---|---|---|---|---|---|---|
| Contig358D | 7064077_c3_155 | 2131 | 4968 | 2187 | 729 | 2508 | 1.10E-260 | Bacillus subtilis | P17889 | IF2 translation initiation factor IF-2B subtilis protein synthesis initiation factor 2 (infB) gene,complete cds,translation initiation factor IF-2 protein synthesis initiation factor 2 (infB) |
| Contig358D | 891700_c1_120 | 2132 | 4969 | 867 | 289 | 599 | 2.10E-58 | Halobacterium halobium | g43499 | ferredoxin oxidoreductase H.halobium gene for pyruvate pyruvate synthase beta chain beta-subunit; pyruvate synthase |
| Contig358D | 9767263_c1_121 | 2133 | 4970 | 639 | 213 | 280 | 1.30E-24 | Bacillus subtilis | e1185518 | yoqZ phage-related protein homolog yoqZ Bacillus subtilis complete genome (section 11 of 21) similar to phage-related protein |
| Contig358D | 9804202_c3_148 | 2134 | 4971 | 627 | 209 | 704 | 1.50E-69 | Bacillus subtilis | e1185241 | tsf elongation factor Ts Bacillus subtilis complete genome (section 9 of 21) |
| Contig358D | 9807807_c3_160 | 2135 | 4972 | 873 | 291 | 522 | 3.00E-50 | Bacillus subtilis | g1842437 | unknown Bacillus subtilis tRNA-Ala, phosphatidylglycerophosphate synthase(pgsA) and CinA (cinA) genes, complete cds, and RecA (recA) gene,partial cds.hypothetical 17.9 kDa protein; ORF158 |
| Contig358D | 10406642_f1_17 | 2136 | 4973 | 342 | 114 | 165 | 2.30E-12 | Bacillus subtilis | P39756 | narQ unknown B.subtilis atpC gene.alternate gene name |
| Contig358D | 1054640_f3_85 | 2137 | 4974 | 213 | 71 | 170 | 6.00E-13 | Bacillus subtilis | P39756 | narQ unknown B.subtilis atpC gene.alternate gene name |
| Contig359D | 10928_c1_113 | 2138 | 4975 | 1242 | 414 | 234 | 3.50E-17 | Rhodobacter capsulatus | g3128293 | hypothetical protein Rhodobacter capsulatus strain SB1003, partial genome. |
| Contig359D | 1209800_c2_148 | 2139 | 4976 | 282 | 94 | | | | | |
| Contig359D | 12588250_f1_40 | 2140 | 4977 | 198 | 66 | | | | | |
| Contig359D | 12595175_f2_62 | 2141 | 4978 | 498 | 166 | 261 | 1.40E-22 | Bacillus subtilis | P49856 | ykkCY kkC Bacillus subtilis hmp DNA for 7 ORFs, complete cds.unnamed protein product |
| Contig359D | 1261078_c1_111 | 2142 | 4979 | 579 | 193 | 471 | 7.60E-45 | Bacillus subtilis | P42085 | xpt adenine phosphoribosyltransferase Bacillus subtilis (YAC10-9 clone) DNA region between the serA and kdg loci.27% identity with E.coli adenine |

| | | | | | | | | |
|---|---|---|---|---|---|---|---|---|
| Contig359D | 1375308_c2_160 | 2143 | 4980 | 411 | 137 | 96 | 4.10E-05 | Staphylococcus aureus | g684950 | sarAStaphylococcal accessory regulator AStaphylococcus aureus staphylococcal accessory regulator A (sarA)gene, complete cds. |
| Contig359D | 13849056_c1_120 | 2144 | 4981 | 279 | 93 | | | | | |
| Contig359D | 14097586_f3_90 | 2145 | 4982 | 438 | 146 | 470 | 9.70E-45 | Staphylococcus xylosus | P42874 | ureBurease beta subunitS.xylosus gene for ureA, ureB, and ureC genes for urease gamma,beta and alpha subunits,urease 12K chain |
| Contig359D | 14460882_f1_10 | 2146 | 4983 | 189 | 63 | 221 | 2.30E-18 | Staphylococcus haemolyticus | g1022726 | unknownStaphylococcus haemolyticus IS1272 ORF1 and ORF2 genes, completecds.ORF1 |
| Contig359D | 14549010_c2_158 | 2147 | 4984 | 666 | 222 | 185 | 1.50E-14 | Bacillus subtilis | e1185016 | mobAmolybdopterin-guanine dinucleotide biosynthesisBacillus subtilis complete genome (section 8 of 21) |
| Contig359D | 15033181_f3_109 | 2148 | 4985 | 444 | 148 | | | | | |
| Contig359D | 19533567_f2_50 | 2149 | 4986 | 264 | 88 | | | | | |
| Contig359D | 21611592_f3_102 | 2150 | 4987 | 369 | 123 | | | | | |
| Contig359D | 21646015_f2_52 | 2151 | 4988 | 210 | 70 | 158 | 1.10E-11 | Staphylococcus haemolyticus | g1022725 | unknownStaphylococcus haemolyticus IS1272 ORF1 and ORF2 genes, completecds.ORF2 |
| Contig359D | 21675050_f3_100 | 2152 | 4989 | 360 | 120 | | | | | |
| Contig359D | 21681561_f1_32 | 2153 | 4990 | 891 | 297 | 776 | 3.60E-77 | Bacillus subtilis | e1182103 | ybblconserved hypothetical protein ybblBacillus subtilis complete genome (section 1 of 21)similar to hypothetical proteins |
| Contig359D | 21776942_c1_116 | 2154 | 4991 | 642 | 214 | 855 | 1.50E-85 | Bacillus subtilis | e1182158 | ybxGamino acid permease homolog ybxGBacillus subtilis complete genome (section 2 of 21)alternate gene name |
| Contig359D | 2211433_f3_93 | 2155 | 4992 | 867 | 289 | 534 | 1.60E-51 | Bacillus sp. | Q07400 | UreDurease accessory proteinThermophilic Bacillus genes for urease subunits and ureaseaccessory proteins, complete cds. |

| | | | | | | | | |
|---|---|---|---|---|---|---|---|---|
| Contig359D | 22290657_c3_177 | 2156 | 4993 | 387 | 129 | 157 | 1.40E-11 | Staphylococcus aureus | g684950 | sarAStaphylococcal accessory regulator AStaphylococcus aureus staphylococcal accessory regulator A (sarA)gene, complete cds. |
| Contig359D | 22692177_c1_131 | 2157 | 4994 | 537 | 179 | 391 | 2.30E-36 | Bacillus subtilis | g2293241 | moaBputative molibdenum cofactor biosynthesisBacillus subtilis rrnB-dnaB genomic region. |
| Contig359D | 23538427_f2_73 | 2158 | 4995 | 309 | 103 | 132 | 6.80E-09 | Pyrococcus horikoshii | d1027429 | PHCD003215aa long hypothetical proteinPyrococcus horikoshii OT3 genomic DNA, 270845-299829 nt position,cloncontains prokaryotic membrane lipoprotein lipid |
| Contig359D | 23609628_c2_153 | 2159 | 4996 | 975 | 325 | 385 | 9.80E-36 | Trypanosoma brucei brucei | g2645495 | inosine-adenosine-guanosine-nucleoside1Trypanosoma brucei brucei inosine-adenosine-guanosine-nucleosidehydrolase mRNA, complete cds.N-ribohydrolase; IAG-nucleoside hydrolase |
| Contig359D | 23620260_c2_150 | 2160 | 4997 | 1107 | 369 | 334 | 2.50E-30 | Arthrobacter sp. | d1008736 | opine dehydrogenascArthrobacter sp. gene for opine dehydrogenase, complete cds. |
| Contig359D | 23631551_c3_183 | 2161 | 4998 | 792 | 264 | | | | | |
| Contig359D | 23642167_f3_81 | 2162 | 4999 | 1218 | 406 | 611 | 1.10E-59 | Bacillus subtilis | e1184551 | ywoGunknown similar to quinolon resistance proteinBacillus subtilis complete genome (section 19 of 21)similar to antibiotic resistance protein |
| Contig359D | 23678262_c3_182 | 2163 | 5000 | 573 | 191 | 370 | 3.80E-34 | Bacillus subtilis | e1183039 | yhfUhypothetical proteinBacillus subtilis complete genome (section 6 of 21)similar to biotin biosynthesis |
| Contig359D | 24104677_c2_143 | 2164 | 5001 | 1656 | 552 | 1619 | 1.70E-166 | Bacillus subtilis | P54715 | glvCphosphotransferase system (PTS) arbutin-likeBacillus subtilis complete genome (section 5 of 21)alternate gene name |
| Contig359D | 24234562_f2_75 | 2165 | 5002 | 222 | 74 | | | | | |
| Contig359D | 24257012_c1_128 | 2166 | 5003 | 735 | 245 | 480 | 8.40E-46 | Synechocystis sp. | d1011427 | ABC transporterSynechocystis sp. PCC6803 complete genome, 24/27, 3002966-3138603.unassigned ATP-binding cassette proteinsORF_ID |
| Contig359D | 24314818_c2_159 | 2167 | 5004 | 1035 | 345 | 923 | 9.60E-93 | Bacillus subtilis | P39757 | narAMoaA-like proteinB.subtilis atpC gene.alternate gene name |

| | | | | | | | | |
|---|---|---|---|---|---|---|---|---|
| Contig359D | 24406577_c2_162 | 2168 | 5005 | 3156 | 1052 | 2317 | 1.80E-240 | Bacillus subtilis | e1182651 | yerPacriflavin resistance protein homolog yerPBacillus subtilis complete genome (section 4 of 21)similar to acriflavin resistance protein |
| Contig359D | 24431532_c1_135 | 2169 | 5006 | 1254 | 418 | 343 | 2.80E-31 | Staphylococcus hominis | e329240 | femAStaphylococcus hominis femA gene. |
| Contig359D | 24616251_f2_63 | 2170 | 5007 | 696 | 232 | 139 | 2.20E-07 | Streptomyces peucetius | g567887 | dnrOputative repressorStreptomyces peucetius TDP-D-glucose-4,6-dehydratase (dnrM) gene.3' end, regulatory protein (dnrN) gene, complete cds, and repressorprotein (dnrO) gene, complete cds.putative |
| Contig359D | 24644008_c3_184 | 2171 | 5008 | 792 | 264 | 408 | 3.60E-38 | Bacillus subtilis | e1249786 | yvgLputative molybdate binding protein, YvgLBacillus subtilis 42.7kB DNA fragment from yvsA to yvqA.alternate gene name |
| Contig359D | 24647292_c3_164 | 2172 | 5009 | 1275 | 425 | 1180 | 5.60E-120 | Bacillus subtilis | P42086 | ypaQtransport proteinBacillus subtilis (YAC10-9 clone) DNA region between the serA andkdg loci.26% of identity to the Bacillus caldolyticus uracil |
| Contig359D | 25430317_c1_132 | 2173 | 5010 | 492 | 164 | 215 | 1.00E-17 | Bacillus subtilis | e1185019 | mobBmolybdopterin-guanine dinucleotide biosynthesisBacillus subtilis complete genome (section 8 of 21) |
| Contig359D | 25443838_c2_149 | 2174 | 5011 | 789 | 263 | 448 | 2.10E-42 | Staphylococcus aureus | d1023468 | NAGStaphylococcus aureus DNA for N-acetyl-glucosaminidase, partialcds. |
| Contig359D | 25554213_f1_20 | 2175 | 5012 | 627 | 209 | 943 | 7.30E-95 | Staphylococcus xylosus | P42877 | UREGUreGS.xylosus (C2a) UreF and UreG genes. |
| Contig359D | 25554675_f3_110 | 2176 | 5013 | 237 | 79 | | | | | |
| Contig359D | 25582885_f1_9 | 2177 | 5014 | 453 | 151 | 153 | 3.80E-11 | Bacillus subtilis | e1184550 | ywoIunknown, similar to cytolysin SlyA fromBacillus subtilis complete genome (section 19 of 21)similar to transcriptional regulator (MarR family) |
| Contig359D | 26679762_c1_119 | 2178 | 5015 | 831 | 277 | 374 | 1.40E-34 | Bacillus subtilis | g1377843 | yktCunknownBacillus subtilis ampS-nprE gene region.similar to E.coli extragenic suppressor protein |
| Contig359D | 26182800_c1_134 | 2179 | 5016 | 813 | 271 | | | | | |
| Contig359D | 26375031_f1_2 | 2180 | 5017 | 195 | 65 | | | | | |

| | | | | | | | | |
|---|---|---|---|---|---|---|---|---|
| Contig359D | 26758426_c2_151 | 2181 | 5018 | 750 | 250 | 107 | 8.80E-06 | Staphylococcus aureus | g684950 | sarAStaphylococcal accessory regulator AStaphylococcus aureus staphylococcal accessory regulator A (sarA)gene, complete cds. |
| Contig359D | 29494067_c3_167 | 2182 | 5019 | 213 | 71 | | | | | |
| Contig359D | 29697752_c2_147 | 2183 | 5020 | 786 | 262 | 499 | 8.20E-48 | Bacillus subtilis | Q02115 | lytRmembrane bound proteinBacillus subtilis membrane bound protein (lytA and lytR); amidaseenhancer (lytB); and amidase (lytC) genes, complete cds's. |
| Contig359D | 3250075_f3_96 | 2184 | 5021 | 1008 | 336 | 705 | 1.20E-69 | Pyrococcus horikoshii | d1027703 | PHAB011376aa long hypothetical dehydrogenasePyrococcus horikoshii OT3 genomic DNA, 512441-547109 nt position(complementary strand), clonecontains ATP/GTP-binding site motif A (P-loop); |
| Contig359D | 33360910_f3_95 | 2185 | 5022 | 549 | 183 | 120 | 1.20E-07 | Synechocystis sp. | d1017705 | hypothetical proteinSynechocystis sp. PCC6803 complete genome, 4/27, 402290-524345.ORF_ID |
| Contig359D | 3371062_f1_3 | 2186 | 5023 | 333 | 111 | | | | | |
| Contig359D | 3401887_c1_112 | 2187 | 5024 | 1485 | 495 | 1969 | 1.40E-203 | Bacillus subtilis | d1005787 | guaBIMP dehydrogenaseB. subtilis DNA, 180 kilobase region of replication origin.IMP dehydrogenasealternate gene name |
| Contig359D | 34192165_f1_26 | 2188 | 5025 | 345 | 115 | 264 | 6.50E-23 | Bacillus subtilis | e1181510 | ykkDYkkDBacillus subtilis 168 56 kb DNA fragment between xlyA and ykoR.similar to chaperonin |
| Contig359D | 34411552_f2_58 | 2189 | 5026 | 1722 | 574 | 2703 | 2.30E-281 | Staphylococcus xylosus | P42873 | ureCurease alpha subunitS.xylosus gene for ureA, ureB, and ureC genes for urease gamma,beta and alpha subunits.urease 62K chain |
| Contig359D | 34431300_c2_146 | 2190 | 5027 | 774 | 258 | 139 | 2.40E-09 | Enterococcus faecalis | d1011987 | orf8ORF8Enterococcus faecalis plasmid pYI17 genes for BacA, BacB, ORF3,ORF4, ORF5, ORF6, ORF7, ORF8, ORF9, ORF10, ORF11,partial cds. |
| Contig359D | 34617187_f2_69 | 2191 | 5028 | 207 | 69 | | | | | |
| Contig359D | 35944052_f1_44 | 2192 | 5029 | 690 | 230 | | | | | |
| Contig359D | 36113805_c1_117 | 2193 | 5030 | 750 | 250 | 775 | 4.60E-77 | Bacillus subtilis | e1182158 | ybxGamino acid permease homolog ybxGBacillus subtilis complete genome (section 2 of 21)alternate gene name |

268

| | | | | | | | | | |
|---|---|---|---|---|---|---|---|---|---|
| Contig359D | 36132792_c3_187 | 2194 | 5031 | 255 | 85 | 127 | 2.10E-08 | Synechocystis sp. | d1011104 | hypothetical proteinSynechocystis sp. PCC6803 complete genome, 22/27, 2755703-2868766.ORF_ID |
| Contig359D | 36134427_c1_115 | 2195 | 5032 | 657 | 219 | 251 | 1.60E-21 | Bacillus subtilis | P54607 | yhcWhypothetical proteinB.subtilis chromosomal DNA (region 75 degreessimilarly to phosphoglycolate phosphatase from |
| Contig359D | 36147301_c3_165 | 2196 | 5033 | 237 | 79 | | | | | |
| Contig359D | 36209660_f2_55 | 2197 | 5034 | 378 | 126 | | | | | |
| Contig359D | 36225625_f1_22 | 2198 | 5035 | 795 | 265 | 1034 | 1.70E-104 | Staphylococcus aureus | e244971 | S.aureus orfs 1,2,3 & 4.ORF1 |
| Contig359D | 36615903_c2_152 | 2199 | 5036 | 1164 | 388 | 1007 | 1.20E-101 | Bacillus subtilis | d1020042 | ydbMbutyryl-CoA dehydrogenase homolog.ydbMBacillus subtilis genome sequence, 148 kb sequence of the regionbetween 35 and 47 degree.SIMILAR TO ACYL-COA DEHYDROGENASE. |
| Contig359D | 3947153_f3_92 | 2200 | 5037 | 456 | 152 | 482 | 5.20E-46 | Bacillus sp. | Q07401 | UreEurease accessory proteinThermophilic Bacillus genes for urease subunits and ureaseaccessory proteins, complete cds. |
| Contig359D | 4042327_c3_180 | 2201 | 5038 | 918 | 306 | 309 | 1.10E-27 | Homo sapiens | g1322222 | RACH1RACH1Human RACH1 (RACH1) mRNA, complete cds. |
| Contig359D | 4086568_c3_176 | 2202 | 5039 | 1983 | 661 | 130 | 1.50E-07 | Escherichia coli | P22539 | soxSregulatory protein SoxSEscherichia coli K-12 MG1655 section 369 of 400 of the completegenome.fl07; 100 pct identical amino acid sequence and |
| Contig359D | 4305342_c2_142 | 2203 | 5040 | 1557 | 519 | 2015 | 1.80E-208 | Bacillus subtilis | g2239288 | guaAGMP synthetaseBacillus subtilis CotA (cotA), GabP (gabP), YeaB (yeaB), YeaC(yeaC), YebA (yebA), GMP synthetase (guaA) genes, complete cds, andAIR carboxylase 1 (purE) gene, partial cds.alternate gene name |
| Contig359D | 4459380_f1_39 | 2204 | 5041 | 207 | 69 | | | | | |
| Contig359D | 4486693_f2_49 | 2205 | 5042 | 804 | 268 | 976 | 2.30E-98 | Staphylococcus xylosus | e324856 | gdhglucose-1-dehydrogenaseStaphylococcus xylosus gltA, gdh genes. |

269

| | | | | | | | | |
|---|---|---|---|---|---|---|---|---|
| Contig359D | 4491450_f2_65 | 2206 | 5043 | 873 | 291 | 306 | 2.30E-27 | Bacillus subtilis | d1020262 | YbbHBacillus subtilis DNA for FeuB, FcuA, YbbB, YbbC, YbbD, YbzA, YbbF, YbbI, YbbJ, YbbK, YbbL, YbbM, YbbP, complete cds. |
| Contig359D | 4547163_f1_19 | 2207 | 5044 | 699 | 233 | 741 | 1.90E-73 | Staphylococcus xylosus | P42876 | UREFUrefS.xylosus (C2a) UreF and UreG genes. |
| Contig359D | 4569012_f1_35 | 2208 | 5045 | 588 | 196 | | | | | |
| Contig359D | 4720928_f1_4 | 2209 | 5046 | 186 | 62 | | | | | |
| Contig359D | 4800202_c1_129 | 2210 | 5047 | 621 | 207 | 384 | 1.30E-35 | Helicobacter pylori | g1800188 | ORF3711.pylori chromosomal fragment ~38.5kb, complete sequence.ORF37 - similar to H. influenzae HitC - S72674; E. |
| Contig359D | 4804153_f1_14 | 2211 | 5048 | 690 | 230 | 439 | 1.90E-41 | Bacillus subtilis | e1182575 | ydiGmolybdopterin precursor biosynthesis homolog ydiGBacillus subtilis complete genome (section 4 of 21)similar to molybdopterin precursor biosynthesis |
| Contig359D | 4876675_f2_57 | 2212 | 5049 | 399 | 133 | 430 | 1.70E-40 | Staphylococcus xylosus | P42875 | ureAurease gamma subunitS.xylosus gene for ureA, ureB, and ureC genes for urease gamma,beta and alpha subunits.urease 11K chain |
| Contig359D | 4884662_c3_171 | 2213 | 5050 | 1128 | 376 | 293 | 5.50E-26 | Acinetobacter calcoaceticus | g2271503 | unknownAcinetobacter calcoaceticus ADP1 vanillate demethylase region,vanillate demethylase (vanB) and vanillate demethylase (vanA)genes, complete cds.similar to salicylate hydroxylase; ORF7 |
| Contig359D | 4976687_c1_137 | 2214 | 5051 | 924 | 308 | 192 | 1.60E-13 | Methanobacterium thermoautotrophicum | g2622492 | MTH382conserved proteinMethanobacterium thermoautotrophicum from bases 1243964 to 1257931(section 107 of 148) of the complete genome.Function Code |
| Contig359D | 5087556_c2_156 | 2215 | 5052 | 849 | 283 | 499 | 8.20E-48 | Bacillus subtilis | e1185017 | mocBmolybdopterin biosynthesis proteinBacillus subtilis complete genome (section 8 of 21) |
| Contig359D | 5113550_f2_64 | 2216 | 5053 | 1089 | 363 | 240 | 9.90E-19 | Borrelia burgdorferi | g2689897 | BBB07outer surface protein, putativeBorrelia burgdorferi plasmid cp26, complete plasmid sequence.similar to GB |

270

| | | | | | | | | | |
|---|---|---|---|---|---|---|---|---|---|
| Contig359D | 5266018_f2_71 | 2217 | 5054 | 771 | 257 | 415 | 6.50E-39 | Bacillus subtilis | P54717 | yfiA unknown Bacillus subtilis complete genome (section 5 of 21) similar to hypothetical proteins |
| Contig359D | 5898328_f2_48 | 2218 | 5055 | 864 | 288 | 1102 | 1.00E-111 | Staphylococcus xylosus | c324855 | gltA glucose uptake protein Staphylococcus xylosus gltA, gdh genes. |
| Contig359D | 6929676_c1_121 | 2219 | 5056 | 342 | 114 | | | | | |
| Contig359D | 7031318_f2_67 | 2220 | 5057 | 339 | 113 | | | | | |
| Contig359D | 7086677_c3_170 | 2221 | 5058 | 243 | 81 | | | | | |
| Contig359D | 818812_c2_157 | 2222 | 5059 | 1287 | 429 | 1034 | 1.70E-104 | Bacillus subtilis | e1185018 | moeA molybdopterin biosynthesis protein Bacillus subtilis complete genome (section 8 of 21) |
| Contig359D | 829761_c1_140 | 2223 | 5060 | 2172 | 724 | 1751 | 1.70E-180 | Bacillus subtilis | d1020016 | topB PROBABLE DNA TOPOISOMERASE III Bacillus subtilis genome sequence, 148 kb sequence of the region between 35 and 47 degree. |
| Contig359D | 959427_f1_25 | 2224 | 5061 | 417 | 139 | 241 | 1.80E-20 | Staphylococcus carnosus | g2735506 | sceB SceB precursor Staphylococcus carnosus N5,N10-methylenetetrahydromethanopterinreductase homolog, SceB precursor (sceB) and putative transmembrane protein genes, complete cds, and putative Na+/H+ antiporter NhaC(nhaC) gene, partial cds.major secreted pro |
| Contig359D | 964077_c1_133 | 2225 | 5062 | 453 | 151 | 443 | 7.00E-42 | Bacillus subtilis | e1185020 | moaE molybdopterin converting factor (subunit 2) Bacillus subtilis complete genome (section 8 of 21) |
| Contig359D | 975061_c3_173 | 2226 | 5063 | 1455 | 485 | 916 | 5.30E-92 | Haemophilus influenzae | Q57007 | HI107 Na+/H+ antiporter (nhaC) Haemophilus influenzae from bases 1163012 to 1173282 (section 105 of 163) of the complete genome.similar to GB |
| Contig359D | 9928500_c1_130 | 2227 | 5064 | 261 | 87 | 229 | 3.30E-19 | Bacillus subtilis | e1185017 | moeB molybdopterin biosynthesis protein Bacillus subtilis complete genome (section 8 of 21) |

271

| | | | | | | | | | |
|---|---|---|---|---|---|---|---|---|---|
| Contig359D | 9977318_f1_33 | 2228 | 5065 | 1437 | 479 | 700 | 4.10E-69 | Escherichia coli | d1017042 | IPA-49DPTS SYSTEM, SUCROSE-SPECIFIC IIBC COMPONENT E.coli genomic DNA, Kohara clone #419(54.7-55.1 min.).similar to [SwissProt Accession Number P05306 |
| Contig360D | 10463_f3_80 | 2229 | 5066 | 504 | 168 | 315 | 2.60E-28 | Bacillus subtilis | P40779 | ytxGYtxGBacillus subtilis rrnB-dnaB genomic region.ORF1 |
| Contig360D | 1056693_f2_45 | 2230 | 5067 | 1101 | 367 | 774 | 5.90E-77 | Bacillus subtilis | g2293210 | ytoPYtoPBacillus subtilis rrnB-dnaB genomic region.similar to hypothetical protein f356 from E. coli |
| Contig360D | 116337_c1_90 | 2231 | 5068 | 627 | 209 | 199 | 5.00E-16 | Lactococcus lactis | g3043872 | transmembrane protein Tmp3Lactococcus lactis transmembrane protein Tmp3 gene, partial cds.PBP1A homolog; identified as a fusion to a signal |
| Contig360D | 1203827_f2_34 | 2232 | 5069 | 639 | 213 | 475 | 2.80E-45 | Actinobacillus pleuropneumoniae | P50854 | ribBriboflavin synthase alpha subunitActinobacillus pleuropneumoniae riboflavin biosynthesis operon,riboflavin-specific deaminase (ribG), riboflavin synthase alphasubunit (ribB). bifunctional G1P cyclohydraseII/3,4-dihydroxy-2-butanone-4-phosphate synthas |
| Contig360D | 1284381_f3_62 | 2233 | 5070 | 741 | 247 | 297 | 2.10E-26 | Methanococcus jannaschii | g1591624 | MJ0960transaldolaseMethanococcus jannaschii section 81 of 150 of the complete genome.Bacillus subtilis 23K phosphoprotein orfUsimilar to SP |
| Contig360D | 13787912_f2_32 | 2234 | 5071 | 1524 | 508 | 118 | 1.40E-05 | Escherichia coli | g1787957 | hypothetical protein b1668Escherichia coli K-12 MG1655 section 152 of 400 of the completegenome.o534; This 534 aa ORF is 38 pct identical (6 gaps) |
| Contig360D | 13852187_c2_161 | 2235 | 5072 | 186 | 62 | 113 | 3.70E-06 | Bacteriophage phi-13 | g758229 | intintegraseBacteriophage phi-13 integrase gene. |
| Contig360D | 14251933_c1_87 | 2236 | 5073 | 663 | 221 | 818 | 1.30E-81 | Bacillus subtilis | g2293319 | rpsDribosomal protein S4Bacillus subtilis rrnB-dnaB genomic region.Escherichia coli ribosomal protein S4 |
| Contig360D | 14742937_f1_7 | 2237 | 5074 | 231 | 77 | | | | | |

272

| | | | | | | | | | |
|---|---|---|---|---|---|---|---|---|---|
| Contig360D | 14882928_f1_16 | 2238 | 5075 | 1098 | 366 | 1279 | 1.80E-130 | Staphylococcus xylosus | e220317 | aroAchorismate mutaseS.xylosus aroA, cpA, acuC and acuA genes. |
| Contig360D | 14894807_c3_190 | 2239 | 5076 | 228 | 76 | | | | | |
| Contig360D | 163151_f2_28 | 2240 | 5077 | 1248 | 416 | 1800 | 1.10E-185 | Staphylococcus aureus | P50307 | S-adenosylmethionine synthetaseStaphylococcus aureus S-adenosylmethionine synthetase gene,complete cds.SAM synthetase |
| Contig360D | 16586012_c3_186 | 2241 | 5078 | 588 | 196 | 456 | 2.90E-43 | Bacillus subtilis | g2293301 | yiqBYiqBBacillus subtilis rrnB-dnaB genomic region. |
| Contig360D | 16994043_f1_20 | 2242 | 5079 | 1128 | 376 | | | | | |
| Contig360D | 191713_f2_39 | 2243 | 5080 | 11091 | 3697 | 562 | 3.80E-49 | Homo sapiens | g405715 | giantinH.sapiens giantin mRNA.giantina new 376kD Golgi complex outher membrane protein |
| Contig360D | 19565876_f3_76 | 2244 | 5081 | 201 | 67 | | | | | |
| Contig360D | 19645900_c3_181 | 2245 | 5082 | 357 | 119 | 135 | 5.70E-09 | mitochondrion Leishmania tarentolae | C30010 | hypothetical ORF-6 protein |
| Contig360D | 19742842_f1_4 | 2246 | 5083 | 849 | 283 | 776 | 3.60E-77 | Bacillus subtilis | e1249784 | yvgNputative reductase protein, YvgNBacillus subtilis 42.7kB DNA fragment from yvsA to yvqA.alternate gene name |
| Contig360D | 1991325_c3_171 | 2247 | 5084 | 219 | 73 | | | | | |
| Contig360D | 1992943_c1_136 | 2248 | 5085 | 747 | 249 | 104 | 1.90E-05 | Plasmodium yoelii | g160225 | CSPcircumsporozoite proteinPlasmodium yoelii circumsporozoite protein (CSP) gene, 5' end.precursor |
| Contig360D | 20834812_c3_194 | 2249 | 5086 | 306 | 102 | | | | | |
| Contig360D | 2117077_c1_124 | 2250 | 5087 | 366 | 122 | 195 | 1.30E-15 | Aquifex aeolicus | g2983116 | aq_449hypothetical proteinAquifex aeolicus section 22 of 109 of the complete genome. |
| Contig360D | 2126250_c3_185 | 2251 | 5088 | 210 | 70 | | | | | |
| Contig360D | 21522010_c3_193 | 2252 | 5089 | 1725 | 575 | 2393 | 1.60E-248 | Staphylococcus aureus | P51065 | pckaphosphoenolpyruvate carboxykinaseStaphylococcus aureus phosphoenolpyruvate carboxykinase (pcka)gene, complete cds.PEPCK; homologue |
| Contig360D | 22078331_c1_138 | 2253 | 5090 | 252 | 84 | | | | | |

273

| | | | | | | | | | |
|---|---|---|---|---|---|---|---|---|---|
| Contig360D | 22391432_c1_137 | 2254 | 5091 | 525 | 175 | 288 | 1.90E-25 | Bacteriophage phi-13 | g758229 | intintegraseBacteriophage phi-13 integrase gene. |
| Contig360D | 22459692_c2_157 | 2255 | 5092 | 201 | 67 | | | | | |
| Contig360D | 23601713_f2_35 | 2256 | 5093 | 1194 | 398 | 1108 | 2.40E-112 | Bacillus amyloliquefaciens | P51695 | ribA3,4-dihydroxy-2-butanone 4-phosphate synthaseB.amyloliquefaciens ribB, ribG, ribA, ribH & ribT genes.GTP cyclohydrolase II |
| Contig360D | 2383253_f3_55 | 2257 | 5094 | 198 | 66 | | | | | |
| Contig360D | 23984787_f1_17 | 2258 | 5095 | 1011 | 337 | 1404 | 1.00E-143 | Staphylococcus xylosus | e220318 | ccpAS.xylosus aroA, ccpA, acuC and acuA genes. |
| Contig360D | 24020250_f3_63 | 2259 | 5096 | 882 | 294 | 551 | 5.40E-52 | Staphylococcus saprophyticus | e1295630 | aasAAS surface proteinStaphylococcus saprophyticus aas gene. |
| Contig360D | 24226543_f2_52 | 2260 | 5097 | 783 | 261 | 365 | 1.30E-33 | Bacillus subtilis | e1182963 | yhdWhypothetical proteinBacillus subtilis complete genome (section 6 of 21)similar to glycerophosphodiester phosphodiesterase |
| Contig360D | 24296925_c1_122 | 2261 | 5098 | 552 | 184 | 127 | 5.70E-08 | Clostridium botulinum | e184374 | P-21C.botulinum progenitor toxin complex genes. |
| Contig360D | 24334563_f1_11 | 2262 | 5099 | 453 | 151 | 109 | 2.00E-05 | Pyrococcus horikoshii | d1027404 | PHBM041279aa long hypothetical proteinPyrococcus horikoshii OT3 genomic DNA, 216006-259128 nt position,clonesimilar to PIR |
| Contig360D | 24337750_f3_74 | 2263 | 5100 | 852 | 284 | 1238 | 4.00E-126 | Staphylococcus haemolyticus | P54694 | datD-amino acid transaminaseStaphylococcus haemolyticus Y176 D-amino acid transaminase (dat)gene, complete cds. |
| Contig360D | 24417252_f2_37 | 2264 | 5101 | 1248 | 416 | 1036 | 1.00E-104 | Bacillus subtilis | g2293179 | yitBYitBBacillus subtilis rrnB-dnaB genomic region.similarity to tetracycline resistance protein from |
| Contig360D | 24609676_f1_6 | 2265 | 5102 | 471 | 157 | | | | | |
| Contig360D | 24692338_f2_36 | 2266 | 5103 | 474 | 158 | 540 | 3.70E-52 | Bacillus amyloliquefaciens | Q44681 | ribHlumazine synthase (b-subunit)B.amyloliquefaciens ribB, ribG, ribA, ribH & ribT genes. |
| Contig360D | 24720291_c3_189 | 2267 | 5104 | 498 | 166 | | | | | |
| Contig360D | 24740701_f2_38 | 2268 | 5105 | 2508 | 836 | 3293 | 0 | Bacillus subtilis | g2293181 | leuSleucine tRNA synthetaseBacillus subtilis rrnB-dnaB genomic region. |
| Contig360D | 24797177_f2_46 | 2269 | 5106 | 3534 | 1178 | 1450 | 1.40E-148 | Bacillus subtilis | g2293215 | ytpTYtpTBacillus subtilis rrnB-dnaB genomic region.strong similarity to FtsK of E. coli and SpoIIIE of |

| Contig360D | 24853437_f3_65 | 2270 | 5107 | 831 | 277 | 423 | 9.20E-40 | Bacillus subtilis | g2293167 | ytpAprobable lysophospholipaseBacillus subtilis rrnB-dnaB genomic region.similar to lysophospholipase |
|---|---|---|---|---|---|---|---|---|---|---|
| Contig360D | 2548537_f2_51 | 2271 | 5108 | 222 | 74 | | | | | |
| Contig360D | 25665878_f3_72 | 2272 | 5109 | 1665 | 555 | 1014 | 2.20E-102 | Bacillus subtilis | g2293198 | ytgPYtgPBacillus subtilis rrnB-dnaB genomic region.similar to SpoVB protein from B. subtilis |
| Contig360D | 26175952_c1_121 | 2273 | 5110 | 258 | 86 | | | | | |
| Contig360D | 26259686_c2_141 | 2274 | 5111 | 1242 | 414 | 801 | 8.10E-80 | Bacillus subtilis | e1181491 | ykdAYkdABacillus subtilis 168 56 kb DNA fragment between xlyA and ykoR.putative serine protease, heat-shock inducible; |
| Contig360D | 26567062_f3_58 | 2275 | 5112 | 792 | 264 | 428 | 2.70E-40 | Bacillus subtilis | g2293162 | ytmAputative peptidaseBacillus subtilis rrnB-dnaB genomic region. |
| Contig360D | 26596062_c1_101 | 2276 | 5113 | 1284 | 428 | 1198 | 6.90E-122 | Bacillus subtilis | g2293312 | ytfPYtfPBacillus subtilis rrnB-dnaB genomic region.similarity to hypothetical protein f400 from E. |
| Contig360D | 2757633_f1_3 | 2277 | 5114 | 1494 | 498 | 1275 | 1.60E-164 | Staphylococcus aureus | Q53634 | meneo-succinylbenzoic acid (OSB) CoA ligaseStaphylococcus aureus o-succinylbenzoic acid CoA ligase (menc),and o-succinylbenzoic acid synthetase (menc) genes, complete cds. |
| Contig360D | 281531_c3_180 | 2278 | 5115 | 372 | 124 | 94 | 6.70E-05 | Kinetoplast Trypanosoma brucei | g501027 | Trypanosoma brucei EATRO 164 kinetoplast (CR4) mRNA, complete cds.ORF2 |
| Contig360D | 2923202_f2_50 | 2279 | 5116 | 1473 | 491 | 1202 | 2.60E-122 | Vibrio furnissii | g1732197 | nagEPTS permease for N-acetylglucosamine and Vibrio furnissii PTS permease for N-acetylglucosamine and glucose(nagE) gene, complete cds.PTS enzyme IINag |
| Contig360D | 29562552_c1_131 | 2280 | 5117 | 276 | 92 | 281 | 1.00E-24 | Bacillus subtilis | g2293294 | ytjAYtjABacillus subtilis rrnB-dnaB genomic region.similar to hypothetical 9.3 kD protein from P. |

275

| | | | | | | | | |
|---|---|---|---|---|---|---|---|---|
| Contig360D | 30079651_c3_164 | 2281 | 5118 | 1620 | 540 | 1135 | 3.30E-115 | Bacillus subtilis | gi1146196 | serAphosphoglycerate dehydrogenaseBacillus subtilis phosphoglycerate dehydrogenase (serA), ypaA,ferredoxin (fer), ypbB, recS, ypbD, ypbE, ypbF, ypbG, ypbH,glutamate dehydrogenase (ypcA), ypdA, ypdB, ypdC, spore cortexlytic enzyme (sleB), ypeB, ypfA, ypfB, |
| Contig360D | 30084402_c2_140 | 2282 | 5119 | 1188 | 396 | 716 | 8.30E-71 | Synechococcus sp. | P14776 | soluble hydrogenase, small chainSynechococcus DNA for the small subunit of soluble hydrogenase.serine-pyruvate aminotransferasessmall subunit of soluble hydrogenase (AA 1-384) |
| Contig360D | 30274187_c1_115 | 2283 | 5120 | 969 | 323 | 1317 | 1.70E-134 | Bacillus subtilis | g2293302 | ytqAYtqABacillus subtilis rrnB-dnaB genomic region.similarity to biotine synthase from B.sphaericus |
| Contig360D | 31256568_f3_86 | 2284 | 5121 | 201 | 67 | 114 | 5.10E-07 | Pyrococcus horikoshii | d1024740 | PHAA016119aa long hypothetical proteinPyrococcus horikoshii OT3 PH1AA001-PH1AA055 genes, complete cds. |
| Contig360D | 3158502_f2_44 | 2285 | 5122 | 225 | 75 | 122 | 2.20E-07 | Bacillus subtilis | g2293206 | ytmPYtmPBacillus subtilis rrnB-dnaB genomic region. |
| Contig360D | 33287515_c2_156 | 2286 | 5123 | 330 | 110 | | | | | |
| Contig360D | 33360312_c3_168 | 2287 | 5124 | 420 | 140 | 295 | 1.30E-25 | Streptococcus pneumoniae | e1284114 | pbp1bpenicillin-binding protein 1bStreptococcus pneumoniae pbp1b gene, partial. beta-lactamresistant. |
| Contig360D | 33630311_f3_73 | 2288 | 5125 | 1341 | 447 | 1001 | 5.20E-101 | Bacillus stearothermophilus | g436965 | hypothetical protein 1Bacillus stearothermophilus maltose permease (malA) gene, completecds. |
| Contig360D | 3365887_f2_43 | 2289 | 5126 | 630 | 210 | 501 | 5.00E-48 | Bacillus subtilis | g2293206 | ytmPYtmPBacillus subtilis rrnB-dnaB genomic region. |
| Contig360D | 34178128_f2_30 | 2290 | 5127 | 216 | 72 | | | | | |
| Contig360D | 34190077_f2_25 | 2291 | 5128 | 1017 | 339 | 864 | 1.70E-86 | Staphylococcus aureus | gi255260 | menco-succinylbenzoic acid (OSB) synthetaseStaphylococcus aureus o-succinylbenzoic acid CoA ligase (mene),and o-succinylbenzoic acid synthetase (mene) genes, complete cds. |
| Contig360D | 34415925_f3_75 | 2292 | 5129 | 654 | 218 | 540 | 3.70E-52 | Bacillus subtilis | g2293207 | ytmQYtmQBacillus subtilis rrnB-dnaB genomic region.similar to hypothetical protein H10340 from H. |

| | | | | | | | | | |
|---|---|---|---|---|---|---|---|---|---|
| Contig360D | 34429838_f2_26 | 2293 | 5130 | 483 | 161 | 261 | 1.40E-22 | Bacillus subtilis | g2293161 | ytkDYtkDBacillus subtilis rrnB-dnaB genomic region. |
| Contig360D | 34610925_c2_139 | 2294 | 5131 | 462 | 154 | 274 | 5.70E-24 | Bacillus subtilis | e1183387 | ymaDConserved hypothetical protein ymaDBacillus subtilis complete genome (section 10 of 21)similar to hypothetical proteins |
| Contig360D | 4110882_c3_172 | 2295 | 5132 | 351 | 117 | | | | | |
| Contig360D | 4183428_f1_15 | 2296 | 5133 | 1329 | 443 | 1966 | 2.90E-203 | Staphylococcus aureus | g2642659 | murCUDP-N-acetylmuramoyl-L-alanine synthetaseStaphylococcus aureus UDP-N acetylmuramoyl-L-alanine synthetase(murC) gene, complete cds.MurC; UDP-N-acetylmuramate-alanine ligase |
| Contig360D | 4296950_f1_2 | 2297 | 5134 | 198 | 66 | | | | | |
| Contig360D | 4299175_f3_56 | 2298 | 5135 | 240 | 80 | | | | | |
| Contig360D | 4502308_f3_83 | 2299 | 5136 | 636 | 212 | 502 | 3.90E-48 | Bacillus subtilis | e1182955 | yhdOhypothetical proteinBacillus subtilis complete genome (section 6 of 21)similar to 1-acylglycerol-3-phosphate |
| Contig360D | 4697318_f3_77 | 2300 | 5137 | 867 | 289 | 671 | 4.80E-66 | Bacillus subtilis | g2293212 | ytpQYtpQBacillus subtilis rrnB-dnaB genomic region. |
| Contig360D | 4776702_f3_67 | 2301 | 5138 | 312 | 104 | 164 | 2.60E-12 | Bacillus subtilis | P54433 | yrkFYrkFBacillus subtilis DNA, 283 Kb region containing skin element,similar to hypothetical proteins from B. subtilis |
| Contig360D | 4876300_f3_81 | 2302 | 5139 | 1695 | 565 | 1839 | 8.20E-190 | Streptococcus mutans | Q59925 | fhsformyl-tetrahydrofolate synthetaseStreptococcus mutans formyl-tetrahydrofolate synthetase (fhs) gene,complete cds.formyl-tetrahydrofolate ligase; ATP-dependant |
| Contig360D | 5081252_c3_191 | 2303 | 5140 | 360 | 120 | 199 | 5.00E-16 | Aquifex aeolicus | g2983116 | aq_449hypothetical proteinAquifex aeolicus section 22 of 109 of the complete genome. |
| Contig360D | 5355250_f2_49 | 2304 | 5141 | 1284 | 428 | 1343 | 3.00E-137 | BACILLUS STEAROTHERMOPHILUS | P00952 | TYRStyrosine--tRNA ligase,TYROSYL-TRNA SYNTHETASE. (TYROSINE--TRNA LIGASE) (TYRRStyrosine--tRNA ligase |

277

| | | | | | | | | |
|---|---|---|---|---|---|---|---|---|
| Contig360D | 551907_c1_134 | 2305 | 5142 | 708 | 236 | 183 | 2.50E-14 | Streptococcus thermophilus bacteriophage TP-J34 | g2897104 | putative host cell surface-exposed lipoproteinStreptococcus thermophilus bacteriophage lysogeny module, integrasehomolog (int), putative host cell surface-exposed lipoprotein,putative metallo-proteinase, repressor, Cro-like regulatoryprotein, and P1-antir |
| Contig360D | 572186_f2_47 | 2306 | 5143 | 1284 | 428 | 190 | 2.00E-11 | Petromyzon marinus | g632549 | NF-180Petromyzon marinus neurofilament subunit NF-180 mRNA, complete cds.180 kDa neurofilament subunit |
| Contig360D | 5911592_f2_29 | 2307 | 5144 | 924 | 308 | | | | | |
| Contig360D | 6070392_f2_42 | 2308 | 5145 | 708 | 236 | 415 | 6.50E-39 | Haemophilus influenzae | P45124 | HI1243hypotheticalHaemophilus influenzae from bases 1311704 to 1324184 (section 119of 163) of the complete genome.similar to SP |
| Contig360D | 6100150_f2_23 | 2309 | 5146 | 189 | 63 | | | | | |
| Contig360D | 6317_f1_13 | 2310 | 5147 | 411 | 137 | 267 | 3.10E-23 | Bacillus subtilis | g2293211 | ytpPputative thioredoxinBacillus subtilis rrnB-dnaB genomic region.similar to thioredoxin.H1 |
| Contig360D | 785952_f1_14 | 2311 | 5148 | 567 | 189 | 552 | 2.00E-53 | Bacillus subtilis | g2293213 | ytpRYtpRBacillus subtilis rrnB-dnaB genomic region.similarity to phenylalanine tRNA ligase of E. coli |
| Contig360D | 82562_c1_116 | 2312 | 5149 | 1110 | 370 | 680 | 5.40E-67 | Bacillus subtilis | c1182272 | ycgMproline oxidase homolog ycgMBacillus subtilis complete genome (section 2 of 21)similar to proline oxidase |
| Contig360D | 954768_f2_33 | 2313 | 5150 | 1053 | 351 | 611 | 1.10E-59 | Bacillus subtilis | P17618 | ribGriboflavin-specific deaminaseBacillus subtilis spoVA to serA region.ribG protein product (AA 1-361) |
| Contig360D | 960012_f3_66 | 2314 | 5151 | 450 | 150 | 109 | 1.70E-06 | Bacillus firmus | g2654484 | hypothetical 16.1 kDa transcriptional regulatorBacillus firmus hypothetical 34.0 kDa protein, hypothetical 8.9 kDaprotein, hypothetical 10.1 kDa protein, hypothetical 21.0 kDaprotein, putative thiosulfate sulfurtransferase, hypothetical 16.1kDa transcript |
| Contig360D | 9845327_f3_60 | 2315 | 5152 | 192 | 64 | | | | | |
| Contig361D | 11739752_c3_51 | 2316 | 5153 | 915 | 305 | 1172 | 3.90E-119 | Staphylococcus aureus | P49994 | dnaADnaAStaphylococcus aureus DNA for DnaA, complete cds. |

| | | | | | | | | |
|---|---|---|---|---|---|---|---|---|
| Contig361D | 157500_c1_43 | 2317 | 5154 | 729 | 243 | 253 | 9.50E-22 | Helicobacter pylori | g2314496 | HP1331conserved hypothetical integral membraneHelicobacter pylori section 112 of 134 of the complete genome.similar to EGAD |
| Contig361D | 21660805_f1_8 | 2318 | 5155 | 1017 | 339 | 867 | 8.20E-87 | Staphylococcus schleiferi | g3044072 | hlbbeta-hemolysinStaphylococcus schleiferi beta-hemolysin (hlb) gene, partial cds. |
| Contig361D | 22902302_c1_41 | 2319 | 5156 | 1407 | 469 | 2010 | 6.20E-208 | Staphylococcus aureus | P95689 | serSseryl-trna synthetaseS.aureus serS gene. |
| Contig361D | 23507_c1_40 | 2320 | 5157 | 2709 | 903 | 3998 | 0 | Staphylococcus aureus | d1001842 | gyrADNA gyrase AStaphylococcus aureus genes for DNA gyrase A and B, complete cds. |
| Contig361D | 23704502_f1_14 | 2321 | 5158 | 267 | 89 | | | | | |
| Contig361D | 24023300_c2_46 | 2322 | 5159 | 516 | 172 | 760 | 1.80E-75 | Staphylococcus aureus | P49994 | dnaADnaAStaphylococcus aureus DNA for DnaA, complete cds. |
| Contig361D | 24645817_c2_50 | 2323 | 5160 | 453 | 151 | 461 | 8.70E-44 | Bacillus stearothermophilus | g143421 | ribosomal protein L9ribosomal protein L9B.stearothermophilus ribosomal protein L9 gene, complete cds. |
| Contig361D | 24817142_c1_39 | 2324 | 5161 | 1947 | 649 | 3147 | 0 | Staphylococcus aureus | P20832 | gyrBDNA gyraseS.aureus genes gyrB, gyrA and recF (partial).DNA topoisomerase (ATP-hydrolyzing) chain B |
| Contig361D | 2708903_c3_53 | 2325 | 5162 | 186 | 62 | | | | | |
| Contig361D | 2931557_c3_52 | 2326 | 5163 | 1119 | 373 | 1692 | 3.10E-174 | STAPHYLOCOCCUS AUREUS | P29232 | RECFrecF proteinRECF PROTEINrecF protein |
| Contig361D | 33244187_c3_57 | 2327 | 5164 | 1989 | 663 | 1592 | 1.20E-163 | Bacillus subtilis | P37484 | yybIunknownB. subtilis DNA, 180 kilobase region of replication origin. |
| Contig361D | 34004590_f3_31 | 2328 | 5165 | 291 | 97 | | | | | |
| Contig361D | 34266582_c2_47 | 2329 | 5166 | 1158 | 386 | 1796 | 3.00E-185 | STAPHYLOCOCCUS AUREUS | P50029 | DNANDNA-directed DNA polymerase, III beta chainDNA POLYMERASE III, BETA CHAIN,DNA-directed DNA polymerase III beta chain |
| Contig361D | 35324092_c1_44 | 2330 | 5167 | 987 | 329 | 219 | 8.20E-28 | Saccharomyces cerevisiae | P08465 | MET2homoserine O-acetyltransferase,S.cerevisiae chromosome XIV reading frame ORF YNL277w.homoserine acetyltransferaseORF YNL277w |
| Contig361D | 35369052_c1_45 | 2331 | 5168 | 1404 | 468 | 1252 | 1.30E-127 | Bacillus subtilis | P37469 | dnaCreplicative DNA helicaseB. subtilis DNA, 180 kilobase region of replication origin. |

| | | | | | | | | |
|---|---|---|---|---|---|---|---|---|
| Contig361D | 36359761_f3_36 | 2332 | 5169 | 840 | 280 | 581 | 1.70E-56 | Streptococcus thermophilus | P96051 | Streptococcus thermophilus tetrahydrofolatedehydrogenase/cyclohydrolase (folD), penicillin-binding protein 2b(pbp2b) and DNA repair and recombination protein (recM) genes,complete cds,orf1091 |
| Contig361D | 41265_c3_58 | 2333 | 5170 | 1365 | 455 | 1593 | 9.60E-164 | Bacillus subtilis | d1005716 | purAadenylosuccinate synthetaseB. subtilis DNA, 180 kilobase region of replication origin.adenylosuccinate synthase |
| Contig361D | 4179680_c2_49 | 2334 | 5171 | 936 | 312 | 214 | 1.50E-16 | Bacillus subtilis | P37485 | yybSunknownB. subtilis DNA, 180 kilobase region of replication origin. |
| Contig361D | 5190938_f3_56 | 2335 | 5172 | 471 | 157 | | | | | |
| Contig361D | 6054512_f3_35 | 2336 | 5173 | 207 | 69 | | | | | |
| Contig361D | 7031563_c1_38 | 2337 | 5174 | 243 | 81 | 358 | 7.10E-33 | Staphylococcus aureus | S54709 | hypothetical protein 81 |
| Contig361D | 10195942_c1_98 | 2338 | 5175 | 636 | 212 | 253 | 9.50E-22 | Thermotoga maritima | Q56320 | trpFphosphoribosyl anthranilate isomeraseT.maritima trpD, trpC, trpF, trpB, and trpA genes.trpF homology |
| Contig362D | 10667002_f1_14 | 2339 | 5176 | 189 | 63 | | | | | |
| Contig362D | 11844802_c3_157 | 2340 | 5177 | 327 | 109 | | | | | |
| Contig362D | 13087513_c2_112 | 2341 | 5178 | 3033 | 1011 | 547 | 1.30E-49 | Aquifex aeolicus | g2983515 | aq_1006hypothetical proteinAquifex aeolicus section 50 of 109 of the complete genome. |
| Contig362D | 1360958_c2_110 | 2342 | 5179 | 270 | 90 | 109 | 1.70E-06 | Bacillus subtilis | e249647 | yncIYneIB.subtilis DNA (26.2 kb fragment; 170 degree region).identical to yoxI (from acc. no. X87845) |
| Contig362D | 13678462_f3_61 | 2343 | 5180 | 564 | 188 | 303 | 4.80E-27 | Synechococcus sp. | P39665 | sphXSphXSynechococcus sp. sphX gene for phosphate regulon SphX, completecds. |
| Contig362D | 13845300_f1_1 | 2344 | 5181 | 309 | 103 | | | | | |
| Contig362D | 13875216_c1_95 | 2345 | 5182 | 1023 | 341 | 895 | 8.90E-90 | Staphylococcus carnosus | e1181777 | glcTantiterminatorStaphylococcus carnosus glcT gene. |
| Contig362D | 14251643_f3_79 | 2346 | 5183 | 309 | 103 | 143 | 4.30E-10 | Bacillus subtilis | c249654 | yncRYneRB.subtilis DNA (26.2 kb fragment; 170 degree region). |
| Contig362D | 14471938_c3_131 | 2347 | 5184 | 183 | 61 | 231 | 2.00E-19 | BACILLUS STEAROTHERMOPHILUS | P23375 | RPMGribosomal protein L33S RIBOSOMAL PROTEIN L33Escherichia coli ribosomal protein L33 |

| | | | | | | | | |
|---|---|---|---|---|---|---|---|---|
| Contig362D | 1461588_f3_62 | 2348 | 5185 | 942 | 314 | 712 | 2.20E-70 | Archaeoglobus fulgidus | g2649218 | AF1357phosphate ABC transporter, permease proteinArchaeoglobus fulgidus section 97 of 172 of the complete genome.similar to SP |
| Contig362D | 14723387_c2_109 | 2349 | 5186 | 282 | 94 | 250 | 2.00E-21 | Bacillus subtilis | P45708 | ynelYnelB.subtilis DNA (26.2 kb fragment; 170 degree region).identical to yoxG (from acc. no. X87845) |
| Contig362D | 14850082_f3_64 | 2350 | 5187 | 933 | 311 | 880 | 3.40E-88 | Bacillus subtilis | P46342 | yqgKYqgKBacillus subtilis DNA, 283 kb region containing skin element.Similatily to phosphate transport protein (PstB) of |
| Contig362D | 14876553_c3_146 | 2351 | 5188 | 996 | 332 | 570 | 2.40E-55 | Enterococcus hirae | g1147744 | PSREnterococcus hirae psr gene, complete cds. |
| Contig362D | 15084826_c3_136 | 2352 | 5189 | 300 | 100 | 268 | 2.50E-23 | Bacillus subtilis | e249647 | yneJYneJB.subtilis DNA (26.2 kb fragment; 170 degree region).identical to yoxI (from acc. no. X87845) |
| Contig362D | 15757712_f3_68 | 2353 | 5190 | 732 | 244 | 358 | 7.10E-33 | Aquifex aeolicus | g2984331 | abcT11ABC transporterAquifex aeolicus section 106 of 109 of the complete genome. |
| Contig362D | 157875_c3_137 | 2354 | 5191 | 390 | 130 | | | | | |
| Contig362D | 16205378_c2_123 | 2355 | 5192 | 243 | 81 | | | | | |
| Contig362D | 16833588_f3_65 | 2356 | 5193 | 654 | 218 | 265 | 5.10E-23 | Enterobacter cloacae | d1023735 | phoUnegative regulatory protein of pho regulonEnterobacter cloacae pstS, pstC, pstA, pstB and phoU genes,complete cds.The phoU gene is required for chemotaxis to ward |
| Contig362D | 19540678_c1_91 | 2357 | 5194 | 438 | 146 | 241 | 9.90E-20 | Bacillus subtilis | P54417 | opuDputative transporterBacillus subtilis rrnB-dnaB genomic region.alternate gene name |
| Contig362D | 19730438_c3_151 | 2358 | 5195 | 1272 | 424 | 2221 | 2.70E-230 | Staphylococcus epidermidis | g1815620 | femBFEMBStaphylococcus epidermidis lactor essential for methicillinresistance FEMB (femB) gene, complete cds.Factor essential for methicillin resistance |
| Contig362D | 20312510_f2_38 | 2359 | 5196 | 1041 | 347 | 290 | 1.50E-48 | Escherichia coli | d1015860 | Dipeptide transport system permease proteinE.coli genomic DNA, Kohara clone #278(33.3-33.7 min.),ORF_ID |
| Contig362D | 20400051_f2_56 | 2360 | 5197 | 810 | 270 | 691 | 3.70E-68 | Bacillus subtilis | P31080 | lexAtranscriptional regulatorBacillus subtilis lexA gene, 3' end.alternate gene name |

280

| | | | | | | | | |
|---|---|---|---|---|---|---|---|---|
| Contig362D | 20501250_c3_148 | 2361 | 5198 | 1029 | 343 | 551 | 2.50E-53 | Methanococcus jannaschii | Q57686 | MJ0234anthranilate synthase component II (trpD)Methanococcus jannaschii section 21 of 150 of the complete genome.trpD homology.similar to GB |
| Contig362D | 21641877_f1_4 | 2362 | 5199 | 954 | 318 | 687 | 9.80E-68 | Archaeoglobus fulgidus | g2649217 | AF1358phosphate ABC transporter, permease proteinArchaeoglobus fulgidus section 97 of 172 of the complete genome.similar to GB |
| Contig362D | 22663932_f3_67 | 2363 | 5200 | 972 | 324 | 450 | 1.30E-42 | Bacillus firmus | g1813497 | dppCdipeptide transporter protein dppCBacillus firmus dppABC operon, dipeptide transporter protein dppAgene, partial cds, and dipeptide transporter proteins dppB and dppCgenes, complete cds. |
| Contig362D | 23491077_c2_129 | 2364 | 5201 | 1266 | 422 | 1031 | 3.40E-104 | Bacillus subtilis | g410117 | lysAdiaminopimelate decarboxylaseBacillus subtilis spoVA to serA region. |
| Contig362D | 23650343_c3_159 | 2365 | 5202 | 1167 | 389 | 527 | 8.80E-51 | Pyrococcus horikoshii | d1028137 | PHAJ010387aa long hypothetical proteinPyrococcus horikoshii OT3 genomic DNA, 922700-958423 nt position(complementary strand), clonesimilar to Swiss_Prot |
| Contig362D | 23671890_c2_117 | 2366 | 5203 | 1287 | 429 | 918 | 3.20E-92 | Bacillus subtilis | e1183597 | uvrXUV-damage repair proteinBacillus subtilis complete genome (section 12 of 21)alternate gene name |
| Contig362D | 23673150_c3_133 | 2367 | 5204 | 1002 | 334 | 1329 | 9.10E-136 | Bacillus subtilis | e1184292 | yumDunknownBacillus subtilis complete genome (section 17 of 21)similar to GMP reductase |
| Contig362D | 23860952_f2_44 | 2368 | 5205 | 516 | 172 | 460 | 1.10E-43 | Bacillus subtilis | P54154 | yppPDNA-binding proteinBacillus subtilis (YAC10-9 clone) DNA region between the serA andkdtg loci.42.4% identity with the Lycopersicon esculentum |
| Contig362D | 23944052_c1_86 | 2369 | 5206 | 378 | 126 | 248 | 1.40E-20 | Bacteroides fragilis | P45737 | katBcatalaseBacteroides fragilis catalase (katB) gene, complete cds.catalase |
| Contig362D | 24225053_c3_134 | 2370 | 5207 | 318 | 106 | 202 | 2.40E-16 | Bacillus subtilis | e1183447 | ynzChypothetical protein ynzCBacillus subtilis complete genome (section 10 of 21) |
| Contig362D | 24251466_c1_92 | 2371 | 5208 | 2745 | 915 | 3437 | 0 | Bacillus subtilis | e249650 | citBaconitaseB.subtilis DNA (26.2 kb fragment; 170 degree region). |

| | | | | | | | | | |
|---|---|---|---|---|---|---|---|---|---|
| Contig362D | 24267942_c2_128 | 2372 | 5209 | 1089 | 363 | 300 | 1.00E-26 | Bacillus subtilis | d1020054 | alrALANINE RACEMASEBacillus subtilis genome sequence, 148 kb sequence of the regionbetween 35 and 47 degree.alternate gene name |
| Contig362D | 24640925_c3_138 | 2373 | 5210 | 1272 | 424 | 1288 | 2.00E-131 | Bacillus subtilis | P54417 | opuDputative transporterBacillus subtilis rrnB-dnaB genomic region.alternate gene name |
| Contig362D | 24647176_c3_152 | 2374 | 5211 | 771 | 257 | 120 | 3.10E-05 | Bacillus subtilis | g1377832 | ykrAunknownBacillus subtilis ampS-nprE gene region.similar in C-terminus to partial sequence of orf1 |
| Contig362D | 24647182_c2_126 | 2375 | 5212 | 729 | 243 | 347 | 1.00E-31 | Aquifex aeolicus | g2983426 | dapBdihydrodipicolinate reductaseAquifex aeolicus section 45 of 109 of the complete genome. |
| Contig362D | 24666043_c2_115 | 2376 | 5213 | 1233 | 411 | 866 | 1.10E-86 | Bacillus subtilis | e1185989 | yubAconserved hypothetical protein yubABacillus subtilis complete genome (section 16 of 21)similar to hypothetical proteins |
| Contig362D | 24744010_c3_132 | 2377 | 5214 | 273 | 91 | 347 | 1.00E-31 | Bacillus subtilis | e1182877 | yhzAribosomal protein S14 homolog yhzABacillus subtilis complete genome (section 5 of 21)similar to ribosomal protein S14 |
| Contig362D | 24823377_f2_35 | 2378 | 5215 | 912 | 304 | 462 | 6.80E-44 | Bacillus subtilis | e1183105 | yitLhypothetical protein yitLBacillus subtilis complete genome (section 6 of 21) |
| Contig362D | 25445253_c3_139 | 2379 | 5216 | 495 | 165 | 336 | 1.50E-30 | Bacillus subtilis | e249652 | yncPYnePB.subtilis DNA (26.2 kb fragment; 170 degree region).similar to hypothetical proteins |
| Contig362D | 25664512_c3_144 | 2380 | 5217 | 495 | 165 | 279 | 1.70E-24 | Bacillus subtilis | e1182832 | yfiWYfiWBacillus subtilis complete genome (section 5 of 21) |
| Contig362D | 25977318_c1_94 | 2381 | 5218 | 2415 | 805 | 3470 | 0 | Staphylococcus aureus | d1011747 | grlADNA topoisomerase IV GrlA subunitStaphylococcus aureus DNA for DNA topoisomerase IV GrlB subunit,DNA topoisomerase IV GrlA subunit, complete cds. |
| Contig362D | 26210925_c3_135 | 2382 | 5219 | 2028 | 676 | 2097 | 3.80E-217 | Bacillus subtilis | P45694 | tktAtransketolaseB.subtilis DNA (26.2 kb fragment; 170 degree region).alternate gene name |
| Contig362D | 26213890_c3_130 | 2383 | 5220 | 699 | 233 | 757 | 3.70E-75 | Streptomyces coelicolor | e313391 | catAcatalaseS.coelicolor catA gene. |
| Contig362D | 26354837_c3_158 | 2384 | 5221 | 900 | 300 | 570 | 2.40E-55 | Methanococcus jannaschii | Q57695 | MJ0244dihydrodipicolinate synthase (dapA)Methanococcus jannaschii section 22 of 150 of the complete genome.similar to GB |

| | | | | | | | | |
|---|---|---|---|---|---|---|---|---|
| Contig362D | 2931337_f1_6 | 2385 | 5222 | 780 | 260 | 352 | 3.10E-32 | Pyrococcus horikoshii | d1027923 | PHCH023oligopeptide transport ATP-binding protein APPDPyrococcus horikoshii OT3 genomic DNA, 695940-732858 nt position,clonecontains ABC transporters family signature ; |
| Contig362D | 32812_c3_145 | 2386 | 5223 | 204 | 68 | | | | | |
| Contig362D | 35187587_c1_97 | 2387 | 5224 | 588 | 196 | 370 | 3.80E-34 | Thermotoga maritima | S34747 | anthranilate synthase, component IIglutamine amidotransferase |
| Contig362D | 35557787_c1_105 | 2388 | 5225 | 1275 | 425 | 787 | 2.50E-78 | Bacillus subtilis | P08495 | LYSCaspartokinase II alpha subunitBacillus subtilis thioredoxin (trx), uvrB and aspartokinase IIgenes, complete cds.aspartate kinase homology |
| Contig362D | 36142827_c2_122 | 2389 | 5226 | 1812 | 604 | 780 | 1.40E-77 | Bacillus licheniformis | d1014255 | Pz-peptidaseBacillus licheniformis DNA for Pz-peptidase, complete cds. |
| Contig362D | 36523462_c2_113 | 2390 | 5227 | 900 | 300 | 1439 | 2.00E-147 | Staphylococcus aureus | d1011744 | grlBDNA topoisomerase IV GrlB subunitStaphylococcus aureus DNA for DNA topoisomerase IV GrlB subunit.DNA topoisomerase IV GrlA subunit, complete cds. |
| Contig362D | 3928177_f1_5 | 2391 | 5228 | 360 | 120 | | | | | |
| Contig362D | 3937551_c2_125 | 2392 | 5229 | 999 | 333 | 803 | 5.00E-80 | Aquifex aeolicus | g2984139 | asdaspartate-semialdehyde dehydrogenaseAquifex aeolicus section 92 of 109 of the complete genome. |
| Contig362D | 3961702_c2_120 | 2393 | 5230 | 1269 | 423 | 2249 | 2.90E-233 | Staphylococcus epidermidis | JC5325 | femAmethicillin resistance factor FEMA |
| Contig362D | 4025303_c3_149 | 2394 | 5231 | 792 | 264 | 450 | 1.30E-42 | Lactococcus lactis | Q01999 | trpCindoleglycerol phosphate synthaseL. lactis trpE, trpG, trpD, trpF, trpC, trpB trpA genes, completecds.indole-3-glycerol-phosphate synthase |
| Contig362D | 4062762_f3_82 | 2395 | 5232 | 405 | 135 | 508 | 9.10E-49 | Staphylococcus aureus | g3135292 | mscLlarge conductance mechanosensitive channelStaphylococcus aureus large conductance mechanosensitive channel(mscL) gene, complete cds.MscL |

| | | | | | | | | |
|---|---|---|---|---|---|---|---|---|
| Contig362D | 4063802_c2_118 | 2396 | 5233 | 1497 | 499 | 808 | 1.50E-80 | Lactococcus lactis | Q02001 | trpEanthranilate synthase alpha subunitL. lactis trpE, trpG, trpD, trpF, trpC, trpB trpA genes, complete.cds.anthranilate synthase component I |
| Contig362D | 4089062_c2_111 | 2397 | 5234 | 1176 | 392 | 319 | 9.70E-29 | Aquifex aeolicus | g2984155 | sbcDATP-dependent dsDNA exonucleascAquifex aeolicus section 93 of 109 of the complete genome. |
| Contig362D | 4798453_c1_87 | 2398 | 5235 | 1026 | 342 | 242 | 2.70E-27 | Bacillus subtilis | e334771 | ylbCYlbC proteinBacillus subtilis genomic DNA 23.9kB fragment.similar to hypothetical proteins from B. subtilis |
| Contig362D | 4884675_c1_99 | 2399 | 5236 | 1212 | 404 | 1268 | 2.60E-129 | Lactococcus lactis | Q01998 | trpBtryptophan synthase beta subunitL. lactis trpE, trpG, trpD, trpF, trpC, trpB trpA genes, complete.cds.tryptophan synthase beta chain |
| Contig362D | 4890802_f1_12 | 2400 | 5237 | 1152 | 384 | 819 | 1.00E-81 | Bacillus subtilis | g143815 | tyrATyrAB.subtilis dbpA, mtrC(A,B), gerC(1-3), ndk, cheR, aro(B,E,F,H),trp(A-F), hisH, and tyrA genes, complete cds. |
| Contig362D | 4964686_f2_42 | 2401 | 5238 | 204 | 68 | 195 | 1.30E-15 | Bacillus subtilis | e267624 | ywhbUnknown, highly similar to Pseudomonas putidaB.subtilis thrZ downstream chromosomal region.similar to 4-oxalocrotonate tautomerase |
| Contig362D | 5109378_f3_78 | 2402 | 5239 | 615 | 205 | 469 | 1.20E-44 | Bacillus subtilis | e249655 | yneSYncSB.subtilis DNA (26.2 kb fragment; 170 degree region).similar to hypothetical protein MG247 from |
| Contig362D | 5120635_c2_108 | 2403 | 5240 | 240 | 80 | | | | | |
| Contig362D | 6258588_c2_114 | 2404 | 5241 | 1470 | 490 | 1305 | 3.20E-133 | Bacillus subtilis | Q45068 | alsTAlsTB.subtilis DNA (26.2 kb fragment; 170 degree region).similar to sodium/proton dependent alanine carrier |
| Contig362D | 6416566_c1_93 | 2405 | 5242 | 1155 | 385 | 1755 | 6.50E-181 | Staphylococcus aureus | P50072 | grlBDNA topoisomerase IV GrlB subunitStaphylococcus aureus DNA for DNA topoisomerase IV GrlB subunit,DNA topoisomerase IV GrlA subunit, complete cds.DNA topoisomerase (ATP-hydrolyzing) chain Bunnamed protein product |

| | | | | | | | | |
|---|---|---|---|---|---|---|---|---|
| Contig362D | 6664127_c3_156 | 2406 | 5243 | 438 | 146 | | | |
| Contig362D | 6818827_c1_104 | 2407 | 5244 | 1608 | 536 | 2088 | 3.40E-216 | Bacillus subtilis | e1185033 | ykpAABC transporter (ATP-binding protein) homolog ykpABacillus subtilis complete genome (section 8 of 21)similar to ABC transporter (ATP-binding protein) |
| Contig362D | 6929652_c2_127 | 2408 | 5245 | 744 | 248 | 683 | 2.60E-67 | Bacillus subtilis | e1181922 | ykuQYkuQ proteinBacillus subtilis 29kB DNA fragment from ykwC gene to csc15 gene.homologous to acetyltransferases |
| Contig362D | 7203176_c2_119 | 2409 | 5246 | 801 | 267 | 426 | 4.40E-40 | Methanococcus jannaschii | Q60180 | MJ1038tryptophan synthase alpha subunit (trpA)Methanococcus jannaschii section 88 of 150 of the complete genome.tryptophan synthase alpha chain homology.similar to GB |
| Contig362D | 7242250_c3_150 | 2410 | 5247 | 681 | 227 | 276 | 3.50E-24 | Saccharomyces cerevisiae | g927800 | YDR533CYdr533cpSaccharomyces cerevisiae chromosome IV cosmids 8166, 9787, 9717,and lambda 3073.similar to Schizosaccharomyces pombc hypothetical |
| Contig362D | 837550_c3_143 | 2411 | 5248 | 246 | 82 | | | | |
| Contig362D | 970306_c2_106 | 2412 | 5249 | 642 | 214 | 776 | 3.60E-77 | Vibrio fischeri | g3064126 | katAcatalaseVibrio fischeri catalase (katA) gene, complete cds. |
| Contig362D | 978450_c2_116 | 2413 | 5250 | 2049 | 683 | 965 | 3.40E-97 | Bacillus subtilis | d1025380 | YfiXBacillus subtilis DNA, genome sequence, 79 to 81 degree region. |
| Contig362D | 9798180_c1_89 | 2414 | 5251 | 204 | 68 | | | | |
| Contig362D | 9814213_f2_36 | 2415 | 5252 | 471 | 157 | 232 | 1.60E-19 | Archaeoglobus fulgidus | g2649219 | AF1356phosphate ABC transporter, periplasmicArchaeoglobus fulgidus section 97 of 172 of the complete genome.similar to PID |
| Contig363D | 10667002_c2_258 | 2416 | 5253 | 207 | 69 | | | | |
| Contig363D | 10734838_c3_307 | 2417 | 5254 | 996 | 332 | 397 | 5.30E-37 | Saccharomyces cerevisiae | P32377 | ERG19diphosphomevalonate decarboxylaseS.cerevisiae ERG19 gene.ORF YNR043w |
| Contig363D | 10735832_c1_220 | 2418 | 5255 | 273 | 91 | | | | |
| Contig363D | 11032762_f3_148 | 2419 | 5256 | 327 | 109 | 160 | 6.80E-12 | Bacteriophage SPP1 | e244469 | Bacteriophage SPP1 complete nucleotide sequence.gene 2.1 |
| Contig363D | 117893_c3_318 | 2420 | 5257 | 426 | 142 | | | | |

285

| | | | | | | | | |
|---|---|---|---|---|---|---|---|---|
| Contig363D | 12277250_f2_111 | 2421 | 5258 | 996 | 332 | 562 | 1.70E-54 | Bacillus subtilis | P54948 | yxeIpenicillin amidase homolog yxeIBacillus subtilis complete genome (section 21 of 21)similar to penicillin amidase |
| Contig363D | 12714833_c2_286 | 2422 | 5259 | 1218 | 406 | | | | |
| Contig363D | 12902217_f1_41 | 2423 | 5260 | 681 | 227 | 292 | 7.00E-26 | Bacillus subtilis | g3169323 | yojGYojGBacillus subtilis YojA (yojA), YojB (yojB), YojC (yojC), YojD(yojD), YojE (yojE), YojF (yojF), YojG (yojG), YojH (yojH), YojI(yojI), YojJ (yojJ), YojK (yojK), YojL (yojL), YojM (yojM), YojN(yojN), and YojO (yojO) genes, complete cds; and OdhA (odh |
| Contig363D | 134702_f3_164 | 2424 | 5261 | 834 | 278 | 673 | 3.00E-66 | Bacillus subtilis | P39610 | ipa-52rphosphomethylpyrimidine kinaseB.subtilis genomic region (325 to 333),alternate gene name |
| Contig363D | 13835930_c3_313 | 2425 | 5262 | 276 | 92 | | | | | |
| Contig363D | 13876005_c2_250 | 2426 | 5263 | 339 | 113 | | | | | |
| Contig363D | 14547143_c1_195 | 2427 | 5264 | 522 | 174 | 501 | 5.00E-48 | Bacillus subtilis | P21335 | yaaJunknownB. subtilis DNA, 180 kilobase region of replication origin.ORF17 (AA 1-161) |
| Contig363D | 14587817_f2_101 | 2428 | 5265 | 528 | 176 | | | | | |
| Contig363D | 14647510_f1_7 | 2429 | 5266 | 255 | 85 | | | | | |
| Contig363D | 14879688_c2_261 | 2430 | 5267 | 927 | 309 | 234 | 4.20E-26 | Pyrococcus horikoshii | d1028731 | PHLE008335aa long hypothetical proteinPyrococcus horikoshii OT3 genomic DNA, 1434542-1450104 nt position,clonecontains GHMP kinases putative ATP-binding domain; |
| Contig363D | 14882681_c1_216 | 2431 | 5268 | 210 | 70 | 99 | 2.00E-05 | Streptococcus thermophilus bacteriophage TP-J34 | g2897106 | repressorStreptococcus thermophilus bacteriophage lysogeny module, integrasehomolog (int), putative host cell surface-exposed lipoprotein,putative metallo-proteinase, repressor, Cro-like regulatoryprotein, and P1-antirepressor homolog genes, complete cds. |

| | | | | | | | | |
|---|---|---|---|---|---|---|---|---|
| Contig363D | 14885260_c2_269 | 2432 | 5269 | 441 | 147 | 209 | 4.40E-17 | Streptococcus thermophilus | g2444132 | ORF25Streptococcus thermophilus bacteriophage 01205 DNA sequence,putative small subunit of the terminase |
| Contig363D | 15735181_f3_134 | 2433 | 5270 | 204 | 68 | | | | | |
| Contig363D | 15782160_c2_245 | 2434 | 5271 | 747 | 249 | 469 | 1.20E-44 | Caenorhabditis elegans | g1458327 | F08F3.4Caenorhabditis elegans cosmid F08F3. |
| Contig363D | 16054827_c3_320 | 2435 | 5272 | 357 | 119 | | | | | |
| Contig363D | 16212803_c2_274 | 2436 | 5273 | 318 | 106 | 124 | 4.50E-08 | Bacteriophage SPP1 | e244843 | 15gene 15 proteinBacteriophage SPP1 complete nucleotide sequence,gene 15 |
| Contig363D | 16413130_f3_170 | 2437 | 5274 | 246 | 82 | 135 | 2.00E-08 | Saccharomyces cerevisiae | P32583 | SRP40SRP40 proteinS.cerevisiae DNA of chromosome XI, right arm.ORF YKR412 |
| Contig363D | 16603427_c2_284 | 2438 | 5275 | 531 | 177 | | | | | |
| Contig363D | 16798777_c3_291 | 2439 | 5276 | 3558 | 1186 | 5906 | 0 | Staphylococcus aureus | P47768 | rpoBDNA-directed RNA polymerase beta chainS.aureus rplL, orf202, rpoB(rif) and rpoC genes for ribosomalprotein L7/L12, hypothetical protein ORF202, DNA-directed RNApolymerase beta & beta' chains.DNA-directed RNA polymerase beta chain |
| Contig363D | 19690876_c1_208 | 2440 | 5277 | 876 | 292 | 662 | 4.40E-65 | Bacillus subtilis | P39648 | ipa-90hypothetical proteinB.subtilis genomic region (325 to 333).alternate gene name |
| Contig363D | 19695386_c3_315 | 2441 | 5278 | 771 | 257 | | | | | |
| Contig363D | 20078287_f2_108 | 2442 | 5279 | 825 | 275 | 145 | 2.10E-07 | Mycobacterium tuberculosis | e1264597 | MTV025.08Sputative membrane proteinMycobacterium tuberculosis sequence v025.MTV025.08S. len |
| Contig363D | 20087752_f1_44 | 2443 | 5280 | 1506 | 502 | 397 | 2.10E-36 | Bacillus subtilis | P13484 | tagEUDP-glucoseBacillus subtilis rodC operon.rodD (gtaA) polypeptide (AA 1-673) |
| Contig363D | 20322153_c3_306 | 2444 | 5281 | 219 | 73 | | | | | |

| | | | | | | | |
|---|---|---|---|---|---|---|---|
| Contig363D | 20331552_c3_296 | 2445 | | 996 | 332 | 447 | 2.60E-42 | Methanobacterium thermoautotrophicum | g2622612 | MTH1495ornithine cyclodeaminaseMethanobacterium thermoautotrophicum from bases 1349621 to 1362200(section 116 of 148) of the complete genome.Function Code |
| Contig363D | 20511590_c2_240 | 2446 | | 384 | 128 | 414 | 8.30E-39 | MICROCOCCUS LUTEUS | P02395 | RPLLribosomal protein L7/L1250S RIBOSOMAL PROTEIN L7/L12 (MA1/MA2)Escherichia coli ribosomal protein L12 |
| Contig363D | 20756260_c1_225 | 2447 | | 408 | 136 | | | | | |
| Contig363D | 2131552_f3_132 | 2448 | | 378 | 126 | 118 | 1.10E-06 | Plasmodium lophurae | P04929 | histidine-rich proteinPlasmodium gene fragment for histidine-rich protein,plasmodium histidine-rich protein |
| Contig363D | 21484465_c2_278 | 2449 | | 516 | 172 | | | | | |
| Contig363D | 21598838_f2_109 | 2450 | | 465 | 155 | 155 | 6.00E-11 | Haemophilus influenzae | P44520 | HI0108hypotheticalHaemophilus influenzae from bases 111654 to 122227 (section 11 of163) of the complete genome.similar to GB |
| Contig363D | 21758468_c3_340 | 2451 | | 489 | 163 | 123 | 5.70E-08 | Aquifex aeolicus | g2983204 | rimIribosomal-protein-alanine acetyltransferaseAquifex aeolicus section 28 of 109 of the complete genome. |
| Contig363D | 22069160_c3_294 | 2452 | | 393 | 131 | 623 | 5.90E-61 | Staphylococcus aureus | P48942 | rpsLRibosomal protein S12Staphylococcus aureus ribosomal protein S12 (rpsL) gene, complete cds, ribosomal protein S7 (rpsG) and ORF 1 genes, partial cds. |
| Contig363D | 222272200_c1_229 | 2453 | | 939 | 313 | | | | | |
| Contig363D | 22400261_c2_273 | 2454 | | 834 | 278 | 634 | 4.00E-62 | Bacteriophage B1 | e139438 | mhpmajor head proteinBacteriophage TP901-1 genomic region. |
| Contig363D | 22694377_c1_185 | 2455 | | 741 | 247 | 762 | 1.10E-75 | Staphylococcus aureus | g677850 | ORF202hypothetical proteinS.aureus rplL, orf202, rpoB(rif) and rpoC genes for ribosomalprotein L7/L12, hypothetical protein ORf202, DNA-directed RNApolymerase beta & beta' chains. |

289

| | | | | | | | | | |
|---|---|---|---|---|---|---|---|---|---|
| Contig363D | 22773302_c1_232 | 2456 | 5293 | 1803 | 601 | 1371 | 3.20E-140 | Staphylococcus phage 187 | e286568 | ply187cell wall hydrolase Ply187Staphylococcus phage 187 ply187 and hol187 genes. |
| Contig363D | 22790941_c2_277 | 2457 | 5294 | 543 | 181 | 143 | 4.30E-10 | Bacteriophage SPP1 | e244714 | Bacteriophage SPP1 complete nucleotide sequence.gene 17.1 |
| Contig363D | 23442135_c2_253 | 2458 | 5295 | 675 | 225 | 148 | 1.80E-09 | Synechocystis sp. | d1018298 | cbbZpphosphoglycolate phosphataseSynechocystis sp. PCC6803 complete genome, 9/27, 1056467-1188885.ORF_ID |
| Contig363D | 23469213_c2_268 | 2459 | 5296 | 411 | 137 | | | | | |
| Contig363D | 23477213_c2_260 | 2460 | 5297 | 1011 | 337 | 1085 | 6.50E-110 | Bacillus subtilis | | ipa-88dphosphotransacetylaseB.subtilis genomic region (325 to 333).alternate gene name |
| Contig363D | 23572178_c3_319 | 2461 | 5298 | 195 | 65 | | | | | |
| Contig363D | 23601637_c1_193 | 2462 | 5299 | 816 | 272 | 374 | 1.40E-34 | Haemophilus influenzae | g471234 | CDP-ribitol pyrophosphorylaseH.influenzae DNA for serotype b capsulation locus.orf1 |
| Contig363D | 23603391_c3_328 | 2463 | 5300 | 294 | 98 | | | | | |
| Contig363D | 23617140_c2_254 | 2464 | 5301 | 1404 | 468 | 441 | 5.00E-44 | Bacillus subtilis | e1183038 | yhfThypothetical proteinBacillus subtilis complete genome (section 6 of 21).similar to long-chain fatty-acid-CoA ligase |
| Contig363D | 23712830_c1_213 | 2465 | 5302 | 489 | 163 | 225 | 8.80E-19 | Streptococcus thermophilus bacteriophage Sfi21 | g2352435 | Streptococcus thermophilus bacteriophage Sfi21 DNA replicationmodule.orf157 |
| Contig363D | 23867125_f1_36 | 2466 | 5303 | 204 | 68 | | | | | |
| Contig363D | 2392837_c1_226 | 2467 | 5304 | 426 | 142 | 226 | 6.90E-19 | Bacteriophage SPP1 | e244844 | Bacteriophage SPP1 complete nucleotide sequence.gene 16.1 |
| Contig363D | 23992128_c2_282 | 2468 | 5305 | 222 | 74 | 114 | 5.10E-07 | Staphylococcus phage 187 | e286569 | hol187holin protein Hol187Staphylococcus phage 187 ply187 and hol187 genes. |
| Contig363D | 24026077_c3_326 | 2469 | 5306 | 954 | 318 | 560 | 2.80E-54 | Bacteriophage SPP1 | e244838 | 7gene 7 proteinBacteriophage SPP1 complete nucleotide sequence.gene 7 |
| Contig363D | 24229837_c1_215 | 2470 | 5307 | 243 | 81 | 97 | 3.20E-05 | Lactobacillus sake | g599850 | orf1hypothetical protein (bacteriocin saiA 3'-region)L.sake sakacin A gene cluster. |

290

| | | | | | | | | | |
|---|---|---|---|---|---|---|---|---|---|
| Contig363D | 24258462_c3_335 | 2471 | 5308 | 336 | 112 | 200 | 3.90E-16 | Lactococcus lactis phage BK5-T | g928831 | Bacteriophage BK5-T ORF410, 3' end pf cds, 20 ORFs, repressorprotein, and Cro repressor protein genes, complete cds, ORF70'gene, 5' end of cds.ORF95; putative |
| Contig363D | 24275342_c1_217 | 2472 | 5309 | 378 | 126 | | | | | |
| Contig363D | 24328127_f3_135 | 2473 | 5310 | 204 | 68 | 154 | 2.10E-10 | Escherichia coli | P77212 | ykgCykgC proteinEscherichia coli K-12 MGI655 section 27 of 400 of the completegenome.f450; 35 pct identical (29 gaps) to 430 residues of |
| Contig363D | 24337800_c2_285 | 2474 | 5311 | 1386 | 462 | 223 | 6.90E-18 | Staphylococcus aureus | JC5470 | hypothetical 29.1K protein |
| Contig363D | 2438878_f3_169 | 2475 | 5312 | 213 | 71 | 288 | 1.90E-25 | Plasmid pI258 | P30330 | arsCarsonate reductasePlasmid pI258 arsenic resistance operon (arsRBC) genes, completecds.protein-tyrosinc-phosphatase, low molecular weight |
| Contig363D | 24401462_c1_200 | 2476 | 5313 | 591 | 197 | 367 | 7.90E-34 | Bacillus subtilis | P42404 | yckFunknownBacillus subtilis DNA around 28 degrees region of chromosomecontaining yckA-H genes.similar to hypothetical proteins |
| Contig363D | 244114050_c3_301 | 2477 | 5314 | 2793 | 931 | 4374 | 0 | Staphylococcus epidermidis | c1296735 | fibrinogen-binding proteinStaphylococcus epidermidis gene encoding fibrinogen-bindingprotein, complete CDS. |
| Contig363D | 24415875_c3_297 | 2478 | 5315 | 300 | 100 | 129 | 1.40E-07 | Caenorhabditis elegans | g1458327 | F08F3.4Caenorhabditis elegans cosmid F08F3. |
| Contig363D | 24429643_c1_192 | 2479 | 5316 | 222 | 74 | | | | | |
| Contig363D | 24491037_c1_218 | 2480 | 5317 | 495 | 165 | | | | | |
| Contig363D | 24500387_c3_322 | 2481 | 5318 | 564 | 188 | | | | | |
| Contig363D | 24617130_c2_241 | 2482 | 5319 | 3648 | 1216 | 5258 | 0 | Staphylococcus aureus | e187583 | rpoCDNA-directed RNA polymeraseS.aureus DNA for rpoC gene.B' subunit |
| Contig363D | 24648937_c1_203 | 2483 | 5320 | 657 | 219 | 626 | 2.80E-61 | Bacillus subtilis | P39615 | ipa-57duracil-DNA glycosylaseB.subtilis genomic region (325 to 333).uracil-DNA glycosylasealternate gene name |
| Contig363D | 24650332_c3_323 | 2484 | 5321 | 228 | 76 | | | | | |

| | | | | | | | | | |
|---|---|---|---|---|---|---|---|---|---|
| Contig363D | 24650468_f2_103 | 2485 | 5322 | 1383 | 461 | 489 | 9.40E-47 | Bacteriophage TP901-1 | eI55312 | integraseBacteriophage TP901-1 ORF1,2 & 3.Orf1 |
| Contig363D | 24667192_f1_42 | 2486 | 5323 | 183 | 61 | 201 | 1.40E-15 | Plasmid pI258 | P30329 | arsBarsenic efflux pump proteinPlasmid pI258 arsenic resistance operon (arsRBC) genes, completecds.arsenical pump membrane protein |
| Contig363D | 24803462_f1_4 | 2487 | 5324 | 861 | 287 | 463 | 5.30E-44 | Synechocystis sp. | P73846 | SLR1717hypothetical proteinSynechocystis sp. PCC6803 complete genome, 12/27, 1430419-1576592.ORF_ID |
| Contig363D | 24823437_f2_102 | 2488 | 5325 | 495 | 165 | | | | | |
| Contig363D | 24854637_c3_300 | 2489 | 5326 | 903 | 301 | 404 | 9.50E-38 | Bacillus subtilis | eI84491 | ywtEconserved hypothetical protein ywtEBacillus subtilis complete genome (section 19 of 21)similar to hypothetical proteins |
| Contig363D | 25438433_f2_81 | 2490 | 5327 | 420 | 140 | | | | | |
| Contig363D | 25509692_c3_331 | 2491 | 5328 | 498 | 166 | 151 | 6.10E-11 | Bacteriophage SPP1 | e244846 | Bacteriophage SPP1 complete nucleotide sequence.gene 17.5 |
| Contig363D | 25578827_c2_242 | 2492 | 5329 | 261 | 87 | 334 | 2.50E-30 | Staphylococcus aureus | Q53602 | unknownStaphylococcus aureus ribosomal protein S12 (rpsL) gene, completecds, ribosomal protein S7 (rpsG) and ORF 1 genes, partial cds.ORF 1 |
| Contig363D | 25579662_f1_52 | 2493 | 5330 | 1221 | 407 | 849 | 6.60E-85 | Bacillus subtilis | eI83009 | yhaAaminoacylase homolog yhaABacillus subtilis complete genome (section 6 of 21)similar to aminoacylase |
| Contig363D | 25660937_c3_339 | 2494 | 5331 | 498 | 166 | 175 | 2.90E-13 | Bacillus subtilis | P46922 | opuACglycine betaine-binding protein precursorBacillus subtilis ATPase (opuAA), transmembrane protein (opuAB) andglycine betaine-binding protein precursor (opuAC) genes, completecds. |
| Contig363D | 26173287_c3_329 | 2495 | 5332 | 363 | 121 | 103 | 7.50E-06 | Bacteriophage SPP1 | e244712 | Bacteriophage SPP1 complete nucleotide sequence.gene 16 |
| Contig363D | 26290912_f2_114 | 2496 | 5333 | 882 | 294 | 665 | 2.10E-65 | Bacillus subtilis | eI82286 | yciAconserved hypothetical protein yciABacillus subtilis complete genome (section 2 of 21)similar to hypothetical proteins |
| Contig363D | 26306568_c1_221 | 2497 | 5334 | 330 | 110 | | | | | |

| | | | | | | | |
|---|---|---|---|---|---|---|---|
| Contig363D | 26350125_c2_265 | 2498 | | | | | |
| Contig363D | 26360327_c1_222 | 2499 | 5335 | 252 | 84 | 3.10E-22 | Homo sapiens | P33316 | DUTdeoxyuridine nucleotidohydrolaseHuman deoxyuridine nucleotidohydrolase mRNA, complete cds,retroviral proteinaseDUT-N; alternatively spliced; nuclear form of the |
| Contig363D | 26369082_c2_267 | 2500 | 5336 | 552 | 184 | | | |
| Contig363D | 26375952_c1_214 | 2501 | 5337 | 252 | 84 | | | |
| Contig363D | 26569377_c3_304 | 2502 | 5338 | 627 | 209 | 1.40E-18 | Bacteriophage TP901-1 | e1254413 | hypothetical proteinBacteriophage TP901-1 ORFs 1-12,ORF11 |
| Contig363D | 26734625_f3_156 | 2503 | 5339 | 639 | 213 | 3.60E-61 | Bacillus subtilis | e1182298 | yckGD-arabino 3-hexulose 6-phosphate formaldeh homolog yckGBacillus subtilis complete genome (section 2 of 21)similar to D-arabino 3-hexulose 6-phosphate |
| Contig363D | 26772801_f3_157 | 2504 | 5340 | 351 | 117 | 3.40E-17 | Streptococcus thermophilus bacteriophage Sfi21 | e308969 | orfl27cI-like repressorStreptococcus thermophilus bacteriophage Sfi21 DNA; lysogenymodule, 8141 bp,putative |
| Contig363D | 26839638_c1_236 | 2505 | 5341 | 504 | 168 | 2.30E-09 | Dictyostelium discoideum | g467292 | glutamine-asparagine rich proteinDictyostelium discoideum AX3 glutamine-asparagine rich proteingene, partial cds. |
| Contig363D | 27318_c2_290 | 2506 | 5342 | 1314 | 438 | 2.30E-146 | Bacillus subtilis | P39651 | ywfOUnknownBacillus subtilis complete genome (section 20 of 21)alternate gene name |
| Contig363D | 276590_c3_309 | 2507 | 5343 | 1035 | 345 | 6.90E-122 | Zymomonas mobilis | P20368 | ADHAalcohol dehydrogenase, IZ.mobilis alcohol dehydrogenase I (adhA) gene, complete cds.alcohol dehydrogenasealcohol dehydrogenase I (adhA) (EC 1.1.1.1) |
| Contig363D | 2847887_f1_43 | 2508 | 5344 | 375 | 125 | 1.70E-24 | Bacillus subtilis | e1186261 | ywzChypothetical protein ywzCBacillus subtilis complete genome (section 20 of 21) |
| | | | 5345 | 576 | 192 | 2.20E-79 | Plasmid pI258 | P30329 | arsBarsenic efflux pump proteinPlasmid pI258 arsenic resistance operon (arsRBC) genes, completecds.arsenical pump membrane protein |

293

| | | | | | | | | | |
|---|---|---|---|---|---|---|---|---|---|
| Contig363D | 29694425_f3_172 | 2509 | 5346 | 852 | 284 | 418 | 3.10E-39 | Bacillus subtilis | P51831 | fabG3-ketoacyl-acyl carrier protein reductaseBacillus subtilis PlsX (plsX), malonyl-CoAalso called 3-oxoacyl-acyl carrier protein |
| Contig363D | 2995675_f2_60 | 2510 | 5347 | 252 | 84 | | | | | |
| Contig363D | 30742332_c2_271 | 2511 | 5348 | 228 | 76 | | | | | |
| Contig363D | 31334838_c3_341 | 2512 | 5349 | 519 | 173 | 544 | 1.40E-52 | Bacillus subtilis | e267625 | ywhDUnknownB.subtilis thrZ downstream chromosomal region. |
| Contig363D | 31353377_c1_188 | 2513 | 5350 | 474 | 158 | 699 | 5.20E-69 | Bacillus subtilis | e1182044 | rpsGribosomal protein S7 (BS7)Bacillus subtilis complete genome (section 1 of 21) |
| Contig363D | 32031437_c1_230 | 2514 | 5351 | 2706 | 902 | 1163 | 3.50E-118 | Bacteriophage PZA | P07537 | 12pre-neck appendage proteinBacteriophage PZA (from B.subtilis), complete genome.phage PZA gene 12 protein |
| Contig363D | 32595152_c1_231 | 2515 | 5352 | 402 | 134 | | | | | |
| Contig363D | 3306563_c2_256 | 2516 | 5353 | 366 | 122 | | | | | |
| Contig363D | 33235050_f2_70 | 2517 | 5354 | 507 | 169 | | | | | |
| Contig363D | 33414693_c3_308 | 2518 | 5355 | 1089 | 363 | 150 | 5.80E-16 | Methanococcus jannaschii | Q58487 | MJ1087mevalonate kinaseMethanococcus jannaschii section 93 of 150 of the complete genome.similar to PID |
| Contig363D | 33600035_c3_295 | 2519 | 5356 | 2118 | 706 | 2785 | 4.70E-290 | Bacillus subtilis | e1182045 | fuselongation factor GBacillus subtilis complete genome (section 1 of 21) |
| Contig363D | 33756503_c3_311 | 2520 | 5357 | 210 | 70 | 125 | 3.50E-08 | Lactobacillus casei bacteriophage A2 | e1285113 | orfBhypothetical proteinBacteriophage A2 rep, xis and int genes. |
| Contig363D | 33786251_c2_287 | 2521 | 5358 | 246 | 82 | | | | | |
| Contig363D | 33869193_c1_223 | 2522 | 5359 | 183 | 61 | 130 | 1.00E-08 | Staphylococcus bacteriophage phi 11 | Q03183 | rinBBacteriophage phi-11 int gene activatorBacteriophage phi-11 rinA and rin B genes, required for theactivation of Staphylococcal phage phi-11 int expression. |
| Contig363D | 34025066_c2_281 | 2523 | 5360 | 642 | 214 | 89 | 6.90E-07 | Bacteriophage phig1e | e247172 | Rorf232Lactobacillus bacteriophage phig1e complete genomic DNA. |
| Contig363D | 34242202_c3_317 | 2524 | 5361 | 270 | 90 | | | | | |

| | | | | | | | | | |
|---|---|---|---|---|---|---|---|---|---|
| Contig363D | 34242202_f2_120 | 2525 | 5362 | 210 | 70 | | | | |
| Contig363D | 34407053_f3_128 | 2526 | 5363 | 783 | 261 | 564 | 1.10E-54 | Synechocystis sp. | d1019442 | hypothetical proteinSynechocystis sp. PCC6803 complete genome, 26/27, 3270710-3418851.ORF_ID |
| Contig363D | 34609703_c3_324 | 2527 | 5364 | 198 | 66 | | | | | |
| Contig363D | 34651555_c1_228 | 2528 | 5365 | 3123 | 1041 | 267 | 2.30E-24 | Bacteriophage SPP1 | e244718 | Bacteriophage SPP1 complete nucleotide sequence.gene 18 |
| Contig363D | 36054813_c2_264 | 2529 | 5366 | 387 | 129 | | | | | |
| Contig363D | 36228563_c3_321 | 2530 | 5367 | 699 | 233 | | | | | |
| Contig363D | 36521067_f2_112 | 2531 | 5368 | 204 | 68 | | | | | |
| Contig363D | 3909643_f2_62 | 2532 | 5369 | 1197 | 399 | 654 | 3.10E-64 | Synechocystis sp. | d1017466 | hypothetical proteinSynechocystis sp. PCC6803 complete genome, 2/27, 133860-271599.ORF_ID |
| Contig363D | 3912503_c2_259 | 2533 | 5370 | 1500 | 500 | 331 | 1.30E-28 | Bacillus subtilis | e1182947 | yhdGhypothetical proteinBacillus subtilis complete genome (section 6 of 21)similar to amino acid transporter |
| Contig363D | 3961590_c1_201 | 2534 | 5371 | 1164 | 388 | 669 | 7.90E-66 | Bacillus subtilis | e1183037 | yhlShypothetical proteinBacillus subtilis complete genome (section 6 of 21)similar to acetyl-CoA C-acetyltransferase |
| Contig363D | 39635_f1_30 | 2535 | 5372 | 1245 | 415 | 972 | 6.10E-98 | Escherichia coli | P77212 | ykgCykgC proteinEscherichia coli K-12 MG1655 section 27 of 400 of the completegenome.f450; 35 pct identical (29 gaps) to 430 residues of |
| Contig363D | 4031952_c1_184 | 2536 | 5373 | 501 | 167 | 545 | 1.10E-52 | Bacillus subtilis | P42923 | rplJRibosomal Protein L10Bacillus subtilis genes for ribosomal proteins L1, L10 and L12,partial and complete cds. |
| Contig363D | 4078518_f3_173 | 2537 | 5374 | 882 | 294 | 534 | 1.60E-51 | Bacillus subtilis | P54950 | yxcKmonooxygenase homolog yxeKBacillus subtilis complete genome (section 21 of 21)similar to monooxygenase |
| Contig363D | 4181527_c1_219 | 2538 | 5375 | 447 | 149 | | | | | |
| Contig363D | 4181577_c3_316 | 2539 | 5376 | 1251 | 417 | 465 | 3.30E-44 | Aquifex aeolicus | g2983861 | dnaBreplicative DNA helicaseAquifex aeolicus section 74 of 109 of the complete genome. |

294

295

| | | | | | | | | | |
|---|---|---|---|---|---|---|---|---|---|
| Contig363D | 4329063_c2_243 | 2540 | 5377 | 1245 | 415 | 1759 | 2.50E-181 | Bacillus subtilis | P33166 | tufA elongation factor Tu Bacillus subtilis complete genome (section 1 of 21) translation elongation factor Tu |
| Contig363D | 4398453_f1_49 | 2541 | 5378 | 477 | 159 | 279 | 3.70E-24 | Chelatobacter heintzii | P54989 | nmoA NTA monooxygenase component A Chelatobacter heintzii NTA monooxygenase component B (nmoB). NTA monooxygenase component A (nmoA), regulatory protein (nmoR) andtransposase (nmoT) genes, complete cds. |
| Contig363D | 446062_c1_235 | 2542 | 5379 | 690 | 230 | 1165 | 2.20E-118 | Staphylococcus aureus | P19380 | putative transposase S. aureus IS431mec gene associated with methicillin resistance,putative transposase (AA 1-224) |
| Contig363D | 4725006_c3_334 | 2543 | 5380 | 537 | 179 | | | | | |
| Contig363D | 4727203_c1_204 | 2544 | 5381 | 369 | 123 | | | | | |
| Contig363D | 4735833_f1_46 | 2545 | 5382 | 711 | 237 | 464 | 4.20E-44 | Bacillus subtilis | P37530 | yaaG unknown B. subtilis DNA, 180 kilobase region of replication origin,similar to deoxypurine kinase subunit |
| Contig363D | 4741068_c3_327 | 2546 | 5383 | 609 | 203 | 210 | 3.40E-17 | Bacteriophage phig1e | e247154 | Rorf204 minor capsid protein Lactobacillus bacteriophage phig1e complete genomic DNA. |
| Contig363D | 4741077_c3_314 | 2547 | 5384 | 687 | 229 | 238 | 3.70E-20 | Bacteriophage phig1e | e247139 | Rorf242 Lactobacillus bacteriophage phig1e complete genomic DNA. |
| Contig363D | 4875756_f2_89 | 2548 | 5385 | 201 | 67 | | | | | |
| Contig363D | 4876967_c1_196 | 2549 | 5386 | 579 | 193 | 168 | 9.70E-13 | Bacillus subtilis | e1182923 | yhdA hypothetical protein Bacillus subtilis complete genome (section 5 of 21) similar to hypothetical proteins |
| Contig363D | 4882760_c3_345 | 2550 | 5387 | 183 | 61 | | | | | |
| Contig363D | 4886075_f2_118 | 2551 | 5388 | 678 | 226 | 794 | 4.50E-79 | Bacillus subtilis | P37529 | yaaF unknown B. subtilis DNA, 180 kilobase region of replication origin,similar to deoxypurine kinase subunit |

| | | | | | | | | | |
|---|---|---|---|---|---|---|---|---|---|
| Contig363D | 4892127_c1_233 | 2552 | 5389 | 2706 | 902 | 1557 | 6.30E-160 | Bacillus subtilis | d1020130 | ydfJantibiotic transport-associated protein homolog ydfJBacillus subtilis genome sequence, 148 kb sequence of the regionbetween 35 and 47 degree.PROBABLE TRANSPORT PROTEIN, SIMILAR TO ANTIBIOTIC |
| Contig363D | 4901703_c1_191 | 2553 | 5390 | 510 | 170 | | | | | |
| Contig363D | 4946962_c2_247 | 2554 | 5391 | 1068 | 356 | 172 | 1.60E-10 | Saccharomyces cerevisiae | e253285 | probable membrane protein YDL246c.S.cerevisiae chromosome IV reading frame ORF YDL246c.alcohol dehydrogenaseORF YDL246c |
| Contig363D | 4964677_c2_263 | 2555 | 5392 | 444 | 148 | 126 | 2.30E-15 | Bacillus subtilis | P37455 | ssbsingle strand DNA binding proteinB. subtilis DNA, 180 kilobase region of replication origin.single-stranded DNA-binding protein homology |
| Contig363D | 5080092_c3_303 | 2556 | 5393 | 744 | 248 | 529 | 5.40E-51 | Bacillus subtilis | e1182188 | ybfT glucosamine-6-phosphate isomerase homolog ybfTBacillus subtilis complete genome (section 2 of 21)similar to glucosamine-6-phosphate isomerase |
| Contig363D | 5125076_f2_107 | 2557 | 5394 | 810 | 270 | 873 | 1.90E-87 | Bacillus subtilis | P39645 | ipa-87rconserved hypothetical protein ywflB.subtilis genomic region (325 to 333).alternate gene name |
| Contig363D | 5251588_c1_234 | 2558 | 5395 | 582 | 194 | | | | | |
| Contig363D | 5258515_c3_325 | 2559 | 5396 | 1314 | 438 | 1298 | 1.80E-132 | Bacteriophage SPP1 | P54308 | SPP1 gene 2terminaseBacteriophage SPP1 complete nucleotide sequence.gene 2 |
| Contig363D | 5370450_f3_127 | 2560 | 5397 | 1284 | 428 | 305 | 2.90E-27 | Archaeoglobus fulgidus | g2650605 | AF0049A. fulgidus predicted coding region AF0049Archaeoglobus fulgidus section 4 of 172 of the complete genome.hypothetical protein; identified by GeneMark; |
| Contig363D | 56626_c2_280 | 2561 | 5398 | 336 | 112 | | | | | |
| Contig363D | 587811_f3_168 | 2562 | 5399 | 345 | 115 | | | | | |
| Contig363D | 6056625_c1_238 | 2563 | 5400 | 258 | 86 | | | | | |
| Contig363D | 6406337_f3_133 | 2564 | 5401 | 210 | 70 | | | | | |

297

| | | | | | | | | |
|---|---|---|---|---|---|---|---|---|
| Contig363D | 6407136_c2_270 | 2565 | 5402 | 1455 | 485 | 667 | 1.30E-65 | Bacteriophage SPP1 | P54309 | SPP1 gene 6portal proteinBacteriophage SPP1 complete nucleotide sequence.gene 6 |
| Contig363D | 6757338_c2_246 | 2566 | 5403 | 1089 | 363 | 1129 | 1.40E-114 | Bacillus subtilis | e1182191 | yhgEbranched-chain amino acid aminotransferase homolog yhgEBacillus subtilis complete genome (section 2 of 21)similar to branched-chain amino acid |
| Contig363D | 6932750_f1_40 | 2567 | 5404 | 378 | 126 | 266 | 4.00E-23 | Bacillus subtilis | g3169322 | yojFYojFBacillus subtilis YojA (yojA), YojB (yojB), YojC (yojC), YojD(yojD), YojE (yojE), YojF (yojF), YojG (yojG), YojH (yojH), YojI(yojI), YojJ (yojJ), YojK (yojK), YojL (yojL), YojM (yojM), YojN(yojN), and YojO (yojO) genes, complete cds; and OdhA (odh |
| Contig363D | 7068751_c3_336 | 2568 | 5405 | 945 | 315 | 974 | 3.80E-98 | Bacillus subtilis | P46336 | iolSmyo-inositol catabolism iolSBacillus subtilis genomic DNA, 36 kb region between gnt and ioloperons,plausibly involved in inositol catabolism |
| Contig363D | 7275263_c1_227 | 2569 | 5406 | 441 | 147 | 158 | 1.10E-11 | Bacteriophage SPP1 | e244713 | Bacteriophage SPP1 complete nucleotide sequence.gene 17 |
| Contig363D | 818942_c3_338 | 2570 | 5407 | 477 | 159 | 173 | 2.80E-17 | Bacillus subtilis | P46922 | opuACglycine betaine-binding protein precursorBacillus subtilis ATPase (opuAA), transmembrane protein (opuAB) andglycine betaine-binding protein precursor (opuAC) genes, completecds. |
| Contig363D | 819575_c2_279 | 2571 | 5408 | 1857 | 619 | 158 | 1.20E-08 | Bacteriophage phig1e | c247163 | Rorf372Lactobacillus bacteriophage phig1e complete genomic DNA. |
| Contig363D | 821012_c3_298 | 2572 | 5409 | 1725 | 575 | 469 | 5.70E-44 | Haemophilus influenzae | g547513 | hypothetical protein 3 (capsulation locus)Haemophilus influenzae serotype a capsulation locus region II DNA.orf3 |
| Contig363D | 833125_f3_149 | 2573 | 5410 | 285 | 95 | | | | | |
| Contig363D | 892842_c1_205 | 2574 | 5411 | 387 | 129 | 337 | 1.20E-30 | Bacillus subtilis | P39619 | ipa-61dconserved hypothetical protein ywdKB.subtilis genomic region (325 to 333),alternate gene name |

| | | | | | | | | |
|---|---|---|---|---|---|---|---|---|
| Contig363D | 9765677_c3_312 | 2575 | 5412 | 804 | 268 | 226 | 6.90E-19 | Lactococcus lactis phage BK5-T | g928839 | Bacteriophage BK5-T ORF410, 3' end pf cds, 20 ORFs, repressorprotein, and Cro repressor protein genes, complete cds, ORF70/gene, 5' end of cds.ORF266; putative |
| Contig363D | 978377_c2_257 | 2576 | 5413 | 264 | 88 | | | | |
| Contig363D | 9819392_c2_248 | 2577 | 5414 | 789 | 263 | 179 | 5.60E-13 | Caenorhabditis elegans | g1463023 | F45E1.3Caenorhabditis elegans cosmid F45E1. |
| Contig363D | 9926903_c2_266 | 2578 | 5415 | 309 | 103 | | | | |
| Contig363D | 994052_c3_333 | 2579 | 5416 | 1536 | 512 | | | | |
| Contig363D | 10006340_f3_215 | 2580 | 5417 | 501 | 167 | | | | |
| Contig363D | 10267016_c1_259 | 2581 | 5418 | 789 | 263 | 210 | 3.40E-17 | Streptomyces lividans | P32184 | tipATipAL-AStipAL-AS complexthiostrepton-specific recognition protein; Method |
| Contig364D | 10268818_f1_41 | 2582 | 5419 | 234 | 78 | | | | |
| Contig364D | 10581693_f3_214 | 2583 | 5420 | 684 | 228 | 842 | 3.70E-84 | Bacillus subtilis | e1184962 | ykvJconserved hypothetical protein ykvJBacillus subtilis complete genome (section 8 of 21)similar to hypothetical proteins |
| Contig364D | 10589818_f3_160 | 2584 | 5421 | 201 | 67 | | | | |
| Contig364D | 10667002_c2_365 | 2585 | 5422 | 201 | 67 | | | | |
| Contig364D | 10737818_f2_133 | 2586 | 5423 | 471 | 157 | 223 | 1.40E-18 | Bacillus subtilis | P17868 | yqxDYqfMBacillus subtilis DNA, 283 Kb region containing skin element.P23 (aa 1-196); unidentified reading frame |
| Contig364D | 10941007_f3_176 | 2587 | 5424 | 291 | 97 | 103 | 7.50E-06 | Leishmania tarentolae | S51910 | cryptogene protein G4 |
| Contig364D | 10976387_c2_397 | 2588 | 5425 | 210 | 70 | | | | |
| Contig364D | 11023402_f1_34 | 2589 | 5426 | 273 | 91 | 127 | 2.10E-08 | Pyrococcus horikoshii | d1028459 | PH AU02110 1aa long hypothetical proteinPyrococcus horikoshii OT3 genomic DNA, 1195819-1238496 nt position,clone |
| Contig364D | 110275_f3_245 | 2590 | 5427 | 276 | 92 | 292 | 7.00E-26 | Staphylococcus epidermidis | e255528 | membrane proteinS.epidermidis gene encoding ABC transport system. |
| Contig364D | 11152176_c3_418 | 2591 | 5428 | 1029 | 343 | 1111 | 1.10E-112 | Bacillus subtilis | e1181485 | ykaBYkaBBacillus subtilis 168 56 kb DNA fragment between xlyA and ykoR.homologous to low affinity phosphate transporter |

298

| | | | | | | | | |
|---|---|---|---|---|---|---|---|---|
| Contig364D | 11883557_f2_150 | 2592 | 5429 | 195 | 65 | | | | |
| Contig364D | 11910927_f3_249 | 2593 | 5430 | 327 | 109 | | | | |
| Contig364D | 1199063_f2_102 | 2594 | 5431 | 510 | 170 | 165 | 4.40E-12 | Haemophilus influenzae | P44520 | HI0108hypotheticalHaemophilus influenzae from bases 111654 to 122227 (section 11 of 163) of the complete genome.similar to GB |
| Contig364D | 1214688_f2_104 | 2595 | 5432 | 939 | 313 | 526 | 1.10E-50 | Bacillus subtilis | P18579 | murBUDP-N-acetylenolpyruvoylglucosamine reductaseBacillus subtilis (clone lambda-BS1) cell division and sporulationprotein (dds) gene, complete cds.ORF2 |
| Contig364D | 12595301_f2_108 | 2596 | 5433 | 258 | 86 | 95 | 7.00E-05 | Pyrococcus horikoshii | d1027485 | PHAY036173aa long hypothetical proteinPyrococcus horikoshii OT3 genomic DNA, 299830-340636 nt position,clonecontains prokaryotic membrane lipoprotein lipid |
| Contig364D | 12616018_f3_159 | 2597 | 5434 | 270 | 90 | | | | |
| Contig364D | 12617827_c3_469 | 2598 | 5435 | 762 | 254 | 856 | 1.20E-85 | Bacillus subtilis | c1186080 | tpitriose phosphate isomeraseBacillus subtilis complete genome (section 18 of 21)alternate gene name |
| Contig364D | 12789077_c2_380 | 2599 | 5436 | 1107 | 369 | 1311 | 7.30E-134 | Bacillus subtilis | g2618842 | uvrAexcinuclease ABC subunit ABacillus subtilis 300-304 degree genomic sequence. |
| Contig364D | 12948336_c2_384 | 2600 | 5437 | 273 | 91 | 316 | 2.00E-28 | Bacillus subtilis | g2668494 | clpPClpPBacillus subtilis Clp protease proteolytic component (clpP) gene,complete cds,proteolytic component of Clp protease |
| Contig364D | 1351533_c1_309 | 2601 | 5438 | 2571 | 857 | 3966 | 0 | Staphylococcus aureus | O06446 | secASecAStaphylococcus aureus NCTC 8325 SecA (secA) gene, complete cds. |
| Contig364D | 13710887_c1_322 | 2602 | 5439 | 753 | 251 | 315 | 2.60E-28 | Acinetobacter sp. ADP1 | g3172120 | quiBcatabolic dehydroquinate dehydrataseAcinetobacter sp. ADP1 pca-qui-pob supraperonic cluster, completesequence. |
| Contig364D | 13714193_c2_375 | 2603 | 5440 | 582 | 194 | 583 | 1.00E-56 | STAPHYLOCOCCUS CARNOSUS | P47995 | HYPOTHETICAL PROTEIN IN SECA 5'REGION (ORF1) (FRAGMENT) |

300

| | | | | | | | | | |
|---|---|---|---|---|---|---|---|---|---|
| Contig364D | 13722318_f2_138 | 2604 | 5441 | 813 | 271 | 348 | 8.20E-32 | Staphylococcus carnosus | g2735506 | sceBSceB precursorStaphylococcus carnosus N5,N10-methylenetetrahydromethanopterinreductase homolog, SceB precursor (sceB) and putative transmembraneprotein genes, complete cds, and putative Na+/H+ antiporter NhaC(nhaC) gene, partial cds.major secreted pro |
| Contig364D | 1376577_f3_170 | 2605 | 5442 | 675 | 225 | | | | | |
| Contig364D | 13803167_f3_169 | 2606 | 5443 | 552 | 184 | 157 | 6.60E-11 | Bacillus subtilis | d1020071 | ydcI.integrase homolog ydcI.Bacillus subtilis genome sequence, 148 kb sequence of the regionbetween 35 and 47 degree.PROBABLE INTEGRASE. |
| Contig364D | 13921942_c2_387 | 2607 | 5444 | 1554 | 518 | 1690 | 5.10E-174 | Bacillus subtilis | e1186079 | pgmphosphoglycerate mutaseBacillus subtilis complete genome (section 18 of 21) |
| Contig364D | 13931527_c2_327 | 2608 | 5445 | 723 | 241 | | | | | |
| Contig364D | 1408438_f2_147 | 2609 | 5446 | 948 | 316 | 110 | 6.80E-06 | Escherichia coli | g1787718 | hypothetical protein b1447E.scherichia coli K-12 MG1655 section 131 of 400 of the completegenome.f149; This 149 aa ORF is 31 pct identical (11 gaps) |
| Contig364D | 14120465_f2_78 | 2610 | 5447 | 513 | 171 | | | | | |
| Contig364D | 14460882_f1_33 | 2611 | 5448 | 183 | 61 | 128 | 5.00E-08 | Staphylococcus haemolyticus | g1022726 | unknownStaphylococcus haemolyticus IS1272 ORF1 and ORF2 genes, completecds.ORF1 |
| Contig364D | 14478377_c2_349 | 2612 | 5449 | 1149 | 383 | 637 | 1.90E-62 | Bacillus subtilis | P49852 | ykiAYkiABacillus subtilis hmp DNA for 7 ORFs, complete cds.high homology to flavohemoprotein (Haemoglobin-like |
| Contig364D | 14500052_f2_83 | 2613 | 5450 | 204 | 68 | | | | | |
| Contig364D | 14564005_f3_198 | 2614 | 5451 | 249 | 83 | | | | | |
| Contig364D | 14642203_c2_339 | 2615 | 5452 | 834 | 278 | 772 | 9.60E-77 | Bacillus subtilis | e1186383 | yxkDconserved hypothetical protein yxkDBacillus subtilis complete genome (section 20 of 21)similar to hypothetical proteins |
| Contig364D | 14648452_c2_378 | 2616 | 5453 | 801 | 267 | 346 | 1.30E-31 | Staphylococcus aureus | c244971 | S.aureus orfs 1,2,3 & 4.ORF1 |

| | | | | | | | | |
|---|---|---|---|---|---|---|---|---|
| Contig364D | 14875890_c2_361 | 2617 | 5454 | 846 | 282 | 713 | 1.70E-70 | Bacillus subtilis | e1249784 | yvgNputative reductase protein, YvgNBacillus subtilis. 42.7kB DNA fragment from yvsA to yvqA.alternate gene name |
| Contig364D | 14878807_f3_255 | 2618 | 5455 | 960 | 320 | 162 | 2.40E-09 | Enterococcus faecalis | e321943 | hypothetical protein.E.faecalis plasmid DNA containing gene cluster involved inproduction and immunity to peptide antibiotic AS-48.ORF7 |
| Contig364D | 14886052_c2_352 | 2619 | 5456 | 495 | 165 | 307 | 1.80E-27 | Bacillus subtilis | P54486 | yqgCYqgCBacillus subtilis DNA, 283 Kb region containing skin element. |
| Contig364D | 15057762_c1_284 | 2620 | 5457 | 1575 | 525 | 1194 | 1.80E-121 | Alcaligenes eutrophus | Q07252 | putative membrane-bound protein with four timesA.eutrophus genes for lactate dehydrogenase, putativemembrane-bound protein with four times repitition of Pro-Ser-Ala at the N-terminus (function unknown) and transglycosidase (partial). |
| Contig364D | 1561_c3_443 | 2621 | 5458 | 1944 | 648 | 1406 | 6.30E-144 | Bacillus subtilis | e1182716 | yfmRYfmRBacillus subtilis complete genome (section 4 of 21)similar to ABC transporter (ATP-binding protein) |
| Contig364D | 15661088_c1_268 | 2622 | 5459 | 513 | 171 | | | | | |
| Contig364D | 15751312_f2_111 | 2623 | 5460 | 2136 | 712 | 1980 | 9.40E-205 | Entamoeba histolytica | Q24803 | ADH2alcohol dehydrogenase 2Entamoeba histolytica IIMIThe derived amino acid sequence of EhADlI2 is |
| Contig364D | 157767_c2_340 | 2624 | 5461 | 1077 | 359 | 227 | 1.20E-17 | Rhodococcus sp. | g2088525 | hetheroin esteraseRhodococcus sp. heroin esterase (her) gene, complete cds.acetylmorphine carboxyesterase; Ser-160 is the |
| Contig364D | 15781336_c1_257 | 2625 | 5462 | 471 | 157 | 150 | 7.80E-11 | Bacillus subtilis | e1186235 | ywiBhypothetical protein ywiBBacillus subtilis complete genome (section 20 of 21) |
| Contig364D | 16595927_f3_251 | 2626 | 5463 | 213 | 71 | | | | | |
| Contig364D | 16603207_f1_13 | 2627 | 5464 | 378 | 126 | 217 | 6.20E-18 | Mycobacterium leprae | g466873 | B1496_F1_41Mycobacterium leprae cosmid B1496. |
| Contig364D | 166713_c1_311 | 2628 | 5465 | 2001 | 667 | 2697 | 9.90E-281 | Bacillus subtilis | g2618841 | uvrBexcinuclease ABC subunit BBacillus subtilis 300-304 degree genomic sequence.alternate gene name |

| | | | | | | | | | |
|---|---|---|---|---|---|---|---|---|---|
| Contig364D | 16834512_c2_355 | 2629 | 5466 | 1380 | 460 | 661 | 5.60E-65 | Bacillus firmus | Q04449 | phrDNA photolyaseBacillus firmus DNA photolyase (phr) gene, 3' end, and cytochromeoxidase (cta) operon,putative |
| Contig364D | 16850303_c3_473 | 2630 | 5467 | 477 | 159 | 510 | 5.60E-49 | Bacillus subtilis | e1186048 | yvalconserved hypothetical protein yvalBacillus subtilis complete genome (section 18 of 21)similar to hypothetical proteins |
| Contig364D | 181500_c2_335 | 2631 | 5468 | 798 | 266 | 415 | 6.50E-39 | Bacillus subtilis | P27620 | tagAinvolved in polyglycerol phosphate teichoic acid biosynthesis tagAB.subtilis tagA, tagB, tagC and tagD genes, complete cds.putative |
| Contig364D | 187568_c1_264 | 2632 | 5469 | 327 | 109 | 178 | 8.50E-14 | Bacillus subtilis | e1184242 | yufCunknownBacillus subtilis complete genome (section 17 of 21) |
| Contig364D | 187916_c1_277 | 2633 | 5470 | 612 | 204 | 134 | 3.90E-09 | Bacillus subtilis | gi1750115 | ynaDYnaDBacillus subtilis SpoVK (spoVK), YnbA (ynbA), YnhB (ynbB), GlnR(glnR), glutamine synthetase (glnA), YnaA (ynaA), YnaB (ynaB), YnaC(ynaC), YnaD (ynaD), YnaE (ynaE), YnaF (ynaF), YnaG (ynaG), YnaH(ynaH), YnaI (ynaI), YnaJ (ynaJ), xylan beta-1,4-xylo |
| Contig364D | 19547783_f3_216 | 2634 | 5471 | 771 | 257 | 438 | 2.40E-41 | Thermotoga maritima | gi575577 | drrADNA-binding response regulatorThermotoga maritima DNA-binding response regulator (drrA) andhistidine protein kinase (hpkA) genes, complete cds,thymidine/pyrimidine phosphorylase homolog gene, partial cds.complete cds,DrrA; OmpR/PhoB subfamily response |
| Contig364D | 19589187_f1_4 | 2635 | 5472 | 207 | 69 | | | | | |
| Contig364D | 19696951_c2_390 | 2636 | 5473 | 183 | 61 | 193 | 2.20E-15 | Bacillus subtilis | e1186051 | yvaLhypothetical protein yval.Bacillus subtilis complete genome (section 18 of 21) |
| Contig364D | 19704062_f3_231 | 2637 | 5474 | 183 | 61 | | | | | |
| Contig364D | 197152_c2_330 | 2638 | 5475 | 348 | 116 | 247 | 4.10E-21 | Bacillus sp. | d1007183 | ORF3Bacillus sp. Na+/H+ antiporter system responsible genes.Na+/H+ antiporter system responsible gene |

| | | | | | | | | | |
|---|---|---|---|---|---|---|---|---|---|
| Contig364D | 19765965_c3_478 | 2639 | 5476 | 249 | 83 | 323 | 3.60E-29 | Staphylococcus aureus | g2226349 | cspCCspCStaphylococcus aureus CspC (cspC) gene, complete cds.similar to major cold-shock protein |
| Contig364D | 19766886_f2_81 | 2640 | 5477 | 435 | 145 | 167 | 1.60E-12 | Bacillus thuringiensis | e1294701 | Bacillus thuringiensis plasmid pGI2 with transposon Tn4430.ORF 2 |
| Contig364D | 20322153_c1_289 | 2641 | 5478 | 219 | 73 | | | | | |
| Contig364D | 20485663_f3_240 | 2642 | 5479 | 210 | 70 | | | | | |
| Contig364D | 20604832_f1_5 | 2643 | 5480 | 558 | 186 | | | | | |
| Contig364D | 20893828_c3_421 | 2644 | 5481 | 219 | 73 | | | | | |
| Contig364D | 20900017_c1_297 | 2645 | 5482 | 2169 | 723 | 2007 | 1.30E-207 | Bacillus subtilis | P50620 | nrdE;NrdEB.subtilis cwlC, nrdE, nrdF, ymaA and ymaB genes.similarity to NrdF of Enterobacteriaceae |
| Contig364D | 209452_f2_145 | 2646 | 5483 | 648 | 216 | 754 | 7.80E-75 | Staphylococcus epidermidis | c255528 | membrane protein.S.epidermidis gene encoding ABC transport system. |
| Contig364D | 209627_c2_369 | 2647 | 5484 | 1032 | 344 | 830 | 6.90E-83 | Bacillus subtilis | P50621 | nrdF;NrdFB.subtilis cwlC, nrdE, nrdF, ymaA and ymaB genes.similarity to NrdF of Enterobacteriaceae |
| Contig364D | 2151937_c3_400 | 2648 | 5485 | 186 | 62 | 175 | 1.80E-13 | Schizosaccharomyces pombe | e1251110 | SPBC19G7.02hypothetical protein.S.pombe chromosome II cosmid c19G7.SPBC19G7.02, unknown, len |
| Contig364D | 21525061_c3_439 | 2649 | 5486 | 681 | 227 | 925 | 5.90E-93 | Bacillus subtilis | Q45539 | csbB;stress response protein.Bacillus subtilis csbB gene, complete cds.similar to hypothetical protein from Synechocystis |
| Contig364D | 21537811_c3_435 | 2650 | 5487 | 1137 | 379 | | | | | |
| Contig364D | 21897308_f3_233 | 2651 | 5488 | 261 | 87 | | | | | |
| Contig364D | 22265936_c2_372 | 2652 | 5489 | 1128 | 376 | 1557 | 6.30E-160 | Staphylococcus aureus | d1005198 | llm;lipophilic protein which affects bacterial lysisStaphylococcus aureus gene for a participant in homogeneousexpression of high-level methicillin resistance, complete cds. |
| Contig364D | 22381590_f3_179 | 2653 | 5490 | 207 | 69 | | | | | |
| Contig364D | 22381693_c2_381 | 2654 | 5491 | 852 | 284 | 1187 | 1.00E-120 | Staphylococcus aureus | P52282 | lgt;prolipoprotein diacylglyceryl transferaseStaphylococcus aureus prolipoprotein diacylglyceryl transferase(lgt) gene, complete cds. |

| | | | | | | | | | |
|---|---|---|---|---|---|---|---|---|---|
| Contig364D | 22391068_c3_454 | 2655 | 5492 | 1056 | 352 | 627 | 2.20E-61 | Bacillus subtilis | e1182350 | yclQferric anguibactin-binding protein precursor FatBBacillus subtilis complete genome (section 3 of 21)similar to ferrichrome ABC transporter (binding |
| Contig364D | 22446053_c1_258 | 2656 | 5493 | 726 | 242 | 335 | 2.00E-30 | Methanococcus jannaschii | g1592082 | MJ1434endonuclease III, putative (nth2)Methanococcus jannaschii section 126 of 150 of the complete genome.similar to GB |
| Contig364D | 22687900_c2_342 | 2657 | 5494 | 681 | 227 | 685 | 1.60E-67 | Bacillus subtilis | g2293175 | ytsAsignal transduction regulatorBacillus subtilis rrnB-dnaB genomic region.similar to two-component response regulator [YtsB |
| Contig364D | 23438461_c3_401 | 2658 | 5495 | 687 | 229 | | | | | |
| Contig364D | 23439061_c3_427 | 2659 | 5496 | 531 | 177 | 258 | 2.80E-22 | Bacillus subtilis | g2522410 | yojVunknownBacillus subtilis yojP gene, partial cds; yojQ/S, yojR, yojT,yojU, yojV, yojW, yojX, yojY, yojZ, and yokA genes, complete cds. |
| Contig364D | 23444838_c1_313 | 2660 | 5497 | 264 | 88 | 373 | 1.80E-34 | Staphylococcus aureus | e1256407 | trxBthioredoxin reductaseStaphyloococcus aureus trxB gene. |
| Contig364D | 23445890_c1_274 | 2661 | 5498 | 492 | 164 | 333 | 3.20E-30 | Synechocystis sp. | d1017593 | hypothetical proteinSynechocystis sp. PCC6803 complete genome, 3/27, 271600-402289.ORF_ID |
| Contig364D | 23450_c2_393 | 2662 | 5499 | 189 | 63 | | | | | |
| Contig364D | 23476517_c1_308 | 2663 | 5500 | 1296 | 432 | 638 | 1.50E-62 | Bacillus subtilis | P39145 | comForf1F1B subtilis comF gene.involved in transformation |
| Contig364D | 23492127_f3_166 | 2664 | 5501 | 453 | 151 | | | | | |
| Contig364D | 23494051_f3_193 | 2665 | 5502 | 1101 | 367 | 336 | 1.50E-30 | Bacillus subtilis | P54595 | yhcKhypothetical proteinB.subtilis chromosomal DNA (region 75 degreesimilarity to hypothetical proteins from |
| Contig364D | 23523326_c2_351 | 2666 | 5503 | 1242 | 414 | 416 | 5.10E-39 | Escherichia coli | P31436 | yicKhypothetical 43.5 kD protein in selC nlpAEscherichia coli K-12 MGI655 section 333 of 400 of the completegenome.o394; 100 pct identical to YICK_ECOLI SW |
| Contig364D | 23572177_c2_386 | 2667 | 5504 | 1194 | 398 | 1322 | 5.00E-135 | Lactobacillus delbrueckii | e1175767 | pgkphosphoglycerate kinaseLactobacillus delbrueckii ygaP, gap, pgk, tpi, and ycsE genes. |

| | | | | | | | | |
|---|---|---|---|---|---|---|---|---|
| Contig364D | 23617338_f2_84 | 2668 | 5505 | 528 | 176 | 215 | 9.70E-25 | Escherichia coli | P77262 | yagU:yagU proteinEscherichia coli K-12 MG1655 section 26 of 400 of the completegenome.o204; 26 pct identical to 46 residues of approx. |
| Contig364D | 23621010_c3_419 | 2669 | 5506 | 843 | 281 | 167 | 1.30E-10 | Bacillus subtilis | d1020103 | ydeC:transcriptional regulator (AraC/XylS family) homolog ydeCBacillus subtilis genome sequence, 148 kb sequence of the regionbetween 35 and 47 degree.PROBABLE 11TH_ARAC_FAMILY OF TRANSCRIPTIONAL |
| Contig364D | 23631928_f3_225 | 2670 | 5507 | 228 | 76 | | | | | |
| Contig364D | 23634651_c3_417 | 2671 | 5508 | 1044 | 348 | 549 | 4.10E-53 | Bacillus subtilis | g2293176 | ytsB:signal transduction protein kinaseBacillus subtilis rrnB-dnaB genomic region.similar to two-component sensor histidine kinase |
| Contig364D | 23672137_c1_282 | 2672 | 5509 | 957 | 319 | 260 | 5.40E-32 | Synechocystis sp. | d1019609 | 47 kD proteinSynechocystis sp. PCC6803 complete genome, 27/27, 3418852-3573470.ORF_ID |
| Contig364D | 23703750_c3_476 | 2673 | 5510 | 639 | 213 | | | | | |
| Contig364D | 23844575_c1_316 | 2674 | 5511 | 1062 | 354 | 771 | 1.20E-76 | Bacillus megaterium | P35168 | hypothetical 37.7K proteinBacillus megaterium glyceraldehyde-3-phosphate dehydrogenase (gap),phosphoglycerate kinase (pgk), and triose phosphate isomerase (tpi)genes, complete cds. |
| Contig364D | 2401430_c2_382 | 2675 | 5512 | 762 | 254 | 1076 | 5.90E-109 | Staphylococcus aureus | e1256407 | trxB:thioredoxin reductaseStaphylococcus aureus trxB gene. |
| Contig364D | 24218785_c1_317 | 2676 | 5513 | 1047 | 349 | 1258 | 3.00E-128 | Clostridium acetobutylicum | g2829138 | gap:glyceraldehyde-3-phosphate dehydrogenaseClostridium acetobutylicum glyceraldehyde-3-phosphate dehydrogenase(gap), phosphoglycerate kinase (pgk), and triosephosphate isomerase(tpi) genes, complete cds; and 2,3-bpg-independent phosphoglyceratemutase (pgm |
| Contig364D | 24230001_f3_162 | 2677 | 5514 | 258 | 86 | | | | | |

306

| | | | | | | | | | |
|---|---|---|---|---|---|---|---|---|---|
| Contig364D | 24258388_c2_358 | 2678 | 5515 | 507 | 169 | | | | |
| Contig364D | 24272125_c1_321 | 2679 | 5516 | 261 | 87 | | | | |
| Contig364D | 24297000_f3_236 | 2680 | 5517 | 225 | 75 | | | | |
| Contig364D | 24329053_c3_424 | 2681 | 5518 | 444 | 148 | 134 | 1.50E-08 | Caenorhabditis elegans | g1825636 | ZK354.3Caenorhabditis elegans cosmid ZK354. |
| Contig364D | 24391937_c3_464 | 2682 | 5519 | 759 | 253 | | | | |
| Contig364D | 24397952_c3_463 | 2683 | 5520 | 681 | 227 | 119 | 9.50E-05 | Bacillus subtilis | e1186169 | yvcDhypothetical proteinBacillus subtilis complete genome (section 18 of 21) |
| Contig364D | 24406577_c2_362 | 2684 | 5521 | 390 | 130 | | | | |
| Contig364D | 24407637_f2_79 | 2685 | 5522 | 243 | 81 | | | | |
| Contig364D | 24429650_c2_360 | 2686 | 5523 | 1197 | 399 | 848 | 8.50E-85 | Bacillus subtilis | g2618856 | nagAN-acetylglucosamine 6-P deacetylaseBacillus subtilis 300-304 degree genomic sequence. |
| Contig364D | 24479842_c3_481 | 2687 | 5524 | 558 | 186 | 256 | 4.60E-22 | Bacillus subtilis | e1182838 | yfhCYfhCBacillus subtilis complete genome (section 5 of 21)similar to hypothetical proteins |
| Contig364D | 24506712_c1_298 | 2688 | 5525 | 975 | 325 | 692 | 2.90E-68 | Bacillus subtilis | e1182348 | yclOhomologue of ferric anguibactin transport systemBacillus subtilis complete genome (section 3 of 21)similar to ferrichrome ABC transporter (permease) |
| Contig364D | 24507932_c3_445 | 2689 | 5526 | 600 | 200 | 322 | 4.70E-29 | Bacillus subtilis | e1185499 | yorSunknownBacillus subtilis complete genome (section 11 of 21) |
| Contig364D | 24640828_c1_262 | 2690 | 5527 | 516 | 172 | | | | |
| Contig364D | 24642632_f1_31 | 2691 | 5528 | 1245 | 415 | 1245 | 7.20E-127 | Bacillus subtilis | P55179 | pepTpeptidase T (tripeptidase)B.subtilis orfs 1,2,3,4, pepT and galE genes.highly homologous to tripeptidases (peptidase T) |
| Contig364D | 24650427_f3_155 | 2692 | 5529 | 330 | 110 | 331 | 5.20E-30 | Bacillus subtilis | d1020045 | ydbPthioredoxin homolog ydbPBacillus subtilis genome sequence, 148 kb sequence of the regionbetween 35 and 47 degree.PROBABLE THIOREDOXIN. |

| | | | | | | | | |
|---|---|---|---|---|---|---|---|---|
| Contig364D | 24650462_c3_407 | 2693 | 5530 | 1515 | 505 | 848 | 8.50E-85 | Bacillus subtilis | e1184241 | yufDNADH dehydrogenase (ubiquinone) homolog yufDBacillus subtilis complete genome (section 17 of 21)similar to NADH dehydrogenase (ubiquinone) |
| Contig364D | 24664840_c1_287 | 2694 | 5531 | 1968 | 656 | 1694 | 1.90E-174 | Bacillus subtilis | e1185030 | fruAphosphotransferase system (PTS)Bacillus subtilis complete genome (section 8 of 21) |
| Contig364D | 24796927_f2_82 | 2695 | 5532 | 789 | 263 | 325 | 2.20E-29 | Bacillus subtilis | e1183386 | ymaCphage-related protein homolog ymaCBacillus subtilis complete genome (section 10 of 21)similar to phage-related protein |
| Contig364D | 24803125_c3_431 | 2696 | 5533 | 978 | 326 | 982 | 5.40E-99 | Bacillus israeli | Q59202 | MDHmalate dehydrogenaseB.israeli DNA for malate dehydrogenase gene. |
| Contig364D | 25401377_c3_453 | 2697 | 5534 | 852 | 284 | 698 | 6.70E-69 | Bacillus subtilis | e1182349 | yctPhomologue of iron dicitrate transportBacillus subtilis complete genome (section 3 of 21)similar to ferrichrome ABC transporter (ATP-binding |
| Contig364D | 25473782_c2_396 | 2698 | 5535 | 186 | 62 | | | | | |
| Contig364D | 25572180_c3_413 | 2699 | 5536 | 1272 | 424 | 895 | 8.90E-90 | Bacillus subtilis | P42312 | yxjApyrimidine nucleoside transport homolog yxjABacillus subtilis complete genome (section 20 of 21)similar to pyrimidine nucleoside transport |
| Contig364D | 25585891_c1_291 | 2700 | 5537 | 1980 | 660 | 1949 | 1.80E-201 | Bacillus subtilis | e1182705 | yfnIYfnIBacillus subtilis complete genome (section 4 of 21)alternate gene name |
| Contig364D | 25806300_f2_144 | 2701 | 5538 | 750 | 250 | 1270 | 1.60E-129 | Staphylococcus epidermidis | e255626 | ATP binding proteinS.epidermidis gene encoding ABC transport system. |
| Contig364D | 26171927_c1_302 | 2702 | 5539 | 342 | 114 | 221 | 2.30E-18 | Bacillus subtilis | P39914 | ytxJYtxJBacillus subtilis rrnB-dnaB genomic region.alternate gene name |
| Contig364D | 26176693_f3_210 | 2703 | 5540 | 828 | 276 | 685 | 1.60E-67 | Methanobacterium thermoautotrophicum | g2621542 | MTH473conserved proteinMethanobacterium thermoautotrophicum from bases 404817 to 415582(section 37 of 148) of the complete genome.Function Code |
| Contig364D | 2618827_c3_451 | 2704 | 5541 | 288 | 96 | | | | | |
| Contig364D | 26211552_c1_314 | 2705 | 5542 | 984 | 328 | 1034 | 1.70E-104 | Bacillus subtilis | e1186163 | yvcLhypothetical proteinBacillus subtilis complete genome (section 18 of 21)similar to hypothetical proteins |

| | | | | | | | | |
|---|---|---|---|---|---|---|---|---|
| Contig364D | 26259638_f2_101 | 2706 | 5543 | 765 | 255 | 176 | 1.90E-11 | Mycobacterium tuberculosis | e1264597 | MTV025.085putative membrane proteinMycobacterium tuberculosis sequence v025.MTV025.085, len |
| Contig364D | 26578577_c3_461 | 2707 | 5544 | 1791 | 597 | 2276 | 1.50E-238 | Bacillus subtilis | g2618842 | uvrAexcinuclease ABC subunit ABacillus subtilis 300-304 degree genomic sequence. |
| Contig364D | 26735877_c2_399 | 2708 | 5545 | 402 | 134 | 446 | 3.40E-42 | Bacillus subtilis | e1184358 | yusHglycine cleavage system protein H homolog yusIIBacillus subtilis complete genome (section 17 of 21)similar to glycine cleavage system protein H |
| Contig364D | 26753150_f2_105 | 2709 | 5546 | 336 | 112 | 295 | 3.40E-26 | Saccharomyces cerevisiae | P36078 | YKL084Whypothetical protein YKL084wS.cerevisiae chromosome XI reading frame ORF YKL084w.ORF YKL084w |
| Contig364D | 26757807_f3_246 | 2710 | 5547 | 951 | 317 | 1619 | 1.70E-166 | Staphylococcus epidermidis | e255529 | lipoproteinS.epidermidis gene encoding ABC transport system. |
| Contig364D | 26834387_f2_135 | 2711 | 5548 | 711 | 237 | 115 | 9.70E-07 | Lactococcus lactis | g3043880 | transmembrane protein Tmp6Lactococcus lactis transmembrane protein Tmp6 gene, partial cds.identified as a fusion to a signal peptide-less |
| Contig364D | 26839462_c2_383 | 2712 | 5549 | 1011 | 337 | 817 | 1.60E-81 | Bacillus subtilis | e1186164 | yvcKconserved hypothetical protein yvcKBacillus subtilis complete genome (section 18 of 21)similar to hypothetical proteins |
| Contig364D | 27522262_c2_366 | 2713 | 5550 | 1014 | 338 | 652 | 5.00E-64 | Bacillus subtilis | g2293447 | opuBAATPaseBacillus subtilis choline transport system including ATPase(opuBA), transmembrane protein (opuBB), choline binding proteinprecursor (opuBC) and transmembrane protein (opuBD) genes, completecds; and unknown gene.OpuBA; part of choline uptake sys |
| Contig364D | 275268_c1_294 | 2714 | 5551 | 1125 | 375 | 773 | 7.50E-77 | BACILLUS SUBTILIS | P17731 | HISIIPHOSPHATE TRANSAMINASE) |
| Contig364D | 29917200_f2_146 | 2715 | 5552 | 192 | 64 | | | | | |

308

| | | | | | | | | |
|---|---|---|---|---|---|---|---|---|
| Contig364D | 2926425_f3_204 | 2716 | 5553 | 960 | 320 | 456 | 2.90E-43 | Bacillus subtilis | P39074 | bmrUBmrUBacillus subtilis bmrU, multidrug efflux transporter (bmr) and itsregulator (bmrR) genes, complete cds, and branched-chain 2-oxo aciddehydrogenase (bfmB) gene, 3' end. |
| Contig364D | 29376503_f3_217 | 2717 | 5554 | 246 | 82 | | | | |
| Contig364D | 29501510_c3_410 | 2718 | 5555 | 1125 | 375 | 432 | 1.00E-40 | Bacillus subtilis | P27621 | tagBinvolved in polyglycerol phosphate teichoic acid biosynthesis tagBB.subtilis tagA, tagB, tagC and tagD genes, complete cds.putative |
| Contig364D | 3001313_c1_310 | 2719 | 5556 | 681 | 227 | 154 | 3.00E-11 | Escherichia coli | g1788628 | hypothetical protein b2291Escherichia coli K-12 MG1655 section 208 of 400 of the completegenome.o199 |
| Contig364D | 304991275_c3_415 | 2720 | 5557 | 1104 | 368 | 391 | 2.30E-36 | Bacillus subtilis | e1184961 | ykvIconserved hypothetical protein ykvIBacillus subtilis complete genome (section 8 of 21)similar to hypothetical proteins from B. subtilis |
| Contig364D | 30601588_c2_337 | 2721 | 5558 | 834 | 278 | 561 | 2.20E-54 | Bacillus subtilis | P42953 | tagGhighly hydrophobic integral membrane proteinBacillus subtilis 168 highly hydrophobic integral membrane protein(tagG) gene and ATP-binding protein (tagH) gene, complete cds. |
| Contig364D | 30745328_c3_480 | 2722 | 5559 | 606 | 202 | 200 | 3.90E-16 | Escherichia coli | g1790856 | gpmBgpmB proteinEscherichia coli K-12 MG1655 section 399 of 400 of the completegenome.Kenn Rudd identifies as gpmB |
| Contig364D | 31257943_c1_267 | 2723 | 5560 | 414 | 138 | 669 | 7.90E-66 | Staphylococcus aureus | g1913907 | tagDTagDStaphylococcus aureus teichoic acid biosynthesis TagB gene, partialcds and TagX and TagD genes, complete cds.similar to Bacillus subtilis TagD |
| Contig364D | 31267503_c1_270 | 2724 | 5561 | 813 | 271 | 784 | 5.10E-78 | Bacillus subtilis | g2293177 | ytsCtransporterBacillus subtilis rmB-dnaB genomic region.similar to ABC transporter (ATP-binding protein) |
| Contig364D | 31289687_c3_456 | 2725 | 5562 | 681 | 227 | 134 | 4.70E-06 | Schizosaccharomyces pombe | e334260 | SPAC14C4.02hypothetical proteinS.pombe chromosome I cosmid c14C4.SPAC14C4.02c, unknown; SMC family; coiled coil. |

| | | | | | | | | |
|---|---|---|---|---|---|---|---|---|
| Contig364D | 31428188_f3_178 | 2726 | 5563 | 222 | 74 | | | |
| Contig364D | 31578_c1_312 | 2727 | 5564 | 537 | 179 | 5.30E-44 | Bacillus subtilis | g2618861 | yvoFputative acetyltransferaseBacillus subtilis 300-304 degree genomic sequence.similar to O-acetyltransferase |
| Contig364D | 31803377_f1_66 | 2728 | 5565 | 612 | 204 | | | | |
| Contig364D | 32062553_c3_406 | 2729 | 5566 | 468 | 156 | 1.90E-32 | Bacillus sp. | d1007182 | ORF2Bacillus sp. Na+/H+ antiporter system responsible genes.Na+/H+ antiporter system responsible gene |
| Contig364D | 32212902_c1_261 | 2730 | 5567 | 1035 | 345 | 1.60E-44 | Bacillus subtilis | e1249808 | yvrBputative hemin permease. YvrBBacillus subtilis 42.7kB DNA fragment from yvsA to yvqA.similar to iron permease |
| Contig364D | 32225012_f2_77 | 2731 | 5568 | 498 | 166 | 3.50E-24 | Bacillus subtilis | e1181516 | yknAYknABacillus subtilis 168 56 kb DNA fragment between xlyA and ykoR.homologous to OsmC from Escherichia coli |
| Contig364D | 32611068_c3_402 | 2732 | 5569 | 1674 | 558 | 1.90E-174 | Bacillus subtilis | e1186234 | argSarginyl-tRNA synthetaseBacillus subtilis complete genome (section 20 of 21) |
| Contig364D | 33210952_f3_168 | 2733 | 5570 | 234 | 78 | | | | |
| Contig364D | 33239001_f3_158 | 2734 | 5571 | 276 | 92 | | | | |
| Contig364D | 33414143_c2_354 | 2735 | 5572 | 1710 | 570 | 1.60E-60 | Shigella flexneri | g2773332 | cydCABC transporter CydCShigella flexneri ABC transporter CydC (cydC) gene, complete cds.similar to E. coli CydC |
| Contig364D | 34160625_c2_341 | 2736 | 5573 | 438 | 146 | | | | |
| Contig364D | 34173385_c3_422 | 2737 | 5574 | 621 | 207 | 6.10E-11 | Pyrococcus horikoshii | d1028675 | PHBQ005166aa long hypothetical proteinPyrococcus horikoshii OT3 genomic DNA, 1393354-1434541 nt position(complementary strand), clone |
| Contig364D | 34173750_c2_389 | 2738 | 5575 | 480 | 160 | | | | |
| Contig364D | 34189817_c3_408 | 2739 | 5576 | 2052 | 684 | 4.90E-89 | Bacillus subtilis | e1186030 | yvgPconserved hypothetical protein yvgPBacillus subtilis complete genome (section 18 of 21)similar to hypothetical proteins |
| Contig364D | 34261088_c2_353 | 2740 | 5577 | 312 | 104 | | | | |

| | | | | | | | | |
|---|---|---|---|---|---|---|---|---|
| Contig364D | 34562762_c2_326 | 2741 | 5578 | 750 | 250 | | 2.60E-19 | Pyrococcus horikoshii | d1027599 | PHBH02623 2aa long hypothetical proteinPyrococcus horikoshii OT3 genomic DNA, 415465-442351 nt position(complementary strand), clone |
| Contig364D | 34571000_f2_110 | 2742 | 5579 | 537 | 179 | 393 | 1.40E-35 | Entamoeba histolytica | Q24803 | ADH2alcohol dehydrogenase 2Entamoeba histolytica IIM1The derived amino acid sequence of EhADH2 is |
| Contig364D | 34589027_c1_283 | 2743 | 5580 | 315 | 105 | | | | | |
| Contig364D | 34612887_f3_221 | 2744 | 5581 | 465 | 155 | 260 | 1.70E-22 | Bacillus subtilis | e1181515 | ykmAYkmABacillus subtilis 168 56 kb DNA fragment between xlyA and ykoR.similar to hypothetical proteins |
| Contig364D | 34627136_f1_3 | 2745 | 5582 | 306 | 102 | | | | | |
| Contig364D | 34641875_c2_359 | 2746 | 5583 | 939 | 313 | 704 | 1.50E-69 | Bacillus subtilis | e1185029 | fruBfructose-1-phosphate kinaseBacillus subtilis complete genome (section 8 of 21) |
| Contig364D | 34642567_c3_472 | 2747 | 5584 | 2406 | 802 | 2175 | 1.70E-228 | Bacillus subtilis | e1186049 | yvalconserved hypothetical protein yvalBacillus subtilis complete genome (section 18 of 21)similar to hypothetical proteins |
| Contig364D | 34645311_f1_62 | 2748 | 5585 | 525 | 175 | 135 | 3.00E-09 | Escherichia coli | P46854 | YHHYhypothetical protein b3441Escherichia coli K-12 MG1655 section 310 of 400 of the completegenome.o162 |
| Contig364D | 35166012_c3_432 | 2749 | 5586 | 210 | 70 | | | | | |
| Contig364D | 35444127_f3_192 | 2750 | 5587 | 663 | 221 | 514 | 2.10E-49 | Bacillus subtilis | g1762328 | yvhKYcr59c/YigZ homologBacillus subtilis putative transcriptional regulator (yvhJ),Ycr59c/YigZ homolog (yvhK), histidine kinase (degS),transcriptionalregulator of degradation enzyme (degU), (degV), (comFA), (comFB), flagellar protein (yviB), negat |
| Contig364D | 35945277_c2_377 | 2751 | 5588 | 1065 | 355 | 1275 | 4.80E-130 | Bacillus subtilis | g2331287 | prfBrelease factor 2Bacillus subtilis release factor 2 (prfB) gene, complete cds.orf3 |

312

| | | | | | | | | |
|---|---|---|---|---|---|---|---|---|
| Contig364D | 36131311_c2_374 | 2752 | 5589 | 696 | 232 | 194 | 1.70E-15 | Bacillus subtilis | g451867 | Bacillus subtilis (clones pDM116 and pDM113) flagellin synthesisregulatory protein (flgM) and flagellar hook-filament junctionprotein (flgK) genes and orf139, orf160, orfX, complete cds's.in Z18629. ORFX is called comForf3; ORFX: putative |
| Contig364D | 36133385_c2_345 | 2753 | 5590 | 681 | 227 | 203 | 1.90E-16 | Bacillus subtilis | e1182699 | yetIhypothetical protein yetI Bacillus subtilis complete genome (section 4 of 21) |
| Contig364D | 36212541_c1_299 | 2754 | 5591 | 204 | 68 | | | | | |
| Contig364D | 36229676_c3_404 | 2755 | 5592 | 795 | 265 | 238 | 3.70E-20 | Acinetobacter sp. ADP1 | g3172115 | pcaDbeta-ketoadipate enol-lactone hydrolaseAcinetobacter sp. ADP1 pca-qui-pob supraoperonic cluster, completesequence.ELH |
| Contig364D | 36230252_c3_434 | 2756 | 5593 | 777 | 259 | 480 | 8.40E-46 | Bacillus subtilis | e1185028 | fruRtranscriptional regulator (DeoR family)Bacillus subtilis complete genome (section 8 of 21) |
| Contig364D | 36601562_c2_357 | 2757 | 5594 | 1182 | 394 | 1669 | 8.50E-172 | Staphylococcus aureus | P21191 | norAORF for norAS. aureus norA gene. |
| Contig364D | 390942_c1_318 | 2758 | 5595 | 456 | 152 | 112 | 7.30E-06 | Kinetoplast Leishmania tarentolae | g896286 | MURF1Leishmania tarentolae kinetoplast pre-edited mitochondrialmaxicircle DNA complete transcribed region and flanks.NI2 terminus uncertain |
| Contig364D | 391527_f1_65 | 2759 | 5596 | 930 | 310 | 700 | 4.10E-69 | Bacillus subtilis | P42954 | tagHATP-binding proteinBacillus subtilis 168 highly hydrophobic integral membrane protein(tagG) gene and ATP-binding protein (tagH) gene, complete cds. |
| Contig364D | 3928762_f3_167 | 2760 | 5597 | 1368 | 456 | 839 | 7.60E-84 | Bacillus subtilis | e1185983 | yubGNa+-transporting ATP synthase homology yubGBacillus subtilis complete genome (section 16 of 21)similar to Na+-transporting ATP synthase |
| Contig364D | 3942263_c2_348 | 2761 | 5598 | 726 | 242 | 913 | 1.10E-91 | Bacillus subtilis | e1182664 | yeeIconserved hypothetical protein yeeIBacillus subtilis complete genome (section 4 of 21)similar to hypothetical proteins |

| | | | | | | | | |
|---|---|---|---|---|---|---|---|---|
| Contig364D | 3953452_c1_285 | 2762 | 5599 | 507 | 169 | 328 | 1.10E-29 | Bacillus subtilis | e1183226 | yjdIyjdItranscription regulation homolog Bacillus subtilis complete genome (section 7 of 21)similar to transcription regulation |
| Contig364D | 3962915_f3_218 | 2763 | 5600 | 627 | 209 | 137 | 4.00E-08 | Synechocystis sp. | d1011025 | hypothetical proteinSynechcocystis sp. PCC6803 complete genome, 21/27, 2644795-2755702.ORF_ID |
| Contig364D | 39818_f3_229 | 2764 | 5601 | 240 | 80 | 234 | 9.80E-20 | Staphylococcus aureus | g1575061 | scdAScdAStaphylococcus aureus scdA gene, complete cds.S. aureus cells containing a scdA disruption have |
| Contig364D | 4023518_f3_177 | 2765 | 5602 | 909 | 303 | 579 | 2.70E-56 | Bacillus subtilis | e1182841 | yfhFYfhFBacillus subtilis complete genome (section 5 of 21)similar to cell-division inhibitor |
| Contig364D | 4036093_c2_350 | 2766 | 5603 | 864 | 288 | 461 | 8.70E-44 | Bacillus subtilis | e1181918 | ykuMYkuM proteinBacillus subtilis 29kB DNA fragment from ykwC gene to csc15 gene.homologous to LysR type transcriptional regulators |
| Contig364D | 4072006_f1_53 | 2767 | 5604 | 201 | 67 | | | | | |
| Contig364D | 4095055_f3_202 | 2768 | 5605 | 894 | 298 | 258 | 2.80E-22 | Sphingomonas S88 | g1314584 | unknownSphingomonas S88 sphingan polysaccharide synthesis (spsG), (spsS),(spsR), glycosyl transferase (spsQ), (spsI), glycosyl transferase(spsK), glycosyl transferase (spsL), (spsJ), (spsF), (spsD), (spsC), (spsE), Urf 32, Urf 26, ATP-binding cassette tran |
| Contig364D | 4096093_c2_395 | 2769 | 5606 | 354 | 118 | 155 | 2.30E-11 | Paracoccus denitrificans | B42573 | urf120 |
| Contig364D | 4100093_c2_363 | 2770 | 5607 | 1161 | 387 | 489 | 9.40E-47 | Helicobacter pylori | g2313385 | HP0293para-aminobenzoate synthetase (pabB)Helicobacter pylori section 25 of 134 of the complete genome.similar to EGAD |
| Contig364D | 4103393_c1_290 | 2771 | 5608 | 597 | 199 | 436 | 3.90E-41 | Salmonella typhimurium | P06193 | PABApabA proteinSalmonella typhimurium pabA gene for para-aminobenzoate synthaseglutamine amidotransferase.glutamine amidotransferaspabA gene product (aa 1-187) |
| Contig364D | 4110888_c2_347 | 2772 | 5609 | 405 | 135 | | | | | |

| | | | | | | | | |
|---|---|---|---|---|---|---|---|---|
| Contig364D | 4111691_c3_441 | 2773 | 5610 | 744 | 248 | 351 | 1.20E-31 | Bacillus subtilis | P42967 | yesJurea amidolyaseBacillus subtilis genome around 39 degrees region encoding 17 ORFs,complete cds,similar to allophanate hydrolase |
| Contig364D | 4195817_c3_412 | 2774 | 5611 | 1743 | 581 | 2597 | 3.90E-270 | Staphylococcus aureus | e264711 | abcAATP-binding cassette transporter AS.aureus abcA, pbp4, and tagD genes. |
| Contig364D | 42167_c3_414 | 2775 | 5612 | 834 | 278 | 834 | 2.60E-83 | Bacillus subtilis | P49938 | lhuCIterrichrome transport protein, FhuCBacillus subtilis 42.7kB DNA fragment from yvsA to yvqA-protein-dependent |
| Contig364D | 422162_f1_36 | 2776 | 5613 | 456 | 152 | 439 | 1.90E-41 | Bacillus subtilis | e1184963 | ykvK6-pyruvoyl tetrahydrobiopterin synthase homolog ykvKBacillus subtilis complete genome (section 8 of 21)similar to 6-pyruvoyl tetrahydrobiopterin synthase |
| Contig364D | 422800_f1_71 | 2777 | 5614 | 447 | 149 | 542 | 2.30E-52 | Staphylococcus aureus | g684950 | sarAstaphylococcal accessory regulator AStaphylococcus aureus staphylococcal accessory regulator A (sarA)gene, complete cds. |
| Contig364D | 429675_f3_238 | 2778 | 5615 | 216 | 72 | | | | | |
| Contig364D | 4461693_f3_254 | 2779 | 5616 | 240 | 80 | | | | | |
| Contig364D | 4487588_f1_38 | 2780 | 5617 | 609 | 203 | | | | | |
| Contig364D | 4501250_c3_477 | 2781 | 5618 | 1080 | 360 | 871 | 3.10E-87 | Bacillus stearothermophilus | d1020364 | membrane proteinBacillus stearothermophilus DNA for glycogen operon, complete cds.The ORF is similar to the Alkaligenes eutrophus |
| Contig364D | 4511550_c1_303 | 2782 | 5619 | 1278 | 426 | 318 | 1.20E-28 | Escherichia coli | P23524 | yhaDhypothetical 42.1 kD protein in rnpB-sohAEscherichia coli K-12 MG1655 section 284 of 400 of the completegenome.f408; 100 pct identical amino acid sequence and |
| Contig364D | 4535652_f2_142 | 2783 | 5620 | 225 | 75 | | | | | |
| Contig364D | 4539143_c3_462 | 2784 | 5621 | 942 | 314 | 970 | 1.00E-97 | Bacillus subtilis | g2618857 | ptsKIIPr(Ser) kinaseBacillus subtilis 300-304 degree genomic sequence.similar to the Mycoplasma genitalium hypothetical |
| Contig364D | 4578956_f2_91 | 2785 | 5622 | 297 | 99 | | | | | |
| Contig364D | 4689077_c1_315 | 2786 | 5623 | 333 | 111 | 466 | 2.60E-44 | Bacillus subtilis | g2668494 | clpPClpPBacillus subtilis Clp protease proteolytic component (clpP) gene,complete cds,proteolytic component of Clp protease |

315

| | | | | | | | | | |
|---|---|---|---|---|---|---|---|---|---|
| Contig364D | 4689130_f3_256 | 2787 | 5624 | 306 | 102 | | | | |
| Contig364D | 4703180_c3_450 | 2788 | 5625 | 453 | 151 | 251 | 1.60E-21 | Bacillus subtilis | P50618 | ymaAYmaAB,subtilis cwlC, mrdE, mrdF, ymaA and ymaB genes.similar to ribonucleoprotein |
| Contig364D | 4726527_f1_32 | 2789 | 5626 | 528 | 176 | 749 | 2.60E-74 | Bacillus subtilis | e1184965 | ykvMconserved hypothetical protein ykvMBacillus subtilis complete genome (section 8 of 21)similar to hypothetical proteins |
| Contig364D | 4773392_f3_161 | 2790 | 5627 | 288 | 96 | | | | | |
| Contig364D | 4775287_c2_364 | 2791 | 5628 | 1008 | 336 | 238 | 1.10E-34 | Escherichia coli | P75745 | YBGKhypothetical protein b0712Escherichia coli K-12 MG1655 section 64 of 400 of the completegenome.o310: This 310 aa ORF is 48 pct identical (1 gap) |
| Contig364D | 4804643_f2_89 | 2792 | 5629 | 246 | 82 | | | | | |
| Contig364D | 4806575_c1_272 | 2793 | 5630 | 651 | 217 | 503 | 3.10E-48 | Bacillus subtilis | e1181486 | ykaAYkaABacillus subtilis 168 56 kb DNA fragment between xlyA and ykoR. |
| Contig364D | 4876077_f1_37 | 2794 | 5631 | 714 | 238 | 778 | 2.20E-77 | Bacillus subtilis | e1184964 | ykvLcoenzyme PQQ synthesis homolog ykvLBacillus subtilis complete genome (section 8 of 21)similar to coenzyme PQQ synthesis |
| Contig364D | 4885876_c3_466 | 2795 | 5632 | 918 | 306 | 829 | 8.80E-83 | Bacillus subtilis | O06973 | yvclhypothetical proteinBacillus subtilis complete genome (section 18 of 21)similar to hypothetical proteins |
| Contig364D | 4892878_c2_338 | 2796 | 5633 | 1077 | 359 | 455 | 3.80E-43 | Staphylococcus aureus | gi913906 | tagXTagXStaphylococcus aureus teichoic acid biosynthesis TagB gene, partialcds and TagX and TagD genes, complete cds. |
| Contig364D | 4898376_f3_244 | 2797 | 5634 | 207 | 69 | | | | | |
| Contig364D | 5084652_f1_56 | 2798 | 5635 | 507 | 169 | 536 | 9.80E-52 | Staphylococcus aureus | gi1575061 | scdAScdAStaphylococcus aureus scdA gene, complete cds.S. aureus cells containing a scdA disruption have |
| Contig364D | 5131265_c1_300 | 2799 | 5636 | 276 | 92 | | | | | |
| Contig364D | 5182962_f2_119 | 2800 | 5637 | 1068 | 356 | 295 | 1.10E-30 | Bacillus subtilis | P35164 | resEtwo-component sensor histidine kinaseBacillus subtilis spoVA to serA region.ORFX18 |
| Contig364D | 5195393_c2_334 | 2801 | 5638 | 654 | 218 | 1088 | 3.10E-110 | Staphylococcus epidermidis | e255543 | sirRputative iron dependant repressorS.epidermidis sirR gene. |

316

| Contig | ID | | | | | | E-value | Organism | Accession | Description |
|---|---|---|---|---|---|---|---|---|---|---|
| Contig364D | 5276677_c3_444 | 2802 | 5639 | 1566 | 522 | 703 | 2.00E-69 | Helicobacter pylori | g2313949 | HP0818osmoprotection protein (proWX)Helicobacter pylori section 71 of 134 of the complete genome.similar to EGAD |
| Contig364D | 5283592_f2_126 | 2803 | 5640 | 288 | 96 | | | | | |
| Contig364D | 5292175_c2_388 | 2804 | 5641 | 1323 | 441 | 2112 | 9.70E-219 | Staphylococcus aureus | g3152725 | enoenolaseStaphylococcus aureus enolase (eno) gene, complete cds.ENO; laminin binding protein |
| Contig364D | 53552_f3_194 | 2805 | 5642 | 660 | 220 | 179 | 6.60E-14 | Bacillus firmus | Q45133 | grpBglutamate-rich proteinBacillus firmus OrfA, OrfB. glutamate-rich protein (grpA), OrfC,and glutamate-rich protein (grpB) genes, complete cds. |
| Contig364D | 5355325_c2_373 | 2806 | 5643 | 888 | 296 | 526 | 1.10E-50 | Bacillus subtilis | P32436 | degUorf3U3B.subtilis comF gene.alternate gene name |
| Contig364D | 5367843_c2_391 | 2807 | 5644 | 759 | 253 | 791 | 9.30E-79 | Bacillus stearothermophilus | Q06174 | ESTesteraseBacillus stearothermophilus esterase gene. |
| Contig364D | 5869702_f3_253 | 2808 | 5645 | 309 | 103 | | | | | |
| Contig364D | 5938762_c3_428 | 2809 | 5646 | 1704 | 568 | 566 | 6.50E-55 | Haemophilus influenzae | P45082 | HI1157transport ATP-binding protein (cydD)Haemophilus influenzae from bases 1218795 to 1228832 (section 110of 163) of the complete genome.unassigned ATP-binding cassette protein.similar to GB |
| Contig364D | 6051500_c3_420 | 2810 | 5647 | 189 | 63 | 112 | 8.30E-07 | Bacillus subtilis | P37953 | csbACsbABacillus subtilis 300-304 degree genomic sequence,putative membrane protein; putative |
| Contig364D | 6051537_c3_460 | 2811 | 5648 | 276 | 92 | | | | | |
| Contig364D | 6053176_f2_118 | 2812 | 5649 | 519 | 173 | | | | | |
| Contig364D | 6053540_c3_458 | 2813 | 5650 | 198 | 66 | | | | | |
| Contig364D | 6257763_c2_385 | 2814 | 5651 | 660 | 220 | 187 | 2.40E-13 | Kaposi's sarcoma-associated herpesvirus | g2246532 | Kaposi's sarcoma-associated herpesvirus glycoprotein M, DNAreplication protein, glycoprotein, DNA replication protein, FLICEinhibitory protein and v-cyclin genes, complete cds, and tegumentprotein gene, partial cds.ORF 73, contains large complex repeat CR |

317

| | | | | | | | | | |
|---|---|---|---|---|---|---|---|---|---|
| Contig364D | 626592_c3_403 | 2815 | 5652 | 852 | 284 | 233 | 1.30E-19 | Archaeoglobus fulgidus | g2648849 | AF17062-hydroxy-6-oxo-6-phenylhexa-2,4-dienoic acidArchaeoglobus fulgidus section 121 of 172 of the complete genome.similar to GP |
| Contig364D | 6437525_f1_60 | 2816 | 5653 | 294 | 98 | | | | | |
| Contig364D | 6440640_c2_346 | 2817 | 5654 | 1278 | 426 | | | | | |
| Contig364D | 6642827_c2_329 | 2818 | 5655 | 2403 | 801 | 1527 | 9.50E-157 | Bacillus subtilis | e1184238 | yufTunknownBacillus subtilis complete genome (section 17 of 21)similar to NADH dehydrogenase |
| Contig364D | 6680312_f3_223 | 2819 | 5656 | 714 | 238 | 208 | 5.60E-17 | Caenorhabditis elegans | g1825636 | ZK354.3Caenorhabditis elegans cosmid ZK354. |
| Contig364D | 6681577_c3_483 | 2820 | 5657 | 432 | 144 | 277 | 2.70E-24 | Bacillus subtilis | e1184356 | yusFhypothetical protein yusFBacillus subtilis complete genome (section 17 of 21) |
| Contig364D | 6822175_c1_293 | 2821 | 5658 | 1914 | 638 | 1229 | 3.60E-125 | Bacillus subtilis | g2619051 | yocIRecQ homologBacillus subtilis chromosome region between terC and odhAB.similar to E.coli RecQ protein (607 aa) |
| Contig364D | 6823453_c2_331 | 2822 | 5659 | 483 | 161 | 123 | 5.70E-08 | Pyrococcus horikoshii | d1028563 | PHCC005174aa long hypothetical proteinPyrococcus horikoshii OT3 genomic DNA. 1300517-1338254 nt position,clone |
| Contig364D | 6829638_c2_356 | 2823 | 5660 | 186 | 62 | | | | | |
| Contig364D | 6833313_c2_343 | 2824 | 5661 | 1920 | 640 | 550 | 3.20E-53 | Bacillus subtilis | g2293178 | ytsDYtsDBacillus subtilis rrnB-dnaB genomic region.similarity to NADH dehydrogenase |
| Contig364D | 7239188_f3_224 | 2825 | 5662 | 675 | 225 | 491 | 5.70E-47 | Bacillus subtilis | e1186152 | yvdDhypothetical proteinBacillus subtilis complete genome (section 18 of 21)similar to hypothetical proteins |
| Contig364D | 7800_c3_474 | 2826 | 5663 | 198 | 66 | | | | | |
| Contig364D | 788950_c2_332 | 2827 | 5664 | 531 | 177 | 219 | 3.80E-18 | Bacillus subtilis | e1184243 | yufBunknownBacillus subtilis complete genome (section 17 of 21)similar to hypothetical proteins |
| Contig364D | 821963_c1_269 | 2828 | 5665 | 546 | 182 | | | | | |
| Contig364D | 867260_f1_48 | 2829 | 5666 | 225 | 75 | | | | | |
| Contig364D | 899177_c2_325 | 2830 | 5667 | 930 | 310 | 596 | 4.30E-58 | Bacillus subtilis | e1249807 | yvrCputative metal binding protein,YvrCBacillus subtilis 42.7kB DNA fragment from yvsA to yvqA.similar to iron-binding protein |
| Contig364D | 900256_c3_440 | 2831 | 5668 | 210 | 70 | | | | | |

| Contig364D | 9642_f2_131 | 2832 | 5669 | 876 | 292 | 769 | 2.00E-76 | Bacillus subtilis | e1185988 | yubBbacitracin resistance protein (undecapreno) homolog yubBBacillus subtilis complete genome (section 16 of 21)similar to bacitracin resistance protein |
|---|---|---|---|---|---|---|---|---|---|---|
| Contig364D | 969075_c3_482 | 2833 | 5670 | 354 | 118 | 359 | 5.60E-33 | Bacillus subtilis | e1184359 | yusIarsenate reductase homolog yusIBacillus subtilis complete genome (section 17 of 21)similar to arsenate reductase |
| Contig364D | 970327_c1_323 | 2834 | 5671 | 297 | 99 | 167 | 1.20E-12 | Bacillus subtilis | e1184355 | yusEthioredoxin homolog yusEBacillus subtilis complete genome (section 17 of 21)similar to thioredoxin |
| Contig364D | 978426_c3_452 | 2835 | 5672 | 978 | 326 | 960 | 1.10E-96 | Bacillus subtilis | e1182347 | yclNhomologue of ferric anguibactin transport systemBacillus subtilis complete genome (section 3 of 21)similar to ferrichrome ABC transporter (permease) |
| Contig364D | 9882950_c1_288 | 2836 | 5673 | 1350 | 450 | 1090 | 1.90E-110 | Bacillus subtilis | e1182956 | yhdPhypothetical proteinBacillus subtilis complete genome (section 6 of 21)similar to hemolysin |
| Contig364D | 9884625_f3_203 | 2837 | 5674 | 1509 | 503 | 1226 | 7.50E-125 | Bacillus subtilis | P94408 | yclHhomologue of Di-tripeptide transporter Dtp of L.Bacillus subtilis complete genome (section 3 of 21)similar to di-tripeptide ABC transporter (membrane |

318

SEQUENCE LISTING (5674 sequences)

SEQ ID NO: 1 - DNA, 204 bp, Staphylococcus epidermidis
ttgttgcaaactcatatttatgtgaaagtccgttttgaattaaccaaattgcatagttataacaataaacacaatttccatcataataaattattggcatgtgtatacactcctttttcattgcttaattatttatattcccatttaggtataataaataaacctatttttctcaattttaactcttttagaattacgcattga

SEQ ID NO: 2 - DNA, 342 bp, Staphylococcus epidermidis
tttttattaaacataaaagaggtgaaatcaatgctagaatttagaaatgtgtataaatcttttaaaaaaaaagaaatattatgtgatgttaattacaaattatctgctggagaaaaggttggtcttataggttctaatgggtctggaaaatcaacattaatgaaacttatagctaaaactcaattaccatctaaaggaaatgtttatttgaacaatatagatatacataaatctcacaatatgataaaagatttttctttcatgataggacaaatatattatcctgagttaaatgcaagaacaaatattgaaaattacctaaaaattaataataagaattag

SEQ ID NO: 3 - DNA, 381 bp, Staphylococcus epidermidis
ataaacctatttttctcaattttaactcttttagaattacgcattgatgtttacttggcaaatttattaattattttagtcccatctattacatcagctatcttaattattttcacttcaaaaatgaaattatatttatggttaaatgtaatttcaaacctaattttttacattatttatagtaaatatatcatgcatctagatggttatctatcctatatcgagagggcgcaaatcaataatagtgatatagaaattaaaatatctccaaatatgcttgaattatctcagattatctttttattttttgtttatttaatacctcaaatgattgtagtttttattaaacataaaagaggtgaaatcaatgctagaatttag

SEQ ID NO: 4 - DNA, 198 bp, Staphylococcus epidermidis
  unsure (38),(46),(66),(147),(161): Identity of nucleotide at the above locations are unknown.
gcgcatcaacgcggtggcgcacggcgcggggtggccantgtggtantggccgcaacaggcatccancaagttgccgctgccgcaaaggcaaatggatgtactcatggttaccaccaatacttctcgaaattttccgggttggcccanaaacgggcattcanccaatccggcacttgtttgtattcaagcagatcgtag

SEQ ID NO: 5 - DNA, 549 bp, Staphylococcus epidermidis
  unsure (23),(37),(118),(138),(146),(189),(233): Identity of nucleotide at the above locations are unknown.
atacaaacaagtgccggattggntgaatgcccgtttntgggccaacccggaaaatttcgagaagtattggtggtaaccatgagtacatccatttgcctttgcggcagcggcaacttgntggatgcctgttgcggccantaccacantggccaccccgcgccgtgcgccaccgcgttgatgcgctcacgntacagcgcctatgtgctggggctggtggattatctggtggccantacgctaccggcacaacagaacggcctcgaccgtgatgccatcggggcctggagcgcgcaaagcacctggctcggcctggaagtggaaagctccgaggtgtttggtgggcagccggaacatgcctttgtcacttttaccgcacgctggcatgacagcaccggcgaacacagccaccgcgaacagttgtctttcgtacagaacgatgggcgttggtactttattgatcctacggtggaggtgaaggccgggcgtaatgatgcctgcctgtgcggcagtgggcagaagttcaagaagtgctgttccagttacctgtaa

SEQ ID NO: 6 - DNA, 243 bp, Staphylococcus epidermidis
  unsure (11),(92),(112),(120),(163),(207): Identity of nucleotide at the above locations are unknown.
atgcccgtttntgggccaacccggaaaatttcgagaagtattggtggtaaccatgagtacatccatttgcctttgcggcagcggcaacttgntggatgcctgttgcggccantaccacantggccaccccgcgccgtgcgccaccgcgttgatgcgctcacgntacagcgcctatgtgctggggctggtggattatctggtggccantacgctaccggcacaacagaacggcctcgaccgtga

SEQ ID NO: 7 - DNA, 240 bp, Staphylococcus epidermidis
tcgatccaggcgttgagcggcgacggtgtggcgttgcattacctgctggaggcgtacaagcatttgaaggcgattgccttggcgggtgaggcgaagcagttgctgcaggtgctcaagctggacgcggatgcggggttgattgtcggcggggatgccaaggcgttgaaggcgtttattgcggcgattgcccagcatcgggtctgggaacgggagcctatggccaaggcggttccggcttaa

SEQ ID NO: 8 - DNA, 249 bp, Staphylococcus epidermidis
  unsure (2),(147): Identity of nucleotide at the above locations are unknown.
gntggccaccgccgaggaccaactcgccgcgttgcaggcccaatcgcccgacgacccggcactcgagccgtatcagcgccaactggccgaggcctatttgcagcgcagccagatcgtcctgcaaaaaggcgatgtcaacgccgccgntacggccttgagccgcgcccgggcgttgatgcccaaggctcccgcgctgaccggtggggtcaacaacgccatcgcccacgcgcgcaaggccgagctggataa

SEQ ID NO: 9 - DNA, 735 bp, Staphylococcus epidermidis
  unsure (341),(486),(501),(513),(709): Identity of nucleotide at the above locations are unknown.
atcaatccgcttcacccgtttagtcagcagcgtgttcagccacgggtaatcctcggtgcgcggcacctggatgctcacatcacactggtaattcaccacatcggtggcgatggcatccagttgatggcgcaattcctggatatccgtgaggttcagcgccaccgtggtgctttcggcggtggggtcgatgaccttggctggcggcttggcttcggcagctttcagggcggcttcggctttatccagctcggccttgcgcgcgtgggcgatggcgttgttgaccccaccggtcagcgcgggagccttgggcatcaacgcccgggcgcggctcaaggccgtancggcggcgttgacatcgcctttttgcaggacgatctggctgcgctgcaaataggcctcggccagttggcgctgatacggctcgagtgccgggtcgtcgggcgattgggcctgcaacgcggcgagttggtcctcggcggtggccanctcactgctggccangttttgttccanctgtgcaatggccacagcgcgcgcatcccgcacctccggggccaacgggcggggtgcttttgcaggcgcccaccaccagggaaaatgccggcaggaacaaataaacggaggttaacggcttcattcctgccactctctaattgcgccaaaagcgagcaagtctacccccctccgacgggggcagggacaaactcanccataaacaattgcgggggccggtga

SEQ ID NO: 10 - DNA, 267 bp, Staphylococcus epidermidis
ggcgaagcagttgctgcaggtgctcaagctggacgcggatgcggggttgattgtcggcggggatgccaaggcgttgaaggcgtttattgcggcgattgcccagcatcgggtctgggaacgggagcctatggccaaggcggttccggcttaagtcattggttgtttgatagggcgccatcgcgggcaagtcgaatcgtcgcactgcccgcgattggcttcagtcggctttacgcggaatcaacacaacctgcgccggaatatgcctga

SEQ ID NO: 11 - DNA, 237 bp, Staphylococcus epidermidis
agacggatttgcaaatcgcaggtttggaaaaaaccaggcgtcggtgatgaaaagccgtacatcagcgtcgcaatttcagaacgcacagtggggacaaaaagcacctctggctctgatgaacagcctgcacaatcgtcgtcatcgccttcaagcgaatcccattcgtcacaacaggcacatcagcctcaaccccaacaggatcaacacccaagcggagtagcaggcttcaatttttga

SEQ ID NO: 12 - DNA, 324 bp, Staphylococcus epidermidis
aaaatgaatttagaaaacttaacaactgaacgtaaaaatgaaaatacaatgggcttaaatgagatgagtgtcaaagaagctttacaaaaaatgaatcaagaagaccaaaaagttgcaatggcagtgggtcaagaattagcagccattgaaccagtggtagaagccatcatcaaaagcttcaatcaaggcggccgcttgatctacatgggcgctggtacaagtggtcggttaggtgtcttaaatgcagccgaatgcgtaccaacttttggcgtcaagccaaagatggttcaaggccccatccgctggtgggccaaaaaccattga

SEQ ID NO: 13 - DNA, 888 bp, Staphylococcus epidermidis
  unsure (505): Identity of nucleotide at the above locations are unknown.
cctcggtttagattcgggtcgagtcgacctttaatcgagttgggcgtaactggccttcggatggactacggcattacgatagaacaaatggctcatgcttcacataagattgatataggattgaatgctagtaccattacactggaagaagtggctgagttaaaggctcatcaagcggacttttctcgcttagaagcttggcataattattatccaagacctgaaaccggcattggaacaacattttttaatgaaaagaaccgctggcttaaagaattaggcttacaagtttttacttttgtgccaggagatgggcaaacaagaggcccaatttttgctggtttaccaacattagaaaaacatcgggggcaaaatcctttcgccgctgccgttggtttgatggctgatccttatgtcgatgctgtttatattggtgatcctacaattagtgagcgaaccatggctcaatttggttattatcaccaaaccaatcaatttctgttanaagtagcacctagcgagagccgctatttgaagcgaatacttgggactcataccaatcgtttagatgctgcaagagatgttttgcgaagtgaattatcaaaaacgagtgaaatgttcagaaaagatgaaattgcaacgattgagtcagagcagactgaagcacgtccagtgggaaccgtaacgattgataatgaaaaatatggtcgctatatgggagaaattcaagtcacacttgtggacttgccgaaagatgaaaaagtcaatacgattacacgaattattgaaaaagatcaaacgatattgccgttaatcaaggcaggcaatcaatttacgctagtcacggaaggaacgatagaaaatgaatttagaaaacttaacaactga

SEQ ID NO: 14 - DNA, 228 bp, Staphylococcus epidermidis
cttgccacaacggcagcaatggcgcgccgtgacacagtgcttccagttgggcgaagaaccgtgccatgtcttctaggttgctcgggccgtgatcttcacgcagcagcccggccaggccctgttgcagcatttgccgccagtgctgcagttgctcggcaaagtcggccggtgcccgctgggccagatcgtcatcgggcagcggggcgatcaccagcagttgcgggctga

SEQ ID NO: 15 - DNA, 186 bp, Staphylococcus epidermidis
cccggcattgcgcagcctgctcaagagctgcgacaaggtgttcaagcgcctgcaaacccagggcatcgaagggatcaacagcccggcaccggaccagttgctcaagagcctgctgttttatatcgccaaagtcacccggccgacgccgcgcatgcaaagcctcaaggaacgctacggcctggatga

SEQ ID NO: 16 - DNA, 1368 bp, Staphylococcus epidermidis
gaagaaaaagcaagagagacgaagagagaaaaggaaagggagaggaaccagccagaaagagaaccagaaaaaaggacaagaaagaagagaggaaaccgagaagaacagatgacgaaaacggaaagaagaaccgggcagagcgaccaagagcgagacaagggaaccagagaagaggagagaagagaaaaaacaagaaggaaaaaagcggggaagagaaagagggcgaagaaagcaaaagaggaaaaaagaacgaaaggccaaaaaagagaagaggggagagagcaggcagggggggaggcccccaaaatgggattctcacttttcaacccattcagaaggggagtcgtattggttgacgggcacgaaaacgtcgccctagaatgggtcaagggcgagatcgcggacaccgtgaagcaggcccgtgcggcaatggacgcctttgcggacgacgccagcgagcaagccctcgcgcagtgcgtggagggcattcatcaggtccacggcgccctgcagatggtcgagttctacggcgcggcactgctcgccgaagaaatggagcacctggcccaggccatgcaagccgggcacgtcagccagcgcgaagaaggcatccgcctgctgcaacaggccctcgggcaactgccgttgtacctggaccgtgtgcacagcgcccggcgcgacctgcccctggtagtgttgccgctgctcaacgacctgcgcagcgtgcacggcaaaagcctgctctcggaaaccagcctgttcagcccgcaactgctggtgatcgccccgctgcccgatgacgatctggcccagcgggcaccggccgactttgccgagcaactgcagcactggcggcaaatgctgcaacagggcctggccgggctgctgcgtgaagatcacggcccgagcaacctagaagacatggcacggttcttcgcccaactggaagcactgtgtcacggcgcgccattgctgccgttgtggcaagtcacctcggcgctggccgaaggcatgctcactggcgtgatcgccaatagcccggcattgcgcagcctgctcaagagctgcgacaaggtgttcaagcgcctgcaaacccagggcatcgaagggatcaacagcccggcaccggaccagttgctcaagagcctgctgttttatatcgccaaagtcacccggccgacgccgcgcatgcaaagcctcaaggaacgctacggcctggatgaagccttgcccgacagcaccgtggtcgatgccgagcgcgcgcgcctggccgggccggaccgcaatgccatgggctcggtgctcggcgcgttgtgtgaggagttggtgcgggtcaaggaacgcctggacctgtttgtgcgcgactct

SEQ ID NO: 17 - DNA, 444 bp, Staphylococcus epidermidis
cgggcacgaaaacgtcgccctagaatgggtcaagggcgagatcgcggacaccgtgaagcaggcccgtgcggcaatggacgcctttgcggacgacgccagcgagcaagccctcgcgcagtgcgtggagggcattcatcaggtccacggcgccctgcagatggtcgagttctacggcgcggcactgctcgccgaagaaatggagcacctggcccaggccatgcaagccgggcacgtcagccagcgcgaagaaggcatccgcctgctgcaacaggccctcgggcaactgccgttgtacctggaccgtgtgcacagcgcccggcgcgacctgcccctggtagtgttgccgctgctcaacgacctgcgcagcgtgcacggcaaaagcctgctctcggaaaccagcctgttcagcccgcaactgctggtgatcgccccgctgcccgatga

SEQ ID NO: 18 - DNA, 267 bp, Staphylococcus epidermidis
cgaaaacggaaagaagaaccgggcagagcgaccaagagcgagacaagggaaccagagaagaggagagaagagaaaaaacaagaaggaaaaaagcggggaagagaaagagggcgaagaaagcaaaagaggaaaaaagaacgaaaggccaaaaaagagaagaggggagagagcaggcagggggggaggcccccaaaatgggattctcacttttcaacccattcagaaggggagtcgtattggttgacgggcacgaaaacgtcgccctag

SEQ ID NO: 19 - DNA, 357 bp, Staphylococcus epidermidis
agaagaaaaagcaagagagacgaagagagaaaaggaaagggagaggaaccagccagaaagagaaccagaaaaaaggacaagaaagaagagaggaaaccgagaagaacagatgacgaaaacggaaagaagaaccgggcagagcgaccaagagcgagacaagggaaccagagaagaggagagaagagaaaaaacaagaaggaaaaaagcggggaagagaaagagggcgaagaaagcaaaagaggaaaaaagaacgaaaggccaaaaaagagaagaggggagagagcaggcagggggggaggcccccaaaatgggattctcacttttcaacccattcagaaggggagtcgtattggttga

SEQ ID NO: 20 - DNA, 195 bp, Staphylococcus epidermidis
ggaatatttctcaggttatcaccccttgggagatcacattttgaggaacaccaatttggccaccgaacagttttttcacgctatattaaacttctccccggcgttttttgggggggagcccaaaaacgggaaggccaaaatgccgcccaaaagaggggattaagggggaaacacgggaaaatggcggaaaattcc

SEQ ID NO: 21 - DNA, 207 bp, Staphylococcus epidermidis
cgtcagatactgcaccccctgaacccccatgctccaacagcaaaaaggaaactttttgctgcttttccgacgcttattcgcttcgctcatatttatatagaaaagaagcgaatgcgcaaaagacataatcgattcacaaaaaataggtacacgaaaaacaagttaagggatgcagtttatgcatcccttaacttacttattaaataa

SEQ ID NO: 22 - DNA, 396 bp, Staphylococcus epidermidis
gcaaaattcattataaccaaattaaagagggttataatgaacgagaaaaatataaaacacagtcataactttattacttcaaaacataatatagataaaataatgacaaatataagattaaatgaacatgataatatctttgaaatcggctcaggaaaaggccattttacccttgaattagtacagaggtgtaatttcgtaactgccattgaaatagaccataaattatgcaaaactacagaaaataaacttgttgatcacgataatttccaagttttaaacaaggatatattgcagtttaaatttcctaaaaaccaatcctataaaatatttggtaatataccttataacataagtaccagatataatacgcaaaatttgtttttgatagtatag

SEQ ID NO: 23 - DNA, 405 bp, Staphylococcus epidermidis
tacgcaaaatttgtttttgatagtatagctgatgagatttatttaatggtggaatacgggtttgctaaaagattattaaatacaaaacgctcatgggcattacttttaatggcagaagttgatatttctatattaagtatggttccaagagaatattttcatcctaaacctaaagtgaatagctcacttatcagattaaatagaaaaaaatcaagaatatcacacaaagataaacagaagtataattatttcgttatgaaatgggttaacaaagaatacaagaaaatatttacgaaaaatcaatttaacaattccttaaaacatgcaggaattgacgatttaaacaatattagctttgaacaattcttatctcttttcaatagctataaattatttaataagtaa

SEQ ID NO: 24 - DNA, 321 bp, Staphylococcus epidermidis
  unsure (311): Identity of nucleotide at the above locations are unknown.
cgaggcttcctatatcaccggcgtgaccttgccgataggaggtggcgacctcggctgattcaccgttacctgcagacattgactcacaacaacaataaagagagcactgccatgcgtacccatgacgttcattcgattatcgacaatgcccctttcaatcgcttccattggctggttgtcagcctgtgtgccttgctgttgatctttgatggctatgacttgtttatctatggcgtggtcttgccatcgatcatgcgcgagtcggggctgacgcccctgcagaccggcgccctgagcatatatgattgttncgcccccccc

SEQ ID NO: 25 - DNA, 735 bp, Staphylococcus epidermidis
aatcgcgcccgcttgctcgtcgatgctgccgtagcgtttcatcgggctgctgtcgagggtctggtcgacgatctgctggtaccacacgcgctcctgctcgctttgcggctggctgttgcgcgggatgcgccgcggtggggcctcggtgccgcccggtgcggtggcattgacacggatgccgctgccggcggtctccagggccaggcacgcggtcagggcattgaccccgcccttggccgcgccatagggcacccgattgaccccgcgtgtggcgaccgaagacacattgacgatggccccactgccctgctccagcatgtagggcagcacgcaatggcaacaccacaacgtggggaacagcgagcggcgcacttcggcttcgatttgcgctaccgcgtagaactcaaagggcttggcccagatagtcccgccgacgttgttgatcagaatgtggatgcgcccaaaccgcaccttggcggcggccatgacctcggcacacgcggcatgttgctcaaggtcggcgatcagggtcagcagccgcgcatgctgcaactcatgcaccagctccgagcgatcgaccgcgaccacccaggcgccctccgccagcaaccgctcggccacgcgccggccgatgccctgggcggcgccggtaaccagcgctaccttggtgtcaaaacgtggattcatgctgatctcctcacgcggcgtcagaacttgcgacggcattggcggtga

SEQ ID NO: 26 - DNA, 312 bp, Staphylococcus epidermidis
  unsure (11): Identity of nucleotide at the above locations are unknown.
ggggggggcgnaacaatcatatatgctcagggcgccggtctgcaggggcgtcagccccgactcgcgcatgatcgatggcaagaccacgccatagataaacaagtcatagccatcaaagatcaacagcaaggcacacaggctgacaaccagccaatggaagcgattgaaaggggcattgtcgataatcgaatgaacgtcatgggtacgcatggcagtgctctctttattgttgttgtgagtcaatgtctgcaggtaacggtgaatcagccgaggtcgccacctcctatcggcaaggtcacgccggtgatatag

SEQ ID NO: 27 - DNA, 819 bp, Staphylococcus epidermidis
cgaagaaattcaccgccaatgccgtcgcaagttctgacgccgcgtgaggagatcagcatgaatccacgttttgacaccaaggtagcgctggttaccggcgccgcccagggcatcggccggcgcgtggccgagcggttgctggcggagggcgcctgggtggtcgcggtcgatcgctcggagctggtgcatgagttgcagcatgcgcggctgctgaccctgatcgccgaccttgagcaacatgccgcgtgtgccgaggtcatggccgccgccaaggtgcggtttgggcgcatccacattctgatcaacaacgtcggcgggactatctgggccaagccctttgagttctacgcggtagcgcaaatcgaagccgaagtgcgccgctcgctgttccccacgttgtggtgttgccattgcgtgctgccctacatgctggagcagggcagtggggccatcgtcaatgtgtcttcggtcgccacacgcggggtcaatcgggtgccctatggcgcggccaagggcggggtcaatgccctgaccgcgtgcctggccctggagaccgccggcagcggcatccgtgtcaatgccaccgcaccgggcggcaccgaggccccaccgcggcgcatcccgcgcaacagccagccgcaaagcgagcaggagcgcgtgtggtaccagcagatcgtcgaccagaccctcgacagcagcccgatgaaacgctacggcagcatcgacgagcaagcgggcgcgattctattcctggcctctgacgaggcttcctatatcaccggcgtgaccttgccgataggaggtggcgacctcggctga

SEQ ID NO: 28 - DNA, 189 bp, Staphylococcus epidermidis
  unsure (45),(128): Identity of nucleotide at the above locations are unknown.
tcaaggatgtcggtggcgtgttggaagcgcggcgtagctgacgcnatgaactaccggggtcagacccccaatgccgctaacgtaaagccctgcgctaacgtggccgagggtctgaccccagtgctggntaatgcgtcttgtcacccgcatgcagtcccgccatcgtggcggtttcaggctgcaatgtga

SEQ ID NO: 29 - DNA, 564 bp, Staphylococcus epidermidis
  unsure (6),(287),(366),(399): Identity of nucleotide at the above locations are unknown.
ttcatngcgtcagctacgccgcgcttccaacacgccaccgacatccttgatcacattcagcgccttcaacagttgcgccgtcgaactgatctcggccgtaaacgtcatgcgggcctggcccttggcgctttgggtattgacgccgatcacgttgatcttttcacgcgaaaagatttcggagatgtcgcgcagcaagccctggcggtcgccggccagaatgaaaatatcgaccggatacacggtgtcgtggccacccgtgctgccccattccgtgaagatcacgcgtncgggcgacttggcgcgcatttcctcgaaattcttgcacgtggcgcggtggataaaacacccttgccgcgcgtgacgaanccgacgatgctgtccggcggcgccggcttgcancacttgggcagcaccgtcatcaaaccctccgtccccaccaccaaaaagccggacttggggccctgctctacactggaagcgcggctcttgcccaacacaacgggtcttccggcaccacaacttccccaatgtcgtgcaacgcctgctccacctggggcaggctga

SEQ ID NO: 30 - DNA, 504 bp, Staphylococcus epidermidis
  unsure (471): Identity of nucleotide at the above locations are unknown.
caaggcctcagcacgcgcgctgccctcgtgcatgtgatgggagacttgctcggctcggtcgccggcatcatcgccggcgccgtgatttactgtacaggctggatgcagatcgacccgctgctgtcggtgctggtgtccctgctgattttaaagtcgacgtttggcgtactgcgcgagtcctatcacttcctgatggaaggcgtgcccttgcacatcgactacatcgtcgtgggcacggacgtggatcaggtggacggcgtgattgccgtgcacgatttgcatgtgtgggatatgtcgccgggccaaccagccctgatcggccacgtggaaatcgaacacctcgaccattggccgaacgtcttgcgggcgatcaagaagatgctgttggacaagcatgggattgatcacatcacattgcagcctgaaaccgccacgatggcgggactgcatgcgggtgacaagacgcattanccagcactggggtcagaccctcggccacgttag

SEQ ID NO: 31 - DNA, 729 bp, Staphylococcus epidermidis
  unsure (46),(340),(373),(452): Identity of nucleotide at the above locations are unknown.
gcccttggaataatgcggggaaacccttgcccccaaggccccgggngttggtggaaggaattccttgccagggggggaggcaaggccgccgttcaatttggaaaccgttggcccaaaaggttgggcttttcccaagttggacgagtttttccttttccttcggcaagggtgaattcagcctgccccaggtggagcaggcgttgcacgacattggggaagttgtggtgccggaagacccgttgtgttgggcaagagccgcgcttccagtgtagagcagggccccaagtccggctttttggtggtggggacggagggtttgatgacggtgctgcccaagtgntgcaagccggcgccgccggacagcatcgtcggnttcgtcacgcgcggcaagggtgttttatccaccgcgccacgtgcaagaatttcgaggaaatgcgcgccaagtcgcccgnacgcgtgatcttcacggaatggggcagcacgggtggccacgacaccgtgtatccggtcgatattttcattctggccggcgaccgccagggcttgctgcgcgacatctccgaaatcttttcgcgtgaaaagatcaacgtgatcggcgtcaatacccaaagcgccaagggccaggcccgcatgacgtttacggccgagatcagttcgacggcgcaactgttgaaggcgctgaatgtgatcaaggatgtcggtggcgtgttggaagcgcggcgtagctga

SEQ ID NO: 32 - DNA, 750 bp, Staphylococcus epidermidis
cgtggctttcctccgcgcgctggtggcgcggctggcccaggaataccgcgtcgatccgcagcgggtatatgtcgccggctactccaatggcggccagatggctttccgcctggccgccgaagcaccggggttgccggcggcgatcgcaacggtggcggcgagcctgccgaccacggagaacgatgcctgtcggccggtcgagcggccgaccgctgcgttgctgatcaacggcacgcgcgatccgatcaatccctatctcggcggcaaggtcagcctgttcggcttcggcgaccggggcgcggtacgctcgacactggactcggcacgctggtgggccggcctgaacggcatcgcagcgccgccggacgtggcgccgctgacccgtcccggcccggtgtggaccgagcgccagcgctggcaggaagacggccatccgccggtggagctgctcagcgtgcatggcgccggccacgtgctggcgcagccggactatcgcttcccgcggattctcggcaagagcgacccggaactggacgcgccagtggaaatctggcgcttcttcagccagttgccgcgctgaggctcagacctcgaagacgaattccggacggaacccgcctctctcgtggggatagccgcccggattggccagcacccgtgcccggccgatgcggtagtcgagggcatcgtggacgtgaccgtgcagccagtagtcggcctgcgccaccagttcgtcgaggttggaagcga

SEQ ID NO: 33 - DNA, 357 bp, Staphylococcus epidermidis
tcagcaacgcagcggtcggccgctcgaccggccgacaggcatcgttctccgtggtcggcaggctcgccgccaccgttgcgatcgccgccggcaaccccggtgcttcggcggccaggcggaaagccatctggccgccattggagtagccggcgacatatacccgctgcggatcgacgcggtattcctgggccagccgcgccaccagcgcgcggaggaaagccacgtcatcgacgtcacgcagccgcgccgaatagctggcggccttgcggcaatcgttccagtggccctcgaagccgtccgggtaggccaccaggaaaccttcttgcgccgccagccggtcgaagccgtagccgctga

SEQ ID NO: 34 - DNA, 852 bp, Staphylococcus epidermidis
cacagcgaggactcgagcctgaaggtcgcgggcctgcgccggcattacctgctctacgtgccgccgggcgtgaccgagggagcgccgttgctggtggtgctgcacggctcacggggcgacggcgcgcatatgcgccgcatcagcggctacggcttcgaccggctggcggcgcaagaaggtttcctggtggcctacccggacggcttcgagggccactggaacgattgccgcaaggccgccagctattcggcgcggctgcgtgacgtcgatgacgtggctttcctccgcgcgctggtggcgcggctggcccaggaataccgcgtcgatccgcagcgggtatatgtcgccggctactccaatggcggccagatggctttccgcctggccgccgaagcaccggggttgccggcggcgatcgcaacggtggcggcgagcctgccgaccacggagaacgatgcctgtcggccggtcgagcggccgaccgctgcgttgctgatcaacggcacgcgcgatccgatcaatccctatctcggcggcaaggtcagcctgttcggcttcggcgaccggggcgcggtacgctcgacactggactcggcacgctggtgggccggcctgaacggcatcgcagcgccgccggacgtggcgccgctgacccgtcccggcccggtgtggaccgagcgccagcgctggcaggaagacggccatccgccggtggagctgctcagcgtgcatggcgccggccacgtgctggcgcagccggactatcgcttcccgcggattctcggcaagagcgacccggaactggacgcgccagtggaaatctggcgcttcttcagccagttgccgcgctga

SEQ ID NO: 35 - DNA, 699 bp, Staphylococcus epidermidis
gtgaagataccggcggttttatcaaatgactataggatgggttacgattttattcaaagcattcaagaattaagcgggatacctacttattttgttccgggaaaccatgatttatggtctgaccaagcagataaaacttcaacagaaatactatcattctttcgctcaaaagaggaatgcttgatcggcaatccaatcattattaatgatcaatatgcaattgtaggccatgtcggttggtatgattatagctatgcagatcatcgtttttctcagcaaaaaatagcaagtggtaaacattatggtgcaacttggcaagataaagtgagaacagattggtcattatcagacccgaaactatcccttttagctgctcaagaggtggaaaaagacattaacaatgtaagcccacgtcaaattattttagttacgcacgttgtaacacatcctcaattcgtagtaccaacgcctcatcgtatttttgacttttttaatgcatttattggtactcatgattttgatactatttatagaaattatcctattcgatttagtataatggggcatgttcattttagaaaaaaacttgttgaaaataacatattatatatatgtccgtgcttaggatatcaaagacaatggatgacagatgatatagcatatgaaataaatcatgctttagtcgattttgatatttag

SEQ ID NO: 36 - DNA, 627 bp, Staphylococcus epidermidis
  unsure (367): Identity of nucleotide at the above locations are unknown.
aatacctgcgcaaaaggacctgaaaaaaaattgctccacccgcaaactgccgcatccaccccccgggcgatttattatttcgacatggtgcggcgctgccattcgatccgcgaagccgcgcggcgcttgaacgtggcgtcgtcggcagtgaaccggcagatcctcaagctggaagatgagatgggggcgacgctgtttgatcgcttgccgggcggcctgcgtgtcacggcggccggcgaaatccttacacgccacatcacgctgctgttgcaggatgtggaacgggtacgcggtgaactggatgggttgcacggggtgcagaccggccatgtggaaatcgccacggtggaaggggctgccgtcgagntactgcccgccgccctcaagcgcatgcgcgagcgctatccgaaggtgacgattggcgtcacggtgcaaggctcgcagtcgattcccagcgcagtggtcaatggccaggcggatttgggactggcttttgccctacctcgcggtggcgaaatcacccaactgtgtgtcggccatttccgcctcggcgcgttgatgacaccgagccatgtgttggccggcgaaagtcatgtcagctacgcacagtgttgcgaacacgggtga

SEQ ID NO: 37 - DNA, 1044 bp, Staphylococcus epidermidis
ttgcacaacaaaaacagagatctccccaccatgactatcccgaaggcgtcaccgcagcggcccgaagatgaaaatctaggcgtcgccgccaacatggcttacggcctgcagcatgtcctcaccatgtacggtggcatcgtcgccgtaccgctgatcgtcggccaggcggccgggttgtcgccggcggatatcggcctgttgatcgccgcgtcgctgtttgccggtggcctggccaccttgttgcaaaccttgggtttaccgttctttggctgtcagttgccgctggtgcagggcgtgtcgtttgccggtgtggctaccatggtggcgatcgtcggcagtgatggcgccggcggggtgccggcgattctcggggcggtgatggccgcgtcgtttatcgggctgttgattaccccggtgttctcacgaataaccaaattcttcccgcccttggtgaccggtatcgtcatcaccaccatcggcctgacactgatgcccgttgcggcacgctgggcgatgggcggcaacacccgcgcggcggattttggcagcatgtccaacatcggcttggccgcgttgaccctgatgctggtgttgctgttgagcaagatcggcagcgcaaccatctcccgtctgtcgatcctgctggcgatggtgatcggcaccgtgattgccgtgttcctgggcatggctgacttctccggggtgacccaggggccgatgttcggtttccccacaccattccatttcggcatgccaaccttccatgtggccgcgatcatctccatgtgcatcgtggtgatggtaacgctggtggaaacctcggcggatatcctcgcggtgggcgagatcatcgacaccaaggtcgattccaagcgcttgggtaacggcttgcgcgccgacatgctgtcgagcatgttcgcgccgatctctggttcgttcacccagagtgcctttgcccagaacgtcggcctggtggcggttaccggggtgaagagccgttctgtcgtggcgaccggcgggtatccgccggatctcttcaccatg

SEQ ID NO: 38 - DNA, 624 bp, Staphylococcus epidermidis
catggtgaagagatccggcggatacccgccggtcgccacgacagaacggctcttcaccccggtaaccgccaccaggccgacgttctgggcaaaggcactctgggtgaacgaaccagagatcggcgcgaacatgctcgacagcatgtcggcgcgcaagccgttacccaagcgcttggaatcgaccttggtgtcgatgatctcgcccaccgcgaggatatccgccgaggtttccaccagcgttaccatcaccacgatgcacatggagatgatcgcggccacatggaaggttggcatgccgaaatggaatggtgtggggaaaccgaacatcggcccctgggtcaccccggagaagtcagccatgcccaggaacacggcaatcacggtgccgatcaccatcgccagcaggatcgacagacgggagatggttgcgctgccgatcttgctcaacagcaacaccagcatcagggtcaacgcggccaagccgatgttggacatgctgccaaaatccgccgcgcgggtgttgccgcccatcgcccagcgtgccgcaacgggcatcagtgtcaggccgatggtggtgatgacgataccggtcaccaagggcgggaagaatttggttattcgtga

SEQ ID NO: 39 - DNA, 192 bp, Staphylococcus epidermidis
cttctccggggtgacccaggggccgatgttcggtttccccacaccattccatttcggcatgccaaccttccatgtggccgcgatcatctccatgtgcatcgtggtgatggtaacgctggtggaaacctcggcggatatcctcgcggtgggcgagatcatcgacaccaaggtcgattccaagcgcttgggtaa

SEQ ID NO: 40 - DNA, 741 bp, Staphylococcus epidermidis
gactttgtcaccaaagttcactgcacgaaaggatcaacatgtctgaccctgcccattccggcgcaaccgtcgcaggttggggggagagccactcgaaagccccagcggcgtgagagtttcgccggccgaggcgcctttctcatcgctgcgatcggttctgcggtcggcttgggcaatatctggaggttcccttatgtcgcctatagcaatggtggtggagccttcatcgtgccttatctggtagcgctgctcaccgctggtattccgttgctcttcctcgactacgccgtcgggcataagttccggggctctccgccgatggctttacgccgtctccacaggcgcatggaggccatcgggtggtggcagaccctcatctgttgggtgatcgtcatctactatgcggtcatcattgcctgggccattcgctatgtcgggttctctgtgacgaaaacgtggggacacgacccggaggggttccttacgggcagcttcctgcacgtggctagcaacgttgacgtcgagttccacttcgtgtctggagtgttctggccattgttgttgctatggctttttgtgcttgccatcatggctaccggcgtcgagaagggcattacccgggcatcgtggatctttatgccgctgctcgcggtgatgttcattactctggttatcgtcgctcttacccttgacggggcctcgcctggacttaagcgacgttcacccgacaatcaccacgga

SEQ ID NO: 41 - DNA, 183 bp, Staphylococcus epidermidis
gacgtgggagagatctacttcgctcacgagcccggcgaggcataccccggtggcgtgaacggggcagtaaccgaaggggttgtcttcgagatactgctggtgctcggcctccgccaggtaaaactcgacgccgttggccatggagatcgcggtcgtgatggctccatagcccgcgttgagtag

SEQ ID NO: 42 - DNA, 279 bp, Staphylococcus epidermidis
ctagagagctggcctgcgaggagacagcacatgaataaaaccgagatggtctcatcggataacgcactaccagggggtcataccccagtgctggcgatgccgtacttccaccgagtgaccggagaccggctcgatcgtcccttcccaagctcagagacgatctacctagccatgggctgtttttggggagccgaaaagctgttttggaacactgacggagtactgcagaccgccgtcgggtacatgggcggtctcacccctaaccccacctaccgctag

SEQ ID NO: 43 - DNA, 240 bp, Staphylococcus epidermidis
caacaacaatggccagaacactccagacacgaagtggaactcgacgtcaacgttgctagccacgtgcaggaagctgcccgtaaggaacccctccgggtcgtgtccccacgttttcgtcacagagaacccgacatagcgaatggcccaggcaatgatgaccgcatagtagatgacgatcacccaacagatgagggtctgccaccacccgatggcctccatgcgcctgtggagacggcgtaa

SEQ ID NO: 44 - DNA, 387 bp, Staphylococcus epidermidis
ccctactcagggaatgcgccagggcaacgacgtgggcacacagtaccgttcggagatctggtgcaccaccaccgaacagttcatgacggccaccactgtcaagggctcttaccaagccaacctactcaacgcgggctatggagccatcacgaccgcgatctccatggccaacggcgtcgagttttacctggcggaggccgagcaccagcagtatctcgaagacaaccccttcggttactgccccgttcacgccaccggggtatgcctcgccgggctcgtgagcgaagtagatctctcccacgtcctacgatcaatgcacttggtcgcgactcagggcacgatgtagttgccacaccaccggagcatcatggatacgaccactactaa

SEQ ID NO: 45 - DNA, 450 bp, Staphylococcus epidermidis
gtgtacacgggatgcaccggacacgccgaaaccgttcgagtaacctacgaccccactcaggtctcgaccgaggcgatcctcactatcttcctggaaaaccatgaccctactcagggaatgcgccagggcaacgacgtgggcacacagtaccgttcggagatctggtgcaccaccaccgaacagttcatgacggccaccactgtcaagggctcttaccaagccaacctactcaacgcgggctatggagccatcacgaccgcgatctccatggccaacggcgtcgagttttacctggcggaggccgagcaccagcagtatctcgaagacaaccccttcggttactgccccgttcacgccaccggggtatgcctcgccgggctcgtgagcgaagtagatctctcccacgtcctacgatcaatgcacttggtcgcgactcagggcacgatgtag

SEQ ID NO: 46 - DNA, 339 bp, Staphylococcus epidermidis
gttggcttggtaagagcccttgacagtggtggccgtcatgaactgttcggtggtggtgcaccagatctccgaacggtactgtgtgcccacgtcgttgccctggcgcattccctgagtagggtcatggttttccaggaagatagtgaggatcgcctcggtcgagacctgagtggggtcgtaggttactcgaacggtttcggcgtgtccggtgcatcccgtgtacacctagcggtaggtggggttaggggtgagaccgcccatgtacccgacggcggtctgcagtactccgtcagtgttccaaaacagcttttcggctccccaaaaacagcccatggctag

SEQ ID NO: 47 - DNA, 186 bp, Staphylococcus epidermidis
caacaaccagccaacaatgaacaccttattcatactgattgcaggcttcattctggccggatgcattcaggccttagtaaaccctgcgcaaatattcctattatccaagctaatccaacaaatcgtaagagatgcttcgatcaattggattgggcaattactgcacaaagactttcatcactttag

SEQ ID NO: 48 - DNA, 1287 bp, Staphylococcus epidermidis
  unsure (1284): Identity of nucleotide at the above locations are unknown.
ttgttgggggagcctttttgtatatgggtggtagggggagtgttcctcgctgtgatcggcctgagtgctatctatctttttacagcccacaaaatcataagatggcggagaaagcacattgacaggatcaacgaacaagaagatgagctgggtgccattctgttcaacactttaaaatcggggaagtctataaaactggaaggagcagaacatactgccacacaccctttgaatgaagctttcacccaatacgccaatgccgcggtaacagttacaagctccggcggttttttaaacggtataaagatcctattcatcagccttgccaccggagggctacttggctggggggtattggatcagctttcaggacaacccgttattagtcttgggcaattagttgcgacattctcaatcgctggcagcttcttaatcaacattactgcgcttacagaaggctaccgggtactggatcaatttctcgcagaccagcgccgactcctgcacctactgtcgttaccaaattttggcgacgacaacggccaactcgaaataccgctaaagcccaaatcaacgttaatacttaatccctgcatcgtgactgacaccagctccatccgcttgaccatcaagacagccatcgaatttacccaaattcagtcagttgccatcactgggccaagtggagcggggaaatctaccttgctggaagtgctggcaggcttgaacccctcactgacaagcaggttgcttatcgacgacaagcccatttgcgaactgagtgcccaagcgcatttgaggtacctgaggtattgcccccagtcgccccagttcctggaaggctactttgatcactccgtactgtttggaatccccccctccccacacttgaaccacgcaattgagcaactgaacctggaagaaatcgttttaaaccgcagcctcagcgaaaacgcgtccaatatttcaggaggcgaagcaaagcgtctgtccctgctgcgcttcgtcaacaggcccggggaattcaatttattcgatgaacccagcgcgtccattgaacaaaaactggccacgcctgtgtgggatctgctgttcgatatcttcggcaaacgcggattgatatgcgtcacacatgatgtccgccacctgcaccgttttgatcaggttattgtcatgtcaaacggagcaatcattgatcaaggcccttggagcgagttggctaacaaaacgtcgatcttgacgctgttaagtgactttgatctggaaaaccaaaccggcaacagntag

SEQ ID NO: 49 - DNA, 192 bp, Staphylococcus epidermidis
ggctgcggtttaaaacgatttcttccaggttcagttgctcaattgcgtggttcaagtgtggggagggggggattccaaacagtacggagtgatcaaagtagccttccaggaactggggcgactgggggcaatacctcaggtacctcaaatgcgcttgggcactcagttcgcaaatgggcttgtcgtcgataa

SEQ ID NO: 50 - DNA, 324 bp, Staphylococcus epidermidis
aacaatacatacataattcaggccctgaggcaaggtgggataaacttattaaagaataatttaaataatttgaagtttaggaaatctaataaggatagtctaaagttaaagtggattagcttggagaaaagaaagctaaggggatgcatattagcatacgacagaaggttgaatgggaaattcttagagccgcttcatctttgtactgaaattgctatatttggggatggtttagatacagtcttgtctgagaccaagaaaggattaaatgaattcttaatgttccttcaatcctatgattctatttgttcagaaaggagataa

SEQ ID NO: 51 - DNA, 195 bp, Staphylococcus epidermidis
gcttgtctggaactcctggcctcaagcattcctcctgcctcagtctcccaaaatgctgggattatgggcatgggccatcacgcccagcctaattcagtatttttagtctcatacagaattaaagcaatgattaactacaactccaatttcaatataaagtctatacaacatgaaaaaaacaaaaaagatgaataa

SEQ ID NO: 52 - DNA, 990 bp, Staphylococcus epidermidis
aaggtgttatcatcttttttaatgttaagtataatcagttcattgctcacgatatgtgtaatttttttagtgagaatgctctatataaaatatactcaaaatattatgtcacataagatttggttattagtgctcgtctccacgttaattccattaataccattttacaaaatatcgaattttacattttcaaaagatatgatgaatcgaaatgtatctgacacgacttcttcggttagtcatatgttagatggtcaacaatcatctgttacgaaagacttagcaattaatgttaatcagtttgagacctcaaatataacgtatatgattcttttgatatgggtatttggtagtttgttgtgcttattttatatgattaaggcattccgacaaattgatgttattaaaagttcgtcattggaatcgtcatatcttaatgaacgacttaaagtatgtcaaagtaagatgcagttctacaaaaagcatataacaattagttatagttcaaacattgataatccgatggtatttggtttagtgaaatcccaaattgtactaccaactgtcgtagtcgaaaccatgaatgacaaagaaattgaatatattattctacatgaactatcacatgtgaaaagtcatgacttaatattcaaccagctttatgttgtttttaaaatgatattctggtttaatcctgcactatatataagtaaaacaatgatggacaatgactgtgaaaaagtatgtgatagaaacgttttaaaaattttgaatcgccatgaacatatacgttatggtgaatcgatattaaaatgctctattttaaaatctcagcacataaataatgtggcagcacaatatttactaggttttaattcaaatattaaagaacgtgttaagtatattgcactttatgattcaatgcctaaacctaatcgaaacaagcgtattgttgcgtatattgtatgtagtatatcgagcttcacatga

SEQ ID NO: 53 - DNA, 966 bp, Staphylococcus epidermidis
ttagtgtcatctattgacactaaaaggagaataataatgaaaaaatctgttagattatataatatgattgaatattgtaatgaaaataggaacttcaaattaaatgatttaatgtcagaatttaatatttctcgtagtaccgctttaagggatataaaagaaattgaagcattaggagtacctttatatagtaatccagggaaaaatggtggttatacgatcataggtaatcgagaccaaacgaaaatagcaatcacagatgaagagttgaaagctttagtatttacactttcgagtatttcaaatgtgagtaatctaccttttcaaacagaatatcaagaaatattaaaaaaattatataataactcgaataaaaaagagttaataaaccaatataatgatctatttcaatattttaatgaagataagtatcagttcaaaagttataagttatttaatgaaatcattagattgataattgagaataagtcttttgaaacctgttattcacaaaactatattaaagaacaatataaaggtattggcattatgtataaaaatcatcaatggtattttgttgtagctaatatagaatcaaagttagtgaatctattaaatatttcgaaaataaaagaactatatgaaatgggagagactcaagagtgtaatgatataactatgcagaattttcaacagttcatggttaaaaatgaaactgctattgatattcttattagaagcaatgttatgggattgaatatcttgaaaggctacctgtggagtgactatatgattgaaaatattgacgaagagacatatttatttaaatcaaaagtgaacgcgaaagatatagattttatagctaagttaattgtcacaggtggtgtcaatgtaaaagtagagacccctaatagtttgaaaaatgctgttaaagttgaattaactaaaataataaacatgtattaa

SEQ ID NO: 54 - DNA, 1242 bp, Staphylococcus epidermidis
gtaaagtttttagcttctcaactattcaaaggaggtttttttatcgattacttaggtgttgatattagtaaaaggagtagtgtagttgcacattataaaaatggaaaattccaaaaagagtttttcatccaaaataataaaaatggctacaattatttactcaagtatttgaatgacttagaccacccacaactcatttttgaatctacaggtatctattcaagaggtatggaacgattttgttgtgtaaatcaaattaactatattcaaatgaatccgttagaagccaaatttaaaacgagcgctctaagatcatggaaaactgatcaggcagatgctcataagcttgcttgtttaggaccgacgctcaaacaaacaggcagcttacctatacatgagttaatattctttgaattaagagaacgtgcccgttttcatctagaaatcgagaatgaacaaaatcgacttaaatttcagattcttgaattactccatcaaacattccctggtttagaaagattatttagtagtcgatattcaatcattgcactcaacatcgcagaaatttttactcatccagacgtggttcttgatatcgacaaggatgtacttattacacatatattcaattctacagataagggaatgtcaatggataaagctacaaaatatgcacttcaattaagagtgattgctcaagaaagctatcctaatgtcgatagacattcctttctagtcgaaaaattacgcttacttattcaacaattaaaacaatctattcatcatctcaaacaattagatgatgccatgattcaattagcacaacaactcgattattttgaaaatattcattcgatacctggtattggtaagctaagcacagctatgattattggggagattggtgatattaagcgatttaaatcaaataaacaactcaacgcttttgtaggcattgatatcaaacgatatcaatcaggtcatacacactgtagagataccatcaacaagcgtggtaataaaaaagcgagaaaacttttattttgggtgattatgaatataataagagggcagcatcattatgacaatcatgtcgtcgattattactacaaactaagaaagcagcctaatgagaaacctcataagactgccatcattgcttgtataaatcgattattaaaaacaattcattatcttgtaatgaatcataaattgtacgattatcaaatgtcaccacattag

SEQ ID NO: 55 - DNA, 546 bp, Staphylococcus epidermidis
tttagtacttttaacttttttttactatccgcttgtacaattaatattgagcgtgatgaggaaaatagtgagaaaaataaacagaaagaaaacactcatactgattcaaacaatacaagttcgaatgaatcaaatacttctaaacaatcatctcaagaaaatactataaatcaaacagaacaaaatcaaccgactgagaataattcaagttcacaacaagatttgcaactaataacagaaaatgaagctattcaaaaagtaaaagatgagtttccacctatacgaacaggaaatgactatcgtatagatactactagaactgataataatgtgtacgctatcaaatttacttctcaagatgcagaaggttatcctatgaaagctgctgtcactattgataagcgaacaggagaatttattgattatattgatgatagaagcgatgaagataaagagcgtcatgtccaacatgctaaagaaagtactctttataaaggtccatacgatgctttcagaaaagattttagtcataaaataaatgaatga

SEQ ID NO: 56 - DNA, 564 bp, Staphylococcus epidermidis
actgccgagttacctaaaaagacgacaagaataggtaaaccgtattataaaacggacaatttattacaaagacaatttaaagcgagttgtccaatggaagtattaacaaccgatattacttatttaccatttggtcattctatgttgtatttatcttcgataatggatatttataacggagaaattgtggcgtataaaatagatgataaacaagaccaaagtttagttaatgatacattaaatcaaatcgatatacctgagggttgtatattacatagtgatcaaggcagcgtttatacatcttatgcttattatcaattgtacgaagaaaaaggcattatcagaagtatgtcccgaaagggaacacccgccgataacgccccgatagaaagtttccattcctcgctaaagtctgaaactttttacatcaataatgagcttaatcgctctaatcatattgtaatagatattgtcgaaaagtacattaaaaactataataataatcgaattcaacaaaaactaggctacttatcccctgtgaaatacagagaattaatagcctag

SEQ ID NO: 57 - DNA, 444 bp, Staphylococcus epidermidis
ttggtttatacgttacacttattgtattttaaaaaagaggtgtcaatgatgacaaagaaaataatttattttatatgtacaggtaattcatgccgtagccaaatggctgaaggctggggtaaaaaaatcttaggagatgaatggcaagtatattctggaggtattgaggcacacggtgtaaatccaaaagcaatcgaagctatgaaagaagttggaattgatatatcaaatcatacttctaatttaattgacaaaaatatactaaaccaatccgatttagtagtaactttatgtagtgatgctgacaataattgtcctatattgccgccgaatgtaaaaaaagaacactggggatttgatgatccagcaggcaaaccttggtcagagttccaacgtgttagagatgaaatcaaaaccgccattgaatcatttaaaactagataa

SEQ ID NO: 58 - DNA, 1278 bp, Staphylococcus epidermidis
gttatggagtttaatggaattttagaagattatgctacttatatttacagaggaaagcaacccaagtattcgactaatggaataccagttatcaatcaaaaagcaattcaatggagtggattaaataaagaatttttaaaatttcataataatgaaataaaagttgattcaagacactttgttaaaaaaaatgacttactaattaattcgactggtactggcaccgttggacgagtttatcatttcaaatttcaacccgaaaagatgtttgttgactctcatataactattataagaactgatgaaaataaattaagaagtcgttttttatattatcaaatgagaacaaataaatttcaaaatatgatcttaaatgagtttttagctgggtctactggacaagtagaatttaataaatcgatggtaaaaaaattaccaatctctattccagaagttaactatcaagatgtagttatcaaagttttagatgaactagaagataaaatagaaataaataaaaaaatcatagcaaacctagaggaactatcacaaacattgtttaaacgttggtttgtagattttgaatttccaaatgaagagggtaatccctataaatctagtggtggagaaatgattgatagtgagttaggtaagataccaagtaattggaaaatctataaattaaaagatatagcaagtcataaaaaggaaacttttaatcctaaaaagagtgaagaagtaacagttaaacattttagtttacctgcttatgataatgaagaacaagctatagaggaagaagtcaataaaataaaaagtaataaatggattattaataacaattgcgtattattttcaaaaatgaatcctgatactaaaaggatttggttacctgtaatagataataaaaaattaaatgttgcttcatcagaatttgttgtaatggaatctcctaataataaaattaattcattcatatataatatatgtcttaattctcaatttatagattatttaaaagctaatactaccggttcaacaaatagtagacaaagagtaaaaccaacaatagctgttaattataaattagcaattgaagatagtattgtaaaaaaatattctgaaataatcactccatatatggaagaaatgaaaatattaagatcagaaattggtaaattaactcaattacgagatactcttcttcctaaactaatgtctggagaactagaaatatctgatgatattgaggtgaatagtgatgaactttcaatttaa

SEQ ID NO: 59 - DNA, 384 bp, Staphylococcus epidermidis
tcaagcaatacaagaactcaaacaaaaatagaaataactatatataagagaggtgattattcaatggaatttattaagtccagctctaatggaacagaggaagaacaattagaattttatgaacagatatttaatgcgctcgctgataaaattagacttaaaatcttgcattctatacgtcaaagcaatacaaagtctttgtgtgtatgtgatttggaagaattgctagaattaaaacagtctaaactttcttatcatttaaaaaaattagtagatgcaaatatcctcattgcagaaaaacatggcacatggaattattataaaattaatgaacaacaaatacaggtagtattaaatgaagatacttgttgtaagatactgtaa

SEQ ID NO: 60 - DNA, 1695 bp, Staphylococcus epidermidis
ctattatgtacaagatgtagcatcgttagatgcgtttggaggcgtattatcatgaatcatatattacaaatgttatctaagctattaagtgtggctaaggaggcaatcgaccgtcaaggtctgattgctatcctaactattcctgttaataatgacgatgaaatagaagaaacggctcaaggtgaaaccgtgtataacgaacttatcgatcagttacgacttaatatcccaaaagatacggattatcgacctaacatctatagttattttggtattaagaagaatcctaatgacaccgtactcatggaaatgatgataaaggtttttcatatcaaacgctttaattcagaactgtttgttttcaaagctaacgggtggcaaaagataaatggagatgaattacaagggttgatatctaaaatgatacaagtattgcttgtagattataagccttcactaagcactctaaaaaatgtcgtagatggattgcaaaaatcaacagatgtagaagaacttgttgaaaatgagcactatattggttgtggtgaaaatatgttcgatcttaatacgtttcaagtcgttaaaaattcaatcgatatctttcctaaaacacgattgaatttatcattaagtacaaatgatgtaattactgataagataccgccttattttaagcaatatatgttacaacttgcgaattatgacgatgatttacaatactttcttttccaacatacagcagtattacttacagctgatactaaataccgtagaggtctcattttgtatggtggagctaagaatggtaaatctgtatatattgaactagttaaatcatttttctatagtaaagatattgtgtctaagccacttaatgagcttgaaggtcgttttgacaaagaaagtttaattgacaaaagtctaatggcaagtcatgaaattgggcaatctaagattcaagaaaagattgtaaatgacttcaaaaagttattatctgtagaatcaatgcatgttgatcgtaaaggaaaaactcaagtggaagtcattttggatttgaaacttatttttagtacaaatgcgatacttaattttcctcctgaacatgcgaaagctttggagcgtcgaattaatattattccatgtgagtattatgttgaaaaagcggacacttcattaattgataagctccagagtgagaagaaagaaatctttctttacttgatgtatgtgtatcaacagattgtaaaagcagatatcgagtaccttgaaaatagccgtgtcactgaaattactcacgattggttaaattttggatatgaatttgtttctagcaggtccgtaagtattgcaaatcagaaagcatgtattaatttactcagaaaacttatagaaatcaaatcaggatcacgaatcaaagtatccgagttaaataaagttattaatgaagaaataaaggtgagttctcaggttattaatcagttaattcaagcaaactttgatactcaaaccaaactatacaatggctacgattattggattgatttaggttggaaagaagccaataaaaaagagattcatgatatttcggaaaaagataatattatttcattagataaaaatgaaaatataacagacgatgaggcattagatgaagagaatttggactttgattgggaggactgtgacgatgaataa

SEQ ID NO: 61 - DNA, 225 bp, Staphylococcus epidermidis
aaaggtgtcaccggaaatggtaaaagttacatcgcttttactttagtaaatcatgcgattgataatcggtatagtgtattattctatagattgacagatttattaagtaagctacaacaagctgattataatagcatagataaactattaaaagtgattagcagaacggatattttagtaaatgatgattttttattgccgtatacaactgaacaagaacaatag

SEQ ID NO: 62 - DNA, 435 bp, Staphylococcus epidermidis
actaaattaacgaggtgccttatgtataaagattataacatgactcaacttactctaccaatggaaacttcagttcttatccccacaaatgatatttcacgacatgtaaatgatattgtagaaacaattcccgagactgaattcgatgaattcagacatcatcgaggtgcaacatcataccatccaaaaatgatgttaaaagtagttttatatgcctacacccaatctgtgttttcaggacgtaagatagaaaaattactcaatgatagtatccgaatgatgtggctatcacaaaatcaaaagccttcttataaaacgattaatcgatttagagtaaatcccaaagtagacgctttattagaatcattatttattcaatttcatagtcagtgtttgaaacaaaatcttattgatgatcaggccattttccattga

SEQ ID NO: 63 - DNA, 273 bp, Staphylococcus epidermidis
gcaccttcaacgaaggtcgcaatggctaaagtcattaaagcttttaaacttaaacctgactgtcattgtacatcgaaatatctgaataacctcattgagcaagatcaccgtcatattaaagtaagaaagacaagatatcaaagtatcaatacggcaaagaatactttaaaaggtattgaatgtatttacggtctatataaaaagaaccgcaagtctcttcagatctgcggattttcgccatgccatgaaattagcatcatgctaacaagttaa

SEQ ID NO: 64 - DNA, 192 bp, Staphylococcus epidermidis
actattgcaactttccagcccaataaaacccatagcataaacaccattaatggattcattaatggtgaagcaattaagaaactcaccgctggaccaaaaggtactttagaatttaatagacctgcaagtattggaattgttgaacaagaacaaaagggagtaatcgcaccaaatatcatcccaaaaaaataa

SEQ ID NO: 65 - DNA, 330 bp, Staphylococcus epidermidis
atggctagaacgtataatgtgattaaatatgtcattaagaaaaataaggatgatcttaaaatacatggattaagattatatgaatttaatataaaagatgaaaaagctataaatattagccaacccatttttgtgaacagagcaactttgattgagaaaatacaaaatgatgaagcatttacgcacgcctttagagtaaatcacaatacttattatgcaggccaattaatttctttatcattgaataaaaatggttatattaataacaactttgaggcctcacgagatattattagaaacgttgaagtaagtattttagactatgaataa

SEQ ID NO: 66 - DNA, 489 bp, Staphylococcus epidermidis
atggaatttgcatattatgaagcgaaatctttaaatgattttgaaaatgaactaaaaacacttgctttaaataaaaaatatacatttagtaaagaaaccgaagtccttaaagaagaagaaattcttgaaaaatcgaatagccatgagcgcgaactattaaaagtatttaaagataatgcgcagataacaacgtatcattttaagagtcataaaagtaattatttaattattattggagagacaaaaacacctaatatcattggtctaacagtgatatttgataaaaaaccttttaaacaaatagggaaagttgcgttaggatggctaattgctttgacttcaggtggaagtatattagccattggagcagtatttggaatacttacctcagttgcaagacgtacacttgtaatcaaaggaccattaggaaaagaaatttcacaaattatagaaaatgaattaggagaaccgatagaaattaaaaaataa

SEQ ID NO: 67 - DNA, 198 bp, Staphylococcus epidermidis
ctcccatatgcaaatacaacagcaactcccaatattgcaactaataaaataacacctaagcttgcaaaaattttcttcacattgctaaccccattctatatttattttaattttatattaatctattttgctacgcttttctatatttattctaaaataattgaaaaagaacacattttgaaatcaatgtgtctttga

SEQ ID NO: 68 - DNA, 510 bp, Staphylococcus epidermidis
aataaaaaagcactaactacaattgcgataattataatttttggcatattagcacctgttgtttttttgttacaacaaatatcaagaagtagaattagaaaaaataaattacaggctaagcaaaaagaaaataatggaagtaactctcaaattattagtgaaacatctaataatatgaatccagagaatgaaagttcaagtaataatcaagaaaaaacacaaactacaacccacgaagctacaatgaatcaacaaaaggtaactagagataacatatttgattatgctattgctgctataaataaagtaggaaatgcagatttattaaaatttcaacaacctgaacacaatggttcagaatggacaattaatgcaaataataaatcaggtactggggctaacaccatcgtagttaaagatgatgaaacagttcaaatatggatggacctaaaacatctatggatcatgaaactaaacaatcagattggcgaacggttgctagttgtttag

SEQ ID NO: 69 - DNA, 216 bp, Staphylococcus epidermidis
gaagctcttttcatagaaaaaaaacacctccgtatgattcattttaatatgaattcaacgaaagtgtttttatataattcccactattggggtcagtctaaaattaaaattgataacttttttaataaaatagatacactaattttaaaacaaggtaaaaaaatagaattattaaaacaacgcaaacaaggcttactacaaaaaatgtttgtgtaa

SEQ ID NO: 70 - DNA, 693 bp, Staphylococcus epidermidis
caaaaaggagccttctgtatgaactatttcagatataaacaatttaacaaggatgttatcactgtagccgttggctactatctaagatatgcattgagttatcgtgatatatctgaaatattaagggaacgtggtgtaaacgttcatcattcaacggtctaccgttgggttcaagaatatgcaccaattttatatcgaatttggaagaaaaagcataaaaaagcttattacaaatggcgtattgatgagacgtacatcaaaataaaaggaaaatggagctatttatatcgtgccattgatgcagagggacatacattagatatttggttgcgtaagcaacgagataatcattcagcatatgcgtttatcaaacgtctcattaaacaatttggtaaacctcaaaaggtaattacagatcaggcaccttcaacgaaggtagcaatggctaaagtaattaaagcttttaaacttaaacctggctgtcattgtacatcgaaatatctgaataacctcattgagcaagatcaccgtcatattaaagtaagaaagacaaggtatcaaagtatcaatacagcaaagaatactttaaaaggtattgaatgtatttacgctctatataaaaagaaccgcaggtctcttcagatctacggattttcgccatgccacgaaattagcatcatgctagcaagttaa

SEQ ID NO: 71 - DNA, 693 bp, Staphylococcus epidermidis
caaaaaggagccttctgtatgaactatttcagatataaacaatttaacaaggatgttatcactgtagccgttggctactatctaagatatgcattgagttatcgtgatatatctgaaatattaagggaacgtggtgtaaacgttcatcattcaacggtctaccgttgggttcaagaatatgcaccaattttatatcgaatttggaagaaaaagcataaaaaagcttattacaaatggcgtattgatgagacgtacatcaaaataaaaggaaaatggagctatttatatcgtgccattgatgcagagggacatacattagatatttggttgcgtaagcaacgagataatcattcagcatatgcgtttatcaaacgtctcattaaacaatttggtaaacctcaaaaggtaattacagatcaggcaccttcaacgaaggtagcaatggctaaagtaattaaagcttttaaacttaaacctgactgtcattgtacatcgaaatatctgaataacctcattgagcaagatcaccgtcatattaaagtaagaaagacaaggtatcaaagtatcaatacagcaaagaatactttaaaaggtattgaatgtatttacgctctatataaaaagaaccgcaggtctcttcagatctacggattttcgccatgccacgaaattagcatcatgctagcaagttaa

SEQ ID NO: 72 - DNA, 306 bp, Staphylococcus epidermidis
acgttacaggcaataaaagaagatatgcacctcatcctttttgacggtaccattacccttgaaggtgaacatgctgtccgtattgatgaacacaaaattcggggggatcgtatggtcgtaccatttgatacgtttaaacaaataggaaaacctagaaaccaaaacgacatccattttaaaaacgatccttttcaaagagttacgaatgatttatggatcacgaatccctcattgtcagaagtggatcaagaacaaatatggcagactggagactatttttcaaaacaccttcagaacattgaataa

SEQ ID NO: 73 - DNA, 342 bp, Staphylococcus epidermidis
gagataacttacattatgattagtaaacaaataaaggatttacgaaagcaacataattatactcaagaagagctagctgaaaaattaaatacttcaagacaaacaatttctaaatgggaacaaggtatttcagaaccagacttaattatgcttatgcaattgtcacaattattttctgttagtacagactatctcattacaggaagtgacaatattattaaaaaagataataaaagctattatgaaatgaatttttgggcatttatgtctgaaaaatggtgggtaattattattatagtaatcataatttgtggaacaataggacaaattttttcaaactaa

SEQ ID NO: 74 - DNA, 474 bp, Staphylococcus epidermidis
aaagctaattacaaatggcgtattgatgagacgtacatcaaaataaaaggaaaatggagctatttatatcgtgccattgatgcagagggatatacattagatatttggttgcgtaagcaacgagataatcattcagcatatgcgtttatcaaacgtctcattaaacaatttggtaaacctcaaaaggtaattacagatcaggcaccttcaacgaaggtagcaatggctaaagtaattaaagcttttaaacttaaacctgactgttattgtacatcgaaatatctgaataacctcattgagcaagatcactgtcatattaaaataagaaagacaaggtatcaaaatatcaatacagcaaagaatactttaaaaggtattgaatgtatttacgctctatataaaaagaaccgcaggtctcttcagatctacggattttcgccatgccacgaaattagcatcatgctagcaagttaa

SEQ ID NO: 75 - DNA, 1203 bp, Staphylococcus epidermidis
aaggataattatatgaaaaaacatgcatataaacaacttttattaggtatgatagcaatgttaatcgttatgtctatcagtaggtttgcttatacacctatattaccatttatgcaacaagatacatctatggacaatcaagaagcggggtttttagctacatggaattatttagggtatttagttggcgctgttattccaatattttatatttataaaactaaagtaatagatttgaaaatttaccttgctttaaatattatttctactatcttaatgggatttacagaacaatatttaatttggtcaatttttcgattgatttccgggataacaagcgggacggtatttgtattaacttcaaacatagtactagattcattaaagaaaatacaaagagaggggatatcaggtgtattatatagtgctgttggattaggtatttttttaagtagtatttatctttatttttttgccagtgtggattcatggaaaatggtttggtttgttttaggaatagtttcactggttttgggcttaattgtattggtttttatgaaagaaaatacaaatacaataataaattttaaagaagaaaaaatgaaaattaataatagactaaacaaaaagtttgttatctttttttctattgcttacttctttgaaggggcaggttatattattactggtacttttctagttgctatagttaaatcaattccttctgttgctgaatatgcgactttaagctggatgtttgttggattaggtgcaattccttctacattaatttggtcacttatagctgaaaaaatcagttataaaaaagccatttatggtgcatttattttacaaattataagcgtttgtctacctgtttttactcatgaaatttttagtttagttattagttcagttctatttggagggacttttttaggtttaactacattatttatttctaaagggcaaagtttaatgtacaaaacagatgaccccttaaatttagtctcattactgactgtaatatacagtttaggacaaatgttagctcctatgtttgcgggaatcttaattggtaaatcgaataattataacattgctttaatatttgcaactgttttattaatactgggtcttatttctacaatatttagctataaacaaaacgaaagtattggtgaaaaatatgaacttaaatga

SEQ ID NO: 76 - DNA, 252 bp, Staphylococcus epidermidis
gttcaagaatatgccccgattttatatcaaatttggaagaaaaagcataaaaaagcttattacaaatggcgtattgatgagacgtacatcaaaataaaaggaaaatggaactatttatatcgtgccattgatgcagagggacatacattagatatttggttgcgtaagcaacgagataatcattcagcatatgtatttatcaaacgtctcattaaacaatttggtaaacctcaaaaggtaattacagattag

SEQ ID NO: 77 - DNA, 348 bp, Staphylococcus epidermidis
gagaaaagatatagaattggatattttaaaaaagtacaaggcattggagaggaagtggtaccaacagtagtcgtagatttagtggatcaattaaaagtaaaatattcaatcaaattgatactagaagtattaaacatacctaaatcaacatattaccgatggaaaaacaaaacccataaaaatgataccgtaacacaaaaagttattgaattatgtaaagctaaccactatacctacggttatcgtaagattacagcattgattaatcaatgttatacatcaccaattaatcataagagagtacagagaatgatgcagaagcatcatttgaactgccgagttacctaa

SEQ ID NO: 78 - DNA, 906 bp, Staphylococcus epidermidis
gagaaaagatatagaattggatattttaaaaaagtacaaggtattggaaaggaagtggtaccaacagtagtcatagatttagtggatcaattaaaagtaaaatattcaatcaaattgctactaaaagtattaaacatacctaaatcaacatattaccgatggaaaaacaaaacccataaaaatgataccgtaacacaaaaagttattgaattatgtaaagctaaccactatacctacggttatcgtaagattacagcattgattaatcaatgttatacatcaccaattaatcataagagagtacagagaatgatgcagaagcatcatttgaactgccgagttagacctaaaaagatgacaaaaataggtaaaccgtattataaaacggacaatttattacaaagacaatttaaagcgagttgtccaatggaagtattaacaaccgatattacttatttaccatttggtcattctatgttgtatttatcttcgataatggatatttataacggagaaattgtggcgtataaaatagatgataaacaagaccaaagtttagttaatgatacattaaatcaaatcgatatacctgagggttgtatattacatagtgatcaaggcagcgtttatacatcttatgcttattatcaattgtgcgaagaaaaaggcattatcagaagtatgtcccgaaagggaacacctgccgataacgccccgatagaaagtttccattcctcgctaaagtctgaaactttttacatcaataatgagcttaatcactctaatcacattgtaatagatattgtcgaaaagtacattaaaaacaataataataataataataatcgaattcaacaaaaactaggctacttatcccctgtaaaatacagagaattaatagcctag

SEQ ID NO: 79 - DNA, 1692 bp, Staphylococcus epidermidis
aaggagcggtatgatatgaagggtaaaattgcactttattcacgtgttagtacgtctgagcagtcagaacatggttattctgtaaaggagcaggaacaagtactcatcaaagaagttgtgaaaaatttcccgggttatgactatgagacatatactgactcaggcatttcaggtaaaaatattgaagatcgaccagcaatgaaacgtctattacaagatgttaaggataataaaatcgaaatggtgttaagttggaaattgaatcgtatctcacgatcaatgagagacgtgtttaatattattcatgaattcaaagaacatgacgtagggtataaatcgatttctgagaatattgatacatccaatgcttctggagaagtactcgttacaatgtttgggttaataggatctatagaacgccagactttgatttcgaatgtgaaactttctatgaatgctaaggcaaggagcggagaggcaatcaccggtcgtgttttaggctacaaattatcacttaatccattgacacagaaaaatgatttagttattgatgaaaatgaagctcatattgtacgtgaaattttcgatttatatttgaatcataataaaggcctcaaagccattacaaccgtacttaatcaaaaggggtatcgtactattaatcaaaagccattttcagtgtatggtgttaaatacattttgaataatccagtctataaaggctatgtcagattcaataaccatcaaaattgggctgttcagcgaagaagtggtaaaagtgataaaaatgatgtgatattggtcaaaggtaagcatgaagccattataagtgaagatgtatttgatcaagttcatgagaaactagcttctaaaagttttaaaccgggtagacctattggtggagatttctacttacgtggccttattaaatgcccagaatgcggaaataatatggtatgtcgacggacgtattataaaacgaaaaagtccaaagaacggacaatcaagcggtattacatttgttccttattcaatcgttcagggagttctgcatgtcacagtaattccatcaatgctgaagtcgtcgagcgtgtaattaatgttcatttgaatcgtattctgtctcaaccagatattatcaagcagattgcgtcaaatgtgatcgaagaactgaaacaaaagcatagtaaccaaacagaaattaaatatgacattgatagtttagaaaaacaaaaagctaagcttaaaagacaacaagaacgattgttagaattgttcttagatgatcaaatggatagcggaatgttaaaagctaaacaaagtgaaatgaatcaacagttggaagtattagaccaacaaattaaagaagcaaaacaagcaaatcaatcacaggatgaaatacctaattttgataaattaaaaggacgactcattttgatgataacacgattcagcgtgtacttaagaaaggctacacccgaagctaaaaatcaactcatgaaaatgttaattgattcaattgaaattacgacagataaacaagtaaaacttgtaaggtataaaattgacgaaagtcttatccctcaatctttgaaaaaagattgggggtctttttttatgcccaaatttcaatttgaaatatatggtcaaaatgattatttcatcgaccaaattaccacttttaccacttag

SEQ ID NO: 80 - DNA, 870 bp, Staphylococcus epidermidis
tgtaagtatctctcaaatattttgggaggttttattatgaaaatcaaaaaattattaaagacattattaattattttattatgttttgtattgtctgttattgtgcaaaatatttcaatgctatggcatattgtgagcatttggagtgttgaatatattttacatgcattaacttatatagtactttcatacttttcagtaaaatggttcattgaaattgtgcttaaaagcaatatgaaagattatagaataataccggtgaaatttttcaagtcttgttttcttataggattaattttgatattagtaattgatttaatatatctattatttattcctggtaaattgataatacctcattattcaacaagcgttggatttatggagatgttctttagcgcatttttaattactggtattgctgcgcctatatttgaagagatggtatttcgaggaatactaatgagatactttgaaaaacaatatggaattttatttggaattataataccctcgattttattttctcttgttcatctatttaatggagagttaaagggagaaaatttattattactacttataggtggctcaattgctggaataatgtatgcagtgactgcatggacgtttaatagtatatgggcctctgctatattacatatgctttggaatataaatggtttattaaatatcacaactcaagatgatcattggggagtatatcagtacatattagaaacaaaaaatgtactgattacaggtggggattatggtatggatacatcattactttcaatatgtagttatattgcagttattatagttatgattgttactaaaagacactttaactttttactaaagtaa

SEQ ID NO: 81 - DNA, 354 bp, Staphylococcus epidermidis
gttttaattcaaatattaaagaacgtgttaagtatattgcactttatgattcaatgcctaaacctaatcgaaacaagcgtattgttgcgtatattgtatgtagtatatcgagcttcacatgaaacagctaaagaagctttgggcgataaagagttaagagccattgcacatgagttaactaaaacagttaaggataacatgagtgttgattggtctaaacgagacagtgctaaagctaaaatgagagttcaagttagacgcctattaaagaaatatggctatccaccagatcttcaaaaaatggctgtggaacaagttgtggagcaagcagaattaatggcaagtccccaataa

SEQ ID NO: 82 - DNA, 255 bp, Staphylococcus epidermidis
atagagtatcaactttatgtccatcacaacatcacttactttttacactccattcagattgtacatatcaatgcttgtatcttaaaaatggtagctttctttatggttttaataacaacaactattaagatatatcaagaaaagtttcttcttaagttttttaagtcccttccctttaatcgaataaaagataatcgttttatttcctcatatagtttgcttgcctgctcttcttcaagttcgaaagctttataa

SEQ ID NO: 83 - DNA, 1470 bp, Staphylococcus epidermidis
ttaatacgtctgtcttttattaaaaatataattgaaggagagagtatggaaatggaattcaatgagaacaatatcgacttagagacgattatcagagatgaagttaataaatatttatctagagatattggagacttacctgcgacacaacaggcaccgctcgagttgagagagaaatatgaaaagatggaagtgccgaataaagggcgagatatctatgaagtactcaaagatttaaataatgaagtgctgaattatttatatcgtccgaaccatccacgttcattctcatttataccaggtccagcatcacgtctatcatggcttggagacattttaacaacagcaaataatatccatgcctctaattttgccaatgcgacgctgccaattaatattgagcgtaatttaattaactacttggtaggaaaaatcggttatgagatcaaaccggccggtggtgtctttgtatctggcggttcaatggccaatttaacagctatcgttgcggctagagatgcacaggtagaaatggaagatattaaaaaagcaaccgtttatcttacatctcaaacgcatcattctgtaggcaaagccttgcatgttgcaggcttccttaaaaataatatccgcagaattgagtacaacgatgactttacaatgaatacagatagcttaaaagccgcaattgataaagatattgaagaaggttacaaacctgctatggtgattgcgactgcaggcacgactaatacaggttctgtcgatgatttcaccacacttggagatatttgtgatcactacaatctatggctccatgtagacggtgcttatggactatcacatatcttatccgataaagcacaacacttatttaaaggcattgaacgttcagatagtgccagttgggatgctcacaaattactgttccaaacatatagttgcgctatggtaatcgtgaaagaaaagaatcatctgctgcaaagctttggcgaagatgctgagtacttggatgatattgcttcagatgatgatgtgattgatccagaaatgttaggcattgaacttacacgccctgcacgtgctttaaaattatggattactctgcaagtcattggtgaagatgaaattatcgagcgcattaaatacggcgaaggtttagcagaatatgcagaagaatacgtgtcaagtctcgataactggcgtattatctcacacgctaatctttccattgtgaacttcagatatgaaaacagtgatttaactgaagcacaaaataatcaactcaatagcatggctgcgcaaaaaattgcagattctggttatgccattgcttataccacagtattgaataaccaacgtgtcattcgtttatgtacaacgaatccattaacgacacatgatgatatcagagaaacaataaatcgccttgatcagtatattggtgattacgatatgaaagatgcttaa

SEQ ID NO: 84 - DNA, 231 bp, Staphylococcus epidermidis
gaattaagacatatattatatatgaatgaattaattttattattaggagattccattacaacaaattctgatgaagcaacatttaattttttattatctattacaggtaaccaaatccttttagtatcaggattcatttttgaaaataatacgcaattgttattaataatccatttattactttttattttattgacttcttcctctatagcttgttcttcattatcataa

SEQ ID NO: 85 - DNA, 714 bp, Staphylococcus epidermidis
gtaatttttaaggggtttatagttatgtatgaagaaaatatttatattaaaaattcagaatatgaatttgataataatcttaaacaattagcatcatacttaaatattcctgttagtattgttagaccttataaagaggatttaacactttatcaatataaaaaaggacaagtcatatatcattcaactgatcaaataaaatttgtatactttttagtaaatggttgtattttacatgaatcttctaatattactggtgacaattatttaagattaagtaaagacgaaaatatatttccaatgaacttcatatttaatgaaacccctgcaccatatgaaatatgtacagctttgacagattgtaaaatattaactttaccgaaagatttacttgagtatttatgtagaaagcataatgaaatatttgaaagtctcttcaagaaacttaatgagactattcaatttcaagtagaatatattatggcgttaagagctaattcagctaaagaaagaattgaaagaatactacaaattttatgcctttcaattggggatgataatggagaattctatgaattaaaacaaattatgactgttcaattaataagtaatttatctggacttaacagaaaaactactggtgaaataatcagagaattaaaaatagaaaatattatatatcaagataaaagaaattggattataaaaaaataa

SEQ ID NO: 86 - DNA, 258 bp, Staphylococcus epidermidis
cttcattttaaagggattaatgctatcaatctgtcctcaaattgtagcattcttgaactatattgttgcaatttgattgtaattatttacattttagtttacaaagctatagttcagcattatcgtaagttaactacattttattggagatactatatacttaaccaatttcaaaataagttatatacaacttattttttagttttatttgtgatacgcttctgcgtatcggttaagagtgcggttttttataattaa

SEQ ID NO: 87 - DNA, 495 bp, Staphylococcus epidermidis
ggagattttaatatggtgaaaaaagataaagacactaatgaccaaaaaagtgagagccatatgaagcataatgatgaaagtaaagttcctgaagatatgacatcgactaatgagggtgaatttaaagtaggagataaagtaacgattacagcagggcatatgccaggtatgaaaggtgcagaagctactgtaaaaggtgcgtataaaacatatgcctatgttgtaagttataaacccacaaatggaaatgaaaaagtaaacaatcataaatgggtcgtaaacgaagaaatcaaagatgcacctaaagatggatttagtaagggcgatactgttaaattagaagcaaatcatatgtctggtatgaaaggtgctacagccattatagataacgtgaaaaagactactgtttacgtagttgattacaaatccaaagataatggtaaaatcattaaaaatcataaatggatgacaggaaatgagctgaaagcacgataa

SEQ ID NO: 88 - DNA, 324 bp, Staphylococcus epidermidis
atgatgactaatgtacaaaggatgatccaaatgaataaaaagagtctccactttttattgttaaaacgcaaggttttaggtattgcattcaatttacctgaaggagaagaatttacatttcatgacttgaacagtcgtgcaaatgtaacgtgttctaaagaagtacaacaaaatgttggacgttggttcgcatattttgtaaaacatgcgccacgtgttccatttattattatcggtaaggatactcacggtcatttagtttatcttaaaacaggtcctaatccacaccataacagcaacccttcgaaaggaggtgttcgctaa

SEQ ID NO: 89 - DNA, 216 bp, Staphylococcus epidermidis
gtatattgtttaccaacttgttgtgaaaatctatatgctagttttggtaaaactgaggaaggacgctggatagctaagaatgcccataattatggatttattataagatatcctaaaaacaaagaaagcatcacaggatatcaatatgaaccttggcatttacgttatttaggaaaaagaaggcgacaaaagtgtacaaatctggtgaaacattag

SEQ ID NO: 90 - DNA, 855 bp, Staphylococcus epidermidis
atgaatcataattttatcaagctgattggagaggttaaaatgcattatataaaatttattgagtcaaaagataatacaaaactttatatgaaagtgaatgatattcaagatgcaaaagcgaatatcattatagctcatggtgtggcagaacatttagatcgttatgatgagataacagcatatttaaatgaagcgggttttagtgttattagatatgatcaaagagggcatggtcgttctgaaggcaagcgtgccttttatagcaatagtaatgaaattgtcgaagatttagatgcgataataaattatgtgaagtcaaactttgaaggtaaagtttacttaatcggtcatagtatgggtggttatacagtcactttatatggaacgaaacatccaaatacagtgaatggtattataacttctggagcattaacacgttataataataaactatttggcaatcctgatagaaacatatcacctgatacttatatagaaaacaatttaagtgagggggtatgttctgatttagaggtaatggaaaaatataaacttgatgatttgaatgcgaaacaaatctctatggggctcgtcttttcaataatggatggtgttaggtatttgaaagacaatgctcaacaatttacagataatattttgatattgcatggcaaggaagatgggctagtaagctatgtagattctttacagctttatcaagaaataggatcagcacataaatcattacacatctatgatcgtttggagcatgaaatatttaatgaaagttcttataatagaactatttttaacgaagttattgaatggcttgaaacggaattaacttataactaa

SEQ ID NO: 91 - DNA, 183 bp, Staphylococcus epidermidis
gctgaaaataatacgaaaatttataaaaaaaaagacaatttctatattatatcaatagaaattgtcttttttcatttatttagaaatgttatatctacagaattttttagtaaaatcactggtagggagaaggtagacgtatcacaccagcaaaacctgctaaagatgctaagttacacttag

SEQ ID NO: 92 - DNA, 375 bp, Staphylococcus epidermidis
acaatgaataatgatagaggaaaaagtcttcaaattccccaaagtacatcgttaaaagaaggatctatatacgttgctacattacattctgtgactgagacagattactcaggcgacataaaacatcaatttacgtatgaaatagagatagatcaacaaatattctatgtgaaccgtagtgttgtggtcaatgtgacacatcaacaattatcaattaatgactggctcgaacgtcatagtaactatagcgcaagtcatgaaaactatgagccttatattgatcagaaacatttaattctattaggtcaatataacggtaactattatgtacaagatgtagcatcgttagatgcgtttggaggcgtattatcatga

SEQ ID NO: 93 - DNA, 375 bp, Staphylococcus epidermidis
ccaaagaataaaatttttttagaaagagtggtgagaatgatggatgagaatcgctcgaaaggtaaccgctggggtgtttgggcctttttcggaatattattggttcctttattggttcctttactttgttgcgcaggaccgattctccttgttgcattagggagcacaggtattggtgccctctttgctggtgcgacaggaaattggtggttgaccggcatttttgcagcattggccattgttatgattgctctgatcctcagcaagttgttgaagaacaaatacaattctcctgaaggcaatggaaaaacaaaaaataaaacggattgctgtacgcctccagagagcgtggatcggaaacatgagacaagataa

SEQ ID NO: 94 - DNA, 1269 bp, Staphylococcus epidermidis
tgtgaatgtaataaagcaaaggaggaatttgaaatggtacaaggacccattcaagtaaatagtgaaataggcaaattgaaaactgtgttgttaaaaagaccaggaaaagaattagaaaatttagtacctgatcatttaagtggtttattattcgatgatattccctacttaaaagttgcacaagaagagcatgacaaatttgctcaaactttgagagatgaaggaatcgaagtagtttatttagaaaaacttgcagcagaatctattactgagccagaagtacgcgagaacttcataaacgacatattaacagaatctaaaaagacaatattaggtcatgaaactgaaattaaagaattcttttcaaagttatctgaccaagaacttgtaaataaaatcatggctggcgtacgtaaagaagaaattcaacttgaaacaacccatttagtagaatatatggatgatagatatccattttacttagatccaatgcccaacctttattttacaagagatccccaagcttcaattggtagaggaatgacaattaacagaatgtattggagagcacgacgtagagaatctatttttatgacatatatactgaaacatcatccaagatttaaagataaagatgtaccagtatggttagatcgtaactcaccatttaatattgaaggtggagatgaattagtattatcgaaagatgttttagctattggtatatcagaacgtacatcagctcaagcaatagaaaagttagcacgtaatattttcaaagatgcaaacacaagttttaaaaaaatcgtagctattgaaatacctaatacacgtacatttatgcacctagatacagtactaactatgattgactacgataagtttacagtacatgcagcaatatttaaagaagaaaataatatgaatatatttaccatagaacaaaatgatggtaaggacgatataaaaattactcgttctagcaagttacgtgaaacacttgctgaagttttagaagtagaaaaagtggactttattccaacaggtaatggcgacgttattgatggtgcacgtgaacaatggaatgatggctcaaacacattatgtattcgaccaggggttgtggtgacatacgatcgcaactatgtatcaaaccaacttttacgcgacaaaggaattaaagtgattgaaattactggtagtgaacttgtacgtggacgcggaggcccaagatgtatgagtcagccgttatttagagaagatatttaa

SEQ ID NO: 95 - DNA, 210 bp, Staphylococcus epidermidis
atagtagccaacggctacagtgataacatccttgttaaattgtttatatctgaaatagttcatacaaaagactcctttttattaaaattatactataaattcaactttgcaacagaaccacttaaagacatgtttgtcatacatatttgtaaaaatcaaaaaatcatggttatatacatcattatttttgataataattatcttaaataa

SEQ ID NO: 96 - DNA, 339 bp, Staphylococcus epidermidis
aagaaaagcaaaatggaggaaaatagtatgaaaatcaatcgatacatcacaagaggcattagtgaacaactatctctagaccttcaaatcttactttggaacatggtaaaagatcgagacaatcaacttaatacagattacctacacattttcaaactacaagaagatgataatatgttgtcaattacacatgaacaagaacaacccgcatacaaattggaatatcactatacaaactatataaaaaatcaaaatgcattacctaagaaagtctacgtcatccgagaagatgatgtagacgctttttattatgtgatgcttttgccagaagaatactaa

SEQ ID NO: 97 - DNA, 225 bp, Staphylococcus epidermidis
tattttataaaggagttcgattttatgaaaataaatcatgcaggtacattatctgttgattattttgttagctacttaaatctaattatgatatcaagagaagtttctttaaaagaagctgtatcatatatgaaaaatgagttctttaaaggaaaaactgacttgtatggtaaagtaacagaaactcattttaatcaagcaatacaagaactcaaacaaaaatag

SEQ ID NO: 98 - DNA, 258 bp, Staphylococcus epidermidis
ttaataataaaaaagcgtctcaatgatattgagacgcttaaagtttatctagttttaaatgattcaatggcggttttgatttcatctctaacacgttggaactctgaccaaggtttgcctgctggatcatcaaatccccagtgttctttttttacattcggcggcaatataggacaattattgtcagcatcactacataaagttactactaaatcggattggtttagtatatttttgtcaattaaattagaagtatga

SEQ ID NO: 99 - DNA, 384 bp, Staphylococcus epidermidis
agaaaagtaaagaaggtgaaaaaagtggaaaatacaaatagtaatatgcataaaaatgacaatagttacgttttatcagcattgagttatttaagtatctttttcgcacctgtcattttacctttatttgtatggatacttgctgatgagccaacatcaggacatggtaaaaaagcattagggaatcatattatgacatggattagtttttgtgtaggcagaggaatttttattttttcaaaaggagtctttgataaaccgtttgatcatcaattattaatatttgttattgctttaatcattgctattgtattctttttaattgctttaatattatatattctcaacattatcagaggaattaaaattttattaaaaaaataa

SEQ ID NO: 100 - DNA, 384 bp, Staphylococcus epidermidis
agaaaagtaaagaaggtgaaaaaagtggaaaatacaaatagtaatatgcataaaaatgacaatagttacgttttatcagcattgagttatttaagtatctttttcgcacctgtcattttacctttatttgtatggatacttgctgatgaaccaacatcagaacatggcaaaaaagcattcattaatcatattatgacttgggttagtttttttataggtagattggcatttattttttctaaagaagtctttgataaacctttggatcatcaattattaatatttagcattcttttaattattactattatattctttttaattgctttaatattatatatcttgaacattaacagaggaattaaaattctattaaaaaaataa

SEQ ID NO: 101 - DNA, 255 bp, Staphylococcus epidermidis
aacagttcaaatatggatggacctaaaacatctatggatcatgaaactaaacaatcagattggcgaacggttgctagttgtttagcatcgcaaaattatatatcgctcgtaaaaggattagtacattatttcacagcgattgaagatgaagaaatacttgataaaatctatgatgattttatgaatgatgactctataacaacggtacttaacaatgatttacagacaatcattaaccattatctatcaaaataa

SEQ ID NO: 102 - DNA, 1125 bp, Staphylococcus epidermidis
aaggagcaaaacactatgtatcaaacaaatacacgtgatttaattacaaaattgcctcaaagcaataaaacagaacactttttaatgaacaaattttcaaatcaagataaagttcagcagctacaaagacaaattagccaacagctagatcaacaatataatgagcttttgtctaatgaaaaagctaagctagaccaatatgtggaagtacaccataatttagaaccattaaagaaagagattgaatcagaatctattaaccttgataccgataaattacctgatatcaaagcgacaatgcttgaaaaggctaagaacgatgaacattctgataaaatcgaacacctatttgatagattagatcagtcattaaatggtacgaatcgattatatacgcaattatcgttgattggcacacgaacacatcggataacaacgaaaagatttaatgttcaaggcttacctaaattagtccaacaaacgattttaccttcgcaatttaaaaaggtttatacaatagattttaaatcattcgaaccatcagttgctgcgtatatgacacaagacgaacaactgattgactacttgaatcttgaagaagggttatacgatgcattactgagagacttatctttgtcaaaagagaagcgcgtgagtgtgaaacgtgcatttatagggtcatttctttttggcggtcgttatagtagctctaaattcaaaatcaatcaagaggttagtgaaattaactggctacaagtaatgagcaaattcaagaagatcattgaatttaaagagcaagtcgaaaaatataaaacaatgcctacgccttacggcattgaacatgatatgagcgcatttcaaggtagtagtattatggcaatttacgtacaaacggtagcgagctatattttcaagcacattttgttggaagtgtacaaagcacagtgcgaacaaaaaacgttcaagattatagtgccgatacacgatgcgattatgattgaatgtaatgataaggagattgcacaaagtgtagcacagctcatgaaagatacagctaatcgactgtttaatggtgaatttgcacatgtgacagtggaagctttaggaggtatagacaatgaataa

SEQ ID NO: 103 - DNA, 2013 bp, Staphylococcus epidermidis
gtgaataaaaatattacagctctaaaatctactgaaaatactacatatatgcagtatacggttcatatcgatgatcaaattataaataatataaaagagtgtaccaaaaagtttaaaattttgcctatggaagataaaattccattatcaccgttgttacaaccagaatatgcaggagaggtacaagattttattagtacatatgagcagtttatgattaattttggtaaagtaatattggatagtcaaggcataaaaatacaatttgaaagtgaatcattaagtagtattcaacgaggcattcaagaacattgttacttaaataagcgaacaaatgacattgatgtgactaaagaatggtatttatgcaaattttcaaatcgaacattagaagaggataaaaatcaattgtataatgctttaaagcaactcatgaatgattctaaaaataaaaagcaagcttttcaagaggtgtttaaggttcatattgatatttatctctacaataaagaaaaatctgaatataagtatcaagcatctagttatttctatcttgtaaaagaaaatcctaaaataatttataaaaaaagacatttacaagagaaacaagggatcaagggtacaactttcacgaacaaattaaaattattgaacaaaatgtatggtgtagatgttgcaaaatatcagccattttataattctaataatcctgaatatgaaagaggtcaatttggtgaaagatacatttctcaaagatctaactatgaatttaatagacttcaatatcaaattatatatatattatcgaaaatacttgataagcatccattaccaaagtcagataataattataaacatattccaactattgaaaaagcaatattaagagatgattcccataatttttatgagtattttgaagatataatgaaagaaattatgaatatggataattctcccttacaggaaaaattattgactgattttacatatcaatcccaatgtagatggtactctgaaaataaaaaattaaaattgcaacttgaaagatttatgcataaagttttagagagtaattattatgagggcaacaaattattgagaatgatgtctaacgcaattgaagaaacaatcaatgaggctaaagaagataaggttcatttcaattattttaaagattattttttgacagacggtggggtgaagaattgggagcaaattagcgagaaaattactgaattcaatggtaaagttattaacgatatccaacatgaatataataagatacagtccaagaatacaaatcaaaatcagaaactaaactttgtttatttatatcattgctttgagtttagtaataacatagtaaaagcaaaagataatgaaagtaaaaattatatcttgttttttatagataaatataaaataaagacaccatttttggatcaattattaataaattgtttgaatcaagaaatagatcaggaaagtattaactacaatatgcaaacaatgtttgaaaaagaaagatatgatagaagtagtatcattgaaaaattagtagcaacaagaaaatttaagtatgaaaaagatgattcagatttattcaaacaacttttcaatgatgttgaaaattcaatagacagattaggtatttacttactaaataatggtataaattcgaatgatgaaaatgcaagatactatagatcgtttttaaaggaacttagtagaataaaaagtaaattaacgccattttctcttgaaataagtaagtctagcggaagagagcaacattatcctgatgatgctgttgatgataaagatgagagaagaaaaaataaagaagaaacatatcatgcttttgatgataaaagcgatattgactacaaattaaagaataaaataagtgattatatcgataatttattgtcagttaaaattaggaataatttgtatgatattagtccaaatacaaaaagcaataattataatgagccaactcaaaaatga

SEQ ID NO: 104 - DNA, 432 bp, Staphylococcus epidermidis
atgttcaaaaatatattattaccctatgatttcgaaaatgattttagtgctatccctgactatttagaaaaagtcaccgatgaagattcagttgttgtaatttatcacgttgtaacagaaaatgatcttgcaattagtgtcaagtattataataagcataaagaagatattattagagaaaaagagaaaaaactcactccatttttacgtgaattagaaaaaagagatattcaatataaaatagatgtagattttgggcatattaaagatacaatcttagaaaaaattacttctggagatataaataatggtgaatttgatttagtaattatgagtaatcatagagtcgatttgaatattaaacatgttttaggagatgttacacataagattgctaaaagaagttctgtcccagtactaattgttaaataa

SEQ ID NO: 105 - DNA, 1287 bp, Staphylococcus epidermidis
tcaagaaaaaagcttactcatttcaaaaataagtgtcttaaatcacttaagagaggattttatgtaatgcttagtaaaaaacaaattaaaaaaactttaaacagcgataaaatgccgtcattaattgttaatgaattagatagagaattgcggaataaatggaaacaacaatatccaagtaaagaagaattaattaaagaattgaagtatgacgcagttaatgagaattctgcagtattaaaaaatgaattgacgagtaaactaaaattcaaacttaaggattatcaagattcaaatgaatttttattttacttaaaaaatagtcaaaagatgattgaaatacatgattataaaatggagcaattttttgaagatatacctcttgaagatagtgatgtttataaatctattgcgaataatgaagatacagaaacatatataataatgaaagctccagaatttaatgaagaagataaactaaatatatcaattaaagttgatgggaaatttaaagaattagattttcacagaatagcatatgatagtaaaaaagaaatgaaatatttatatcagaaccgatatataaagatattcatgttaatagaaaaaaatttagaatatattagttggggatttcatcatctttttaatgaaagtataggggaagtaaatacaattaatataattgatacttataaaatgttaatagcgctagctagtggcgaaatgtatacagcaaataagataaaatttaataacgattcagcaagtaaaaataaagaaatcttagaatctttaaacagagatttaaaattatttgaaattattcatgaatttcaaaattcgttggataaagaatttaagatatccaccccgtttaattctaaagaaattatagaaggagtaaaaacctactttttattatataaacaaaaactaatattggaagaaaagcgtttagaaagtttactaatcaaaacatcttccttcgatttagaagatataaaaggaaaaaaattcaccttaattcaagaggaaaaagtaacaaaaactatttttactcaaaaaatctcttacacacaatatcaatgttattatcaagtaaaatcctcagactatgaaaaattacaagatgatgaatttaaactaaaatttaatcctgaagatgtaattactattattttaaaagcttcattcaacacaaccgaacctatcggattagaaaatattgcttttgaagaagcggaaactttagatacctttattagtaactataaatcaaattaa

SEQ ID NO: 106 - DNA, 441 bp, Staphylococcus epidermidis
ggaggaaaaaacatgaaatttcaagtaagtccatattttttaatcactcaaaatgcagagggtttaaaaaagttgtatgaagagctgtttggcgctaaaacactgtatattcaacgtattaaagatagacctatagataagcaacttaatattgacgaaaatgatttaaataaaattgatcaatgtgtacttcaatttggagatataaaaattatgatcgcagatgacactgaaggtttgcccataacacaaggtaataatatatctctttgtctcacttttgaccaagtagaagaaactaaacatgtatatgaccagttaatagaaaaaggcagtgaggtattgaaaacatttagtccagaattctatactgaaggttatggttatgtaagagatccttatggtatctctttgcatttatttacaaagagaaaaaattag

SEQ ID NO: 107 - DNA, 522 bp, Staphylococcus epidermidis
aggagtgaaaatttcatgaaaacaatcaaaagtacattagaaaccgaagccattttcagtgatgaccaacaacatcgctatctacttaagaaaacatggaatagtgaaaaacaaaagatcacaatcatcacaatgtatccaaattatacaggccttcttcgtatagatttaactacccaattgataatgaacaaagtttcagaaatggatacatttggttccatcaattttgtgaatctatactctaatattacaacccctatcaatctcaaacatttagaaaacgcctatgataatcatacagatattcaaattatgaaagccgtgaaagagtcagatgaagtgatactagcttggggtgcttacgctaaaaagcccgttgttgaatcacgcgtcaatgaagtattagagatgttgaaaccacataagaaaaaagtgaaacgactcatgaaccccgcaaccaatgaaatcatgcatccccttaatccgaaagcgagacagaaatggactttgaaagcataa

SEQ ID NO: 108 - DNA, 681 bp, Staphylococcus epidermidis
agtggagaaaatataaggaggaataagcttatgaaaaatatttcagaattctcagcccaacttaatcaaacttttgatcaaggggaagccgtctctatggagtggttattccgtccgttgctaaaaatgctggcggagggcgatccagtccccgttgaggacatcgcggcggagaccgggaagcccgtcgaggaagttaagcaagtcctacagactctacctagtgtggaacttgatgagcagggccgtgtcgtcggttatggcctcacactggtccctaccccccatcgcttcgaggttgatgggaagcaactatatgcatggtgcgcccttgacacacttatgttcccagcactcatcggccggacggtccacatcgcttcgccttgtcacggcaccggtaagtccgtacggttgacggtggaaccggaccgcgttgtaagcgtcgagccttcaacagccgttgtctcgattgttacaccagatgaaatggcctcggttcggtcggccttctgtaacaacgttcactttttcagttcaccgagtgcagcccaagactggcttaaccaacaccctgagtcgagcgttttgcccgttgaagatgcctttgaactgggtcgccatttgggagcgcgttatgaggagtcaggacctactaatgggtcctgttgtaacatttaa

SEQ ID NO: 109 - DNA, 969 bp, Staphylococcus epidermidis
aaccaggaaaagaaaaaaactataaaatttgaggttaatcaagattctgctacgttatggtatcacccccacccctctccaaatacagctagacaagtttataatggcttatcaggattattatatatagaagatagtaaaaagaataattatcctagtaattatggaaaaaatgatttgcctataataatccaagataaaacatttgtatctaaaaaattaaattattcaaaaacgaaagacgaagatggcactcaaggtgatactgttcttgtgaacggaatagtaaaccccaaactgacagcaaaagaagagaaaatacgtttgagacttttaaatggttctaatgctcgagatttaaatcttaagctaagtaataatcaaagttttgagtatattgcttcagatggcggtcaattaaaaaacgctaaaaaattaaaagaaattaatttagctccttcagaaagaaaagaaatagtaatagatttatctaaaatgaaaggcgagaaaatcagtctggttgataatgataaaactgtaattttaccgattagtaacaaagagaaaagttctaacaaaggtaatacaccaaaagtaagtaaaaaaataaaattagaaggtatgaatgatcatgttaccattaatggtaataaattcgatcctaacagaatagattttacacaaaagttaaaccagaaagaagtatgggaaattgaaaatgtcaaagataaaatgggtggtatgaaacatcctttccacatccatggaacgcaatttaaagttttatctgtggatggtgagaaacctccaaaagatatgaggggtaaaaaggatgttatatctttggaacctggacaaaaagctaaaatagaggttgtatttaaaaatactggaacatacatgtttcactgtcatatacttgagcatgaagataatggaatgatgggtcaaataaaagtaacaaactaa

SEQ ID NO: 110 - DNA, 978 bp, Staphylococcus epidermidis
gctgatagaaagatgagtataagcgaatataaaaatagatacttagagtcactatataacacctttaaaactgagttagaaaacgaacgcactcgctattttatattagataccaactatacaaatagtgatgatactgaaaaggagtttacttgggatgtaaaacagaataataagatcagagaaggcgatttgttcatttttagacggccaactaatttatctcaaattgctcaacaattttatttctttggagctgggaaaatagaaaaaattgagcgaaaaaataatgtagcaaccgcttacatttcaaaacccttactttttgtggatcgtgttttaaaagataatattgaaaatttaaaatgggagttcaaagaaagaattaaagaagagtgggagcagtttttctttaaaaataaaatcagtaatattacaaaaaatgattttttaaaactactaagtttgagtagaaatgtagtggaaatagaaagtaattatattaataatgatatttcgctaacttttaaacaaatggctgatatggcaactcgaataaagaaaaatatttactacgtagggaatcatgaagcatttgttcaagctaagggaagtgctcattttgagttttcaaaaaggattaaacaaaattatagttatagatgtgcaattaccgggattaaaactaaagactttttagtcgttacacatattattccttggcatgaaaatgagtttattagactagatccttcaaatggtatttgtttgtctttatttttagcaaaagcatttaagaaaggctttatcactttttctaacagttatagagttgttttatctaaagaagcagagaaagatgctgctttatatgaagaattaaagatttatgaaaatcaaaaaatcgaactaccagattgtcagaaacctaatttgaaatatttagattggcatagagaacatatttttaaaaattaa

SEQ ID NO: 111 - DNA, 510 bp, Staphylococcus epidermidis
cgatatatgaatacaatcaaaagtacgatacacacagaagcgatatttagcgatgatgaacaacatcgctacttactcaaaaagatatgggatgacaagaaaccggcttgtactgtgataacgatgtatcttcatttagatggtgtattatcactcgatcttactacggttctcatcctcaatcaattagctaattctgagcaatatggcgctgtttatctcgttaatcttttctctaatattaaaacaccagagaaccttaaacatatcaaagagccttatgatgagcacacagatatacacttaatgaaagcaattagtgaaagtgacacagtcattcttgcttatggtgcctatgcgaagcgaccagttgttatcgaccgtgtcgaacaagtgatggaaatgttaaaacctcataaaaagaaagtaaaaaagctcataaatccagtaacgaacgaagttatgcatccactcaaccctaaagcacgtcaaaaatggacactaaagtaa

SEQ ID NO: 112 - DNA, 3126 bp, Staphylococcus epidermidis
atagtgatgaactttcaatttaatgaagatgatttagaacaagtcgcattagaatggttacaatcactaggctatgactataaaaaaggtaatgagattagtatgacaggtctaacgccagaacgtaaaagtgataaagacgttgtccttcatgaacgattagaaaaggcgttaagaaaaattaattcagatattcatcctcgttttattgaaaaagcgatacatgaactaactttagagaagtcgcccaatcttttagaaaataaccttacttttcatgaaaatttgatcaatggtattgaaatcgaagactatgatgacgaaggacaatcggtagtagaaattgttaaaatcgttgattttgaatatccacaaaacaatgattttttagcagtcaatcaattcacggtcgttaatggagactatacaaaacgtcccgatattgtactctttatcaatggcttgcctatcgttgtgattgaacttaaaaattcaaccattgaaaccgtaggcgtcgaagacggctatcgtcaattagaaacatataaaatgcgtattccacaattatttacatttaatgaagttcttgttacaagtgatggtattaatacaaaggcgggctccctaaccgcaaattatgatcgttttatgacttggcgttctaaagatggagaaacggaatcatcatcaagtttagctagtttagatgtgctgattcatgggatgctaaatccagaaaccttacttgatttaattcgatattttgtcttattccaagatgatggtaaaggacatatcagtaaaattctagcagcgtatcatcaatactatgctgttaataaagctgttgatagagctttattagcttcatctgggcagggtgatggtaaaggcggcgttatttggcatactcaagggtctggtaaaagtttaaccatggtctttttctctggaaaattaattcaaatgcttaataatcctaccttagttgtcgtaacagatcgtaatgatttagataaccaactatacagtacgtttgttaaatcgaaaggacggtctggtaaaggtttattaagacaaacaccaaaacaagctgaaacacgtaaagaattaaaatcgttattatctgttgagtcgggcggtattgtatttacaacgatgcaaaaatttgaacctgaacaaaacgaaacgaccatgtctgctctaacagaacgtaaaaatgtgattgttatggcagatgaagcgcatcgtacacaatatggttttaatgcaaaatacgatgataaaggggaaggcattaaatatggttatgcgaagtatttaagagatgctttaccgaatgcgacgtttgtaggatttacgggcacgcccgtagcttcaacggataaaaatacgcaaatggtctttgggaactatatcgatgtttatgatatgacacaagccgtagctgatggaagtacggtgaaaatttactatgaaagtcgcataattccattaaatttacctcaaaatttagacttagacgaagcatataatgacattacagaggatcaagaagaggatgtaaaacagcgtttaaaatcaaaatggtcacgaattgaagccttagcaggcgcaaaacctcgtgtagaagctttagccaaagacatcatccaacattttgaaacacgtcagcaagcgatgaaaggtaaaggaatgatcgtaacgatgagtcgtcgaattgctgttgatttatacgatgaaatcattcgtctaaaaccagaatggcattcagatgatgatgataaaggggtcattaaagtggtgatgactggctcatctatgcacccaatttctttccaaagacatattggtcctaaaaaacgtcgtaatttattagaaaaacgtatgaaagatatgaatgatgaattacaactcgtgattgttcgagatatgtggctcacaggatttgatgtaccttccatgcataccatgtatatcgataaaccgatgaaaggtcataatttaatgcaagcgattgctcgtgtcaatcgagtgtttaaagataaaccgggtggattgattgtcgattatgtgggtatcgctgaaagtttaaaagaggcacttaaagaatatacagaatctgatcaagcacaaacggcgatagatacagataaagcggttgaattgatgttattgaaatatgatgtgattcaagatatgttatataatcttgactattctaagtttaattcagagaaaaagtctgaacgttattatgcgatttcagatacgatggattatgtgattggtttaggcgaagatgaacgccagcgttttattaaaacggtcacagagttagggaaagcttttgcgctttgtgcgactgaacctacagcccaagaactcaatgatgaaattgccttctttaaagcagttaaagcaggacttgttaaattgttacaaccgccaaaagaaggaaaaacacgtaaaacacctgcagaagttgaagcagagattaatcaacttgtgtcacaatctgttgtgacagaagatgtgattgatgtttaccaaacactaggtcttgaacaacccgatttatcaatcctatcagatgacttcctaaaagatgtcgaaggattgaaacaaaaaaatgttgcggtagaattattaaatcgattactcaaagggcaagtaaaatcattaatgaaaacgaacgcgacagtatctaagcgtttctctgaaatgttaggaaattcgattaataaatataatagccgttctattgaaacatcaaaagtgattgaagaactcattcaactcgctaaagatattaaacaagaacaacaacgaggaaatgaattaggcctgaattcagatgagattgcgttttacgatgctttagcttcacatgaaacagcaaaagaagccatgggagataaagaactacgtgcgattgctcatgagctaactaaaacagtgaaagaaaacatgggtgttgattggtctaaacgcgatagcgcaaaagctaaaatgcgcgtagctgttagacgattgcttaaaaaatatggctatccaccagatttacaaaaaatggctgtagagcaggttgtagagcaagcagaacttatggcgagtaatcagtaa

SEQ ID NO: 113 - DNA, 339 bp, Staphylococcus epidermidis
aagagtcagaacgaaaggaagtctcttatgaatagatatattactcaaggtattgccaataacttacctatcatcttacaacaacaattatggaaaatagtagcacaacgtgaaaacgaacagtccaaggaactagaagcaatagattactttcatatcttccagttcaacatgcataatgatcaattatatatcaaacacaaacaagaacgtcctgagtacatcaaaacacataaagctaattattcaaaagctatcaatataaataaggtctatattatccgagaagatgatgtagacctttcttattacgtcatgttactaccggaagaatactag

SEQ ID NO: 114 - DNA, 249 bp, Staphylococcus epidermidis
cttattaagaagatggatgaagataaaggtaccggaaaaatattatcttcattgtatataaaagacgatgaattaaaaaaacaatattctacatgtagagaatttctagatgattatttatatacagcatggattattcctgttttgctgaatgaacatgcaacaagtcaattagaggaatatttaggtagatatttaattaaccaaaacgtaccaatccttaatttactttcacatactttcaaataa

SEQ ID NO: 115 - DNA, 183 bp, Staphylococcus epidermidis
atagttgagaagctaaaaactttacttaacctttctcatttcattttcctatacacggtttcaagaacccaacatactacaaacgaatttcaaaaggtgagagtaaagctgacttgttttttttacggatttaaaatcctagagtctggacagtctactcctctctataactataaaaaatag

SEQ ID NO: 116 - DNA, 186 bp, Staphylococcus epidermidis
atccaccgtttagttaagatgatggattttttcaaactgtggatgaggtacagagtttcattagataaaaacagggaaaacttattaaagagtgatttctgtgaggaggataatgatgacaaagaaatacgatcttattgtgattggtacaggttctgcggggtcaatcacagcagcaaaatgtaa

SEQ ID NO: 117 - DNA, 363 bp, Staphylococcus epidermidis
ggaggcaatgatatgaaaacaactactcaagaactcaaacaatatatgactcgcttattccaattatctaacaatgaaacatgggaatgtgaaacactggaggaagcggcagaaaatattctacccaaacgttttattaatgattccccacttgcacatcttatacttgaaacttatacctactataataatgagctacatgaactaagtatctatccatttctaatgtattctaataaccaactcatcagtattggttatctggatcattttgatatggactttctatacctcacagatactaaaaatacgattatcgatgaacgtcatttactaaaagaaggagggaataaccatgaataa

SEQ ID NO: 118 - DNA, 777 bp, Staphylococcus epidermidis
ataatgaatgatttgttaaaaatttatgaaaaattgaaaaaagatattgaaaacaggtggttaataccatttcattatgtggtttttggattagcattagttgtatattttctggaaattcctatttataaattggtgaataacttagataaagagcttgttgataaggttttatatgctttttcattagtgtatgatcacattgtattgatatttatattaattataattatcattttgatagtttatttattctttgatgtgtttaatatgaatcgttttgttccatcgcctacaacttatgtagatggtagtgaaagttctataaactatgtaagtgctattaaaagattgataaactttatgatattaattatcacaaagtactggataacttactttattgtaaacttaatatttcataatgataaattactgtatttaaacaatgattcaaaacatttgtataagtgtctcttgtttttaaatatctgtatctttatagtgcatatattaaaatcaatttttataataaaaattatggcagatgattcgctaagacttattaatgaaaatgatttaactgatttttacataacattaaataaaaatgatgaatatcgtatggtaaaacctaaatatagaaaaatagataattttattattattaaaaaaagtgaagatttcactaattcaaatgagtataaagttattaataaaagtaaaaattttgaggaaataatttatcattttgacaatcttacttcaaatcattga

SEQ ID NO: 119 - DNA, 186 bp, Staphylococcus epidermidis
tatctcatggaggtattcgaaataagaagccgtgaaaaatcattaatactttgttctcaaatgacttccgtagaatggcataagaaattaagtggaaaagtcatcgcttatgcgattttaattcgtgctgtatcaaagtcatttaaaatatttttagaagtagagtcgttgagaaaaattaaataa

SEQ ID NO: 120 - DNA, 450 bp, Staphylococcus epidermidis
acgatgaaggaaatcaatattgtttcactacaaatgataaaaacagatacattaagttatctaaaaaatcatatttcaaaccctgaggatgcggcagaaatcttgcgttcattcattggaaacagtgaccgagaacatctcattctcatatgtatgaacagtaaaaatgaacctacacatattcaaacactatcgattggatctattaaccaaacagtgattcaccctagagaaatattcaaaacagcgatactcagtaacgcaaatagtataatgctcggtcataatcatccaagtggggatataaccccctctcctgaagatatcaatgtaaccaaacggttaatgctcatcagtgaaatgatgggcattttattttatgatcatattattttttcagatagtaacacctattccattagacaacatgatttagaagtagaggtatag

SEQ ID NO: 121 - DNA, 387 bp, Staphylococcus epidermidis
actacatcactattacactatctaggaggcaataatatgaaaaccatcactcaagaactcaaacaatatataacccacctattccaactatctaataacgaagcttgggaatgtgaagcgctggaggaagcagcagaaaatattctaccggaacgttttattaatgattctccactggtacatctcacactcgagacttatacctactataatgatgaactacatgagctaagtatctatccatttctaatgtatgccaataaccaactcatcagtgtcggatacttagaccattttgacatggactttctgtaccttacagatactcaaaatatcattattgatgaacgtcatttactaaaacaaggaggtcaggaccatgaataa

SEQ ID NO: 122 - DNA, 213 bp, Staphylococcus epidermidis
aaaagagcacttgaaacagataatttgtattatttagcctatgtaacaactttagataattgttttaaatattaccaattaattacacaaaatgaacatttttgctattctcaacaagaagaaagagaaagttatcagcaaaaatttcaaagtatgattaatggtttaaaaattaaaattggcatacaaagttcaaatgatgatgcgcaataa

SEQ ID NO: 123 - DNA, 435 bp, Staphylococcus epidermidis
aggggagaacttatgcactggaaagaaaatagaataaaatcagccaaaaatgacacgaatccgatggtaatcaaagaattaaaaggtagttatgtggtttttggagatgttcagtttcttccaggttattgtgtattacttcctaaaagagaggtaagattattgaatgatcttactttagaagaacgacaagattacttattagatatgagctttgttggtgatgctatgatgaaagcattgaaacctacaagagtaaattatgaaatactaggtaataaaaatcactttcttcatgcacatttattccaaagatatgaatgggaagatgaatctgttaggtatatgccagtgtggtgtatgatgcttctaattggtctaatgaagaaacgtcttacgattctgataaacatgatgaaattagaaataagataa

SEQ ID NO: 124 - DNA, 732 bp, Staphylococcus epidermidis
acaggattatggcggggattggccccatgttttaaagataggagtggaattatgagtttttcgtttctcttcattctgaccgctggaatggttgcggcctttaatccttgtggtatcgccttgcttccttcttatatctcctatttaattggaggcgaaacaaaggatcattcgttccgctatgcaatttttaaaggattagggcttggtggagcgatgaccacggggtttttaacgatttttgtattggctggtttgttgataggaggattgggaagcgcactaacagggatttttccgattctttcattggttatgggtatactcattgctttattggggttgggcatgctatttgggaagcatttgccgattaaaataggatcttttcaagtcaagccagggaaatggtctatctatttttacggaatagcctatgccgtgacatcacttggttgtaccttgccagcctttatgttggtggtctctgcatcgctgaatgacaatagcgtaacggccgtgatcatcaagttcatcatctactcccttggtatgggaattgtggtgacagcgatcacgatggtctcattgatttcacgacaattggtacagaagtttctgcacaactatatgggttctatccaaaaaatagcagctgttgtgattttcctctccggtttgtacatggcttattactggtatttcggttctggtggcatttgtacattttaa

SEQ ID NO: 125 - DNA, 2124 bp, Staphylococcus epidermidis
gggggtatatgttatattataagtagctttactataacattttcattaggaggggttaatttgaataataatagtgaagagcataatcatcaaaatcacatgaatcattccaatcacatgcatcatgataaccatgaatcacataatcatcatagtggccatgcacatcatcatggaaattttaaagttaagttttttgtttcattaatttttggaatacctatcattcttttatcgccactgatgggtgttaacttaccttttcaattcacatttccaggttctgaatgggtagtgttaatattaagtacaattttattcttttatggtggtaaaccgttcttgtctggtggtaaagatgaaattgctgaaaaaaaaccaggcatgatgaccttagttgccctaggtatttcagtagcttatatttatagcttgtatgctttttatatgaataactttagtaatgcaactggtcatacaatggactttttttgggaattagcaaccttaattttaattatgctattaggacattggatagaaatgaatgctgtcggaaatgctggagatgctttaaagaaaatggcagaactgttacctaatagtgctattaaagttatggataatggccaacgcgaagaagttaaaatatcagacatcatgactgatgatatcgtcgaagtaaaagccggagaaagcattccaacagatggtattatcgttcaaggacaaacatctatagatgaatccctagtcactggagaatctaaaaaagtacaaaaaaatcaaaatgacaacgtcatcgggggttctattaatgggtctggaacaatacaagtcaaggttacagctgttggagaagatggatatctttctcaagttatgggacttgttaatcaagcacaaaatgataaatctagtgctgaattgttatctgataaagtagcgggttatttattctactttgctgtaattgttggcgtgatttcttttattgtctggatgctcattcaaaatgatgttgattttgcactcgaacgtcttgtaactgtgttagtcattgcttgtccacatgctttaggattggcaatacctttagtcactgcacgttctacttcaattggtgcacataatggtttaattattaaaaatagagagtctgtagaaatagctcaacatatcgattatgtaatgatggataaaactggtactttaactgagggtaacttttctgtgaatcattatgagagctttaaaaatgatttgagtaatgataccatattaagccttttcgcctcattagaaagtcaatctaatcacccattagctataagtattgttgattttgcgaaaagtaaaaatatttcatttactaatccacaagacgtgaataatattccgggtgtcggattagaaggtctagttgataataaaacatataaaataacaaatgtctcttatcttgataaacataaacttaattatgacgatgacttgtttactaaattagctcaacaaggtaattcaatcagttatttaatcgaggatcaacaagtcattggcatgattgctcaaggagatcaaattaaagaaagctcaaaacaaatggtagctgatttactatcaagaaatattacaccagtcatgcttacaggtgacaataatgaagtggcacacgctgtcgcaaaagaattaggtattagtgatgtccacgcacaactcatgccagaagataaggaaagcattataaaagattatcaaagtgacggtaataaagtcatgatggtcggagacggtatcaacgatgcgccgagtcttataagagccgatattggtatagcaattggtgcaggcacagatgttgcagtggattcaggtgatatcatacttgttaaaagtaatccatcagatattattcatttcttgaccctttcaaataatactatgagaaaaatggtgcaaaacttatggtggggtgcaggttataatattgttgctgtacctttagcagctggcgcattagcttttatcgggttaatattatcaccagctgtaggagcaatattaatgtctttaagtacagttatagtagcgattaatgcttttacattaaaattaaaataa

SEQ ID NO: 126 - DNA, 198 bp, Staphylococcus epidermidis
cctaaaacacgaccggtgattgcctctccgctccttgccttagcattcatagaaagtttcacattcgaaatcaaagtctggcgttctatagatcctattaacccaaacattgtaacgagtacttctccagaagcattggatgtatcaatattctcagaaatcgatttataccctacgtcatgttctttgaattcatga

SEQ ID NO: 127 - DNA, 354 bp, Staphylococcus epidermidis
atgaaaaaacgcatttccttcaccgctataatgacggtgttgttaatcggtttaacagcttgtggagcagaatctgataccgcgaatgaatcaaaggttcaagacattcaaggaaatccagtcagcctacctaatgagaaacccacactcatttattttatggcaacctggtgtccatcttgtatatacaatgaggaaatctttaaggaaattcatcaactaaacccgaacgatgttcaattgatcacagttagtttagaccctaacacagatacaaaagaaagctttgcgaaatttaaacaggattatggcggggattggccccatgttttaaagataggagtggaattatga

SEQ ID NO: 128 - DNA, 690 bp, Staphylococcus epidermidis
gagagggttagtatggctagttatttattttttcatcctaaaccagcgtgtgatacttatggggatatgaatatttatcacgacaaatttggaaataatgaggacccatacgtatggagtgaacggtttttgcatagcttttgtaaaataacggattatgcatatagtaaatctactcaaaaggacattattttttggatatcaataaataaagaaggcaataatttaaaatatttatgtgatttagtatttaaaatagaaaagtgggatttttggtataaaacttttagtgaacaaaaagatgccatagctacaaataaagaattaacgataaatgacgcagtagtagaaggcgatgaagaagcatatgaatatcattattcttggatcaacagaggggaacacaagtgggaaccaacttatcgaaggcgaagactcacattaaaagcagatcccgtcttgagttttcagcctcaaaatcgacaaggtaatttactagatgtcacggaattactaaaaacaattgtgaattttaatgttgaaaaatcacctgcaaaaagtgggacttcttataaagctttcgaacttgaagaagagcaggcaagcaaactatatgaggaaataaaacgattatcttttattcgattaaagggaagggacttaaaaaacttaagaagaaacttttcttga

SEQ ID NO: 129 - DNA, 543 bp, Staphylococcus epidermidis
aatggggttagcaatgtgaagaaaatttttgcaagcttaggtgttattttattagttgcaatattgggagttgctgttgtatttgcatatgggagttacaaagatttagaactaaaaaaagaagaagctaaactaaaggataagaagaataagaaaatcgataaaaacaaaactacagaaaatgaaaatcaagaccagattaataatcaaacaattacagcaccaaatgaaaaagcacaatatggcaataacctaggagttcaagaaaaaagtacggataaaaatgatcctaatggtgtgcttagatttgatacaaacggagatggacttatctccactagtgaagtaacaccagaagctcaaaaattagttgatgaaggtaaactacagccatcttcagatagaatggttgaagagtggactaagaataaaaataatgtagataatacatatgactatgatgaatcatataaaaaacaacaagaaatgtacaaaaaagctgctcgtggcgaagttcctgaacctggagaaacaataaaataa

SEQ ID NO: 130 - DNA, 228 bp, Staphylococcus epidermidis
ctcaacgagctgaaaataatcaaaaaatttataaaaaaagacaatgtctatattatctcaatagaaattgtttttttttcacttattccaagaactttatgtcccggactcattatgatttatttttttattggggacttgccattaattctgcttgctccacaacttgttccacagccattttttgaagatctggtggatagccatatttctttaataggcgtctaa

SEQ ID NO: 131 - DNA, 339 bp, Staphylococcus epidermidis
aagaaaagcagaagggagggaaatagcatgaaaatcaatcgatacatcacaagaggaattaatgaaagtattccactagaccttcaaatcttactttggcacatggtagaaaaaaaagataaccagcctcatacagattacctacacatttttaaattacaagaagatgagaatatactctcaatcacacatgaacaagaacaacccacatacaaattggaatatcactatacaaactatgaaaaaaatcaaaatgcattacctaagaaagtctacgtcattcgtgaagatgacgtggacgctttttattatgtgatgcttttaccagaagaatactaa

SEQ ID NO: 132 - DNA, 273 bp, Staphylococcus epidermidis
tcttatataaggagtatattgatgaaaaagataaaaattgttccacttattttaatagttgtagttgtcgggtttggtatatatttttatgcttcaaaagataaagaaattaataatactattgatgcaattgaagataaaaatttcaaacaagtttataaagatagcagttatatttctaaaagcgataatggtgaagtagaaatgactgaacgtccgataaaaatatataatagtttaggcgttaaagatataaacattcaggatcgtaaa

SEQ ID NO: 133 - DNA, 834 bp, Staphylococcus epidermidis
atcatacggaggtgttttttttctatgaaaagagcttcttattcagtagaaacaaagtataaagcagttgaaatgaaagcagcaggatttccaacaaaagaaattatgaaagaattaaatattagaaatagaacacaagtgaaaaattggtggcgatggtatcgaaatggggaaagttatagattttcacaacatgttggtaaacaatatacctacggttatcgtaagattacagcattgattaatcaatgttatacatcaccaattaatcataagagagtacagagagtgatgcagaagcatcatttgaactgccgagttagacctaaaaagacgacaagaataggtaaaccgtattataaaacggacaatttattacaaagacaatttaaagcgagttgtcccatggaagtattaacaaccgatattacttatttaccatttggtcattctatgttgtatttatcttcgataatggacatttataacggagaaattgtggcgtataaaatagatgataaacaagaccaacgtttagttaatgatacattaaatcaaatcgatatacctgaggggtgtatattacatagtgatcaaggcagcgtttatacatcttatgcttattatcaattatgcgaagaaaaaggcattatcagaagtatgtcccgaaagggaacacctgccgataacgccccgatagaaagtttccattcctcgctaaagtctgaaactttttacatcaataatcagcttaataactctaatcatattgtaatagatattgtcgaaaatacattaaaaactataataataatcgaattcaacaaaaactag

SEQ ID NO: 134 - DNA, 519 bp, Staphylococcus epidermidis
gaaaattttgggagtgggattatgaaactaagagcattagagtatagtgatttactttttgttcatgaattaaataatgaatattctattatgtcttattggtttgaagagccttatgaatccttaacggaacttcaacatttatttgataagcatttattagatgaatcggaaagacgttttattgttgaagatgaaaatcaagtcgtaggtattgttgaattagtagaaattaattacatccatcgtaattgtgaaatacaaataattattaaacctgagttcagtggtaaaggttatgcaaaattcgcattcgaaaaagcgataatttatgcattcaatattttaaatatgcacaagatctatctatatgttgatgcagataacaaaaaagctattcatatatacgagtcacaaggatttaaaacagaaggattacttaaagagcaattctacactaaaggtaaatataaagatgcctattttatgtcattattgaaatctgaatatattttgtag

SEQ ID NO: 135 - DNA, 1713 bp, Staphylococcus epidermidis
caaatacatggaggtcaatatggaaacaaaacaaatcaacatcgttttactgtaaatgatattgttgaaacaattcctgacaatgaattcgacgaattcagacatcaccgtggtgcaacttcgtaccatcctaaaatgatgttaaaagtgattctatatgcctacacacaatctgtattctcaggtcgtaaaatagaaaaaatgcttaatgatagcatccgaatgatgtggctatcacaaaatcaaaaaccttcttataaaacaattaatcaatttagagtaaatccaaaagtagatgctttattagaatctttatttattcaattttacagtcagtgtgtaaaacaaaatcttatagatgataaagctatttttattgatggtacaaaaattgaagcaaatgccaatcgatatacatttgtatggaaaaagagtattcaaaaccatgaatcaaagatgaatgaggattctaaagccctctaccatgaattggtaaccaataaaatcataccggaaattaaagaagatcatgataatgaattaacaaaagaagaaatagatttgattggtagtcacttagataaagaaatcgaagatttaaaccaacatatcaacaatgaaaaatgtactaaaacaagaaaacaaatacgtctcaaaagaactaaaatcaaaaaatacaaaaagcaaatcaatgattattttgagcgaaagtatcgatacgaatttcaaaaatctattttaaaggatagaaatagttattctaagacagattatgatgcgacatttatgagaatgaaagaagatcacatgaaaaatggacaacttaagccagggtataatttacaaatagcaacaaattcccaatttgttttatcttataatgtgtatcaaaatccaacggatactagaacgatgattccatttttaaattcaattcaagagacctacggtcatttacctgaatatattgtagctgatgcaggttatggtagtgaatcaaattataaggcaattatagatgactttaatcgaacgccactcataacatatggaatgtttataaaagataaaactaaaaaatataaaagtgacatctttaatactcaaaattggaactatgacgaaattaatgacgaattcatttgtccgaataataaacggctaggttttaaaagatatgcctatcgtcatgataagtatggttataagcgagacttcaaattatatgaatgtgatgattgttcagaatgtcctctgaaaaatcaatgtatgaacttcaattcaaaaacaaacaaaaaaataatgaagaattataactgggaatattttaaatcccaaattaacaaaaagctttcagaaccagaaacaaaaaatatctacagtcaaagaaaaattgatgtggaacctgtttttggatttatgaaggctattttgggtttcactcggatgtctgtccgacgactcaataaagtcaaaagagaactgggttttgtattaatggcacttaatataagaaaagtagtagctcaacgagctgaaaataatcaaaaaatttataaaaaaagacaatgtctatattatctcaatagaaattgtttttttttcacttattccaagaactttatgtcccggactcattatgatttatttttttattggggacttgccattaattctgcttgctccacaacttgttccacagccattttttga

SEQ ID NO: 136 - DNA, 1650 bp, Staphylococcus epidermidis
atgaagaaaggatgtaacataatgcaacaacttaaaacaaaacgtgtcggtatctatgtacgtgtatcaacagaaatgcaaagcacagaaggttatagtatcgacggacaaatcaatcaaatcaaagaatactgtgacttccatcattttgaagttaaagatatatacgctgaccgtggtatttcaggtaaatctatgaacagacctgagctccaacgtatgttgaaagatgcaaaagaaggcaatatcgactgtgttatggtatacaaaacaaaccgattagctcgtaatacatctgatcttctcaaaattgtcgaagatttacacaaacaaaatgtcgaatttttcagtttgtcagagcgtatggaagtcaatacttcttctggtaaactcatgttacagatacttgcgagtttctcagaattcgaacgtaataacattgtcgagaacgtatttatgggtcaaacgagacgtgcccaagaaggctattatcaaggcaatttaccactaggttatgacaaaataccagatagtaaacacgagctaatgattaaccaacatgaagctaatattgtaaaatatatattcgagtgctatgccaaaggacatggctatcgtaaaattgccaatgcattgaatcacaaaggatatgtcactaaaaaggggaaacctttcagtattagttcaatcacatacatcttagctaaccctttctatatcggcaaaattcaatttgcgaaatacaaagattggagtgaaaaacgtcgtaaagggctgaatgataaaccagtgatagctgaaggtaagcattcccccattattaatcaagatttatgggataaagtacaaatgcgtaagaaacaagtcagtcaaaaaccccaagtccatggcaaaggaacgaatctgcttacaggcattattcactgtccccaatgtggcgcacctatggcagcaagcaataccacgaatactcttaaagacgggactaagaaacgtattcgttactattcatgtagtaattttcggaacaagggttccaaagtatgttcggcaaacagtgtaagagctgatgtgattgaagattatgtgatgaagcaaatacttgaaatagtcaaaagtgataaagtcattcaacgcgtagtaacacacgtcaatcaagaaaatcaagttgatggcgctgcacttcatcacgatattgcttataagcaacaacaatatgatgaagtacaaatcaaaataaataacttgattaaaaccatcgaggataatccggacttaacatcagtaatcagaccaagtattcaaaaatatgaaaagcaactcaatgacattacgaatcaaatcaaccaactcaaaaatcaacaaaatgaagataagactttatttgatgccaaagaaatcagtaaactattacaacacatctttcatgatattaagcacatagaaaaatctcgactcaaagcattgtatctatcagtgattgatcgcattgatattaaaaaagatggtaatcataaaaaacaattctatgtcacactcaaacttaataacgaaatcattaaacaacttttcaataataaacaactcgacgaagtgcatctcagcacttcgtctttatttttgccccaaacactatatcttactatttag

SEQ ID NO: 137 - DNA, 1662 bp, Staphylococcus epidermidis
atagaaagagggattcaaatgactcaaaattcatataaaatacccattcaaggcatgacatgcacaggctgtgaagaacatgtaaccgaagcattggaacaagccggagctaaagatgtttcggccgatttccgacgcggtgaggccatttttgaactcagcgatgatcagatcgaaaaggctaagcaaaatatttcggcagccggctatcaacccggagaggaagaaagccagccctctgaaaacagtgtagatttcaatcgggatggcgattacgatcttctgattattggttccggcggtgcggcgttttctgcagctatcaaggccaatgaaaacggggcgaaagtggccatggtagaacggggaaccgtcggggggacctgcgttaacatcggttgtgtaccgtcaaaaaccatgcttcgtgccggtgaaataaacggtctcgcccaaaacaatccgtttaccggacttcaaacgagtaccggtgctgcggaccttgcccaattgaccgaacaaaaagatggattagtcagtcaaatgcgtcaagaaaaatatatagacttgatcgaagaatatggatttgatctcattcgtggcgaggcctcgtttatcgacgataagacgatacaagtgaatggacaaaacatcacgtctaaaagctttttaatcgcaacgggggcttctccggctgttccggaaatcccgggaatgaatgaggttgattatttaacaagtacatccgcactcgaattaaaagaggttccacaacgattggcagtgatcggttctggctatatcgcagcggaattaggtcaaatgtttcacaacctcggaacagaagtgactctcatgcaaagaagcgagcgtctgtttaaaacctacgatcctgaaatttccgaagccatcgatgaatccttaactgagcaaggacttaacctgatcactggggtcacttatcaaaaggttgagcaaaacggtaagtcgacaagcatttatattgaagtgaacggtcaagaacaagtcatcgaagccgatcaagtcctcgtggcaacaggaagaaagccgaacacagagactttaaaccttgaatcagcaggtgtgaaaacagggaaaaaaggcgaagtgctgaccaatgaatatttgcaaacgtcgaataaccgaatatatgccgcgggcgatgtgaccctcggtccgcaattcgtttatgttgcagcttatgaaggcgggattgtggcaaataatgcgttgggtctagcgaaacgcaaaatcgatcttcgctttgttcccggcgtaaccttcaccaatccatcgatcgccacagtcggcttgactgaacaacaggcaaaagaaaaaggttacgatgtcaaaacatcggtccttccgttggacgctgtaccgcgggccttagtcaatcacgaaacaacaggggtctataaacttgtagtcaacgcccaaacccagaaattgatcggggcgcacattgtgagtgaaaatgctggagatgtgatttatgcggcaacgttagcggttcaatttggattgaccattgaagaccttacggatagctttgcgccttatttaacgatggctgaaggattaaagcttgcagccttgacgtttgataaagacgtatcgaaattatcttgttgtgcaggctaa

SEQ ID NO: 138 - DNA, 615 bp, Staphylococcus epidermidis
atagtaggaggtataattaacgtgttcaatacaacatataaagaaatatatagcatgtttcctaataaaccatacccagtacatgatatctatgaagactgtagaactattcttgctgacttgcaaatagaaatgtttaatagaattaataaacagctttataaaacctgtcattacaataagcctagaaaacatcacgaaatgattaagaaattactaatcgaatttattatagacaacaaagatagcaaaatcgttagcgcggaaccatttgaattaaacctagaagctttttatgctatcaaacaaaattgtaatattagtaataacaataaacccttagatgaatatattattacatattttgaggatttattgtctaatataagtaacacattaacaaataataatagagctaatggaaataacccaataataaattacatctatgttactcaaagaaaagatggcatggtttgcgtagttggaaaatcacatttcaaatatgaatttaagggtaatgaatataaattagttaaaaatcaagaaggtgacttattaagaagatggatgaagataaaggtaccggaaaaatattatcttcattgtatataa

SEQ ID NO: 139 - DNA, 891 bp, Staphylococcus epidermidis
cttaaaggaggtgacatattggatcgtgcatttcgaatacttacgatatacaatcgtttactacaaaataaatccgtcaacaagcaatcactcacattagaactcgatacaagtcctcggacgatacaaagagatatcgacgatataagaaacttcttatatgaaagtaaatcatggataagcgcacctaaagaaattacgtacgattataaatcagaaagttataagctcgaacaaaataaaagtgaaaatatgtattttatgtatgatattttgactgctttatacctaacaacaccaaaattaagccattacttttatcaatatcttaaattattaatcgtcaaacatcattcaaattatcgaactacattattaaaatatcttgagcgttttgaaattgataagaatcaaacaggtatttcgacatcatcattagttgttcaagcaatgaacgaaaatcaatatcttcaatacaatcaaaatctattattacctttatcgatgtactatcaaatgcatgcttttcacttggtatatcgaatgaacgatgaaattcatatcgatgatattaatcaaatgaatctgagtttgtctgaaaaatctgtggacacacatgaaaaatcaaaggtacaaacctatatcacgtttgaaatttctaaagatgtgtggtcaaaaatgcatcgatattatcaaattcatgtgatagaaaaatatgatgcgcattatcttatcgtcacttttaagatgacaaggattgaagcgattcaactctgttttatgtatcgatccaatatacgtatcatttcaccccctgatttgaaggaacaagtgattgatgaattacttttattacaaacaacctatttaaaacaacaggttcaaaagtag

SEQ ID NO: 140 - DNA, 339 bp, Staphylococcus epidermidis
atcatacggggggtgtttttttctatgaaaagagtttcttattcagtagaaacaaagtataaagcagttgaaatgaaagcagcaggattttcaacaaaagaaattatgaaagaattaaatattagaaatagaacacaagtgaaaacttggtggcgatggtatcgaaatggggaaagttatagattttcacaacacgttggtaaacaatatacctacggtaaaggattagaagagctgttagaagtagaacaattaaaattagaaaataagagaaaagatatagaattggatattttaaaaaagtacaaggcattggagaggaagtggtaccaacagtag

SEQ ID NO: 141 - DNA, 570 bp, Staphylococcus epidermidis
aattcatttattgggcatacaatgcttttaggcaaatgtttaggaggtatggcaatggatagtcatttaaatcacattttgtcctattggcagggaccaccgttggaaggggcaaaaaccataattagtaagtatggatatccccaggaagcaacaatgagacgattaatttggtacaatagcgggccatggaaacgcacgatagtatataaggatccagtccctcataacttccctacccctcaccttgatttccttaagcagaccatcgattataaagtgcccgtacacttatatgatgcgattgccgcttttgatggaagtgtctacttagatcgaactacaggtgaggcatcagcaaagtgtcatgaggaagcgatgaattttttatctttaaacttgttaaatgacattgtaactggcaaacgtgatgttcaaggagcaaaagctttctacgcccaaactgccgaacagtttaccaaatatcatataacatctccttatacagaaggttttctttttccaatgcaatataatacggcagaccttggcgttacatattttaaataa

SEQ ID NO: 142 - DNA, 1383 bp, Staphylococcus epidermidis
atatatattatcactgtgaaaggaggagccgatatgaaacaagtcataggctatttacgtcaaagtacgatgaaacaacaatctcttgcagcacagaaacaagctatcgaagcaatagccgaaaaacatcatattcaacatatcaacttttatagcgacaaacaatcaggtcgcaaagataatcgtagtgggtatcgacaaataacacaattaattcaacaaggacagtgtgacatattatgctgttatcgtcttaataggttgcatcgtaatctgaaaaatgcattaaaactcatcaaattatgtcaaacgtaccatgttcatatcttaagcgtacatgatggttactttgatatggatcaagctttcgaccgactcaagcttaatatcttcatcagtttagccgaacttgaatcggataacattggagaacaagtcagaaatgggcttcaagaaaaagcaaagcaaggtcgattgattacaacacatgcaccttttggttacgaatatcacaacggaacattcatcatcaatcaaaatgagtcaccaacggtaaaggctgtattcaattattacattaaaggtcatggttataagaaaattgcacagttattagaagaagataacacgtatatcaatcgacaaccctatcaagttcgtaacattatcatcaatcctaattattgtggtcgtgtcaacaatcaatatggccaattcgacaatatgtttccttctattgtttccacaagtatatatgagcaagcgcagagacttcgattgcaaaaacaaaccaaacagacaccttcggataatcaactcaaacaaaaaatcaaatgcccatgttgtaatgcaacacttacaaatatgaccattagaaaaaagaatcatacattacgttactacgtctgtcctaaaaacatgaatgcttcacgctttgtctgtgattttaaaggcatcaatgcacaaacacttgaagataaagtattagaagtgtgccgagacttttatcaaaatcaacgcatctacacaaaaattaaaagtgcgattgacaaacgcatcaaaagacaaagaaacatagaaaaacatcacacattgactcaagaacaactgatagaaaagttggcacaaggcatcattgatgcagaaacgttcagagagcaaacacaatcattacgtcaacaaccgcaacgcactacatctatcaatgggcatcaaatacaacacatcattcaaaatattattcaaaaacgtttcacgttaaacatattgtacccctatattgaaaccattcacattacgaaagataaaaatcttataggaatctatttcaaaaatgaaccactcaatattgtcaatcaaaccatgcaatcatcgattgcataa

SEQ ID NO: 143 - DNA, 1515 bp, Staphylococcus epidermidis
atggcaactattggatttgaagaaaaactatggcaagctgcagataaattgagaggaagtatggatgctgctgaatataagaacgtagcattaggtttaatatttttaaaatatgtatcagattcttttgaagaaaagtatgaagaattgaagcaagatccttatgctgacgaagaagatcaagatgaatacttagcggaaaatattttctgggtgccaaaagaagcaagatggcaatatatcaatgataatgcgaaaaaaccagaaattggacaaataattgataaagccatgattgcaattgaaaatgaaaatgaatcattaaaaggtgtgttaccaaaagaatatgcgcgtcctgcattagataaagaaaaattaggcgatattattgatttatttacatttaaggttggagatactgaaagtcgcaagcaagatgtattaggccgagtgtatgagtattttattgctaaatttgcgagtgctgaaggtaaaaatgctggagaattctatacgccatcatcaattgtaaaattattagttgagatgattgagccttataaaggccgtatttacgatccatgttgcggttcaggtgggatgtttgtacaaagtgaacgcttcgttgagaaacatcaaggtcgattagacgatattgcgatttatggacaagaatctaaccctacgacttggaaattagcaaaaatgaacttagctatccgtggtattgataatgatttaggtgaacgaaattctgatacattccataacgatttacataaaggactaaaagcagattacatattagccaatcctccttttaatgcaagtgattggggtcaagaacgattacttgatgattaccgttggcaatttggtattccgccaaaaggtaatgccaactatgcatggattgaacatatgatttcaaaattagcacctaatggtacagcaggttttgtattagctaacggatcaatgtctacaagtggaaaagatgaattagaaattcgcaaaaatcttattgaacaagatttagtagaatgtattgtcactttacctggacaactcttttactcaacccaaatacctgtctgtctttggttcattagtaataataaaggtcaaaatggtaaaaaagaacgtaaaaatgaaattttatttatcgatgctcgtgaaatcggtcatatggtatctagaacattaaaagaattttcagatgaagatattcaaaaagtagcacaaacatatcatgcgtggagaggtacaaacgataaaccttatgaagatatagctggtttttgtaaagtagctaatttagaagaagttaagaataatgaatacattttaacacctggacgatatgttggtttagctgacgttgaagaagaggaagaaccttttgaacaaaaaatggaacgtattacttctgaattaagtgaacaattcgcaaaatcaaaagaacttgaagaccaaatccgtaaatcattggagggactaggttatggagtttaa

SEQ ID NO: 144 - DNA, 1293 bp, Staphylococcus epidermidis
ataatgactattctagcgattattatttttcttttaactcttatgtttgttatttggcaacctaagggtttagatattggtattacagcattgattggtgctatcatcgccattattacaggcgttgttagtctctcggatgttattgaagttacagggattgtttggaacgctactttaacttttgtcgctgttatactcatttcattaattttagatgaaattggatttttcgaatgggcagctatacatatggttagagcttcaaatggtcatgggtttaaaatgtttgtctacattatgttattaggcgctattgtagcagctttctttgcgaacgatggagctgcattaattctcactccaatcgtgctagctatggtaagaaaccttgggtttaatcaaaaagtcatttttccttttatcattgcaagtggattcattgcagatactacatctctcccattaattgtaagtaatttagtaaatattgtttctgctgactacttcaatattggatttatcgaatatgtaagtcgtatgattattccaaatatattctctttaatagcaagtattgttgtattatggttatatttcagaaaagttattcctaacaattttgaaattaaaaatcttaaaacacctaatcaagcaattaaagatccaaaattatttaagttttcgtggattgttttgtcaattttactcattggttatatagttagtgaatttattcaaattccagtatcgttaattgcttgtttgattgcacttatatttactgtactggcctataaatcgagagtagtaaacacgaaacaagttatcaaaggcgcaccttggaatattgttctcttttctataggcatgtatttagttgtatttggtctgaaaaatgtgggtattactgcactattagctaatattctatcaagcatatcaaactatggactgtttagtagtgttataggtatgggcttcatatccgcatttctttcagcaattatgaataatatgcctaccgtattaattgatgcaattgctattggacaatctgcaactactggtttaatcaaagaaggcatgatttatgccaatatcattggcgcagatttaggacctaaaatcacacctatcggctccttagcaacactgctatggctacacgttttaacacaaaagggagtaaaaatttcatggggcacatattttaaaacgggtattgttattacgattcctgttctttttatcacattagttggtttatacgttacacttattgtattttaa

SEQ ID NO: 145 - DNA, 417 bp, Staphylococcus epidermidis
ggtgacaatatggagatgaaaatcagtgaattggctaaagcgtgtgatgtgaataaagaaaccgttcggtattacgagcggaaaggattgatagccgggcctcccagaaacgaatcagggtatcgaatatattcagaggaaacagcagatcgggtacggtttattaaacgaatgaaggaattggatttctcgctaaaggaaatccacctgttgtttggtgtggttgatcaagatggggagagatgtaaagatatgtacgcctttaccgttcaaaaaaccaaagaaatcgagcggaaagtgcaggatttgttacgaatccaacggttattagaggaattaaaagaaaagtgtccagatgaaaaggcgatatatacctgtcctattattgaaacgttaatgggagggcctgataaataa

SEQ ID NO: 146 - DNA, 945 bp, Staphylococcus epidermidis
aaggaggatataaatatgtctaaaatcgtcgtagctttgggtggtaacgctttaggacaatcgcctaaagaacaattagatttattaaaaagtacatctaaatctctagtaagtttaatcgataaaggatacgaaattgtaattagtcatggtaatggtccacaagttggaagtattaacttaggtttaaattatgcggcggaacacaaacaaggtcctccttttcctttccctgaatgtggtgctatgagtcaagcttatattggctatcagatgcaagaaagtttacaaaacgaacttcattcaatgggcatagataaacaagttgttacgctagtaacacaagttcaagttgcaagcgatgattctgctttcaataaccctactaaaccaattggattattttatacaaaagagcaggctgataaatttacgaaagaaaaaggttatacttttgtagaagattctggacgcggctatcgtcgcgttgtcccttccccacaacctataagtatagttgagttagatagtatagaaacattaatcactcatggaacactagttatcgctgccggcggtggtggaattccagtaattaaggaaaatgaagtttatacaggtgttgatgcagttattgataaagataaaacgagtgctttattagcagcacatttacaatctgatcaattaatcatattaactgctgtggaccatgtttacattaactatggaaaagaaaaccaaagaggtctcgatgaagtgtctgtggatgaaatgaaaaaacatatctctgatggtcaatttgctaaaggaagtatgcttccaaaagttgaagctgcacttcaatttcttgaaaaaaatactaaaggcagtgttttgattacatctctagcaggattaggggacgctttagacggtaaaataggaacattaattaagaattga

SEQ ID NO: 147 - DNA, 333 bp, Staphylococcus epidermidis
ctaggaggtatatttatgtcttataaagaattatcagcaatattaaaagttttatcagatccaagtcgattagaaatattagacttattatcttgcggtgaactatgtgcttgtgatttattagcgtattttcaattttcacaacctacattaagccatcatatgaaaattttagtggataatgaattagtatctacacgaaaagacggtactaagcgcatgtaccgacttaatcatacgttcttagattcaatcaacaaagaattaacttatattagttctcctactcaacaatgtatgtgtaaaaagataaagacaggtgaatgtaaataa

SEQ ID NO: 148 - DNA, 537 bp, Staphylococcus epidermidis
tgcttttacattaaaattaaaataaaagaggtaaaccttatgtataataaagtttttgcaattttaattataattttttccataataattattgcgtctaatgatactttcgcagaaagtaagaatgacatgatgaacatgaaagaagataagaaaagtacaatggacatgacaaatatgaaacatcatgacgaaagaaagaaattaaattcttcacaaggaaaaaatgaaataatatttcctgaagttgcagagtcaaaaaaagataacaatggttataaaaattatacattaaaagctcagaaaggaaagacagagttttacaaaaataatttttctaatactctaggctacaatggaaatttacttggaccaactttaaaattaaaaaaaggagataaagttaaaattaagttaataaataacttagatgaaaatacaacatttcattggcatggattagaagtaaatggaaaagtggatggagggccttctcacgttataaaaccaggaaaagaaaaaaactataaaatttga

SEQ ID NO: 149 - DNA, 1044 bp, Staphylococcus epidermidis
aaaaataacatgaataaaatattaattgaaaaggagatattcaaaatgaaaaatttaagaaatagaaactttttaactttgttagacttcacacaaaaagaaatggaatttttacttaatttatctgaagatcttaaacgcgcaaaatatgcaggaatagaacaacaaaaaatgaaaggtaaaaatatcgctctactttttgaaaaagattcaacacgcactcgatgtgcatttgaaacagcggcttatgatcaaggtgcacatgtaacataccttgggccaacaggttctcaaatgggtaaaaaagagtctaccaaagatactgctcgtgttttaggtggaatgtatgatggcatagaatatcgtggattctcacaaagagtagttgaggatttggcaaaatattctggcgttcccgtatggaatggtttaacagatgaagatcatcctacacaagtacttgctgattttttaacagctaaagaagtattgaaaaaaccatataatgaaattaacttcacatatgttggagatggacgtaataacgttgcaaatgccttaatgcaaggagcagcaatcatgggcatgactttccatcttgtatgtcctaaagaactaaatccaactgatgaattattaaatcggtgtaatgatatagctgacaaaaacggtggtgaaatccttataactgatgatattgatgaaggtgtcaaaggatctgatgtaatttacacagatgtttgggtatctatgggtgaacctgatgaagtttgggaaaaacgtatcaaattattagaaccataccgtgtaactaaagaattaatgaaaaaaacaggtaatccacatacaatttttgaacattgcttaccatcattccatgatactgaaacaataatcggtaaacaaattcaagaaaaatatggtctaactgaaatggaagtaacaaatgaagtatttgaaagtgaacaatcagttgttttccaagaagcagaaaatagagcacatacaataaaagcagtcatggtagcaacattaggagagtaa

SEQ ID NO: 150 - DNA, 927 bp, Staphylococcus epidermidis
tactgggtcttatttctacaatatttagctataaacaaaacgaaagtattggtgaaaaatatgaacttaaatgacttagaagctttttataaagtctgcgaaaatcgtagctttactaaagcagcgcaagaactgaattatgttcaatcaaatgtaacagctaaaattcaaagattagagtcttattatcaagtgaaattactatatagagataaaaaaggaattaaaccgacaccagaaggtattgaattactaaaatatattaagagaatattcacaattttacatgaagcagaacataatgtaagcaacaataaaaaattaaatattaacatagggacaattgaaacaatagctgcagttcatttacctaaattattgaatgaatataagaggaaaaatccaaaaattcaaattaatttaaaaacagataatagtattaaattaattgaacatgtaaagaatagagaaatggattgtgcttttatatctgggaatattaacgataaagatcttatttgcacaaatatctttaatgaaaaattagtgattttatctcaaaagagcaactttaaacagaatataaacgaaaataagtctattataatgtttggcgaaggttgtttttatagaaaaatttttgaagattggcttaattatcatgatattaatatagaaaataaaatgacattaaatactttagatggcattttggggtgtgttgaagctggattaggtatagcatttttacctatgtcagtattaaataaaggaaatagcgatggtatagaaataaccaaagtagaggaatcatttcaaacaatatcactaaatatcatttatcgacaagataataaaaataataatgtgataaatcaattgaaacaagttgcttttgagaaaatgaaatcaaatataataaaatag

SEQ ID NO: 151 - DNA, 324 bp, Staphylococcus epidermidis
ataacattaataataatgaaaggaatgggaattatgagtaacatcataaaaacaataggcaaaggtattggaaaaggtgtcggtgcagcagcatattattcagttgcgactgttggtgctgccatcggtgcgatttgggaaacaacaggcgatagaggtttgatgagagacgctttaagtgatagctctaaccaagacttaatagaaatatatgagatacaaaagaaagatgatggggattatgatacttatattgcggctaaatccttattacaagagagaggattcacttataatcatgaaacgaataaatgggaaaaataa

SEQ ID NO: 152 - DNA, 549 bp, Staphylococcus epidermidis
aaggtgttaattatgaatttaactactcaaatcacaaaaatgttaggtattaaatatcctattatacaagctggaatggcaggaagtactacgccagaactagtttctactgttagtaaacaaggaggcttaggtatgataggagcaggttattttgattcacatcaactttcgaaagagattttagaagttcaaaaactgacacaagctccttttgcagtaaatctatttacacccaatgatattaagtacgataaaaaacaaattgagcagatgaatacaaaactcaaaccatatagagaagcgcttggattatctactcccaaaaatagtacggttaaagaaaaagaaaagtttgaagatgcaatagaagttattgaatcattaaaagtacctatcattgcttttacttttggtattccaaatcaaaatattattaaacgacttcataatgcaggaaaaattttaattggaactgcaacatcagtcgaagaagcagttgaaaatggaaaatgctggtatggatatagttgtagcccagggctatga

SEQ ID NO: 153 - DNA, 234 bp, Staphylococcus epidermidis
gaggtcataatgatgacattagaacaacaactcaaacactatataactaacttattcaatctgccaaaggatgaaaaatgggaatgtgaatccatcgaagaagccgctgatgatattctacctgaacaacacgtaagacttggtccacttagtaataaaatacttcagactaatacctactactcatacacacttcacaaaagtaatatctatcccttcatcctctactattag

SEQ ID NO: 154 - DNA, 474 bp, Staphylococcus epidermidis
tcaaaaataataaagggggtaataaaaatgaaaaaagaaaaacgtttaaatcttatcttaactgttatacaacagaatcagtttaataaaaaacaacaaatagtggattacatggcaagacattttggagtttactatagcttgacaactatttctcgtgacttacaagaattagaaatttacaaaatccctgttgaaaataaaaagtatatttacaagaaaataaatcaaacaaatcaattaagtgcaaaaaaacaattagaaatatttagtgatgagattattgaatttataacgctaaataactatgtcttaataaaaacatctcctggctttgctcaaagtataagttattacatagatcaattacaaatgaaagaaatattaggaattattggaggtaacgatactttgatgattttgacttcttcaaatgaaatagcagaatttgtttgttatcaattattcccttaa

SEQ ID NO: 155 - DNA, 465 bp, Staphylococcus epidermidis
ttaccacaaattgttgatgatgtgtctataccagtaattgcagctggtggtattatggatggaagaggtttagtagctagtttagctttgggggctggagcagcgcaattaggtactgcttatttaacaacgaatgaaagtggcgctgatgacaaaatcaaaaatgaaattattgaaagctctgaaacagatacaatactgacaaatgtatttagtggcaaattggctcgcggaattatgaatgaatttgtacacaatatgaatttatattcaaaacaggtgcctccttatcctttacaaaatcaattaacaacgcaaatacgaaaatctgctttggagaaaggatatactgagtggacccatatttggagtggacaaagtactagattagctgacacagtcgatgcagctcaattaacaaaaaatattattaatgatgcagtcaaaattatcaataataagtga

SEQ ID NO: 156 - DNA, 2739 bp, Staphylococcus epidermidis
ggggaacaaatgaaaaatatagatatcgcaatttatgatatagataaagttatttgtaaaagtattgagaataactcatcagatttaggttatttatcacaaagtatcttatcacatttaagaaactacgtagaacatattggtatgaaatattatttcgaaagtgtaaatgaagatatgactaatagttcttcaaatatctataatgaaatacaaatgggaataggttattttaggaagcattacaaattgaattggcttaaaaattttcatgaattacttcagcaatctgtttctcattatacatttgatgaagatagatccgaacggttatttataaagtattatgacttaatgttagaattaaaagaaaagttaaagaaagattttgaaatggatttattgcaaaatttatataaagtaccgctgaatattgatagtgatttaaaaggatattatcatacaatatctcaattaataggtaataaatacactgataatgaatatgaagtagataattcaaggtattatattgaaaaaacaaaaccatttgttattgaaaataaagtatattatgaaattacatttagaaatgcaaatgataaaactagtaaatacgaaaggctgattggttattcaaaacatagaataaacacaaattatgctgtaaaattcgcattagaaatgcaaacaataagttatttagggattaaagctaacgtaataataataaatgattacgaaatatctataagaccttgtgaatttaataattttgctaaaatattagattacgatttaaaattacaatcaaatcataatgaatataaaaaattaatgaaattgttaaaagaatttaatttacatttacttgatattgttttgttagatgacgatgaatttaatgaattggagtgttcagtgaatagcgaatcagcagttattaatatttttaatgtgttgagactagcaagaagatatattttaacaaataaatcaggcgcaaatgttcttaggtatttattatttgtttttaacaataggataattcgtttacagttaccttataataggaataaatgttataaattatctaaccttatattggattataaatgtgttccatttgatcaaatgccatttacagcctctttaaaaggccataatcctaatatctatactttgttacaatgtatagaatacaaagggagagaatatgaattattagtcaggaagattcaaaagaatactttgaagaataagaaagtttatacaagcaaagaagaaattgagcagtatggtgttgtaaacgaactaatcgataaatataataataatttgtattataagcatcgaccgaatagggaaatacattcatttggtgataaatattatttatatgaaaatgagcagagtattatgagtataataaagtcaattaaactattgtcaaatgaaagcgtagagggctattcaaattcagtagagttttggctaaataatgaatatacatcgttggattgtaaagaaaagaaggaaatactcttaagaatgttttcaaatagcaaaatatcgatggtatacggagctgctggaacagggaaatcaactttaataaaccatatttgcaattttttctatgataaagatgttatcgtcatagcaaatactaatactgcagtagacaatattaaaagaaaaatcaaattatctaacattaaaacgtctactatttctaaatttttatataatgataaagaaaagtatgacttgttaataatcgatgaggcaggtacagttagtaataaggacatgaatcgaattcttgaaaacaagcaatttgaattattattaattgtcggtgataattatcaaatcgaatcgatagattttggaaattggttcgaaattgccaaagatgttttgtcaaaaaatataatcaacgaactaactgatatgtatcgaactaaaaatgatgatttactttacttttggaaatctgttagagaaaaaaagagtaatttaaatgaaattattaatatgaataaatattctacaagattagatgaaagtatatttaatgaattcaataaagatgaaattattctttgtttaaattacgatggtatatatggtatcaataacattaatagattattacaagcaaataataaaaatgattctgtaatttggggtgtgaaagaatataaagttggtgatcctattctatttaatgaaactaataagtactcaccaatactttttaataatttaaaagggtcaataattgaaatacatgtttttgaagaatatatattgtttgatttagaaataaataaagttataaatgaacttgatattatttcgttagaaattgatttaataagttcttctgaaaatagttcggtgattaggattagagtagaaaaaagtgatgggttgaatgatgatgataatgattcatctgatagtatagttccttttcaagtgagttatgcaatttcaatacataaagctcaagggttagagtttaattcagtaaaaattgttatatctgatgatttagacgaacaaatcactaacaatattttttatactgcaattacacgagctagagaaaatttaaagatttattggtcaccacgaactgaaaagaaaattattgataatataatttctaaaagaaacttgaaggatctttctatattaaaatctcgaataaaaaaacaaaatacttag

SEQ ID NO: 157 - DNA, 1824 bp, Staphylococcus epidermidis
cagcaacccttcgaaaggaggtgttcgctaatgactcaaactaacccttcatttaatccttcaccacgatacaaatcaaaaaaaggttggtataaagacaagcctcccaaagaaaaaggaggaatgcctactgaagttgaaatcgcaggtcctatcgttatcgaaaataagtttattgaccctaaaactaacactgaaaaagtaattattacagacgaggatcaaaaagtaattgttgaatctagtgatattttaacaacacaaaaactgccctctttaatgaaatatggatttagtattaatgaaaaatatacaaaagatttaggttatgcgttgcaacaaatgcgcaaccaattacccatttcctacttatatgaaggggtaggtatactggaaacaccgtttggtcctattgtatcgttaaatgaaatctatactactacggaatttgataataaatctccatctgacgccatttgtgagaatacttatgacttagcacctaggggaacatttgataattggtttaacatgtatattgacgaggttaaagatcatcttcttttagaattgacagtcatatttgggatttctgccttagtgacaagttttctgaagcataaacatgaaatcgaatttgcaggaattctctttagttttacaggtcaatcctcaaccggtaagtcaaccgcagctgctttagctgtatcagtcgctggtaaccctaccaaaggtaatgaaactctttttagaagttggaatgccacacgtaacgcacttgaaggttatttgagtaacaattatggcgttcctatagtatttgatgaactttcatctacgacacttaaagataccacaggtttgttatattccatcgctgaaggtcaaggtcgtcaacgttccaatgtacacggagaagttaaagcgcctaagaattggggtacatctgtgatttcaacctcagaatacagtatatttaatgattctgctcaaaatgatggtttacgtgtgagaaccatcgagattaatgaacaattcactacaaatgcgaccaatgctgacaatattaaaaaagctgtagcactaaactatggtcatgttttaccgttagtagctaaatatcttataaatcgtgaagatgaagttattcaatggttttacaaggaagtagattggtttgaagctaaattgaaagatgaaacaaacaatacaggtattcgtatgtttaagcgttatgcagtcattacaacatctgcgaaaatattaggtcgtgttttatctacagatattgatatcgctaatataagagactactttattgattatcatactcatacagtctctgaacgctcattagctgataaagctattgatgtcatcattcaatttgtggcacaaaacagaggtaagttttcagatgaaggtgctttgaaaaatatgtttgagaactatggattaatctcattaaaagatgaccatatcgaagtaaaaataattgcgaacgtttttaaacagatgctaaacaatcatcaatttcaagatgttaataatgttgtcaacgccttaagagataaaggtttcatattagctgaccgtggacgccaaacaactaaaagaagtgtcaaagataatagcggtaaaaaacaatcacttgtattttaccatctaaaattagatgtagagtttgcatctatcctcggattaactaaagataagtcgttacttcaaaattggacaccgtcaaatgataacaaagctgcgaaagaactttttaaatccgctaatgaagggataggcccttcaggagttcacgaagatttctaa

SEQ ID NO: 158 - DNA, 825 bp, Staphylococcus epidermidis
ctaggtggaattatgaaaaattttaaagttcaagaagctaaagaaactccattaagtgctcaaaatgcaaatgtattcattaaatgtgttaaaaaatataattggcttaaagacataataataaatggttatttccaatataggtatgtaactgaagaagtagaatatttaaatatagagactactgacttaagtggaaagagaattcctatcgaagacattacgtttccaatgttatgtttttgtgatataccattaaatcaattaaaagatcataataaatggtatggagactatgcgatatgtatgaaaaaatcttggggagtaaacaaaaacctacagccattgcattatgtatcgaatactagtgagtatattaaaatgtatcaagaagtgtttaataatatagttaataaaccagacactgatgaaaaagtatatgaatttatattcgcttcattatttttcttaaaacattttaaaggaagtcaatattgtgaaaaaactgataaaatagaagagaaaatattcatggatgaacaagaatggagaagtataaaattagttgatgaagatttagatcctttttacatcaatgaaaatagtgactctaaaagaaattattataatgaagctttaacaaaattatcaagtaataaattagaatttaattgtgaagatattaggtacattattgttgaaaaagaagaggacgttattcagctaataaatgatattaattgctctaattacgatgatcaagaaaaaagcttactcatttcaaaaataagtgtcttaaatcacttaagagaggattttatgtaa

SEQ ID NO: 159 - DNA, 1530 bp, Staphylococcus epidermidis
aagagagtgattatcatgattaaaaataagtggaaaatagagctgtggtttcaattcttcagttattttatacacaaaattgattccgaatttatactaaaagaatatgcacaacatattttacctgaagaaatgagaacaaattatgtagtgggagaagcacaacctaatgaaactatatatataagctactttgtaaatacctctaatcaaaatattgaacaacacactgtgaaatgtagtgaagagggtatatttatcgataaaattcctagtggctttactaaagataatctgacgtattctattgatagtcaaagtatggtggacatagatgaactttcaaatgaaatcattgaccaaggtgtagatgctctagatgtgttagaatcaacaactctagatacatatttcaccgagttcttaaccacaatcaataaaacaacagattttgctaaaaagatagctaacaatacaataaaacagattcgagaaaatattgaattaaaaaaagctaactatagaatagattatgaaaaagctattgacgatgtatcttctttggaatcatttataaatctgaaagatacaatattagaaactcatcaagatttatctaaagaaaattttgacgatgtattaataagtgattttttaacgaaatatctcatttataaagaaaaacaagactcttatgttaagaaaaatatctcaaacttaaataagtctaactactttaaacaattagtgacggaaggtttaatcaaagaacgaacaagtaattctcaatactttgaaattgctaatagtatcaaaccttcgattcataacaagtatagcttaaatcaatctgatgagttagaccaatttaggcaagctgttatcggcatttctctcaacttatatgatcaaaatgatacatactttaaattcatccgtagtattctgacagaaaagtcacgtaaagttaatttaacaatagatggacttattgagtctcaaaacactataaatgaatttatgaaaaaacaagatctaattagcgacaatgaattatattatttaacaactattgaagatacgttccactttgcattattcactgccatttccgatttaatggatgaattagttttagtaacaagtaaaatcattcaaagtgcgacacaatacgatgtattagtcgctttatatagtatttctaatttaaaaaatgatttgaataaattagcacacaaacacgaacgatcattaacccgttttaaaagtcttattgatggttatgtaagaaatactagattaaaagatttaattcataatattattatgaatgatataaaaatgacagaaaaagtagaaaggtctttactcaccgatctaaaaaaatataatattagcaacttttataaaagagacaactttaataataatcctaatgattttctcgataaactaatgattcaaataatcagtaagttttacaagacacgtttagaagatattaacgatggaccaaatttatattattaa

SEQ ID NO: 160 - DNA, 342 bp, Staphylococcus epidermidis
ttagaggagatcgattcatttaatgaattattttatttaatagaattatatttgaaggcatttaaaggacaaaagaaaacaggctatgaatttgaagaaagattgaacacatttattcaatcatatgtcattattttacttatagatataaggttaccgactgttaggttatatattattaggcatattgtggatacatgcgaaaaagaagtggacaatcaaaaaagaattatactaatagagaaatctattaaaaagtacagatatgtaaaagaacagattaaaagatttggaaatgcgttgaaagaagaattatctaacgcgactttgtctattgaatag

SEQ ID NO: 161 - DNA, 567 bp, Staphylococcus epidermidis
cgtggacgctttttattatgtgatgcttttaccagaagaatactaaaggaagtgacgatgatgaatacaatcaaaagtacgatacacacagaagccatatttagcgatgatgaacagcaccgctatttactcaagaaaacatgggatgaaaagaaagctgcatgcacagtgataacgatgtatcctcatttagacggtgtattatcactcgatctcacaactgttcttatcctcaaccaattagccaattcagaacgatacggtgctgtatatcttgtaaatctattctctaatattagaacacccgaaaacctcaaacatatcaaaaatccatacgatgagcacactgatattcatttgatgaaagcgattagtgaaagtgacacagtgattcttgcttatggtgcctatgcgaagcgaccagttgttatcgaccgtgtcgaacaagtgatggaaatgttaaaacctcataaaaagaaagtaaaaaagctcatcaatccagtaacaaatgaaattatgcatccactcaaccctaaggcacgtcaaaaatggattttgaaatcatag

SEQ ID NO: 162 - DNA, 195 bp, Staphylococcus epidermidis
actttaagcgtctcaatatcattgagacgcttttttattattaattattttatactttttgatttatctccaggattagtcatttttcttatctttttaatttacacactaaaaaatatcctccttaacaataataagttatttaaattattgattaaggaggatatttttatatctatttatttctcaatctag

SEQ ID NO: 163 - DNA, 270 bp, Staphylococcus epidermidis
cttttcttagtgatgataggatatgttgaccaaattggccgtgagattggaggggtggtttttatggttagttgttgttcaatcgatccatacactgaattcgaagtcattattattggtgccggggtgccggaggtttctcttgcctttcatttgacttcatacggcataaggacggcacttgcggatgaacagaacgtggataacagattaaaggactttttaagaacttttcaagaattgattgagcgcgattcgggtatgccgtga

SEQ ID NO: 164 - DNA, 1491 bp, Staphylococcus epidermidis
aagtcacaagtaattcattcattaaatcaaataacaagatttttaccacctttattaggggagattaatatggatgaaaataaattaggtaaaacttccttaattggtttagtcataggctctatgataggcggtggtgcattcaatatcatctcagatatgggtggccaagctggtggacttgcaataattatcggttggataataactgctattggtatgatttctcttgctttcgtatttcaaaatttaacaaatgagcgaccagatcttgatggaggaatttatagttatgctcaaacagggtttggagattttattggtttttcaagtgcttggggatattggtttgcagcatttctaggtaatgtggcttatgcaaccctattaatgtcagctgtgggtaactttttccctatatttaaaggaggtaacacacttccaagtattatcatagcatcaattttattatggggtgtacattttttaatacttagaggtgtagaaactgcagcgtttataaatagtattgttacagtagctaaattaatacctatatttctagttattatatgcatgatagttgtattcaacttcagtacttttaaatccggtttttatggtatgactagtggaagtgttggcgtttttagttggggagatacaatggcacaagtaaaaagtactatgttagtaactgtatgggtattcacagggattgaaggagccgttgtcttttctggacgtgcaaagtctaaaaaggatgtaggaactgctaccgttattggtttgatttctgtgctagtcatttatttcttaatgactgtactagcccaaggtgtcattcaccagaaccaaatttcaaaacttgctaatccatcaatggcacaagtattagaacatattgtaggtcattggggttcagtgttagttaatataggcttaattatctctgttttaggagcttggttaggatggacattactagctggtgaattaccattcattgtagctaaagatggacttttcccgaaatggtttgctaaagaaaataagaataaagctccggtcaacgctttaattattactaatatattagttcagttatttttaattagtatgttgtttacagatagtgcctatcagtttgcgttttcacttgcatcaagtgcaatcttaattccatatacactcagtgctttttaccaggttaaatatactattcaaaataaatctaaagctaatttaaaacaatggataataggaattattgcatctatttacacaatttggttggtttatgcagctggattagattatttactattaacgatgttgttatatatacctggattactcgtatacagctacgtacaaagggataataacaaacatttgacaaaattggattatacgttattcatattcatcattgtacttgcaataataggaatagttcgtttgattacaggtaatatttctgtattttaa

SEQ ID NO: 165 - DNA, 231 bp, Staphylococcus epidermidis
cttctaaaagttttaaaccgggtagacctattggtggagatttctacttacgtggccttattaaatgcccagaatgcggaaataatatggtatgtcgacggacgtattataaaacgaaaaagtccaaagaacggacaatcaagcggtattacatttgttccttattcaatcgttcagggagttctgcatgtcacagtaattccatcaatgctgaagtcgtcgagcgtgtaa

SEQ ID NO: 166 - DNA, 1146 bp, Staphylococcus epidermidis
attaaaggagtgttggaagtgaaaactagagcagcagttttacatgaaatgggggctaaaaagccctataaagaatctaaacctttaaaaattgaatacttagaacttgataatcctagcgaacacgaagtattaattaaaattcatgcagctggattatgtcactctgatttgtcagtaattaatggtaacagacctagacctttacctatggcacttggtcatgaagcttccggtgaagtaattaaagttggaaaagctgttacaagagttagcgaaggagatcatgtggtatgcacatttattcccagttgtggaaaatgtatcccatgtaaagaaggacgtcctgcattatgtgaaaacggagcaatatctaatgaaaaaggcgaaatgttagagggagggatgcgtttatctaatgatgaaggaaaagtatatcatcacttggggatatcaggttttgctgaatattctgttgtctctgaaaactctatagttaaaattgataaaaaaataccttttgaacgtgcagctgcatttggttgtgctattatcacaggtatcggtgctgtggtgaatacagcccaaattcgttctggtagtaatgtagcggttgttggtttaggaggtattggattgaatgctattattggagctaaactagcgggagccaatgaaattattgctttagatattaacgaagataaatttgaattagcaaagcaatttggggctacagcaacatttaattcaagcgataaagatatcgatgagcaaattaaagaatatattcctggcggagtagaatatgcttttgaaacagcgggtgtagtgccagctatgaaagttgcttatcagattactaaacgaggggggacaactgtaacaacaggactgcctaatcctaaagataatttttctttccctcaagttactttagcggctgaagaacgtaccattaaaggatcatatgtaggaagttgtgtacctgacagagatataccaaggttcgttaatctatacaaccaaggacgtttaaatattgattcactcatcagtgaggttatcactttagatgaaattaatgagggatttgatcgtttgtctaatggtgaagtaggtagaattataatgaagatgcattga

SEQ ID NO: 167 - DNA, 243 bp, Staphylococcus epidermidis
agtaaaggagtattatctatgaaccatgacaacactatacaatccaattggcgaacggttgctagttgtttagcatcacaaaattacatttcaatagtaaaaggtctggtgcatcatttcacagccatcgatgacgaggaaatacttgataaaatctatgaagagtttataaatgatgactctattacaacggtacttaacaatgatttacaaacaattattaatcattatctatcaaaatga

SEQ ID NO: 168 - DNA, 264 bp, Staphylococcus epidermidis
caaaaaggagtcttctgtatgaactatttcagatataaacaatttaacaaggatgttatcactgtagccgttggctactatctaagatatgcattgagttatcgtgatatatctgaaatattaagggaacgtggtgtaaacgttcatcattcaacggtctaccgttgggttcaagaatatgccccaattttatatcaaatttggaagaaaaagcataaaaagctaattacaaatggcgtattgatgagacgtacatcaaaataa

SEQ ID NO: 169 - DNA, 195 bp, Staphylococcus epidermidis
atagtctcattaagtttcttgaagagactttcaaatatttcattatgctttctacataaatactcaagtaaatctttcggtaaagttaatattttacaatctgtcaaagctgtacatatttcatatggtgcaggggtttcattaaatatgaagttcattggaaatatattttcgtctttacttaatcttaaataa

SEQ ID NO: 170 - DNA, 198 bp, Staphylococcus epidermidis
agtaatacattacataggagtgataaaatgccaagtcgttgggtaaaagttaaaacctttaagtcattatctacttccaaattagagaaaaagttacaaaatttcaaatcatataatagctttgatattatagaaattaaaagacattcatatttatttttaaatatagtcgaagtttattacaaagataaaacttag

SEQ ID NO: 171 - DNA, 216 bp, Staphylococcus epidermidis
ttatgggcattcttagctatccagcgtccttcctcagttttaccaaaactagcatatagattttcacaacaagttggtaaacaatatacctacggtaaaggattagaagagctgtcagaagtagaacaattaaaattagaaaataagagaaaagatatagaattggatattttaaaaaagtacaaggtattggaaaggaagtggtaccaacagtag

SEQ ID NO: 172 - DNA, 912 bp, Staphylococcus epidermidis
tttaataaatttggaggcgttatactaatgatagattcgattatagaatttataaaaacatttctaatgctattttttgaattattaatactgttcataatcgtaagttttattgtaagtctaatccaacaagtagtttcggaagataaaatcaaaagcatgttaagtaaacctaaccaaggaatcaattatttttttgggatgatatttggtgcgattactcccttttgttcttgttcaacaattccaatacttgcaggtctattaaattctaaagtaccttttggtccagcggtgagtttcttaattgcttcaccattaatgaatccattaatggtgtttatgctatgggttttattgggctggaaagttgcaatagtttattttattgtactagcaatatttagtatctttacaggtcttgtgttttcaaaaatgaatttggctgaaagttataagggcgtaaatgttaaaggagatggattttttgccaataaagaaggatctcgttttaaacaagcattaaatgatgcgtgggcatttttatatccaatgcttccttacctatttattggtgtatttattggagcattcatatatggatttgtacccgaaacatttattacaaaatacgcaagtggagatggcgttatatccgtattcattggatctgttataggcattccaatgtatattagacctgaaacaatgttacctatagctgaggcattagtatcaaaagggatgtctttaggaacagtagttgcgttgataataggtggtgctggtgcaagtattccagaagttgtattgttaacgaaattattcaagaaaaaatttgtagtctcattcgtaatcgcaattttagttgtagctattgctacaggtttgattgtgaacatcgttatttaa

SEQ ID NO: 173 - DNA, 333 bp, Staphylococcus epidermidis
catgataaattagtggttagctatatttttttactttgcaacagaaccctattctttggcgcaacatgggggccaattatgtgggtaatgttgccagaaatgttccctacacgcgctcgaggtgcagctactggtatcgctattgtagtattacaaataggaacacttattatttctcaagtatttcctatccttgttaatatgttagaagtacaatatgtattcttgatttttgcagttataggggcattagcactcatttttgtagttaaattcttaccggaaacgcgtggtaaaagtttagaagaaatcgaattacaattacaaaactaa

SEQ ID NO: 174 - DNA, 243 bp, Staphylococcus epidermidis
gtagcgaaatttattggaaaaggtacttatattgaagatattgttaatggttcatttttaaaaagccaagacgatttgaagttaaaagcttctgacttcactgtcgaagataactataactacggtgtacttatatttccagagaatctttctcttacagataataataagaaattggaatctttaataaaaactatactatttacaggtaaacgatatcaatatacttattttaaaatttga

SEQ ID NO: 175 - DNA, 450 bp, Staphylococcus epidermidis
acgttgatttctcaagaactgttaatacaaaaaattcaagatgcagatgcattaatcactttattgtctacccaggtaagccgacaagttattgaatcggcgccaaaattaaaaatcattgcaaattatggtgctggttttaataacattgatatccaagcagctcgcgaacaccatattaatgttacgaatacacctatagcttctacaaatgcaacagctgagttaacaatgggaatcttattggctgtcgctcgtcgtattcctgaagacgatcaactttgccataatgaagggttcaatttgaaaatcacagatgataatctgcaagtcgattaccctcgtcaatttctgaaaggcgcacatgcaccgagtgttaaagcacagcacgttattcattggggcgacaccttctgggtttcgtcgttatggttagcgtggttttattaa

SEQ ID NO: 176 - DNA, 1374 bp, Staphylococcus epidermidis
agagtgatttctgtgaggaggataatgatgacaaagaaatacgatcttattgtgattggtacaggttctgcggggtcaatcacagcagcaaaatgtaataaagccggctggaatgtagctatggtagatgacaggccgtttggaggcacgtgtgcactacgtggatgtgacccaaaaaaggttctacatggtgctgccgagcttattgattggaacaaacggatggttaagaatggagtaccgtctgaagtctccatcaactggaaagatcttatgaattttaaaagaacctttacagatgatgtcccggaaaaaaaagaggaagcattgaataaacagggaatcgatacgtatcatggcaatgcatctttcgtgagtgaggacaaacttgaagtgaataaagaagtgctcgaggggagtcatttcttgatcgctagtggtgcgaaacctacccctttacccataaaaggagaagaacatcttacttatagtgatgagtttttggagttggatgaattaccacaaagaatcgtctttgttggtggtgggtatatttcgtttgaatttgctcatatcgcggcacgtgctggatcagaagttcatattatccatcgaggtcaaagacctttggagaattttgatatagatcttgtagatatccttttagaaaagtcgaaagagattggcatacaggtacatcttcaacattccgttgaatccattgaaaaagaacaaggaaagtttcatgtgtacgctcgaaaaaaagaggatataacgcggtttgaagcagacattgttattcatggtgctggacgggtccctgccttagatatgaatcttgaaaaagggaatatagaaaggaaaaaacatggtgtccatgttaatgagtatttgcaaagtgtaagtaacccgaatgtctatgcagctggagatgctgcagcaacggatggcttgcccctcacacctgtagccagtgcagattctcatgtcgtagcatctaatttattgaaagggaacagcaaaaaaattgaatatcccgtgattccatctgctgtatttaccgtacctaaaatggcatcggtaggtatgagcgaggaggaagccaaaaactctggccggaatattaaagtaaagcagaaaaacatctccgactggtttacgtataaacggacaaatgaggactttgctgcgtttaaagtgctaattgacgaggatagtgatcaagttgtcggtgctcatttgattagtaatgaagccgatgaactaattaaccactttgcaacagccattcgctttggaatttcaaccaaagaattgaaacaaatgatatttgcctatccaacggcagcttcggacattgcacacatgttgtaa

SEQ ID NO: 177 - DNA, 369 bp, Staphylococcus epidermidis
ataaaggagttttcaataatgaaaaataaaaaaggattaggcataggtcttatcacaattatgattatcgtttgtattgtactagtaatcatgatgttcgtgggtggtaagaaagaatcatactacggtattatgaaagatagcacgactattgataaaatgataaatactaaaaatgaaaaaattgaaaaaaacgtagaattacctaaagatgctaatgtatcagttaaaaaagaagattttgtgatgctctttaaagatgaaaaaactggaaaaattactaaagttaagaaagttaatcacgatgacgtacctcatggtttaatgtcaaaaatccatgatatgggtaatatgaaacacggaatgtag

SEQ ID NO: 178 - DNA, 2112 bp, Staphylococcus epidermidis
tatacaatgacatgttttttaaatatatataaagaatatcattctccccctgaacgcaatattaatagaattattctgatgttttcacttacaaatgacttaaaaatcactattaatggtgaaacaaaagatttaggtaatcatatagctatcattaatcaatctgacatctattttattaatagtgcttcaaatctcgtattactctctattccagttatttatttttatagtaaagataataaattttttaaatgttattttgacagacatttattacaatcaagcagttttgttaaaacaattattttacaagctattcaacatttaataaaaggagaaaatcaagatgagcaatccatctctaaaataatacaaacgctactaaaagaagcagtcattcgatataagaaaaaatatattcctcaaattgcagttaatcattcagtgtttactgaaggattaacatttattcattcaaaagtatcacagtcactttcactacgagaagtagctcaacattgtaatatatctgaatcttattgttctaacctatttgcaagatatcttaatatgaattttaaagattattttacaagcttaaaagtgattgactctataaaaaggctactttcatctgaggactcaattaacgctatttcagaacaatctggatttagtagtcataccaattttacaaatcaatttaaaaattatttaggttgtagcccaaaacaataccgaacgattatctctaagttagactccttaccttcgataagttttagtgatactgacttttcacaatatattgatttaattaatcaatttgagtttagtgatcatttggctactgaaacgactgaaagagatatcaatgaattttatcctcaagatcagactaaaaactctaaagcgtttatacgttttcaaaatttcaacgaattatttcaatttgtttttaatgaatattacaacattgattttacctccctgccacaagctgtaatttttatcaatgatatcactgatatttcgacgcgagaggtgaactttaatttattaaatcgatgctttgaaaaattattcgaaaaaaatataggtttagccatgagattaacatctacaaatgaatttgaatctatcaaagaaataattttattatttcttaatagccaccaagattataaaatgaacaaaaaaatggttaaatttatgttagtctttgaaactaagaatatgtcagtgaacgatatacatttatgccatttaaaaattaaaaataaaaataaagctatccgttatagtataactgttgaaggattactacaccaaaattcttctattgatcgaacttatgatatgatgaagcgattaaatttcgattactattttatagacattgaaaatctagaaaccaaaaactcattaattaccaaacgtaaatcgtacttacattcgtccacacactttgaaaattataaacaatttatattagattccggtataccttcaactaaatttgtttacaataatttatctttaaagtgttttaaatatacaaacaatggtacttatccacttcaattatctgaccttgtttgtcatttagtcgcattaatgcgttacgggggtggtgtaagttatcaactgatagaagatgagagtccttttattgccttatttaatcgttatggtagtcccctacctctcatgcacctctataaattaatcgaaccatttttaaatgaacctttagagatagctaacaattttttaatgagtcgcaaagatggtaactatcactttttattatttaataaaataaatgatcgttatctatctgatagtcaacagcgctacgtttttaaaaatacattatcaaccaactcattaattattattaaaacgttaaatcatgagcatggcgcaattcaaaaccttctaccacaaactaaacaacaattttatattgaacgtagtattcttgatgaacttgataaatcaaatcaaccaaaaacagaattagctatacaacatgaccatcatcttcctttccaagtcaccttaaaacacgatgaagtcaaatatatttgttttaaaccttcttaa

SEQ ID NO: 179 - DNA, 822 bp, Staphylococcus epidermidis
atctatggcaaaggtgagttattaccgattatctttttcgcagtattttttggattaggattagctgcgataggagaaaaagcagaacccgttaaaggattcttaaatggtactttagaagctgtattttggatgatcaataaaattttaaaattagctccaattggagtatttgcatttatctgtacgacagtaatgacttttggtgcttctgcattaattccattatttaaattattagttgttgtagtatttgctatggttttctttgttattgtagtattaggaattgttgcaagaatggttggaataagtattttttcaatcatgaagatacttaaaagtgaattgttacttgccttttctacttcaagttcagaagcagtattgccgattatgatgaagaaaatggaacgctttggttcgccaaaagatgttacttcatttgttattcctatcggttattcatttaatttagatggctcagctttatatcaatctatagctgctttatttgttgctcaaatgtatgatatacatttatcattaactgaacaacttgtattaatggccacacttatgattgcttcaaaaggtatggctggggtgccaggcgtatctattgtagttttattaacaacattaacttctatgaacataacagcacaaggtcttgctttaattattggtattgatcgtttattagatatggttcgtacatgtgttaatgttattggtaatgcactatcaacagttgttattgctaagtgggaaaacgtctatgataaagagaaaggtcaaaactacttaaattcaatttaa

SEQ ID NO: 180 - DNA, 468 bp, Staphylococcus epidermidis
attatgtgtgataaggatatatacaataataaggagatgataattttgaataaacaacaagtgacaaaagcaatagaaaaagtattaaattcttcaaaaattggtgtcctatcaacagcacatcataataaacctaatagcagatatatggtcttttacaacgatgacttaaacttatatacaaaaacgaatatcaattcactaaaagtcgaagaaatagaaaataatcctgatgctcatattttattaggctataacgaaacaacaaacaatagctttgttgaaatagatgccactatagaagttgtcaaaaatcaaaaagttattgattggttatgggaaactcaagacaaaacatttttcaattcaaaagaagatcctgaattatgtgtactcaaagttatacctcgttcaattaaattaatgaatgatgatgaactagatacgccagctacaattgagttataa

SEQ ID NO: 181 - DNA, 531 bp, Staphylococcus epidermidis
aggggagtttgcataatggctctattcaagaaaaaaataagtgtaccaacgcaagtaattattgctttggtactcggtgtcatcgctggtctattactatatggacaagatgatgttgcaaattatattaagccatttggtgatgtgttcttaaatttaattaagatgatcatcattccgattgtattttgttcattagccttatctatttcaaatttaggggattctaaaaaggtaggaagctatggatggaaagcaatcctttattttgagattattacaactatcgctataggtttaggtcttatcattggtaatctattcaaaccaggttcaggtctagatccagataaattacctaaaggcgatattactaaatatcaatcatctgcacattcagcagaacaagcgactacttatggtaatcatcttatagatacattagttcatattgtgccaacgaatttatttgaatctatggcaaaggtgagttattaccgattatctttttcgcagtattttttggattag

SEQ ID NO: 182 - DNA, 378 bp, Staphylococcus epidermidis
ttgaaagaacgcggaaaaatagaaaaattgtggcgtgaagaaaaatatcgtgtgctatttcatgatcagaatgcatatcattcgataagaacgttattaaaatcgcctaccacattgggtgaagtgaaagaacatataacgcacgctttaaccattacacctacaaaaggctcagttatcaatgcttttgaacatatgtgggggtatttcaaaaaacaatgtacacaatatgaaaagcaacatagccgagaattaaaagcgttgtatattgaaaatcaaattgactattttgagctgttgtcttttttaaaaaatttagcagataaatatgctgtcgagtacttacaacaaagtaccatactcaatattacaaaatga

SEQ ID NO: 183 - DNA, 1401 bp, Staphylococcus epidermidis
  unsure (157): Identity of nucleotide at the above locations are unknown.
aaaaagtaccagattgctgcaagccttaggttagtagacctgtgggggacgagagaagctggatttgagttgcccagtttaggtttggctggggggctccatacaattacaagaaaggaaagcattatggttaatcgtcaacccccccagggggtgntattcggtttacccatatctctgatttgggggtttgtggccattgccgtgttcatgaccggggatggaattgaactagcgtttctctcccgatatgtagttgatctgggtttctcccctactcaggcaactcttttatttacggtctatggttttttggcagccatttcaagttggggttccggtgtgctggcggaaaccttcggtcctcggcggatcatgctgattggcgtcgcggcctggattgtctttcatgtgttgttcctgattttcggcctggagcagcagaaatacacattaatggtggttttttacggtatccgtgggttggcctacccattgttcatttatgccttcatggtttggatcgcacaggtgacgccaggcgcacgtatggcctcggccatgggctggttttggtcgatgtattgcatcggtattggccttttaggcaactggattccaagcctgagcatttcacgtatcgggtttatcaacacgttgtgggtcggtgtattttgggttgccgttgccgggctgatgatcatgtatttagtcaaggagcgtggggccggcaaacccgacgatgcagtgacattggttgagcgtctgaaaaccttgagttcgggcgtcaccatcattgctgagcgacggggcatgttcctgattgtattggtgcgaattatctgcaacctgagcctgttcggtctgccggtgatcctgccgctgtacctaacctcggtcgaggtcggtttcagcatggagcaatggttgcatttgtggggtgtgatgtttgtggtgagcatcttcaccaacgtgatttgggggcaaattggtgatcgcctggggtggctgatacaaatgcgctggttcggctgcataggctgtgcgctgtcgtcactggcgttctattacctgccgcagttctacggtgcccattttgaaatcgctttgattgccgccatcggctttggcatcagcgtgaccgctttcgtgcccatgggcgcggtattcctggccctggcgccggagcagaaaggcgcggcgatttctgcacataacctggcggctggcctgtcgaatttcatggggccggggattgccaccctgtttatcgccactctgggcatcaagggcgtggtgtggatctacgcagggctctacgtggccggtgcggttttgaccttcttcattcctgtccctcaacctcgactctgtcaactgcgtcattgcccacgatacgcc

SEQ ID NO: 184 - DNA, 192 bp, Staphylococcus epidermidis
gcgacggggcatgttcctgattgtattggtgcgaattatctgcaacctgagcctgttcggtctgccggtgatcctgccgctgtacctaacctcggtcgaggtcggtttcagcatggagcaatggttgcatttgtggggtgtgatgtttgtggtgagcatcttcaccaacgtgatttgggggcaaattggtga

SEQ ID NO: 185 - DNA, 521 bp, Staphylococcus epidermidis
cgggttgccgaatcccgtggtcgaaggtcttatcgtcagcgggtgttacggggggcatggacctggcgttggcgctggtcgaagaagattacggcagagaattggcgctcagcgtggcccgtgaaatggtgatgttcttcaagcggcctggcgggcaatcgcagttcagcgcgcaactggcagcgcaaaccgccgaacgcagcgtgatccgggacgtgcaggaatatgtggtggagcacctgaaggccgacttgagcgtccctgccttggccgcccgcgccggtatgagtgagcgaaacttcgcccgtaccttcaaggctgaagccggctcgaccccggccgaatttgtcgaattggcccgcattgatgcggccagacggctgattgaagatgccgatgtttcacttaaacgcttggccgatacagtcggttatgccaatgcggacgggttcagaagggcatttatgcggcgtctcggcgttgggccaagtgattatcgaaagcggttttcattgatgtga

SEQ ID NO: 186 - DNA, 453 bp, Staphylococcus epidermidis
  unsure (7): Identity of nucleotide at the above locations are unknown.
cgatatngagttcaccctgttgcgagacgaattttcggagttccggaaccgcttggcgatcttgatatgtacaccgcgaaggccggagtgctcacttttctccccgtgggtcaaagcccaggattagacattcagcaggtgtggtgtttcgaccctgttgctcaagcctggcgggtggacatgatgattgaatcaggaagccctgaagtatgggtatacaaacgggatgggtctatccggtttccccgtaccgaaatgttgtatctgagcagtgagggcattccatatttaaggccagcggcgatcctcttgttcaaagccctgcacgtgcggccaaaggatgaggaggattttcacaagaccttgccgacgctgcccgatgaggaggtggcgtggctgaagcggcatttgctgaagcttcatccggggcatcactggataaccccgtcatga

SEQ ID NO: 187 - DNA, 444 bp, Staphylococcus epidermidis
agaagcatgaagggccttttgcaacgggtgcgtggcgcccgggtcgaggtggcggggcaagtggtgggcgcgatagaccagggtttgctggtactggtggccgttgaaccttcagataccgccgccagtgccgacaagttgttgcataagctgcttaactaccgggtgttcagtgacgacgagggcaagatgaacctgtcgttgaaggacattggcggtggtttgctgctggtgtcccagttcaccctggcagccgataccaaaagcggcctgcgtcccagcttctccaccgcggcgccaccggcgttgggcgaggcgctttttgagcacttgttgtcacaagcgcaacaattgcatggcacggtggcgtcggggcgttttggcgcggatatgcaggtgcatttggtcaatgacgggccggtcaccttccttttacagacctga

SEQ ID NO: 188 - DNA, 228 bp, Staphylococcus epidermidis
cccgcgccgaacaggcaaaacagggcggagcccgtcaccagtgcgtttcgtaaccgtttggcagacaattttggtgcattacagggactaacaatcacgagcaaccctcgccgaaaacagatcaaaaaaccaacggccagctatctatatgccaggttggcgagcattgttccgactccgatggggctaaatgattccccaagggcgaccggacaagtctctacctaa

SEQ ID NO: 189 - DNA, 711 bp, Staphylococcus epidermidis
tttggtgaagaccttgagcgcattcgcgagcacctggggattgaaaaatgggtgctgttcggtggttcctggggctcgaccctggccctggcctatgcacaaacccaccctgatcgcgtgcttggcctgattgtgcgcggcatcttcctggcccgcccccaggatatccagtggttctaccaggccggcgcgagccgcctgttcccggactactggcaggactacatcgcgccaatcccggtggaagagcgccacgacatgatcagcgcctaccacaagcgcctgactggcaatgaccagatcgcccagatgcatgccgccaaggcctggtccacctgggaaggccgcatgctcggcctgtgccccagcccgcagttgatcgagcgcttctccgagccccagcgcgcgttgtcgattgcgcgcatcgagtgccactacttcaccaataactcgttcctggagcccaaccagctgattcgcgatatgcacaagatcgcccatctgccggggatcatcgtgcatggccgctacgatatgatctgcccgctggataatgcctgggagctgcaccaggcctggccgaacagtgagttgcaggtgatccgcgaggcgggccacgcggcgtccgagccgggcatcaccgatgcgctggtgcgtgcggcgggcgagatggcacgacgcctgcttgatctgccccctgaagaagcatga

SEQ ID NO: 190 - DNA, 183 bp, Staphylococcus epidermidis
tcgcgtgcttggcctgattgtgcgcggcatcttcctggcccgcccccaggatatccagtggttctaccaggccggcgcgagccgcctgttcccggactactggcaggactacatcgcgccaatcccggtggaagagcgccacgacatgatcagcgcctaccacaagcgcctgactggcaatga

SEQ ID NO: 191 - DNA, 225 bp, Staphylococcus epidermidis
caacaagtgctcaaaaagcgcctcgcccaacgccggtggcgccgcggtggagaagctgggacgcaggccgcttttggtatcggctgccagggtgaactgggacaccagcagcaaaccaccgccaatgtccttcaacgacaggttcatcttgccctcgtcgtcactgaacacccggtagttaagcagcttatgcaacaacttgtcggcactggcggcggtatctga

SEQ ID NO: 192 - DNA, 207 bp, Staphylococcus epidermidis
tccgcgaggcgggccacgcggcgtccgagccgggcatcaccgatgcgctggtgcgtgcggcgggcgagatggcacgacgcctgcttgatctgccccctgaagaagcatgaagggccttttgcaacgggtgcgtggcgcccgggtcgaggtggcggggcaagtggtgggcgcgatagaccagggtttgctggtactggtggccgttga

SEQ ID NO: 193 - DNA, 1191 bp, Staphylococcus epidermidis
  unsure (1071): Identity of nucleotide at the above locations are unknown.
ctggccgttggttttttgatctgttttcggcgagggttgctcgtgattgttagtccctgtaatgcaccaaaattgtctgccaaacggttacgaaacgcactggtgacgggctccgccctgttttgcctgttcggcgcgggtcaactgtgggcattcagcctggacgatgtgtcggccaaggcaaaagagctggccgggcagaaatacgaagccccgcgcagcaatctgccgaacgaattccgcgaaatgaagttcgctgactaccagaaaattcgtttccgcaatgaaaaagccgagtgggccgagcagaaaactccgttcaagctgtccttctatcaccagggcatgcacttcgacacgccggtgaagatcaacgaaatcaccgcgaccgacgtccaggaaatcaagtacgacccgactcgtttcgatttcggcgacgtcaagtttgatcctaaagccaccgatcagctgggttatgccggctttcgcgtgctgtacccgatcaacaaggacgacaagcaagacgaaatcatgaccatgctcggcgccagctatttccgcgtcgtgggcaaggaccaggtctatggcctgtccgcccgtggcatggcgattgataccgcgctgccgtccggcgaagagttcccgcgtttcaccgagttctggatcgagcgtccaaagccgggcgacaagcacctggtgatcttcgccttgctggattcgccgcgggccactggcgcctaccgcctgatcctgcgcccgggcaccgacaccattgtcgacgtcaagtcgcagatgttcctgcgtgacaaggtcagcaagctgggcgttgccccgctgaccagcatgttcctgttcggcgccaaccagccgtccaaagtgctcaactaccgtcgtgaactgcacgactccagcggcctgtcgatccatgccggtaacggcgagtggatctggcgcccgctgaacaacccaaaacacctgtcggtcagcaacttctcggtagaaaacccacgtggtttcggcctgttgcagcgtggtcgcaacttcagccagtacgaagacctcgacgacaantacgacaagcgcccaagcgcctggatcgagcctgaaggcgactggggcaagggttccgtggatctggtagagattccgaccgccgatgaaaccaagtgctcaccagcgggaagggcggag

SEQ ID NO: 194 - DNA, 261 bp, Staphylococcus epidermidis
tcatgtcgtggcgctcttccaccgggattggcgcgatgtagtcctgccagtagtccgggaacaggcggctcgcgccggcctggtagaaccactggatatcctgggggcgggccaggaagatgccgcgcacaatcaggccaagcacgcgatcagggtgggtttgtgcataggccagggccagggtcgagccccaggaaccaccgaacagcacccatttttcaatccccaggtgctcgcgaatgcgctcaaggtcttcaccaa

SEQ ID NO: 195 - DNA, 2667 bp, Staphylococcus epidermidis
gatggatgttctttttattttttaggaggtagacatatggaaatgaaaccaaaatatgatccaagagaagttgaaaagggtcgttatgaggaatgggtaagtaatggttactttaaaccatctgaagataaatctaaagaggcatatacaattgtaattccgccccctaatgtaacaggtaaattacatttaggtcatgcatgggatactactttacaagatataataactagaatgaaaagaatgcaaggatacgatactttatatctgcctggtatggatcatgctggtatagcaactcaagcaaaggttgaagcaaaacttaatgaacaaggtatatctagacacgacttaggaagagaaaaatttttacagcaagcatgggattggaaagaagagtatgcaacatttattagacaacaatgggctaaacttggcttagggttagattatagtagagaacgctttacgttagatgatggtttaagtaaagctgtaagaaaagtatttgttgatttatataataaaggtattatttatcgtggtgaaagaattattaactgggaccctatagctagaacagctttatcagatattgaagtcattcatgaagatgtccaaggtgctttttatcattttaaatatccttatggtgatgggaatggatatatagaaatagctactacacgtcctgagactatgttaggtgacactgctattgttgtaaatccaaatgacgaaaggtataaagatgtgattggtaaaacagttatattacctattgtaggaagagagttacctattttagctgatgaatacgttgatattgaatttggttcaggagcaatgaaagttactccggcacatgatcctaatgactttgaaattggtcaaagacatcaattagaaaatattatagtcatggatgaatatggtaagatgaacgataaagctgataaatacaaagggatggatagatttgattgtagaaatcagcttgttaaagacttaaaagaacaagatcttgttataaaaattgaagaacatacacattcagtaggacattctgaacgttctggtgcaatagtagaaccttatttgtctacacaatggtttgtaaaaatgaaacctttggcacaaagagctttggataatcaaaatacaaaagatagaattgactttttcccaggtagatttgaaaatacattcaatcgctggatggaagaaattagagattggacgatttcgcgtcaactatggtggggccaccaaatacctgcttggtatcataaagatacaggtgaagtctttgttggtgaagaagcacctgaagacatcgagaattggatacaagatgaggatgtattagatacatggttctcaagtgcactttggccgttttcaacattaggatggcctgatacaaatgctgatgattttaaacgttattatccgacaaatgcattagttactggttatgatatcattttcttctgggtagcccgtatgattttccaaggattagaatttactgatagaagaccatttaatgatgtattactccacggtttagtcagagctgaagatgggcgtaaaatgagtaaatcattaggtaatggcgttgatcctatggatgttattgacgagtatggcgctgatagtctacgttactttttagcaacaggatcttcaccaggtcatgacttgagatattctactgaaaaagttgaatcagtttggaattttattaataaaatatggaatgctgcccgctttagtttaatgaatattggtgaagattttaaagtcgaagatatagacctaagtggtaatttgtcattagcagatcaatggatattgactagattaaatgaaacgatatctacagtaaccgaattaagtgataaatacgaatttggtgaagtaggtcgtgcgctttataatttcatttgggatgagttctgcgattggtatattgaaatgagcaagatacctatgaatggcgaggacgaatctcaaaagcaaacgacgcgatcagtacttagttatgttttagataaaataatgaaaatgttacatccatttatgccttttgtgacagaaacaatttggcaaagtcttccacatcatggagaaacaattgtaaaagctaactggccaactgttgatcaagcattaatctttaatgaaagtaaacaaacaatggaacaattagttgaaattattaaatctgtccgtcaatcaagagttgaagttaacacaccgttatctaaggcaataccgattttaattcaaactaaagatgaaaagattaaacatacacttatggataacataagttacctacacaaattctgtaatccaagtcaattgactattgatactgagattgaaattccagaaaaagctatgacaactgtagtagttgctggtaaggtagttttgccattagaaggtcttattgatatggacaaagaaattgctcgacttgaaaaagaattagataaattacaaagcgagttagatagagtagataaaaagttatccaacgagaattttgtaaataaagcaccagaaaaaataattaatgaagaaaaagaaaaacaacaacattatcaagaaaaatataatggtgttaaatctagaattgaacaattaaaggcatag

SEQ ID NO: 196 - DNA, 1329 bp, Staphylococcus epidermidis
attagtcaatcatggaggtatttatacatgacagcaacttgggaaaaaaaggaaggtaatgaaggcgttttaactgttactgttcctgcagagaaagtaaataaagcattagatcaagcatttaaaaaagtggtcaaacaaattaatgtgcctggattccgtaaaggtaaagtgcctcgtccaatttttgagcaacgttttggtgtagaagcactttatcaagatgcagtggatattttattacctgaagcttatggtgaagcaattgaagatacagaaattaatccagttgcacaaccagaagttaatgtaactcaaatcgaaaaaggtaaagatttcatttttgaagctacagttacagttgaacctgaagttaaattaggtgattacaaaggattagaaattgaaaagcaagaaactgacctttctgatgaagaattacaagaatcaatcgaccatagcttaagtcaccttgctgaaatggttgttaaagaagatggtgctgttgaaaacggtgacacagtaaacattgatttctcaggttcagttgatggtgaagaatttgatggtggacaagctgaaggttatgacctagaaattggttctggatcattcattcctggctttgaagaacaaatagaaggaatgaaaactggcgatgaaaaagatgtagttgtaacattcccagaagaataccacgctgaagaattagctggtaaagaagctacatttaaaacaaaagtcaacgaaattaaattcaaagatgtaccagaattaaatgatgagattgctaacgaattagattctgatgctgaaaacgtggacgaatataaagaaaatcttcgcaaacgtttaagtgaacagaaagcaactgaagctgaaaatactgaaaaagaagaagctattaataaagcaacagaaaatgcttcaattgatattcctgaagcaatgattaatactgaattagatcgtatgattcaagaatttggtcaaagaatccaacaacaaggcttagatttgcaaacatattatcaaatctctggtcaaaacgaagagcaactaagagaccaaatgaaagacgatgcagaacaacgcgttaaaacaaacttaacgttaactgcgattgctgatgaagaaaatattgaagtatctgatgaagatattgataaagaattagaaaaaatgagcgagcaatttaacatttctgtagaagatattaaatctactttaggtaatacagatattgttaaaaatgatgtacgcattcaaaaagttattgatttattaagagataatgcgaaatatgttgaagctactaaagaagactag

SEQ ID NO: 197 - DNA, 1269 bp, Staphylococcus epidermidis
aaaagaatgttcaaattcaatgaagatgaagaaaatttaaaatgttctttctgtggtaaagatcaagatcaagtaaaaaaattagtcgcaggaagtggcgtttatatttgtaatgaatgtattgaattgtgctcagaaatcgttgaagaagaattagcacaaaatacatctgaaggatttacggagttaccaactcctaaagaaattatggatcacctcaatgaatatgtcattggtcaggaaaaagccaaaaaatcattagcagttgctgtatataatcactataagcgtattcaacaattgggtccgaatgaagatgatgttgaattacaaaaaagtaatatcgcattaattgggccaactggtagcggtaaaacattattagctcaaacactagctaaaacactaaatgtaccatttgcaattgctgatgctacaagtttaacagaagcaggttatgtaggtgatgacgtagaaaacatcttattacgtcttattcaagctgctgatttcgacattgataaagctgaaaaaggtattatatatgtcgatgaaattgataaaattgcgcgtaaatctgaaaacacttcaatcacgcgtgacgtgtctggtgaaggtgtacaacaagcattgcttaaaattttagaaggtacaactgctagtgtaccgcctcaaggtggtcgaaagcatccaaaccaagaattaatccaaattgatacgacaaacatcttatttatcttaggtggagcttttgatggtatcgatgaagtcattaagagacgcttaggagaaaaagtgataggatttgctagtaatgaagcagataaatatgatgaagaagctttactggaacaaattcgtccagaggatctccaatcatatggcttaattccagaatttattggtcgtgtacctatagttgctaatcttgaaactttagatgttgctgcacttaaaaatattttaactcaacctaaaaatgcgctagttaaacaatacactaaaatgctagagttagataatgtagaattagagttttctgaagaggctctatctgctataagtgaaaaagcaatcgaacgtaaaacaggagcgcgtggattacgttcaattatagaagaagcattaattgacatcatgtatgatgtaccttcttctgaaaatgtaagtaaagtagtcattactgaacaaacaattaatgaagaaattgagcctgaattatatgatgatgaaggaaatctaattaataagaacaagacatctgcttaa

SEQ ID NO: 198 - DNA, 333 bp, Staphylococcus epidermidis
gatactaattttagtcatatagaggtgttctgggtgcttaagttttttagaaataacaagctcattgtcgttttatgtgcaatgattatttttattgcattaatagggttatcgatacgttctcagacccaatctccagctgaacaatacgtaggagactctgtatcatttggacaaagagtaatcagttatccaattcaatttgttactggatctattggtgatttatttgaaaaaggaagctcaaaaaaggataaaaataaaatcaaacaacttgaagctaaaaatgaagagttagaatcagcaaataagaaatataacaacagaacttga

SEQ ID NO: 199 - DNA, 324 bp, Staphylococcus epidermidis
agtaaccattacttacccattcctcataacgacccttttcaacttctcttggatcatattttggtttcatttccatatgtctacctcctaaaaaataaaaagaacatccatcctataaaaaataggacggatgttctgttccgtggtaccacctatattcaagaagaaataattcattcttttcttcaagcacttaagtctctgattaacgctcatacacggcttctacctacttgtcgtctatgtttcaatagaagttataaaatagggctaccttcagacttaatcatttacatattcacagccaccatatgctctctttaa

SEQ ID NO: 200 - DNA, 222 bp, Staphylococcus epidermidis
tactacatatacaatataagtgatttaaggaggttcaacataatgagcattttgacgattattttaattgttttgctagtcatcctcttatttaaagttggattatctatattacgctttttgatttcagtaggcattgttttgttatgtatctatttaggttatcaaggtgtattatggttatttgaacattttcaaaacttttcaggttttattcgataa

SEQ ID NO: 201 - DNA, 381 bp, Staphylococcus epidermidis
agatcatctaaggaggaatttattatgccacgagttaaaggtggaacagtaacaagagcacgtcgtaaaaaaacgattaaattagctaaaggttactttggttcaaaacatacattatataaagtagctaaacaacaagtaatgaaatcaggtcaatatgctttccgtgaccgtcgtcaacgcaaacgtgatttccgtaaattatggattacacgtattaatgcggctgcacgtcaacatgacattagctactcacgtttaatgaacggcttgaaaaaagctgagattgatatcaatcgtaaaatgttatcagaaattgcaatctcagatgacaaagctttcgctgaattagtatcaaaagctaaagaagctttaaaataa

SEQ ID NO: 202 - DNA, 930 bp, Staphylococcus epidermidis
cgtatgcgtaaattaattgttgggtcgcgaagaagtaaattagcgctaacacaaagtcaacaatttatagataaattaaaatttatcgatccgtctttggatattgaaataaaagaaattgtaactaaaggcgacaaaattgtagataaacaattatccaaagttggaggtaaaggactttttgttaaggaaatccaaaatgaattatttaataaagagatagatatggcgattcattctctaaaagatgtaccaagtatgattcctgacggtcttaccttaggatgtattcctgacagagaaattccttttgatgcctatatagcaaaaaatcatataccattacaagaattgtctgagggcagcattgtaggtacaagttctttacgtcgtggcgctcaaattttatcaaaatacccacatttaaaaattaagtggattcgtggaaacattgatactcgattaaaaaaattagagactgaagattatgatgctattatattagctgctgctggattaaaacgcatgggttggtcagataatattgttacgacttatcttgatcgagatatattactgccagctatagggcagggtgcacttggtattgagtgtaggagtgatgacaaagaacttttagatttactatctaaagtacacaatcatgatgtagcacaatgtgtgactgctgaacgtacttttctatcagaaatggatggcagttgtcaggttcctataggtggatatgcaacaattgctcaagataaccaaattgaatttacaggactgattatgtctccagatggtaaggaaagatatgagcatacagcattgggtactgatcctgtaaaattgggtatagaagtgagtcaagtacttaaaaaacaaggtgcttatgacataattaaaaaattaaacgaagcagaataa

SEQ ID NO: 203 - DNA, 522 bp, Staphylococcus epidermidis
attatactaaatttgatttgtaaaaggagggcttatatgagatatatctttagtgttattaaaaatattattgcagtattagcgataatattgattatatatatagctcttcaacatgcaccatttctcaaaaatcaagaatggaacccacttaatgatatgaacaatcatcatcaaaatatcacacagaaagtgagtcaaaaaaataatacactctattcacaacctagtaacgataaaagttacattttaaaagaaaatgatatcatcaataatgttccagcaggtcaaattaagacagtttttaatatgattgataaggcagaatttatgtctgtttcaggtttagaacgtatgggattcaatgacgaatatcttgctggccaacaaggtgacgaatttattatttataaattcggtgatgattatatccgagtttataatactgaattcgaaatgaacgaagacctaaatcaattaaaacaacctattaatttgaagccaattgaagcctatcaataa

SEQ ID NO: 204 - DNA, 234 bp, Staphylococcus epidermidis
atcctggtgaagaggcctataggaaatgaatcatgcctaggaatgaaaactcaccgtggagcagctaaacgtgttaaaagaactggttcaggtcaattaaaacgttctagagctttcacatctcacttattcgcaaataaaaatactaaacaaaaacgtcaattacgtaaagctaagttagtttctaaaagtgatatgaaacgtgttaaacaattattagcatacaaaaaataa

SEQ ID NO: 205 - DNA, 186 bp, Staphylococcus epidermidis
aaagtagggaacaaaatgaaatttgatagacatagaagattgcgttcatctaagacaatgcgtgatttagtaagagaaactcatgttagaaaagaagatttaatatatccaatatttgtagttgagcaagatgatataaaaagtgaaattaaatcactaccaggcatataccaaattagtttttaa

SEQ ID NO: 206 - DNA, 486 bp, Staphylococcus epidermidis
agtaaatatgaagtgaaaagacgtggtgatatggaagatgatccatcgtttaaacaattaatatcatattgcctactagaaaatgagaagggtgaaatccttatttacgaacgtctttctggtggtggagaagaacggttacatggtcagtcatcaatcggtgttggtggtcatatgaacgatgttgttggagctgattctattaatgaagttttaagagttaatgctcaaagagaattagaagaagaagtaggattaagtaataataaatctcaaaatatggaatatttaggttttataaatgatgatgacaatgatgtgggtaaagttcatatgggcgtcgtatttaaaatcactgtgcattcaaacgatgttgaagctaaagaaactgatacgctaaaaattaaatggatagaacaaggcgacattcaatcctatgaggattttgaaacatggagtgcattaattcttcaagatatatcatga

SEQ ID NO: 207 - DNA, 825 bp, Staphylococcus epidermidis
tttggtgatgatatgcaagaaaccctgttaattcgatttcatgaaatcatattaatgatttatctgtttagtattatatgttactttgttgatttcattaataaaaattataagactagaactgtaggtttttattcattagggattgtttgggttttacaaacaatctctttgtctattttttttattcatactaaacaagtgccactaggttctatatttgacgtttttttctctttaacttggattattatatcaatttcgttgatattgaatttgattaaagtaatgaatttttctgtttttttccttaatttgattggatttatcctaatgagtttaaatacttttcagcctgaacattatcaaacgcaaattcaacaaattgcagtaattaatgaattattacttgttcatatagcacttgcagtattaagttatgcattttttgcaatcgcatttgtaaattcattactctacattattcaatatcgaaatttaaaggagaaaaatttcgatcaaaattactttagaattggtagtgttgctactttagaaaccatcgttttctattcaacacttgttgcatggattatccttatattaagtacgattttaggtgcacaatggggtatctttgcagtcggtaaacaaatatttatagatccaaaagtaatattttcaacaattattactttattatatggtgtttatattttcattagaataaaaaaatggatatcacaaagaaatcttatctactttaacattatattattttgtttgtgtatgattaatttattctttttaactcattttagataa

SEQ ID NO: 208 - DNA, 264 bp, Staphylococcus epidermidis
tcttcagcacttgtagaactaattactatgtccgttgtttctaataaagatggtaatgctgaaagtgaatcatatgaaacattgtgtttttcggctaaaattttagctttagataatgtccgattaacaattgttacatttgaaattccagaacctaaaagatttaagagtgataattcacccatttcccctgctccaataacgacagcatgtttactttttaattttccaaatacctttttagctaattcaacagcagcataa

SEQ ID NO: 209 - DNA, 627 bp, Staphylococcus epidermidis
tatattattttactcatttatattataatggatattaaaataagtcaatgtattggagatgaaattatgaatgaatgtgcttttaacacaactgatcctatctatatagagtatcatgattattattggggacaaccaatctatgatagcaaagaattatttaagctaatggctcttgaatcacaacatgcaggattatcatggttgacaatattaaagaaaaaagaatcgtatgaacaggcattttacaactttgaacctcaatttatcgcacatatgactgaacaggatattgattatttaatgaaattcccaaacattattcataatcgtaaaaagttagaagcaattgtgagccaagcgaagggatatttaaaaattgaaaaagactatggtagttttagtaaatttttatggtcttatgtaaatcatcaacccataaatatgggttataaaaaacctagagatcgtaaaaaagttgatcaaagagctactcaattatcaaaagatttaaaagcatatggttttaaatttttaggtccagtaaccgtgttctcattcttagaagctgctggattgtatgactcacatcttgaaggatgtcctttcaaaccaaatcatgagtga

SEQ ID NO: 210 - DNA, 618 bp, Staphylococcus epidermidis
ttatacaatagtataagaaagaggaagtctatgaatataaattttaataatattaacttaattataagtgctgtaaaaaaagcacagtatcctgacactggattaacagaagtagcgttaagtggacgctcaaatgtagggaaatctacatttattaatagtatgattgggcgtaaaaatatggcgagaacgtcacaacaacctggtaagacacagacattgaatttctataatatagatgaacaacttatttttgttgatgtaccaggatatggatacgctaaagtaagtaaagttcaacgagaaaaatttggtaaaatgattgaagaatatattacacaacgagagaatttaaaacttgttattcaacttgtcgatttaagacatcaacctactgaagatgatgtgcttatgtacaattatcttaaacattttgatataccaacacttgtaatatgtactaaggaagataaaattgccaaaggaaaagtacaaaagcatatcaaaagaataaaagacaaattagaattagaatctggagataatattataagttattcttcaattaaaaatagtaaacagcaagaaatttggaactttattgaaacatatatataa

SEQ ID NO: 211 - DNA, 1077 bp, Staphylococcus epidermidis
agtggtattttgaagcggaattttattaataatttaatcatattattaattgctattatgttaagtctgttattaaaaatgttacatgtgattttgccatttatgtttggaccaatattagcggcgttattatgtgtaaaagtattaaaattaaaaatacgatggccattttggttgagtcaaattggtttaatactacttggagttcaaattggctctaccttcacacaacaagtgattaaagacataagtaaaaattggctaactatcgtttttgtcactatcctactaattttattagctttgataattgcattcttttttaagaaaattgcacaagtaaatttagaaactgcaattttaagtgttataccaggtgcgctaagccaaatgttagtgatggcagaagaaaataagaaagcaaatatattagttgtgagtttaacacagacatcacgtgtaatatttgttgttattttagtaccacttatttcgtatttttttcaggataaccatcatgaaatgaatcatactacaatggaagtacccacactttctcagactttaaatatatggcaaataatcatcttattctcaatggtgggaatcatctatataggaatgtcaaaaattaacttccccactaaacaattattagcacctataatagttttaattatatggaatatgacaacacatttaacattttcactagatcattggttgttagccacagcgcaacttatttatatgatacgtattggattacagattgccaacttaatgagtgatttaaagggaagaattgcaatagcaatagcctttcaaaatataatgctcatagtcacaacgtttataatgataataggaatacatttgattactaatgaatccatcaatgaattgtttttaggagcagcaccaggaggtatgagtcaaatagttttagtggctatggctactggagctgatgtagcgatgatttcaagctatcacatttttagaatattttttatattatttgtcattgcgccactaattggttattttattaatgttaaattaaataataaatga

SEQ ID NO: 212 - DNA, 1284 bp, Staphylococcus epidermidis
aggcataggagcatgatcatgaattacctagacagcttgtattggatacacgaaagatctaaatttggtatcaaacctggcgtcaaacgtatggaatggatgctagaacaattaaataatccccaacataaaattagaggtattcatgtgggtggaacaaatggtaaaggttcaactgttgcatacttgagaaccgcattaattgagaacgattactcagttggaacatttacctcaccatttattgaaagtttcaatgaacgtattagtttaaacggtgtaccaattatgaacgatgaaattgttcaattagttgaacgagttaaacctgttagtgaagccttagagatagaaacagatttaggtggggctactgaatttgagattataacaacaatgatgttcctttattttggtgagataaatcctgttgattttgtgataattgaagcaggtttaggaattaaaaatgattcgacgaatgtttttaaacctgtgctatccatactcacaagtataggacttgaccatacagatatcttaggaacaacttatttagatattgcaaaagataaggcagctataattaaaccacatataccgattgtttatgctgtaaaaaatgacgatgctttaaagtatgtgagagattatgcgcttgaacagaacgcaaaaccaattgaattggatcgggagattaccgttgtctcccaagatgatgagttcacatatcggtataaagattatgaattagaaactatcattcttaatatgttaggggaacatcaaaaggaaaatgcagcacttgctattactgctctcattgaattaaatgaaagacaaatcatagaattagattttaataaaatgatagacggtatagaatctgtgaattggacaggtagaatagaacaagtaaaagaacaaccattaatggttattgatggtgctcataataatcgaagtattgatgcgttagtagacacaataagacattattatggaagagataaaattgatattttattttctgcaattaaaggaaagccaattcatagtatgattaacaaattaaatgatattgcatcaaaattctatatagcagattttgagtttccaaaagcattagctaaagaagaaattgccgaagaattgaaattagataatttacatttaattgatgattatgttgattttattgaaaattacgaaggtgatgggctgattattactggaagtttatacttcatcagcgaggtaaaagcaaaaattaattttaattaa

SEQ ID NO: 213 - DNA, 690 bp, Staphylococcus epidermidis
aataaatttatgaaaccagttatagttatgacgcagacgaatgaagttcatagtcatttagttgatattatccataagccttttatccaactaaaacaacttcattttaatgaaaaattgcttgatcatagctacgactggcttattttttcgtctaaaaacgcagtaaaatacttttatccttatttaaaaaacgttaaagttaaaaaggtagctgttataggtgataagacagctcagtattgtaatgaattaggtattagtgtcgactttgtgccacgtgatttttctcaagaaggctttttggacgagtttaagattagcgaacaacatttattgttgccctcaagtgaaaaagcacgttctaaattagttcaacaattgagcaaatataatgaagtcgttaaaattgatttatatagaccagtaccgaattttaaaaatataagtcaagttaagtctcttgttagaaaacatcaaatagacgcagtgactttttctagttcctctgcagttgaattttatttcaaagaggacaatgtgcctgaatttgatcattattttgctatcggtaagcaaactgctaggaccattttaaaattcaatacatctgtaaaagtggcaaataaacaaacattagattcacttattgataaaataatagaaagtagggaacaaaatgaaatttga

SEQ ID NO: 214 - DNA, 1296 bp, Staphylococcus epidermidis
ggaggtcatatgatgagttttgaaaaatctattaaagcaatggagcaagctgagaaattaatgcctggcggtgttaacagtcccgtaagagcatttaaatcagtagacacaccagctatttttatggatcatggtgaaggatctaaaatatatgatattgatggaaatgaatacattgattatgtgctaagttggggcccattaattctgggacataaaaatcaacaagttatatccaaattacatgaagcagtagataaaggtacaagcttcggcgcttcaacacttcaagaaaataaacttgctgaacttgtgattgaccgtgtaccttcaattgaaaaagtaagaatggtttcctcaggaactgaagctactttagacacacttcgtttagctaggggttatacaggacgtaataaaattataaaatttgaagggtgttatcatggacacagtgattctttattgattaaagcaggatcaggtgttgcaacactaggtttacctgattcaccaggcgtccctgaaggtattgctaaaaacactatcacggtgccatataatgatttagattcacttaaattagcgttcgaaaaatatggcgatgatattgctggtgttattgttgaaccggttgctggaaatatgggtgtagtgcctccagtgaatggatttctacaaggtttaagagatattactaatgaatatggagcattacttatatttgatgaagtgatgactggtttccgtgtaggttataattgtgcgcaaggatactttggtgtaacacctgatttaacttgcttaggaaaagtgataggtggaggtttacccgttggagcttttggtggtaaaaaagaaattatggattacattgctcctgttgggactatttatcaagctggcacactttcaggtaatcctttagcaatgactagtggttatgaaacattgagtcaacttactcctgaatcttatgagtattttaattctctaggagatatacttgaaaaaggattaaaagaggtatttgctaagcataatgttccaatcacagtaaatcgcgctggttcaatgattggttacttcttaaatgaggggcctgtaacaaattttgaggaagcaaataaaagtgatttaaaattatttagtaatatgtatagagaaatggctaaggaaggtgttttcctaccaccttcacaatttgaaggaacatttttatcaactgcacatactaaagatgatattgagaaaactatccaagcatttgataatgcattaagtcgtattgtgtga

SEQ ID NO: 215 - DNA, 297 bp, Staphylococcus epidermidis
gcagatgtcttgttcttattaattagatttccttcatcatcatataattcaggctcaatttcttcattaattgtttgttcagtaatgactactttacttacattttcagaagaaggtacatcatacatgatgtcaattaatgcttcttctataattgaacgtaatccacgcgctcctgttttacgttcgattgctttttcacttatagcagatagagcctcttcagaaaactctaattctacattatctaactctagcattttagtgtattgtttaactagcgcatttttaggttga

SEQ ID NO: 216 - DNA, 669 bp, Staphylococcus epidermidis
atatttacctttaataccatttatattcttatcattcgtagtaacttcatcagtttatcaccaacttttatttcttttaaggggagaattttattgagaataaatgaaatggcactgcatgaaaaacctagagaacgtttaattacatatggcgctaaaagtctatccaatgttgaacttttagcaattctcttaaacactggtagaaaaggattttctagtattgacattgcaaacgaattactgaagcaacaatccactattagagatttaaaaaaattgtctataaatgatctactgaaaataaagggcattggactttataaagctgtaatattacaggctgcatttgaactaggtgaacgtattaattctacaagcacttttgacaaagtacagattacacatcctagtgatgttgctagtctgatgatgtcgacaatgaaagatttagagcaagaacattttgttgtacttttacttaactcaaaaaatatagtcacaaaacaagcttgggtatataaaggcacattgaatagttcgattattcatccaagagaagtatttaatattgcaataagagagtcttctaattcaataatagttgtacataatcatccttcaggtgatgtaacaccttctgaaagaggatatgaatacaacgtatag

SEQ ID NO: 217 - DNA, 960 bp, Staphylococcus epidermidis
ttcttcaagatatatcatgattggagtgctaaattaatggctgatattataccttttccacagtttaaaagtaaaatgattaagcaaataaatgatgcagaaagaaatgcagattttgaaaagatgtatcaattgtttaatgtatatgaacagcatttcgaccccaacgaggagattgcactaaagaaatgccagatgcttttacaattgaatgcttatttagagttacgagaagaggcaattattttgttaaaacgtggattcaactgttatgacgaattgatgatatattatattaaaagtctgaatggcttaggtcaatttaatgaagcagttgaagtaattaatcaaattatcgatgaagttaaaaatcataaaaccagaatggaactttttccacttaaagaatatgcgatatcgagacttgatgaagatagaaaggcattgtcctcatctttatcagatttcggttcgcttaacacacgtgaacaaacttctttaatattacaacttattgataatggacattataattttaaagaatcagtagcgaatatactaatttctatggatttaccaaaaaatttagtgagcttaatgttggaatatttaagatttgctgaatattctcatacaattacaatccataaatatggtgaaactatcaatgtaaaccctaatcatttaagtggcattgagcatacgacgataaaagacaaggtcattcctgtcgtaatgaatagattagaagatggagcgttgcatattttaaaagaagcacaacatattatgaataatcattctatactcatgtatcctatagatatagagtcgttatacactattgataattggatagatgcatatgatgtttacttcaaacaattaattggtatagatataaatggctgtaacaatgatactttacaattcattaaatcattagataatgaaatgtaa

SEQ ID NO: 218 - DNA, 1347 bp, Staphylococcus epidermidis
atgcattttgttgcaattagcataaatcatcgaacagctgatgtaacattaagagagcaagttgcttttagagatgatgccttacgattagcacatgaagatttatatgaaactaaagcaattttagaaaatgtcattttatctacatgtaatcgtactgaagtatacgctattgttgatcaagttcatacaggacgttattatatacaaagatttttagcgcgctcttttggatttgaggtagatgatattaaagatatgtcggaagttaaagtgggggacgatgcagttgaacatttattgcgtgtcacttctggcttagattcaattgtgcttggtgaaacacaaattttaggacaaatgcgcgatgcatttttcttagcgcaaaatactggtacaactggaacgatttttaatcatttatttaaacaagcgattacttttgctaaaaaagcacacagtgaaacagacattgcagataatgctgtgagtgtttcttatgctgctgttgaattagctaaaaaggtatttggaaaattaaaaagtaaacatgctgtcgttattggagcaggggaaatgggtgaattatcactcttaaatcttttaggttctggaatttcaaatgtaacaattgttaatcggacattatctaaagctaaaattttagccgaaaaacacaatgtttcatatgattcactttcagcattaccatctttattagaaacaacggacatagtaattagttctacaagtgctgaagactatatcatcactaattctatggtgaaaacaatttcagaaactagaaaactggattcattagttctgattgatattgcggttccacgagacattgaaccagggattgatgcaattacaaatatttttaattatgatgttgatgatttgaaagatttggtagatgccaatttaagagaacgtcaattagctgctgaaactattgcaggacaaatacctgaggagattgattcacacaacgaatgggttaatatgcttggtgttgtacctgtaatcagagctttacgtgaaaaagctatgaatatccaagcagaaactatggaaagtattgatcgtaaattgccagatctctctgaaagagaacgtaaagtcatttcgaaacatacaaaaagtattatcaatcaaatgttaaaagatcctatcaaacaggctaaggaattaagtactgataaaaaaagtaatgaaaaattagagctatttcaaaacatatttgatattgaagccgaagatcctcgtgaaaaagcaaagttagaaaaagagagtagagcaaaggaaatcttagcgcatcgaatatttagttttgaataa

SEQ ID NO: 219 - DNA, 219 bp, Staphylococcus epidermidis
actgatgaagttactacgaatgataagaatataaatggtattaaaggtaaatatttaatatctttaaaagaaaaaatttttaaaattatggcaaaaatccccccaatgataaacgtaaatacaacaataaaaaagaaaaaatttaacggaaatataagtcccaatatattaaaaagcaatatgtctccataccctataaatttagatgcgaatagataa

SEQ ID NO: 220 - DNA, 714 bp, Staphylococcus epidermidis
tatatgctattacttgcctatacttgtagcattatatttagttttctttatcaattttgcaatcaaaatatattaaaacttcaatatctttattctaggtctcactgtgatttttgtcatactatcataaaacccttagatttactgcctattataagttttttaaaacttcgtggacaatctcgttgttgtaatcaaccattacaacgtttatatttaatcggagaactcgtttcgtttggtgctattttcctctattatcctactcattttaatatacacttcacattatttttaataactttcctgtttctactgacgatgtgtctttacgatattcactcaatgcatattgatatgagactcttatttgtatacacagtcgtatctgtttttacaacccaaacctattttggtaattttataatgatatttttgatttcacatgttatttatctattcgcatctaaatttatagggtatggagacatattgctttttaatatattgggacttatatttccgttaaattttttcttttttattgttgtatttacgtttatcattggggggatttttgccataattttaaaaattttttcttttaaagatattaaatatttacctttaataccatttatattcttatcattcgtagtaacttcatcagtttatcaccaacttttatttcttttaaggggagaattttattga

SEQ ID NO: 221 - DNA, 297 bp, Staphylococcus epidermidis
gttaaaatatttttaagtgcagcaacatctaaagtttcaagattagcaactataggtacacgaccaataaattctggaattaagccatatgattggagatcctctggacgaatttgttccagtaaagcttcttcatcatatttatctgcttcattactagcaaatcctatcactttttctcctaagcgtctcttaatgacttcatcgataccatcaaaagctccacctaagataaataagatgtttgtcgtatcaatttggattaattcttggtttggatgctttcgaccaccttga

SEQ ID NO: 222 - DNA, 861 bp, Staphylococcus epidermidis
aaagtgaaattaaatcactaccaggcatataccaaattagtttttaaaaaaaaaattttattgcatgaagagattaaagaggcatatgatttaggtattagagcaatcatgttcttcggtgtgccaaatgacaaagacgacattggatctggtgcatatgatcataatggagttgttcaagaagcgacacgaatatctaagaatttatataaggatttacttattgttgcagatacttgtctttgtgaatacacagaccacggacactgtggcgttattgacgatcatacgcatgatgtagacaatgataaatcacttccattacttgtaaaaacagctatttctcaagttgaagctggagctgacatcattgctccaagtaatatgatggatggttttgttgctgaaattcgtgaaggccttgatcaagcgggatatcaaaatattcctatcatgagttatggtattaaatatgcatcaagctttttcggtccattcagagatgctgcagattcagcaccttcttttggggatagaaaaacctatcaaatggatcctgcaaaccgattagaggcattaagagaattggaaagtgatcttaaagaaggttgcgatatgatgatagttaaaccatctttaagttatctagatattattagagatgtaaaaaataatacgaacgtgccagtcgtagcaaacaacgttagtggagaatatagtatgacaaaagcagcagcgttaaatggttggatagatgaagagaaaattgttatggaacaaatgatatctatgaaacgtgcaggtgctgatttaataattacttattttgcaaaagatatctgtcgttatttagataaatag

SEQ ID NO: 223 - DNA, 351 bp, Staphylococcus epidermidis
ctgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtag

SEQ ID NO: 224 - DNA, 1845 bp, Staphylococcus epidermidis
agggagcgtcttatgaagtggcttaaacaactacaatcccttcacacgaaactcgttattgtttatgtactactcattattattggtatgcaaatcatcggtttgtattttacgaatagtttagaaaaggaattactcgataacttcaagaagaacataacacaatatgcgaagcaattagacgtcaatattgaaaaggtttataaggataaagataaaggttcagtcaacgctcaaaaggatatccaagaccttttgaatgaatatgcgaatcgtcaagaaataggagaaatacgctttattgataaagaccaaatcatcatggcaacaaccaagcagtctaaccgtggtcttatcaatcaaaaggttaacgacgggtcagttcaaaaggcgctctccttagggcaaacgaatgatcatatggttcttaaggattacggaagtggtaaagagcgtgtttgggtatacaatataccggttaaagtcgataaacagacaatcggtgatatatacatagaatcgaaaattaatgatgtatacaatcagctgaacaacattaatcagatattcatcgtagggacagcgatatcactattcattacagtgatactaggattcttcattgcacgaacgattactaagccgataaccgatatgcgtaaccaaaccgtcgagatgtctaaaggtaactacacgcaacgagtgaagatatacggtaacgatgaaatcggtgagctcgcacttgccttcaataacttatcgaaacgtgtccaagaagcacaagcgaatacagaaagtgagaaacgtcgtctagattccgttatcacgcatatgagcgatggtattcttgcgacagatcgccgtggacgtgtacgtattgcaaacgacatggcgctgaaaatgctcggtctcgcgaaagaagatgtcatcggctactacatgcttggtgtccttaacttagaaaatgaattctcattagaggaaattcaagaaaatagtgattccttcttgttagatattaacgaagaagaaggcattattgcacgcgtaaactttagtacgattgtacaagaaacaggtttcgtgacaggttacattgccgtattacatgatgtcactgaacaacaacaagtcgaacgtgaacgtcgcgaattcgttgcgaatgtttcacacgaattacgtacaccgctgacatctatgaatagttatatcgaagcacttgaagaaggtgcttggcaagataaagaattggcaccatcattcctatctgtcacacgcgaagagactgaacgtatgattcgtttagtgaatgatttacttcaattatctaaaatggataatgaatcagatcaaattacgaaagaaattatcgacttcaatatgtttatcaacaaaattattaaccgtcatgaaatggcagcgaaagatacgacattcgtgcgcgaaattccgcaacaaaccatctttgctgaaatcgatccagacaagatgacacaagtatttgataatgtcattaccaatgcaatgaaatattcacgtggcgagaaacgtgttgagtttcatgtgaaacaaaatgcactttacaatagaatgacgattcgtattaaagataatggtattggaataccgattaacaaggtagataaaatatttgatagattctatcgtgtagataaagcacgtacacgtaagatgggtggtacaggacttggtctagctatttccaaagagattgtcgaagcacataacggtcgaatttgggctaacagtgtagaaggacaaggtacgtcaatctttattacgcttccttgcgaaatcattgaagacggtgattgggatgaataa

SEQ ID NO: 225 - DNA, 792 bp, Staphylococcus epidermidis
atgaactggaaacttacgaagacacttttcattttcgtttttattcttgtgaacatctttttagtcatcgtttatattgataaagtgaataaatcacaagttaatgactcggaaaaggtaaacgaggtcaattttcaacaagaagaaattgacgttcccaaggatgtcttgaatcaaagcgtgaaagatactgaacttgaacaaattactgcccgttcaaaaaatttctcaagttatgcgaaagatcattcaagcctgcaaacgtctgattccgataaaacacttgaaggagatattgataaaggcgttcaagtgagtgataagaacttacaagatatcaaagagtacattgcaaagaaaatctttaacggtaaagagtatcaattaagtgatttaactaaagacaaagtcacttacgaacaaacgtataaagattatccaattatgaataatagtaaagcacgcctaacgtttaatttgagcgatggcaaggcgacaagctataagcagacagcgatggatgatatacaagtagctaaaggttcaaatagcacgaagaaacaagtcatcacaccgcgtaaagctattgaagccctttattacaacagatatctaaaacaaaatgatcaagtgctagacgcacgcttaggctattattcagtggtaaaggaaacaaatgttcaattactccaacctaactgggaaattaaagtaaaacataaaggcaaggatgaagttcaaacctattatgtagaagctacaaatcataatccgaaagtgattgattattag

SEQ ID NO: 226 - DNA, 705 bp, Staphylococcus epidermidis
tatatggctagaaaagttgttgtagttgacgatgaaaaaccaattgctgatattttagaatttaatttaaaaaaagaaggttacgacgtatattgcgcttatgacggtaatgacgcagtagatttaatctatgaagaagaaccagatatcgtcttacttgatatcatgttacctggtagagatggtatggaagtatgtcgtgaagtgcgtaaaaagtatgaaatgccgattatcatgctgacagcgaaagattctgaaattgataaagtattaggccttgaattaggtgcagatgattacgtaactaaaccatttagtactcgtgaactcatcgcacgtgtgaaagcgaacttacgccgtcattattcacaaccagctcaagaagtaagtggtgcgacaaatgaaattacaattaaagatattgtgatttatccagatgcatattcaattaaaaaacgtggagaagacattgaattaacgcatcgtgaattcgagctattccattatctttctaaacatatgggtcaagtcatgacacgtgaacacttactacaaacagtgtggggttacgattattttggtgatgttcgtactgtggacgtaacaattcgccgtttaagagaaaaaattgaagatgatccatctcatccagaatacattgtgacacgtagaggcgttggatacttcctccaacaacatgattag

SEQ ID NO: 227 - DNA, 807 bp, Staphylococcus epidermidis
gaaaggatgagtcgcttgatacgtatgagtgtattagcaagtggtagtacaggtaacgccacttacgtagaaagtgagaaaggtagcctactcgtcgatgtaggtttaactggcaagaagatggaagaacttttcagccaaattgacagaaacattaaggatttaaatggaatattagtgacacatgaacacatcgatcatattaaaggtcttggtgtcttagcacgtaaatataaacttccaatttacgcgaatgagaatacatggaaagcgatagagaagaaagatagtcgcattccaatggatcagaaatttatctttaatccatatgaaacgaaatctcttgcaggattcgatatagaatcatttaacgtgtcacatgacgcgattgatccacagttctacatcttccacaataactataagaaattcacgatgattactgacacaggttacgtttcagatcgtatgaaaggtatgattcaaggtagtgatgtctttatgtttgaaagtaatcacgacgtcgatatgttacgcatgtgtcgttatccatggaagacgaaacaacgtattttgagtgatatgggtcacgtatccaatgaagacgcgggccttgcgatgagtgatgtcattacaggtaatacgaaacgtatatacctctctcatttatcacaagacaataatatgaaagacctcgcacgcatgagtgttgggcaagtgctcaacgaacatgatatcgatacagagaaagaagtattgctctgcgataccgataaagcacaagccacaccgatttatacactataa

SEQ ID NO: 228 - DNA, 192 bp, Staphylococcus epidermidis
aaacttaatattcctatacatgcttatatttctataattaaaaatactgtcattacggcacttttgacatatacgaaaacgataaaatatgatgataaacctaaacaaaagcgtcaagcatattgcaaaagtctaacttattttgcggaactgtatttcaatggtaaaattataaataatattattctataa

SEQ ID NO: 229 - DNA, 1401 bp, Staphylococcus epidermidis
aaggacaaggtacgtcaatctttattacgcttccttgcgaaatcattgaagacggtgattgggatgaataacaaagaacatactaaatcaattattttagtcctactcgtcttgatgagtatcgttttgacatacatggtctggaacttttctccagacctttcaaatattgataacacggataatagtaaaagtgataagcctaaaccacttactaaaccaatgactgcagaaatggaaggaacaatcacaccatttcaaatcgtgcattctagagatgataaatctcaaggaacagtagcatcaggtgcagtcttagataagatgattcaacctttaaagaatcaagaagttaaatctgtatcacatctgaaaagggaacataaccttgttatccctgaactaagtaacgactttattgtcctagatttcacttatgatttgccactttcaacgtacttaagtcaagtactcgatatcgatgcgaaagtgccgaataactttaattttgatcgtctccttatcgatcaagatcataataaccacgtcgtactatttgcgattagcaaagaccgtcatgaagtagttaaacttaagacaacgatgaaagggaataatgttgataaagcttttaaaagtatcgaacctgacatgcagccctatacggaaatcatcacgaataaagatacaatcgacaaagcaacacacgtgtttgcaccaagcaaaccgaaagacttaaagacgtatcgcatggtcttcaatacgatcagtgttgaacgcatgaactcaatactatttgatgattcaacgattgttcgtagctctcaaagtggtacgacaacatacaacaacaatactggcgtcgccaactacaatgataaagatgaaatgtatcattataagaatttatctgaagacgcgaaaagttcaagcaacatgcaagaaaccatcccaggcacatacgagtttataaatagtcatggtggcttcttaaatgaagattatcgcttatttaaaacagataatagaacagggaaactcacatatcaacgattcctcaacggttacccaacgtttaataaacagaacttcaatgaaatccaagtcacatggggggataaaggcgtttacgattatcaacgttcgctacttaagacggacgtcacactgaacagtgaagaatctaaatccgtccctaccgttgagtccgtgcgttctgcattagccaaccatcctgatattgattttgaaaaggtaacgaacattgcgattggttatgatatggacgacaaggcaaataacgaagatattgaagttcaacgtaactgtgaattaataccacgttggtttgtagaatacgatggcaattggtatgcctataaagatgggaggcttgaataa

SEQ ID NO: 230 - DNA, 2541 bp, Staphylococcus epidermidis
ttcataccgtggggcacgtccaatggaagaaatccgtgtgagaaaaaacgcgaatttgatccaaacttagcgccaggtacagagaaagtcgttcaaaaaggtgaaccaggaacaaaaacaattacaacgccaacaactaagaacccattaacaggagaaaaagttggcgaaggtgaaccaacagaaaaaataacaaaacaaccagtggatgagattgttcattatggtggtgaacaaataccacaaggtcataaagatgaatttgatccaaacgcaccgaaaggtagccaagaggacgttccaggtaaaccaggagttaaaaatcctgatacaggcgaagtagtcacaccaccagtggatgatgtgacaaaatatggtccagttgatggagattcgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggggaaaaagttggtgaaggtgaaccaacagaaaaaataacaaaacaaccagtggatgagatcgttcattatggtggcgaagaaatcaagccaggccataaggatgaatttgatccaaacgcaccgaaaggtagccaagaggacgttccaggtaaaccaggagttaaaaatcctgatacaggcgaagtagtcacaccaccagtggatgatgtgacaaaatatggtccagttgatggagattcgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggagaaaaagttggcgaaggtgaaccaacagaaaaaataacaaaacaaccagtggatgagattgttcattatggtggtgaacaaataccacaaggtcataaagatgaatttgatccaaacgcaccgaaaggtagccaagaggacgttccaggtaaaccaggagttaaaaatcctgatacaggcgaagtagtcacaccaccagtggatgatgtgacaaaatatggtccagttgatggagattcgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggggaaaaagttggcgaaggtgaaccaacagaaaaagtaacaaaacaaccagtggatgaaatcgttcattatggtggcgaagaaatcaagccaggccataaggatgaatttgatccaaatgcaccgaaaggtagccaagaggacgttccaggtaaaccaggagttaaaaaccctgatacaggcgaagtagttactccaccagtggatgatgtgacaaaatatggtccagttgatggagatccgatcacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggggaaaaagttggtgaaggtgaaccaacagaaaaaataacaaaacaaccagtggatgagatcgttcattatggtggcgaagaaatcaagccaggccataaagatgaatttgatccaaatgcaccgaaaggtagtcaaacaacgcaaccaggtaagccaggagttaaaaatcctgatacaggcgaagtagtcacaccaccagtggatgatgtgacaaaatatggtccagttgatggagatccgattacgtcaacggaagaaattccattcgacaagaaacgtgaattcaatcctgatttaaaaccaggtgaagagcgtgttaaacaaaaaggtgaaccaggaacaaaaacaattacaacaccaacaactaagaacccattaacaggggaaaaagttggcgaaggtgaaccaacagaaaaaataacaaaacaaccagtagatgaaatcacagaatatggtggcgaagaaatcaagccaggccataaggatgaatttgatccgaacgcaccgaaaggtagtcaaacaacgcaaccaggtaagccaggagttaaaaatcctgatacaggcgaagtagtcacaccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggggaaaaagttggtgaaggtgaaccaacagaaaaaataacaaaacaaccagtggatgagatcgttcattatggtggcgaataa

SEQ ID NO: 231 - DNA, 1152 bp, Staphylococcus epidermidis
atcaagccaggccataaggatgaatttgatccaaacgcaccgaaaggtagccaagaggacgttccaggtaaaccaggagttaaaaaccctgatacaggcgaagtagtcacaccaccagtggatgatgtgacaaaatatggtccagttgatggagatccgatcacgtcaacggaagaaattccattcgacaagaaacgtgaattcaatcctgatttaaaaccaggtgaagagcgtgttaaacaaaaaggtgaaccaggaacaaaaacaattacaacaccaacaactaagaacccattaacaggggaaaaagttggcgaaggtgaaccaacagaaaaagtaacaaaacaaccagtagatgaaatcacagaatatggtggcgaagaaatcaagccaggccataaggatgaatttgatccaaatgcaccgaaaggtagccaagaggacgttccaggtaaaccaggagttaaaaaccctgatacaggcgaagtagttactccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattacaacaccaacaactaagaacccattaacaggggaaaaagttggcgaaggtgaaccaacagaaaaagtaacaaaacaaccagtggatgaaatcgttcattatggtggcgaagaaatcaagccaggccataaggatgaatttgatccaaatgcaccgaaaggtagccaagaggacgttccaggtaaaccaggagttaaaaaccctgatacaggcgaagtagttactccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattacaacaccaacaactaagaacccattaacaggggaaaaagttggcgaaggtgaaccaacagaaaaaataacaaaacaaccagtagatgaaatcacagaatatggtggcgaataa

SEQ ID NO: 232 - DNA, 408 bp, Staphylococcus epidermidis
atcaagccaggccataaggatgaatttgatccaaatgcaccgaaaggtagccaagaggacgttccaggtaaaccaggagttaaaaaccctgatacaggcgaagtagtcacaccaccagtggatgatgtgacaaaatatggtccagttgatggagatccgatcacgtcaacggaagaaattccattcgacaagaaacgtgaattcaatcctgatttaaaaccaggtgaagagcgcgttaaacagaaaggtgaaccaggaacaaaaacaattacaacaccaacaactaagaacccattaacaggggaaaaagttggcgaaggtgaaccaacagaaaaagttacaaaacaaccagtagatgaaatcacagaatatggtggcgaaaaaattcagcacggccctaaggtatga

SEQ ID NO: 233 - DNA, 300 bp, Staphylococcus epidermidis
ggtagtatcccaccaacgcctccacgtaagctagcgctcacgtttcaaaggctcctacctatcctgtacaagctgtgccgaatttcaatatcaggctacagtaaagctccacggggtctttccgtcctgtcgcgggtaacctgcatcttcacaggtactatgatttcaccgagtctctcgttgagacagtgcccaaatcgttacgcctttcgtgcgggtcggaacttacccgacaaggaatttcgctaccttaggaccgttatagttacggccgccgtttactggggcttcgattcgtag

SEQ ID NO: 234 - DNA, 303 bp, Staphylococcus epidermidis
cgcttgccacctacgtattaccgcggctgctggcacgtagttagccgtggctttctgattaggtaccgtcaagacgtgcatagttacttacacatttgttcttccctaataacagagttttacgatccgaagaccttcatcactcacgcggcgttgctccgtcaggctttcgcccattgcggaagattccctactgctgcctcccgtaggagtctggaccgtgtctcagttccagtgtggccgatcaccctctcaggtcggctacgcatcgttgccttggtaagccgttaccttaccaactag

SEQ ID NO: 235 - DNA, 294 bp, Staphylococcus epidermidis
gggagcttgactgcgagacctacaagtcgagcagggtcgaaagacggacttagtgatccggtggttccgcatggaagggccatcgctcaacggataaaagctaccccggggataacaggcttatctcccccaagagttcacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgtgggcgtag

SEQ ID NO: 236 - DNA, 351 bp, Staphylococcus epidermidis; identical to SEQ ID NO: 223

SEQ ID NO: 237 - DNA, 225 bp, Staphylococcus epidermidis
gccaacatcctagttgtctgggcaacgccacatccttttccacttaacatatattttgggaccttagctggtggtctgggctgtttccctttcgaacacggaccttatcacccatgttctgactcccaagttaaattaattggcattcggagtttgtctgaattcggtaacccgagaggggcccctcgtccaaacagtgctctacctccaataatcatcacttga

SEQ ID NO: 238 - DNA, 225 bp, Staphylococcus epidermidis
gcacacggtttcaagttctctttcactccccttccggggtacttttcacctttccctcacggtactggttcactatcggtcactagagagtatttagccttaggagatggtcctcccagattccgacggaatttcacgtgctccgtcgtactcaggatccactcaagagagaatatgtttccgactacaggattattaccttctttgattcatctttccagatga

SEQ ID NO: 239 - DNA, 207 bp, Staphylococcus epidermidis
ctgtgttggctttctaacccgcaccacttatcgtggtgggagacagtgtcaggcgggcagtttgactggggcggtcgcctcctaaaaggtaacggaggcgctcaaaggttccctcagaatggttggaaatcattcatagagtgtaaaggcataagggagcttgactgcgagacctacaagtcgagcagggtcgaaagacggacttag

SEQ ID NO: 240 - DNA, 366 bp, Staphylococcus epidermidis
ataatatccactgagaaatattcaaaagaaaaacacactttatttttaatatctagtcaccagttaaaagaattagaagatctttgtgatagatttctattactcgaaaaccatcaaattagagaaattgacttacataatagaatattcactcaaaagttaatattcaaaaatactttaaacaatgctccagaactaaaggctaatttcaatttcattaaaaaaattgatagcaattcaataacaattataaataaagatgaagaagtagatcttacaaatttacttaatttagtaggtaaaaatcccttaataaaaattgaaagtaatgataatctattatcttcatatttctataaagagtag

SEQ ID NO: 241 - DNA, 411 bp, Staphylococcus epidermidis
agagtaggtaatattatgtttaaatttaacttcttttatatttcaaagattcgtgcaacttggatgctttacctcattgggatttatcctctcttgatattcctagctgaattacttaatagtaattttctttcattatcagcaactcataagaatagtgtaagctttttagaattatttatcgcaatatatgatactcaacaaaaagtaatgctatcacttataattattggatatttatcttctttattattttatagcgaaattagcacaggaagactattgttttataaggatcaaagtcgctacaaaatttttaattctaaattaacatctattatttctagttactttatattcttcttcattttattattatcaacgtggctcttaaccgccgaatgcccccac

SEQ ID NO: 242 - DNA, 255 bp, Staphylococcus epidermidis
atggtaaattttaaaattgaaaaattaaaactaaataatttattcatatcactaagtattgttattattactactattgtactaaatataagcattggaataatatcataccttaaattatctgaatattgtgaatttttatcgatgattctttctcttataataagttttataataatacctacttttctctcttcaatatttaattataaaactaatccatttaaattgttaactataaaaaatttactttaa

SEQ ID NO: 243 - DNA, 630 bp, Staphylococcus epidermidis
cacttgagatataacatttcacgtatatttggagtgttagtgggtataccagtggcctttattgtttggcttattactgtttttgcgttggatttatcattcattatagacatgcttatcagttttggtagtttcattgcatcatacttccctacgcaaaggctcacttcacgaaagtatcttaatgaaattggtttatcaagaagagattacagatatgttcaatcacagcttcatcatgcacatactaaaattagaaatatcttaaagtcatttattaatattcgttcaatcaaagattttagacaagtaaatgatatatatcgaatttctcgttctattcatacaagcattaagcaaagacccgcgatgttttttaaagttgaaagctttttctattctcatttggataatgcacttaacttagtagactcgtatacacgtcttgcaagaatgccacgtaagtcgcaagatgaaaagctaaaattagaacaaacacgtattactctagatgaaataaagagaacgctcattgctgaccttaaaaggcttaatgaggaagattatgagcgactagatgttgaaatagaattaaataaattagaacagcaacgtcgacataataattaa

SEQ ID NO: 244 - DNA, 240 bp, Staphylococcus epidermidis
tgcatattgaaagaatttagtcttggaggtttcagaattatgaaacaaggtacagttaaatggtttaatgccgaaaaaggttttggtttcatcgaagttgaaggagaaaacgacgtattcgtacacttctcagcaattaaccaagaaggatacaaatcattagaagaaggtcaatcagttgaatttgaagtagttgaaggcgatcgcggtcctcaagctgcaaacgttgttaaactataa

SEQ ID NO: 245 - DNA, 210 bp, Staphylococcus epidermidis
ttaaatattgaagagagaaaagtaggtattattataaaacttattataagagaaagaatcatcgataaaaattcacaatattcagataatttaaggtatgatattattccaatgcttatatttagtacaatagtagtaataataacaatacttagtgatatgaataaattatttagttttaatttttcaattttaaaatttaccatttaa

SEQ ID NO: 246 - DNA, 228 bp, Staphylococcus epidermidis
gttataattgaaaaactaagtttgaatttatatcttataacatacaaaattatacttgagggaaatcttattaatagattagattctaatgactcattgagatgtaagattaaagcaaatagtaaagaaccaatagaaatagaagttaataaactgaagttatttagcaaaatgttaaatactacttccctaaataaaatttcttcccctaaagctataaagaaataa

SEQ ID NO: 247 - DNA, 336 bp, Staphylococcus epidermidis
ctttatagtagggaaggggaaattaatatgtggacagtagtcaagatcagggctgactacgaaggttggtggctatttgaggattggccacaaaaaattgtggaacaatcagaatttactacatacgaccaaatgttggattattacataaatgtattaaaccatagtaagaaatgttacgacaattatgtagtaggcaagtataatatacatgctttttacaacaattgtgatttaaacttttgtgaagactgtgaggaagatttacaaatattttatagttttattattttaaaaaataatgaggtttattttaatcttccaaaaatagattga

SEQ ID NO: 248 - DNA, 1302 bp, Staphylococcus epidermidis
atgttctttggcgcaggtaaccttatatttccaacacaacttggactcgaaagtggtcatttcttttggccagccatactagcctttgcacttacgggtattggattaccgcttcttggcgttgtggtaggcgcacttgataaacatggttatattgggtcttttaataaaatatcaccacgattttcgttaatctttttaattatcatatatctcactataggaccattatttgcgataccacgtacagcttcaacttcatttgaaatgactgtgactcctattgcacataatagtgggaatttagcattatttatttttacagtaatctattttttaatcgttctttatttatgcttgaatcctaataagatgatagatcgaattggttcattacttacacctttattacttattaccattgtcgctatgattattaaaggttttgtagattttagtggacattcttcaaattacggaatgacaaatgcttatcattccaatttaagtggattttcacaaggatttacacaaggttaccttacaatggatgctatcgcttcaattgcattttcaatgattgttgttaatgcgattaaaacaacaggaatacagcatgctgataaaatctttaaacagaccattattgctggtctcatcgctgcaatcgcattagtatttatatatatttcgctagggtacataggcaatcatattaatattccttcagacactctaaaggaattgaaagctaaagatcaaaatatagggacgtatttactcacaacaatggcaacgaagggctttggaactttcggaaaatacttacttggtattatcgtatcattagcatgtttaactactgcttgtggattaattgtatcagtaagtgaatatttccacagaatactacctaagataccttataaagtatttgtgatatttttcattttagttagtttcattctagctaaccaaggacttaattccgtaattaaaatgtcagtccctgtactcagtgtaatctatccagtggctattacagttattttgttaatactcattgctcgcttcatacctacaaaacgtattgcacaacaaataccgctaattattgtagcaattgaatcaatcttaagcttaataacgacacaagggtggatacgtatttcatttatagatggtttacctttaaaagaatattcacttgaatggttcccaattgctgttgtagcaactcttgttggttatatgattagttattttgttaaacaatctaacattgtatatcaaaaagaataa

SEQ ID NO: 249 - DNA, 327 bp, Staphylococcus epidermidis
tattttataatcttattaattttaatagtttatgttgatgattataagttaatcatattttatttctttatagctttaggggaagaaattttatttagggaagtagtatttaacattttgctaaataacttcagtttattaacttctatttctattggttctttactatttgctttaatcttacatctcaatgagtcattagaatctaatctattaataagatttccctcaagtataattttgtatgttataagatataaattcaaacttagtttttcaattataactcattggatatataatatttttattgtagtaatgagatga

SEQ ID NO: 250 - DNA, 315 bp, Staphylococcus epidermidis
ttttttacaattaaaatacgtataataaagacaagaggtgattttatgcaacgtaaacatattcaagtttttggtacagtacaaggtgtaggatttagattttacacgcaacgtattgctcatcaatttaatattaaaggtacagtccaaaatgttgaggactacgtagatatatatgctcagggcgacgatacagaattagaacagtttattgattctgtaatccaaggtgcttcaccggcttcacaagtgtctaattacaatattgaagaattagaccttgatgaatctttatcagagtttaagacaatttag

SEQ ID NO: 251 - DNA, 1179 bp, Staphylococcus epidermidis
aacagcaacgtcgacataataattaatagaaatggagagatgagtgagatggtaagtgaacgaagtagtaatcagtcacatccacttgattactatatgaataatcaatcaactgatcatcatacaatcgctgaagatcttgaaatccaattaactgaaaatgataaacaaagaattaaatcaataagtgagcaaattgagccacttaatcatgaaggattgttaaaatatggtgctaatcttcaacaaaagatgtctcatttttcgcatcaaattttagatgatgttcaatcaaaagatatgggaccagttggggaaactttaagtcaattaatgggaaaattaaaatctgtaaatccaaatgacataaatccagaaaaacaatctagattaaagcgtttatttaaacgtactaaagcttctattaatgaagtgttttctagaatgcaatctgtaagttctcaaattgatcgtattactattcaattagaaaaacataaagatcagttaactaaagatgttgaatttcttgatcaattatatcagcaaaataaaacttattttgataacgttactttatatatcttagcggctcaaaaaaagaaaaaagagatattgacagaaaccataccacagttacgtgaaaaggcgcatcaaactggtaatcaaatggatattcaggcaactgctgatatggaacagtttgtggatcgtttagataagcgcatttatgatttacaattatctaggcaaattgctattcaaactgcacctcaaatccgtatgatacaaaatgtcaaccaagctttagccgaaaaaattcaaagttcaattttaacaagtattcctttatggaaaaatcaaatggctattgccctaactttgatgagacaaagaaatactgtttcagcacaacgttcggttaccgatactacgaatgagttacttactccaaatgcatcaatgttaaaggaaaatgctattgaaacggcagctgagaatgagcgtggcatcgtggacatcgaaacgttaaagacaacacaaaatgacattattgaaacaattgaacaaacacttcaaattcaagaagatggtagacagaaacgtcaagttgcagagaaagaacttaatgagttagaacaagatttgaaacagcatctattagctatgcgtaaataa

SEQ ID NO: 252 - DNA, 345 bp, Staphylococcus epidermidis
cgttctctatctaaaccgatagaacgatatgagtataaaatgactaatatggtaataataatacttgtgatgatgagtagagcgctaaaaatatcgactacaaatacaatgctgtatggggctttccaagagcccagttcaaccttgattggtccatctcgtagcacattctttaagttaatcaatgcaatgaccaatgttagcaatgtaccgacaagtgcaacatatctttttattattgggcgctttccaataaatatgagtaaaattgcagttaggataggtatgactaaagttaaaacaagcaagttactctctatcatcttctggcgctcctttcattag

SEQ ID NO: 253 - DNA, 387 bp, Staphylococcus epidermidis
tataggatgttatatcgattttctcacaagactggtgtttatggtgtaagtgtcaaagaggaaactggaaatcaaatactcgtacaaattgaacaagtaattaaacatcccaaacaaggtgatttacaccaccccaatgaaacagaaggcgtcttttttcatgaacgtaaagctttaagccattttgagaaacgttacgctacaccttctcaacttcgtgattttaatgtcgaggccatgccttatgaagactcacttcaacatgctattacacatcttgagaatcaactaaaaaaagagaagacagagtattctcgattgtctttaaataatttaaatcgtttaaaagaagattacgctattcaatataaaagacacttcgactaa

SEQ ID NO: 254 - DNA, 294 bp, Staphylococcus epidermidis
acaaaattaacgaggtgccttatgtataaagactataacatgactcaacttactctaccaatggaaacttcagttcttatccccacaaatgatatttcacgacatgtaaatgatattatagaaacaattcccgagactgaattcgatgaattcagacatcatcgaggtgcaacatcatatcatccaaaaatgatgttaaaagtagttttatatgcctacacacaatctgtgttttcaggacgtaagatagaaaaattacttaatgataatatccgaatgatgtggctatcataa

SEQ ID NO: 255 - DNA, 1356 bp, Staphylococcus epidermidis
gtacttataacaggaggcaataagatgactcacattcaattagactatggcaaaactttagaattttttgataagcatgaactagatcagcaaaaggatattgttaaaactatccatcaaactattcataaaggtacaggagcaggtaatgactttttaggttggttagatttaccagttgattatgataaagaagaattttctagaatcgtcgaagcatctaaacgtatcaaatcaaattccgatgtacttgttgttatcggtattggaggttcatacttaggtgcacgtgctgcaatcgagatgcttacatcttcatttagaacaaatacggaataccctgaaattgtatttgtaggtaatcatttatcctcaagttatacaaaagaattacttgattatttacaaggaaaagatttttcagttaacgttatttcaaaatcaggtactacgacagaaccagcagttgcatttagattatttaaacaattggttgaagaaaaatatggaaaagatgaagctaagaaacgtatttatgcaacgacagataaatctaaaggtgcacttaaacaattagcagacaatgagggttatgagacgtttgttgtacctgatgatgtgggaggtcgttattctgttcttacagctgtaggattactaccaattgcaactgcaggtatcaatattgaatcaatcatgattggtgcggctaaggcacgtgaagagttatcttctgatgatttagatcaaaatatcgcatatcaatatgcaactattcgaaatattttatacagcaaaggttatactactgaaatgttaattaattacgaaccctctatgcagtatttcaacgaatggtggaaacaattatacggtgaatcagaagggaaagatttcaaaggtatttatccatcaagtgcgaattacacaactgatttacattccttaggacaatatgttcaagagggccgtcgtttcttattcgagacagtggttaaggtcaaccatccaaaacatgatatcaaaattgaagaggatgcagatgatttagacggactgaactatcttgctggcaaatcaatcgatgaagtgaatactaaagcatttgaaggtacattacttgcacataccgatggtggcgttccaaatatcgttgtaaatattcctcagttagatgaagaaacatttggatatgttgtttatttctttgaattagcttgtgcaatgagtggatatcaattaggtgttaatccatttaatcaacctggagttgaagcctataaacaaaatatgtttgcgctattaggtaaaccaggctttgaagataagaaaaaagaattagaaaatcgtttataa

SEQ ID NO: 256 - DNA, 279 bp, Staphylococcus epidermidis
gtggtgaagacttttgcgaatatacctattatcgcttcattatttataccttttggagcatcaattggtttagacacaatggctcttattgctttaattggtacagcaagtgctttaggtgattcaggttctccagcaagtgattctacacttggaccgacagccggtttgaatattgatggacaacatgatcatattcgtgatacatgcatcccgaatttcttgttttataatgttccccttatgatttttggtacgatagcagctatggtactataa

SEQ ID NO: 257 - DNA, 213 bp, Staphylococcus epidermidis
aaattgtctcaagcgtcgccaaagctatggttcaactggtcaagaatcagtaaaacatcaactaaaagtcgcaaaagcattattaaaagacaacgaatcaaaatagttattaaaaataatagccatctaaaattacaaaaatttaattttgtattaagttatcaaagtttatataaaaaaaatgtaaaattccctttcatcctttcaaattga

SEQ ID NO: 258 - DNA, 201 bp, Staphylococcus epidermidis
tgtggctatcataaaatcaaaagccttcttataaaacgattaatcgattcaaaaacaaataaaaaaataatgaagaattatagttgggaatatttcaatgtccaaattaatcaaaagctttcagaacgaaaagcaaaaaccatctacagtcaaagaaaaattgatgtggagtctgtttttggaattatgaagctattttga

SEQ ID NO: 259 - DNA, 1512 bp, Staphylococcus epidermidis
aaggagcgccagaagatgatagagagtaacttgcttgttttaactttagtcatacctatcctaactgcaattttactcatatttattggaaagcgcccaataataaaaagatatgttgcacttgtcggtacattgctaacattggtcattgcattgattaacttaaagaatgtgctacgagatggaccaatcaaggttgaactgggctcttggaaagccccatacagcattgtatttgtagtcgatatttttagcgctctactcatcatcacaagtattattattaccatattagtcattttatactcatatcgttctatcggtttagatagagaacgtcattattattatttctctatcatgtttatgttgattggtattattggctcatttacaacaggagatattttcaacttgtttgtgttctttgaagtctttttaatgtcttcatattgtttactcgttattggtactactaaaatacaattacaagaaacaattaagtatattttagtcaatgttgtttcatcgtctttctttgtcatgggtgttgcagttttatattcagttgtaggaactttaaatctcgctcatattagtgaaagattgtcacaactttctgtacatgacagtggcttagtcaatattgtttttattttatttatctttgtctttgccactaaagcaggcgtttttcctatgtacgtatggctacctggtgcttattatgcccctccagtagcgatcatcacgttctttggtgcactattgactaaagtgggtgtatacgcaattgcgagaactctaagtttattctttaataatacagtaagcttttctcattatgtcatccttttcttagcattacttacaattatttttggatgtataggtgcgatagcttactatgatacgaagaaaatcatcctttacaatattatgattgcagtaggtgtcatattagttggtattgctatgatgaacgaatcaggcatgactggtgcaatatattacacactacatgatatgttagttaaagcttcattgttcttactcattggcgtcatgtacaaaatcactaaaacgactgacttacgtcattttggtggcttgataaaagggtatcctattctaggttggacattctttattgcagcgctaagcttagcgggtataccaccttttagtggtttctacggtaaattctatattgttcgagcgacctttgaaaaaggattttatctaagtggtatcattgtacttttatcaagtttaatcgtgttatattcagtcatacgtattttcttaaaaggatttttcggtgaagttgaaggatatactttatctaaaaaggtaaatgttaaatatctaacaactatcgctgttgcatctacagttattactgtaatctttggattatctgcagacacgttattcccaatcatcaaagatggcgctgaaacgtttgtcgatccaagtcaatatattcatagtgtgttaggaggtaaatag

SEQ ID NO: 260 - DNA, 261 bp, Staphylococcus epidermidis
aacatgaaacatttgattaaatatttgatttccttcacttttgcaattattattgtaatattcattcaatcatttataatcgtaggcgctgtgatatcaaataatagcatgacacctaccttgcaaacgggagatagagtaatagttaataaaattaaagtcacgtttgaccttattcaacgtggtgatataatcatgtacaggcataataacaaaacgtactttagcagaattgtcggaaacagccataaccacgggatg

SEQ ID NO: 261 - DNA, 243 bp, Staphylococcus epidermidis
gcgagatttaaagttcctacaactgaatataaaactgcaacacccatgacaaagaaagacgatgaaacaacattgactaaaatatacttaattgtttcttgtaattgtattttagtagtaccaataacgagtaaacaatatgaagacattaaaaagacttcaaagaacacaaacaagttgaaaatatctcctgttgtaaatgagccaataataccaatcaacataaacatgatagagaaataa

SEQ ID NO: 262 - DNA, 603 bp, Staphylococcus epidermidis
tacaaccctaagaaaggatttgatgtattgtcgctttctcagttagaagaatggtttgacgcatttcgacaattcggatatattcctgggttcattatgctttatttaagagccattgtacctgtgttgcctctcactttgtacgtcgtgctattaatacatgcgtatggattgtttccaggtataattatcagttggctaggtatcgtctcaggtacttttactgtctttcttatctgtaagaaatttgtgaatacaataagaatgaaaaaattaaaaagtagaaagtctgttcaaaggctaattagcttcatagatagacaagggcttatccctttattcgtattattatgctttccatttacacccaatacattaataaatattattgcgagcttatctcacatcaaaataaaatattatttttttgtattagttatttctaagttgatttcaattactattctaggagtaatgggaaaagaaattttcaccatatttactaatccattaagagcgcttattatgattgtgttactcgtagtattatggtttattagcaaaaaggtagaaaagcattttatgggttctaccaaggagtaa

SEQ ID NO: 263 - DNA, 393 bp, Staphylococcus epidermidis
ggggttatcaagttgaatcatcactacaaagtaggtcaacatatcaaggtacgtgtgactggtattcaaccgtatggcgcatttgttgagacccctgaccatactgaagggcttatccatatctcagaaattatggatgattatgtccataatttaaagaaatttctatctgaaggacaggttgttaaagcaaaaatattatcaattgatgatgaaggtaaattaaatttgtccttaaaagataatgattactttaaaaattatgagcgtaaaaaagaaaaacagtctgtcttagatgaaattagagaaacagaaaagtatgggtttcaaacacttaaagaacgcttaccggtctggatcaaacagtcaaaacgtgcaattcacaatgactaa

SEQ ID NO: 264 - DNA, 378 bp, Staphylococcus epidermidis
actatgaccaatcttttagaaacatttgaaatgaagattgaacaaaaagaagatggtaaagtagtagtgtctatgcctgtgacagataaagtaaagcaaccctttggctatttacatggtggtgcaagtttagctttaggtgaaacagcatgttcgataggtgctgctcatttgattgatacgcagcaatttattccactaggtttagaaatgaatgcaaatcatattcgctcaactcgacaaggacatgtgagagcatttgcttctttaatacatcaaggaaaaacaacacaagtttggaatattgatatcaaagatgaccatgaccaattaatcagtgtcatgcgtggtacgattgctattaaacctattcaataa

SEQ ID NO: 265 - DNA, 435 bp, Staphylococcus epidermidis
atgaccatgaatagacaacaaaataaccttatctttcaatacgctgccgtgattattttcttcatggtcattgtgtttggcttttcattatttttagctggacattatacacctggtggcggtttcgttggtggtttgcttttcgctagtgcattattagttattacaattgcatatgatgtaaaaacgatgcgaaagatttttcctttagattttaaaatcttaattggtattggtttattattttgcgtgggtacaccattaacaagttggttcatgtctaaaaacttttttacacatgtcacttttgacatccctttgcctttacttgaacctatgcacatgacgacagcgatgttttttgatttcggtgttttatgtgcagttgttcgaactattatgactattattatttcgattggagagaacgaatag

SEQ ID NO: 266 - DNA, 1263 bp, Staphylococcus epidermidis
aaagaggcgaataggatcatgactgagaataataatttagtaacttccactcaagggattattaaagaagcattacacaagttgggctttgatgatggtatgtatgaccttataaaagaaccaattagatttttacaagtgcgcattccagtacgaatggacgatgggacagttaaaacatttactggataccgtgcacaacataatgatgcagttggccctactaaaggtggcgttcgtttccatccagaagttgatgaagaagaagtgaaggcattatcaatgtggatgactttaaaatgtggcattgttaatttaccttatggtgggggtaaaggcggtattgtttgtgatccacgtcaaatgagtatacacgaagttgagcgtctatctcgagggtatgtaagagctatatctcaatttgttgggcctaacaaagatattccagcaccagacgtttttacaaactctcaaattatggcttggatgatggatgagtatagtgcattagataaatttaattcgccaggttttataacaggcaaacctattgtattaggtggatctcaaggacgtgatcgctctacagctttaggtgtagtcattgcaattgaacaagcggcaaaacgtcgtggcatggatattaaagatgccaaaattgtgattcaaggtttcggcaatgcaggtagtttcttagctaaattcttatacgatttaggtgctaaagtagttggtataagtgatgcatatggagccttacatgaccctaatggacttgatatagattatttattagatcgacgtgatagcttcggtacagttacaaatctattcgaagatacaatttctaacaaagaattattcgaattggattgtgacatccttgttcctgctgcaatttccaatcaaatcactgaagataatgcgcacgatattaaagcaagcattgtagttgaagctgctaatggccctacgacgcctgaagcaacacgtattttaacagaaagagatatattactagtgccggatgtacttgcaagtgcaggaggtgtgactgtatcttatttcgagtgggtacaaaataatcaaggttattattggactgaagaagaagtcaatgacaaactacgtgagaagttagtaacagcatttgatacgatttatgaattgtcacaaaatagaaaaattgatatgagattagcagcatatatagtaggtattaaacgtactgctgaagcagcaagatatagaggttgggcataa

SEQ ID NO: 267 - DNA, 186 bp, Staphylococcus epidermidis
ttcatattagatggaatatttgtttgttgttgtatcgatttctctgattggtttggtgctggagagtggttcgaagtttcagctatcgaaggggaacttaaactagctaaacccagtgtaacggtagataaagttgaaatgattattttcttagatttaaacataaaaacatcctttcaaaaatag

SEQ ID NO: 268 - DNA, 2427 bp, Staphylococcus epidermidis
attttaaaggaggaaaacatagtgagtttgttacatattgcggtactattaccgttaatatttgcactcattattccattcctataccggttcgttaaacgtatacatttaggatggtttgtattacctgttcctattgtcttatttatatatttcatatcattgatttcaatgacgatgtcaggtaataacgtaatgaaaaacttaaattggatgccacatattggaatgaattttaatttatatgtggatggtctcggattattattcagtttgcttatcactggcataggaagtctagtggttttatattctatcggatatttaagcaaatcagaacaactcgggaatttttactgttatttattactatttatgggtgcaatgttaggagttgtactctctgataattttattattttatatttattttgggagttaacttctttctctagctttttattaatctctttctggagagagaaaaaagcttcaatttatggtgctcaaaaatctttaatcattaccgtattaggtggcttgagcatgctaggtggtatcattttactttccctagctactgatacttttagtattcaggctatgatttcaaaagcaagtgacattcaaaatagtcctttctttatcttagtaatgatactttttatgattggtgcatttacaaaatctgcacaagtgcctttttatatttggttaccagatgctatggaggcgcctacgccagtgagtgcataccttcattctgcaacgatggtaaaagcaggactatatctaatcgcaagaatcacacctatttttgcaatatccgaaggttgggtatggacaattacacttgttggtttaatcaccctattttgggcatcactcaatgcaacaaaacaacatgacttaaaaggtattttagctttctcaactgtgtctcaactagggatgattatgtctatgcttggtattggtgctgtaagttatcattatcaaggcgctaatagtcaactttatgttgctggatttgttgctgccatatttcatttaattaatcatgccacgtttaaaggtgcactatttatgattacaggtggtattgatcattcaactggtacacgtgatgttaaaaagttgggcggtttacttacaatcatgcctatctcattcacgcttacagttattacaacattaagtatggctggtgtgccgccttttaacggctttttatcaaaagagaaattcttagagtcaatgattaatgttacacatttaaatttaatgagtttaaatactttaggtattcttttaccaatcattgccattattggtagtattttcacatttgtatattcaattaaatttatattgcatatattctttggttcttataaacctgaagctctgccaaaacaagcgcatgaatcttcaattttaatgcttatttcacctatcattttaacatcactagttatagtattcggtttattcccaagtatattaacgcaatctattatagagccggcatctgtagcagttagtcaaacatcaaatataactgctgagttccatttattccatggtataactccagcattcctatcaacaataggtatttatattattggtattttattattaatttcatttagttattgggttcgtttattacaagcacatccatatcagttaacgttgaatcattggtatgacacttcaggccaacgtattccaggatattccgaaaatataacaaatagttatgttacaggtttttctagaaataatttggtgattatcttaggtattctcattgctttaacttttgttacagtcatcagtgtacccttcagtattgactttaaaaacgtgagtcatttacgcgtatttgaaggtgcaacagtattgtttttactgattgcttcaactttcattatatttgcaaaatcacgtttgtttagcattatcatgttaagcgctgtgggttacgctatatcagtattatttattttctttaaagcgcccgacttagcattaacacaatttgtagtggaatctatttctacagcattattcttactatgcttttatcacctacctaatttaaatcgctacaatgaaaaaccaacctttaaactgacaaatgctgtgatttcaattggagtgggattatcagtgattattttaggattaattggctatggtaatagacactttgactctattactaaattctatcaagaacatgtttttgatttagcacatggtaaaaatatggtaaatgtcatcctcgtaaatttccgtggtatggatactttattcgagtcatctgtactaagtattgcaggtttaggcgtatatacaatgattaaattacgattaaaacagaaaaatcaatcaagtgaggtgaatgaccatgaatag

SEQ ID NO: 269 - DNA, 189 bp, Staphylococcus epidermidis
tgtggagtctgtttttggaattatgaagctattttgagtttcactcgaaagtccgttcgagggataaataaagacaaaagagaactaggacttgtgctaatgacacttaatataagaaaagtaccagctcaacgagctgaaaattataaaaaaatcataaaaaagacaatttttatattatttcaatag

SEQ ID NO: 270 - DNA, 1221 bp, Staphylococcus epidermidis
gtttttattcgaaaacgaaggggagattttatgactcaatctgaaaaaattattaacttaacaaatcactatggggcgcataactacgttccacttccaattgttatttctgaagcagagggtgtatgggtgaaagatccggaaggtaacacgtatatggatatgctttcggcctactcggcagtgaatcaaggtcatcgacacccaagaattattcaagcattgaaagatcaagcagataaagtcactttagtatcacgtgcttttcatagtgataatttgggtcaatggtatgagaaaatatgtaaactcgcaggtaaagacaaagcattgcctatgaatacgggagcagaggcggttgaaacagctttaaaagctgctcgtcgttgggcttatgatgttaagggtattgagccgaacaaagctgaaattatcgcttttaatggtaatttccatggacgtacgatggcaccagtatcattgtcttcagaagctgagtatcaacgaggctatggtccattgttagatggctttcgaaaagttgagtttggtgacgttaatcaattaaaagcagcaattaataaaaatacagcagcaattttagtagaacctatacagggagaagcagggattaacgtaccaccagaaggatatttgaaaacaattagagaattatgtgatgaacatcaaattttatttattgctgatgaaattcaagcaggattaggacgttcaggaaaattatttgcaacggattgggatcatgtaaaaccggatgtttatattttaggaaaagcgttaggtggaggggtatttcctatctcggtagttcttgcagataatgaggtattagatgtatttactcctggctcacatggttctacatttggtggaaatccactagcgagtgcagtttctattgcagctatagatgtcattattgacgaggatttacctggtcgttcattagaattaggagaatattttaagtctgaattgaaaaaaattgagcatccatctattaaagaagttaggggacgaggattatttatcggtattgaattacatgaaagtgccagaccatattgtgaagctttgaaagaacaaggattattatgtaaagaaactcacgacaccgttattagatttgcacctccattagtgataacgaaagaagagttagacatggctttagagaagattaagagtgtatttgcatag

SEQ ID NO: 271 - DNA, 312 bp, Staphylococcus epidermidis
aaaggtaggcgagaaataatgccttttaaaatatttattattacagccttaattattgttgtcttatcaatgttagcaatgttaatacgtgttattttaggaccctctctagcagaccgtgtcgtcgcacttgatgcaattggtttacagttaatggccgtgatagcgctatttagtattttactgaatattaaatacatgctcgtcgttattttaatggtcggtattcttgcttttctaggaactgcagtcttttctaaatttatggatgaaggtaaggtgatcaagcatgatagcaacgatcgtcactag

SEQ ID NO: 272 - DNA, 492 bp, Staphylococcus epidermidis
gaggtaaatagtttggctatacagtttgtaattaatttacttgtttctgtcatatggttacttgtaacaaatagctataccttaaataactttgtattaggttttatactaggtttgtttctagtttatctcctgcaccgtgtcttgcctggtcagttttatttagtgagaatatatagaattataatgcttatcattacatttttaactgagttaataaaagcaaactttggtgtactaaaaattattctcaaaccacgaattgagaataaacccggattctttgtgtacgagacggaattagaacgtgactggcaacttgttttactttccaacttgattacgttaacacctggcacagtcgttttaggtattagtgatgaccgtaaaaagatttatatccactcaattgatttcagtacaaaggaagaagagattcaaaatatcaaatcttcattagagaaggtcgttagaaaggtaggcgagaaataa

SEQ ID NO: 273 - DNA, 333 bp, Staphylococcus epidermidis
  unsure (174): Identity of nucleotide at the above locations are unknown.
tctttgttgagtggtattctcacatctataagtgtctatctcgtttcgtctaaaagtttgatacgtatcattatggggactacactactaactcatgctgcaaatttatttttaattactatgggaggtttaaagcacggaactgttccaatatttgaaaaaggaacatcaagntatgttgaccctatcccccaagcattgattttaacagctatcgttatcgcctttgctacaacagctttctttttagttcttgcatttagaacatataaagaactaggcactgataacgttgagctaatgaaaggagcgccagaagatgatagagagtaa

SEQ ID NO: 274 - DNA, 612 bp, Staphylococcus epidermidis
cacgaatggagaattgaaatgacgaactatcctcagttaaataaagagattcaagataacgaaattaaagtagttatgcatacaaataaaggtgacatgacatttaaattatttcccgacattgctccaaagacagttgaaaactttgtgacgcattcaaaaaatggatactacgatggtgtaacattccaccgtgttatcaatgattttatggtacaaggtggggacccaactgcaactggtatgggcggagaaagtatttatggtagtgcttttgaagatgaattttctctagaagcttttaacctttacggtgcattatcaatggctaatgcaggtcctaatacaaatggatctcaattctttattgtccaaatgaaggaagtgcctgaaaatatgttaagtcaattagcagatggtggatggcctcaacctattgtagaagcatacggtgaaaaaggtggtacgccttggttagatcaaaaacatacagtatttggtcaacttattgagggtgaatcaactttagaagatattgcaaatactaaagttggtgctcaagacaaacctgtttatgatgtagtcattgaatcgatagatgtagaagaataa

SEQ ID NO: 275 - DNA, 1173 bp, Staphylococcus epidermidis
aagcagaggggcgattcaatgcactggacaattattggtggtggcttacaaggaaccaccattgcacttaaattaaaaaatgaaggactaaaaaatgaggcgcttactatcatagatccttactcctcattatgtgagcgatttaatatttatacacaacgtattagtatgccatacttaagatcgcctttcgttcatcatattcatcctaaaccttttcatctcaaacaatatgctagatatcatcagtatacttcagcttattacggcccgtataaacgtcctcaaagagatatgtttatgcatcatgttcatgatttgatacatcaatttaaacttaatgattgtcatatacaaggtaaagtcgaagctattaataaatcaagaggtaaatggtgtataaaactatcaactggcgataaaatgattaccgattgtgttgtgatagcaaatggctatacgcaaacgccattcatacctgaaattttcagaaataaagcgaatgtaaaacacatattcgctgataattatcatgcctctttagataaagatactcaacatgttgttggttcaggtatatctgctgcccacctcactttaaaattattaaatgaacacaatcaccaacttgttcatttatggatgaataaagatattgagatacataattttgatgctgaccctggttggttaggacctaagaaattgaactatcttgcatctatatcctcatcagatgcaagaatgaagttaattgaagacgaacgtcatagtggttcaatgcctatggaattatttttaaggttaaagaaatatgtgcaaagtggtcgactcgtcatacatacgagtcaaattgatgatgtaactgaatcctatattatctccgctggaaaatattttgaatataagcatattttgttagctactggattttataatcaattgttaacacaaccactcataaaaaatcttattcaaaacgaacaagcaccacttaatcaatcaggttatccttctttgtcaaacgaactagaatggttaaatcaattattcgtagctggtggactcgcagatttagaactaggtccttttgcaagaaatataatgggcggtaaagaaagcgctgaacgcataagtaaagcatataaacgtttaaataagaaaatctcttaa

SEQ ID NO: 276 - DNA, 186 bp, Staphylococcus epidermidis
ggtaattctatatctgaaattgttccatcatcatttgatgaagtatgtgtaagaggagctaaaacaaaacgatttcttacttcaacaccattaggtagtgttaaagatttaaataaaggttcatatttattattcatatttttaatactctccttgtttaatgatgttatgactatagcatgctag

SEQ ID NO: 277 - DNA, 1215 bp, Staphylococcus epidermidis
ggtgtaaatatgaaagataaaatcgttttagcatattcaggtggtttagatacaagcgttgcagttcaatggcttattgataaaggatatgatgtagttgcttgttgtcttgacgtaggcgaaggcaaagatttagacgttgtatatcaaaaagctttagatatgggtgcagtcgaatgtcatattattgatgcaactaaagaatttagtgatgattatgtaagttatgctattaaaggaaatttaatgtatgaaaatgcatatcctctagtttcagcattatcacgtccactcatcgcgaaaaaactggttgaaattgctgaaaaaacaaattctattggtattgcgcatggatgtactggtaaaggtaatgatcaagtacgtttcgaagtggcaatcaaagctttaaatcctaagttaaaagcatttgcacctgttcgtgaatgggcttggagcagagaagaagaaattgattacgcaatcaaacataatattcctgtttcaatcaattatgactcgccatactcaattgaccaaaacttatgggggagagctaatgaatgtggtattttagaagatccgtatgccgcacctccggaagatgcatttgatttaactacacctttagaagaaactccagacaatgcagacgaaattatccttacatttaaacaaggtattccagtacaagttgatggcaaagattatcaattagatgaccttattctttacttgaatcaacttgctggcaaacacggtattggtagaatcgatcatgttgaaaacagaatggtcgggataaaatcgagagagatttatgaaacacctggtgcggaagttattttaaaagcacacaaagcactagaaacaattacattaactaaagacgtagcgcactttaagcctgtcattgaaaaacaattttcagaacaaatatacaatggtttgtggttctcgccattaacagatagtttaaaactctttatcgatagtactcaacaatatgttgagggagatgtgagaattaaattatttaaagggaacgctattgtcaatggcagacaatctccttacactttatacgatgaaaaattagctacttatacaaaagaagatgccttcaatcaagaatcagcagtaggtttcattgatatttatggtttacctacacaagttaatgcattacttcacggggggtatagtaatgagcaataa

SEQ ID NO: 278 - DNA, 1062 bp, Staphylococcus epidermidis
aaggatgtttttatgtttaaatctaagaaaataatcatttcaactttatctaccgttacactgggtttagctagtttaagttccccttcgatagctgaaacttcgaaccactctccagcaccaaaccaatcagagaaatcgatacaacaacaaacaaatattccatctaatatgaatcaatcatcagctaaaacatttaaacgacaagctgaatcagactcagtaagtggtaaaacaaacgatactcataatcattggactaaaaatttaactggagagaaatttacaaccattgcacatcgtggcgcaagtggttacgccccagaacatacttttgaagcatatgataaaagtcataatgaattaggagcatcttacatagaaatcgatttacaacgtactaaagatggtcacttggttgctatgcatgacgaaaaggtcaatcgtacaactaatggccatggacgtgtcgaccaacttactttaaaagagttaaaacaacttgatgcaggaagctggtttaatcgaaagcaccctgaatatgccaaaaataaatataaaaatgctaaagttcctactttagacgaaattttaaatcgctatggcaaaaatgcaaactattatattgaaactaaatcgccagatgtttatcctggcatggaaaaacaattattagatacattagataaacatgacttgttaacacaaaaatcacttaaacatggacatgtgatgatccaatcattttcagggagtagtttagaaaaggtacatcacatgaacgccaatataccacttattagactaatgaataaatttgaacttaaaaaagctactaatcaagatttaaaaaatattaaatcttatgccattggagtaggtcctgaatacacagatttaaatattaagaacacaagacatttaaaaaatttaggatttttagttcatccttatacagttgatgatgaaaatcaaatgagaaacttaaatcaatatggtgttgatggtgtattcactaattttgctgatagatataaaaaagtttcagaaacacaacaataa

SEQ ID NO: 279 - DNA, 1455 bp, Staphylococcus epidermidis
gtttcattgatatttatggtttacctacacaagttaatgcattacttcacggggggtatagtaatgagcaataaagcttggggtggcagatttgaaactcaacccgaagaatgggttgatgatttcaatgcgtcaattgattttgataaaaatttaattaaacaagatgttcaaggtagtattgcacatgcaactatgctcgctaaacaacatattattacagatgatgaagctcaatccatcattaatgagcttaaaaatattcaaagtgactttgaagaaggtaaacttaaatttaaagcttctctcgaagatattcatcttaatattgagcacgagcttattcaacgtattggcgaagctggtggaaaactgcatactggtcgtacccgtaatgatcaagttgccacagatatgcatttgtatactaaagaacaagttcaatacattattgaacttatagcgtcgtttcaagaaacaattgttcaattagcagaccagcacgttgacacaattatgcctggatacacgcatttacaacgtgcacaacccatctcgttcgcacatcatattatgacttacttttggatgttagaaagagacaaaggtagattcatggatagtcttaaacgtatagatatctcaccattaggtgctgcagctttaagtggaactacacaccctatagatagacatctgactcaagaacttctaggatttgcaaatctgtatgaaaatagtttagatgctgtcagtgatcgtgactatatcgttgaaacattgcatcatatttcactcactatggtacatctatcacgttttgcagaagaaatcattttttggtcgactgatgaggcaaaatttatcactttatcagatgcgttttctactggctcatctattatgccacaaaagaaaaaccctgatatggctgaactaataagaggaaaagtcggacgtactacaggacacttgatgagtatgttagtaacacttaaaggcttacccttagcttataataaagacatgcaagaagataaagaaggtttatttgatgctgtacacacacttaaaggctctcttcgaatcttcgaaggtatggttgcatctatgaaagttaattcaaaccgtttaagtcaaacagtaaaaaatgatttttcaaatgcaacagaattagcagactatttagtcagtaaaagtgtaccttttagaaccgctcatgaaatcgttggtaaaatcgtattaaattgtattcataaaggtatatacctattagacgtacctttaagcgaatatcaagaacatcatgagaatattgaggaagatatatatgattatttaacacctgaaaattgtctcaagcgtcgccaaagctatggttcaactggtcaagaatcagtaaaacatcaactaaaagtcgcaaaagcattattaaaagacaacgaatcaaaatag

SEQ ID NO: 280 - DNA, 363 bp, Staphylococcus epidermidis
tcaagcatgatagcaacgatcgtcactagtgtctctatcatatttgttgttcttggagctttgattagtgcctttgctgcaacgggtctcattcgattaagggatgtttactcaagagcacatgcagctggtaaagcagccacgttgggtgcgatgtttttactatttggagcatttttatactttattggcactgaaggatatgtaaatatgcaattaattatcggaattattttcgtatttattactggccctctttcaagtcatttaatcatgaaagctgcctacaacattaaaacaccatataccaaagatactaaaattgatgaaattaaagaggatatgaagcatacaaaactataa

SEQ ID NO: 281 - DNA, 1173 bp, Staphylococcus epidermidis
  unsure (620): Identity of nucleotide at the above locations are unknown.
catgctatagtcataacatcattaaacaaggagagtattaaaaatatgaataataaatatgaacctttatttaaatctttaacactacctaatggtgttgaagtaagaaatcgttttgttttagctcctcttacacatacttcatcaaatgatgatggaacaatttcagatatagaattaccttacattgagaaacgttctaaagatgttgggattgcaattaatgcagcaagtaatgttaatgatgtaggcaaagcatttcctggtcaaccttctgttgcacatgactcagatatcgaagggttaaaagaacttgctcaagttatgaagaaaaatggtgcgaaagcaatagtccaaattcatcatggaggtgctcaagctttaccagagttaacacctgatggagatgttgttgcaccaagtgccatttctcttaaaagttttggtcagcaaaaagaacatgatactcgtgagatgactgctgaagaaattgaacaaactattagagactttggtgaagcaactagaagagcaattgaagcaggttttgatggcgttgatattcatggggcaaaccaatgtcttattccccaatttgtttctccttactataatataanaaatgatgtttgggctgataactataaattccctgttgctgttatagatgaagttgttaaagctaaaaaagctcatgcaaatgatgattttattattggttacagattgtcacctgaagaagcggaatcaccaggtatttcaatggagataactgaagaattaattcaccaaatcgcaaataaaccacttgattatattcatgtgtcattaatggatgttaactcagttacgcgagaaggtaaatataaaggtgaaaatcgcttggaacttattcatcaatggataaatggacgtatgccgcttattggtataggttctgtctttacagctgaagatgcactaaatgctgttgaaaacattggagttgaatttgttgcattaggtcgtgaaattctacttgattatgattttgttgctaaaataaaagaaggtcgagaagacgaaattataaatgcttttgatcctaatcgtgaagaccaacattatctaacaccaaatctttgggaacagtttaatcaaggattctatccattacctcgaaaagacaaataa

SEQ ID NO: 282 - DNA, 183 bp, Staphylococcus epidermidis
ttttgtttattggtatttattaaattatacgaaagaccttatttttttaagtatttcattgtgaaattacatataaacacaaagtattttggcgagactcttgagggagcaggacaagttgaagactacaggctgaagctgtccctaagaaagcgagccaacaatacgaggtattgtaaataa

SEQ ID NO: 283 - DNA, 990 bp, Staphylococcus epidermidis
aaggttagttccatgcttaagttaaatccctataaaataggatttagaactgtcaaaactgctgtgggaatgactttaggagtaatcatatgtaaacttctaggcttagataattatgcatccagtgctattttagttgtattgtgcataaagcacactaagatgcattcagtacaagcaattttatctcgactagtttcatgtttactcatattatttttaggttcagcaatttttagtcttttaggacaacatgcatttgttttaggtttaattgttttgttgtttattcctttgacagttgttctaaatgtgcaagaaggtgttatcactagttgtgtcatattattacatgtctttaacgccaaagctattaatgggcaccttattttaaatgaaataatgctattaatagtgggcttaggtatagcatttctaatgaacttaatgatgcctagtttagataagaaattgaatcattttaagcaggatatagaaaatcaaataactgaaatatttaatatttttagtcaagcctgctcaatgcataatgatcatttaaatattaaatttgattcattacttttaaatattaaaaaagcaaaatcacttgcttttagagatgttaaaaatcactttgtacgaaacgaaaattcattttatcattattttgatatgagagaagaacaagttgaattattaaaacgtatgacatcgttattagaaagaataaatacagatgatcctatactcgaaaagatttcacaattaatgtatgaaattggaagtaacgtaaatagcaatgattatacggctctaagactacattcactttatgaaatacgtttatctctcgatgatttaccattaccgactactcataagactttaaattcccgagcacatattattcaaattctaaatgaactagaagaatacttaaatattaaatctcaatttggttctttaaaattgcatagtgaaatataa

SEQ ID NO: 284 - DNA, 1236 bp, Staphylococcus epidermidis
caattttactcgtttataagatgttataattatgtagtgtataaggaggcatacaagatgactgaagaattcaatgaatcaatgattaatgatattaaagaaggtgacaaagtcactggtgaagttcaacaagtagaggataaacaagttgttgtgcatattaatggtggcaaatttaatggaattattcctattagccagctttcaacacatcatatcgaaaaccctagtgaagttgtaaaagtcggtgatgaagtcgaagcatatgtcactaaaatcgagttcgacgaagaaaatgatactggggcatacattttatcaaaaagacaacttgaaactgaaaaatcttatgaatatttacaagaaaaactagataacgatgaagtgattgaagctgaagttactgaagtagttaaaggtggtttagtcgttgacgttggtcaaagagggtttgtacctgcttctctaatttcaactgatttcattgaagatttttctgtattcgatggtcaaacaatccgtattaaagtggaagaacttgatcctgaaaacaatagagtcattttaagccgtaaagctgtggaacagttagaaaacgacgctaaaaaagcttcaatattagattctttaaatgaaggcgatgttattgatggtaaagttgctcgattaactaactttggtgctttcattgatattggtggcgtagatggtttagttcacgtttctgaattatctcatgaacatgttcaaacaccagaagaagttgtgtcagtaggtgaagcagtcaaagttaaagttaaatctgtagaaaaagattctgaacgtatttctttatctattaaagacactttaccaacaccatttgaaaacattaaagggaaatttcacgaagatgatgttattgaaggtactgtagtacgtttggcgaactttggcgcattcgtagaaattgctccatccgtccaaggtttagtgcatatttctgaaatcgatcataaacatatcggttctcctaacgaagtattagaacctggacaacaagttaatgtaaaaatattaggtatcgatgaagataatgaaagaatttcattatcaatcaaagcaacgttacctaaagaaaatgtcattgaaagtgacgcatccacaactcaatcatatcttgaagatgataatgatgaagataaaccaacattaggcgatgtttttggtgataaatttaaagaccttaagttttaa

SEQ ID NO: 285 - DNA, 192 bp, Staphylococcus epidermidis
attgtacactctgtatatcaactcgatattttagataagttaccatttataaatcaaatgatttcagttaatatttctatacctttttctaattgttttttagtgatggtcaatggcggtaataacctaatcacatttttaccagctgttaaaatgattaaccccatacgtttagcttctcgcactacttga

SEQ ID NO: 286 - DNA, 186 bp, Staphylococcus epidermidis
tcaaatccatcgacatctatcattataaataaagattccagtcactacagtaagatgctgactagaatagctatatcatgtcatactaatgagaggacatcttcttcacaaagattctcttactatagaatcgacgagctaaacttgatagacggagatagcaattatacgggagcgagactatga

SEQ ID NO: 287 - DNA, 894 bp, Staphylococcus epidermidis
aaagaaggattaaaaatgcctcaaagagtattgctcgttgatggaatggctttattatttagacatttttatgcaacaagcttacacaatcaatttatgtacaattctaaaggaattcctacaaatggtattcaaggttttgtaagacatatttttagcgctatcaaggaaatcgaacctactcacgtagcagtttgttgggatatggggcaagaaacattcagaaatgaaatgtatgatggctataaacaaaatcgcccagcacctcctgatgaacttattcctcaattcgattatgttaaagaaatatcccatcagtttggttttgtaaatgttggtaagcgtaattatgaagctgatgatattattggcagtttagcggaaacatattcacaagaacatgaagtttatatcattaccggagaccgagacttactccaatgcattaatcataatgtagaagtttggcttataaaaaaaggttttacaatctatcaacgttacacgcttgatcgtttcattgatgaatacgggcttaatcctcaacaattaatagatgttaaagcttttatgggtgatacagcagatggctattctggtgtaaaagggataggtgaaaaaacagcaattaaattaattcaaaatcatggaactgtcgaaaatgtagtgaacaatttatcatcattaactcccgctcaacagaaaaaaataacaaataatttaaatcatctgcatttatcaaaatcactcgcagaaatatataccaaagttccaattgaaacagacaaactttttaaagagatgacatatgctcatacactaaatgagattttatccatttgtaatgaacatgaactatacgtttcaagtaaatatattgcaactcacctctaa

SEQ ID NO: 288 - DNA, 468 bp, Staphylococcus epidermidis
tttgaggtgttaattgtgccaaaaaagtcagtgagacatataaaaataagagagataatttcaaatgaacaaatagaaacacaagatgaactagttaaacgtttgaatgagtatgatttaaatgttactcaagctactgtttcacgagatattaaagaattgcaattaattaaagttcctgcacctacagggcaatatgtttatagtttaccaaatgatcgtagatatcatccattagagaagttgggtagatatttaatggattcatttgtaaacattgagggtactggtaatctactagttcttaaaacgcttcctggtaatgctcaatccattggtgctatacttgatcaaattgattgggatgaggtacttggtacaatttgtggtgatgatacatgcttacttatttgtcgagacgaagaagcgagtgaagaaatcaaaactcgaattttcaatttattataa

SEQ ID NO: 289 - DNA, 945 bp, Staphylococcus epidermidis
attcgtcagttaaagtgtatcgaaaggagactggacatgcaaaaaaatattctaaaaagtggcatcgaaatttctgaacttgggttaggttgcatgagtttaggcacagattataaaaaagcgcaaccaattattgaaagtgcaattgataatggtattacgtattttgatactgcagatatttacgatcaaggagttaatgaagaaattgttggtaaagccttaaaaaaatatcaaaatcgtgatgacatcgttatcggaactaaagttggaaatcgattaactgacgatggacatatgacgtgggatccttcgaaaaaacatattaaagaaagtgttaagggatcattgaaacgattaggattaaaccatttagacttatatcaattacatggcggaacaatagatgatcctctagacgaaactattagtgcatttgatgaattaaagcaagaaggatatattcgtgcatatggaatttcatctatacggcctaacgtgatagactattatcttaaaaatagtcaaattgaaacacttatgtcccagtttaatttaatagataatcgccctgaaagtcttattaatgacgttcatgataagcaagttaaaattctagcacgtggccctgtatttaaaggtttattaacttcaaaaagtgttgatgttatagatgaaaaatttaaaaacggtgtgttagattacactcaagacgaattaggtagcacgattgcttctattaaagaattggaaagtaatttaaccgcgttatcatttaaatatttaacttctcatgatgctatggggtcaattattgtaggagctagtagcgttgaacaacttgaagagaatgtccgcaattattataaagaaatcagtttagatcaaatcaaatctgcacgtaatagagttaaagatattgaatatacacaacatttgaaataa

SEQ ID NO: 290 - DNA, 246 bp, Staphylococcus epidermidis
tttgtgcatacctgttcgtatgttggattttctacatgtcctccactatatccggaaacgactgattttattccaggatatgaggtgaagggtttaaccatgcaccaaaaacaacctccagctagtgtcgcatatgccatgttatattccctccttaagttatctgtttgtttaaatttacgctatattgtcgggaatttaaagtatttaactcagaatcattcatgtgattttgtgacaacttag

SEQ ID NO: 291 - DNA, 1488 bp, Staphylococcus epidermidis
ggatgtgataccatgaatgatcatcaaaaaaatcatgcaacatctcaagatgataacacaaagtcaacaccatctaagaatagcaagcatataaaaattaaattatggcatttcatactcgttattttgggtattattcttttaacatccatcattactgtagtatcaacaattttaattagccatcaaaaaagtggtttaaataaagaacaacgtgcaaatttaaaaaaaattgaatatgtctatcaaacacttaataaagattattacaaaaagcaaagttctgataaattaactcaatctgccatagatggtatggttaaagaacttaaagatccatattcagaatatatgactgctgaagaaacaaaacaatttaatgaaggtgtatcaggtgatttcgttggcataggtgctgaaatgcaaaagaaaaatgaacagataagtgttactagtccaatgaaggattcaccagcagaaaaagctggtattcaacctaaagatatcgtcacacaagtgaatcatcattcggtagtcggtaaaccacttgatcaagttgttaaaatggtccgcggtaaaaaaggaacatatgttactttaactataaaacgtggttcgcaagaaaaggatattaagattaaacgcgataccattcacgttaagagtgtagagtatgagaagaaaggcaatgtaggcgtactaacaatcaataaattccaaagcaatacttctggtgaactcaaatctgcaatcatcaaagcgcataagcaaggcatccgtcatatcattttagatttgagaaataatccgggggggttattagatgaggcagtcaagatggctaacatctttattgataagggaaatactgtcgttcaattagaaaaaggtaaggataaggaagaattaaaaacttctaatcaagcactaaaacaagcaaaagatatgaaagtatccatcttagttaatgagggatcagctagtgcttcagaagtgtttacaggtgctatgaaagactatcataaagctaaagtttacggttctaaaacatttggtaaaggtatcgttcagaccactcgtgaatttagtgatggttcattaattaaatatacagagatgaaatggctaacgcctgatggccattatattcatggtaaaggaattagaccagatgttagtatctcaacaccaaaataccaatcactcaatgtcattccagataacaaaacttatcatcaaggtgaaaaagataaaaatgttaaaacgatgaaaataggtctaaaagctttaggttatccaattgataacgaaacaaacatatttgacgaacaattagaatctgctattaaaacatttcaacaagacaataatttaaaagttaatggcaattttgataaaaaaacaaatgataaatttactgaaaaactagttgaaaaagcgaataaaaaagatactgttttaaacgatttactaaacaaactaaaataa

SEQ ID NO: 292 - DNA, 612 bp, Staphylococcus epidermidis
catctcatcacaaacattacaacaggtttaaaagatgtggttgaagttacattcaatcaaatcactgtagatggtgacacttcaacaaatgatatggtgcttgtgatgtcaaatggatgtacaaataataacgaaattaaaaaagacagcgaagactactataaatttaagcagatgcttctatatattatgaccgatttagcaaaaagtattgcaagggatggcgaaggtgcttctaaattaatagaagtcacggttaaaggtgcaaaagaatctagtgctgcaagaatgattgctaaaagtgtggtgggttcaagtttagtaaaaaccgcaatttttggcgaagatcctaattggggtagaattattgctgctgcaggttatgctaaaacatattttgatattaatcaggtagacatttttataggtaggatacctgtattaataagatcctcaccagtaaagtacgataaagaagaaattcaagaaataatgagtgctgaagaaatatcaattcagcttgaccttcatcaagggaattgtgaaggtcaagcatggggatgtgatttatcgtatgactacgttaaaatcaacgcactatacaccacttag

SEQ ID NO: 293 - DNA, 393 bp, Staphylococcus epidermidis
gagtctgaagccgacagtatagtctggatgggagaaaatggaggttttttgttgttcaaatttcctccttttctaagtaagatgaatggaaggagaaaattatatatgcaacaaaacaaacgtttgattacaattagtatgttaagtgcggtagcgtttgtgttaactttcatcaagtttccattgccatttataccaccgtatctaactctcgattttagtgatgtaccgacgttattagcaacattcctcttaagtcctattgctgggattatcgttgcactcatcaaaaatattttaaattttctattcaatataggggatcctgttggaccagtagctaactttttagccaggcgtcagctttttgctatcatcatactatgtttatag

SEQ ID NO: 294 - DNA, 339 bp, Staphylococcus epidermidis
gctaatgcggcacattacggtgcatcgaaagcagggtttagcgccgttcttaatgcattgagattagaacaaccggaattaaaagtgctcaatgtacagcccggtccaatagatacaccattccaaaaaaacgcagatcctactctaaagtattttaaaaattatagacacatgatgatacaacctcaacaacttgccaagcaaatagtggaaggaataatactaaataaaattgaaattaatcaaccatcatggatgcaaataatgcttaaattttatcaattatgtccacgtacactagaaaaattatgtccaaatctatttaaaaataaagtttaa

SEQ ID NO: 295 - DNA, 465 bp, Staphylococcus epidermidis
aggagtgaggcttccgtggaagaacgattaaatcgcgtgaagcaacaattacaacaatcttcatataaattgactccacaaagagaggcaactgttagagtattaattgaaaatgaaaaagatcatcttagcgcagaagatgtgtacttaaaagtcaaagataaggctccagaaataggattagctaccgtttatagaactttagaattgctagctgaaataaaagtgctagataaaataaattttggtgatggtgtagctcgttttgatttaagaaaagaaggagccaagcatttccatcatcatcttgtttgtatggaatgtggtaaagttgaagaaattgaagaagatttattacctgaggttgaaaatcgtgttgaaaatgagtttaatttcaagattttagatcaccgtttaacgtttcacggtgtatgttttgaatgccaagccaaaaataagcaataa

SEQ ID NO: 296 - DNA, 972 bp, Staphylococcus epidermidis
gggtttaatttgtacaatatactatcatacgctatgagtcatgcatttaactacaaaaccaataaaagtatctataatattttaacaggcaagaagtcacaccaaacgtttttcgatgcgtcaagccaacaacttttgtcattatatcatagtttacctaacttaaagtattcaacttttgagcaatttatactccaaaaggatgattttaaaaaatcaattcaagtaaaaatacatccacaatacacttatgatagtctcactcaaacctttagttgcatacaattacttatccaaacgttatctcatacacgcaaggagtcaaatacatttattccaatcgttcaaaatacctatatccaacaaagggttaaacaactttatcatcaggtcattgaatcaaatcaagtatcaaatactatagacgaaatatatttattatttgagaatttaaataataaatataaccatacatttcttcattattatttacaaggatatgaggaatccatgtatactagacaacaaataagtttaattgagggtataccacaatcagaattatttgaacgagaaatgaatgaactgattgacatattgaatcaattaaaagattcaacgaaatatccaatactttctcaagctatcattctttcaccattactaacaaatacatacttaagctatcaaaagttaaaatctggtctcaatttaaaagaaattgctcaattacaaaatgtaaaacttaacacaattgaagatcatattctagaaatgtatattaaaggttatttgatagactatacattatttataaataaaaaagatattctcgaatttataaactactatcaaaaacatcgcggtgaacgattaaaattttataaagaacattttactgattggacttactttcaaattaagttagttatagtaggaatagaaagaggtgatttaattgctgaaagataa

SEQ ID NO: 297 - DNA, 513 bp, Staphylococcus epidermidis
gagtgcatttacatgtttaaaaagttatttggaaaagctaaagaagttgacaaaaacattaaaatctacgcacctttgacaggtgagtatgtcaaaattgaagatattcctgatccagtttttgcgcaaaaaatgatgggagaaggctttggtattaatcctacagagggtgaagttgtttcaccgattgaaggcaaagtcgataatgtttttccaacgaaacatgccgtagggttaaaagccgaaaatggattagagttattagttcatatcggattagataccgttcaattggatggaaaagggtttgaagtacttgttgaaagtggagatgacattaaaataggtgacccacttatacgttttgacttagaatatattaataataatgcaaaatctattatttctcctattattattacaaactctgatcaaactgaatcaattcatattgaagacgtacaagcagtagttaaaggggaaacacaagttattgatgtgacagtaagctaa

SEQ ID NO: 298 - DNA, 465 bp, Staphylococcus epidermidis
aaaagcatttatcgaatcacactggggaggctcaaaatgattaaaaaaaacaaagaagaactgaatgacatggagtatctagtcactcaagaaaatggtactgaacctccgtttcaaaacgagtattggaatcactttgaaaaaggaatttacgttgataaattgtccggcaaaccattatttacttcagaggataaatttgaatctaattgcggttggccaagtttctccaaagcattaaatgatgatgaaatcgtagaacttgttgataaatcatttggtatgattagaactgaagttcgatcagaaaaagcaaatagtcacttggggcatgtttttaatgacggacctaaagaaaaaggtggtttaagatactgtattaactctgctgcgattcagtttataccttatgataaactagaagagttaggatatggagatttaattaaacattttaaaaaatag

SEQ ID NO: 299 - DNA, 717 bp, Staphylococcus epidermidis
gaggaaagttatatgtataatgaaatatttggtattgcgtcatttattgttacattcgctttaatggtactgatgtatcgctgttttggtaaacaaggactaattgcttgggtagcaataggaacgattatcgctaatatacaggtcataaaagcggttcatatttttggtattacggctacacttggaaatgtcatgtttgcttctatatatttagctactgatatattaaatgacatctatggtcgtaaagttgctaaaagagcggtgtggcttggtttctcttctaccttagtaatgattatagtcatgcaaatgtcattgcattttattcctgctccagtagacaatgcgcaaaactcattaaaaatgatttttgatttagttcctagaattgctataggttccattattgcttatatcataggccaacatattgatgtatttatattcagtatgattaaaaagatatttagctctgataagaccttttttattagagcatatggtagtaccattttaagttctatcattgataccggtttatttgtttcaattgcttttattggtactatgcctggtactgctgtttttgaaatatttattaccacttacttgttaaaactagtgtcaactatttttaatgtaccatttggatatatcgctaagtcactatatcgaaaaggaaagatagaacaactagataatgggtattga

SEQ ID NO: 300 - DNA, 1059 bp, Staphylococcus epidermidis
aggaacacctattcatattattccaagaaaaagaaattaaaaacaaaggggaattcaataatgagaaaaattacagtttttggtatgggtagttttggtactgcattagctaatgtattagctcaaaatggtcatgatgttttaatgtggggcaaaaatgtagagaatgtagatgaacttaacacacatcatatgaacaaaaattatcttaaagatgctaaattagattcatctataaaagcaactgtagatttaaataaggcagtgcaattttcagatatctatcttatggcactacctacaaaagcaattagagaagtatcaaaagatatcgatcaattactcacatctaaaaagacttttattcatgttgctaaaggcattgaaaacgatacatttaagcgcgtatctgaaatgattgaggactctatctcttcagaacataatggaggaatcggcgtcttatcaggtccaagtcatgctgaagaagttgttataaaacaacctacaactgtagctgcatcatctaaagataataatgtgagcaaacttattcaagatttatttatgaacgactatttacgtgtttacacaaataatgatttagtaggtgtagaattaggtggtgctttaaaaaatattatagctatagctagtggtatcgttgccggcatgggttacggtgataatgcaaaagcagctttaatgacacgaggtttagccgaaatcagtcgacttggtgagaaacttggtgcagatccaatgactttcttaggtctaggtggcataggtgacttgatcgtaacttgtacgtccacacattcacgaaattacacacttgggtttaaattagggcaaggcaaaacagcagaagaagctttaaaagagatgaaaatggtggttgaaggtatgtatacaactaaatcagtatatcatcttgctcaacaagaaggagtagagatgcctatcactaacgcattatatgaagttttatttgaagatgtccctgtaagtaaaagtgttagaacacttatggaaagagacaaaaaagcagaataa

SEQ ID NO: 301 - DNA, 573 bp, Staphylococcus epidermidis
aagtatcaatatgatttaaatttattgttaccactcgttaaaattctaaaaaagaggtgttttagtaagatgattagattagcaactaaaaatgatttacttagtattactcaattagtcaaagatgctaaacagattatggaagaattcaacaacaaccaatgggatgatgaatatcccgcgaaagaacatgttgaagaagacatcgaatataaaacactatatgtgttagacgtggatcatacaatttatggtttgattgtgatcgaccaaaatcaatcggagtggtatgatgacattgattggcctgttaatccaaatggggcatacgttattcacagattacctggatcaaaacaatataaaggtgctgccactgaacttttccaatttgccattgacttagcaaatgaacatgatattcatgtcattttaacagatacatttgccctcaataaacctgctcaaggattatttgaaaagtttggttttactaaagttgatgagatagagatagattatcatccttttgatagaggggcacctttttatgcatattataaaaacatataa

SEQ ID NO: 302 - DNA, 1317 bp, Staphylococcus epidermidis
aaagaaaaatataggagtttggttatgaaaactacgattaaacaagcgaaaaaacatcttaaccaagaagtaacaattggtgcttggttaactaataaacgttcaagtggtaaaatagcgtttttacaattacgcgatggtacaggatttatgcaaggagtagtagtaaaatctgaagtagatgaagaaacatttcaactagcaaaagatataactcaagaatcatctttatacatcacaggaacgattacagaagataatcgttctgatttaggctacgaaatgcaagttaaatcaatcgaaattgtacatgaagcacacgattatcctattacaccaaagaatcatggaacagaatttttaatggatcatcgtcacttatggttacgttcaaaaaaacaacatgctgtcatgaaaataagaaatgaaattatccgtgcaacatatgagtttttcaatgaaaatggcttcactaaaattgatccacctattttaacagcaagtgcaccagagggaacaagtgagttattccatacaaaatatttcgatgaagatgcattcttatcacaaagtgggcagttgtatatggaagcagccgcaatggctcacggacgtgttttttcatttggcccaacttttcgtgcagaaaaatctaaaacacgccgtcatttaattgaattctggatgattgaaccagaaatggcctttacaaatcatgcagaaagcttagaaatacaagaacagtatgtgtctcacattgttcaatctgttttaaatcattgccaattagaactcaaagctttagatagagatacaactaaactagaaaaagttgctacacctttccctagaatttcttatgatgatgctatcgaattcttgaaaaaagagggattcgatgatattgaatggggtgaagactttggtgcacctcatgaaacagccatcgctaatcactatgatttaccagtattcattacaaattatccaactaaaattaaaccattctatatgcaaccaaatccagacaatgaagatacagtattatgtgctgatttaattgcgcctgaaggttacggtgaaattattggtggttccgaacgtattaatgatttagaattattagaacaacgcattaatgagcacgaattggatgaggaaagttatagctattatttagatttacgtcgctatggtagcgtaccacatagtggttttggcttaggcttagagcgaacagtagcttggatttctggagttgaacatgttcgtgaaacatccccattcccacgtttacttaatcgcttatatccataa

SEQ ID NO: 303 - DNA, 315 bp, Staphylococcus epidermidis
tataatgaatatcattataaaacctcaggaggtgaattcataatgaataaaactgatttaattaatgcagttgcagaacaagctgacttaactaaaaaagaagctggttcagcagtagatgctgtatttgaatctatccaaaactcacttgctaaaggtgaaaaagtacaattaatcggtttcggtaactttgaagtacgtgaacgcgctgctcgtaaaggtcgtaaccctcaaacaggtaaagaaattgacatccctgcaagtaaagtaccagcatttaaagctggtaaagcattaaaagatgctgtaaaataa

SEQ ID NO: 304 - DNA, 1725 bp, Staphylococcus epidermidis
gaaactggatacatcactatattaaggagaatgtacatgtttagaaagtctatgctcatcttaatgattgctgtcattttgttcgtaacagcatgtagcaaagataaaacgcaagatgaagcgaaaagaaaagcagatgctaaaggtaaaccagatacatggattgcagatagaaagcttaaaggacttgtgtttcaaagtgataacgatgcctcccctaaaatgaataaagaagtcgctcaagaacttaagaaaaagactggcatcacgttagaacttcaaaccgtttctaatgaagattccacagaagcattaacttcaggactcgcttcaggagatttacccgacttcatcgtttattacttagacgatagtggaagacctgaaatgaaagtactaaataaagcagcgaaacaaggtcgactcacagacttaacgaaaatgcttaaaaacacaaaaatttatagtaagtatttcaaaaaaggatatttaccaaaagatacgaaagataacatcatgtttaataaagaacaagatggaacgtaccttgtacatatggggattaaccgtcatccaggacaagaagaacgtcgcactgtaggtggtccttacgtcagaaaagatatcatggataaacttcatatcgaccctacttctatcaagacgtccaaagatgtagaaaaacttgctgaaaagatgaaagaacaccacttcaaagatgataatggtaaagaaatcacacctattggcccaacagcgtggggcggtgacgatcgtactaaattctataatgaccttgtgtggactggtcagtctgatgagaaatttttaaataaaggtaagaaaattatacatgaatcacaaaccgaatatccacttaaacgtgtacattacgttaaagaccttatgaagaaaggcttaatgacaaaagagttctatacaatggaagaaaataaagcaaaagaaggactcgttaatggctcatggggcattgtttcagatttacataactatgttactgaaaatcaaagtatgaaatacgttcctcttgggccactcaatacagtcaaaggtaaatttagagttgaaaagccatataaatcaggcgcaaacggttgggctgtaccaagtacgactgaacatcctgaagacgtcgttaaactcgctgatttccttgcaagtcgcagaggtaaattactcggtcagtacggtattaaaggacgtgactatacgttagataagaaaggtaaccctcatgttaaacctgaagtgttaaaagaagttgaaaataatccagacgaagctaaaaaacgtggttttagaggtgcgggttcttattgggcagatcatcttggttatactgatatagataataaagctgatttcggtgaaactgaatacggagataatacaaaaacgaaaaagacgactcctgaaaagattgctgatatgtggcattatgatcaaagacagaaacacgccaaaatcgtaaacggactcacagtaaagtcattcttatctaaatatgaatatggcgaagatttagaagttgcactcgatgattatagtgacgctattaaacgtgcttattattctcaatcagacaaggaaacgaaacaaattattgatagtgctaagcaacgtttagaagaggcaggcttaaatcaatttgaaagatacgttgaaaatcaaagagataaaaaaggaactcaaattatttattaa

SEQ ID NO: 305 - DNA, 774 bp, Staphylococcus epidermidis
ataattatgtataaaagaaatgaacgtttgaatcttattcgtaaacgtgttgatcagtacggacaggtggcagtaaaagatttagctatattcttacaagttacgcctgaaaccgtgagaaaagatttagaaaccttagaaaacgataaactgattacacgtacacatggaggtgcgatacaatacaatcatattaataaagagaaatcatatgcgaataagtggcagaaacaatcacaagtaaaagagcgtattgctaagaaagctgctttgcaaataaagtctggagaaattattgtcatcgatggtggaaccacaacagggcgaattcctcaatatctcaatgatattactcagaccacgattgtgacgaattctctgaagattgcggatgaattgaatcgtgctatagaggagcaacgaattcaagcagaagtgattatgcttgctggaaagacgaatactgaacaagatgttgtgcgcgggcatatgacgaatgagttattacaacgttttaaatttgataaagcttttatttcatgtggttcgtttgatacgagtgattgttatgaatttgatctggaagaagcgcatgcaagtcacattatgattcaaaaaagtcaactgagttatctcttagcggatagtagtaagcgagatgcgcatgcgtcgtatcgtattgatggttttagcgaaattgattatatgatttctgattatgctaaacctcagaatatagaatattttaatcagaagcattggttacagatttaa

SEQ ID NO: 306 - DNA, 1278 bp, Staphylococcus epidermidis
aataaaaatctccttgtttgtctaactgacttatgttgtgtgattgaatatgataatatattaaacatattacaatttaatgtattgaagaatagaaaggggcgtgcgatcatgagataccttacatccggtgaatcacatggaccacaacttacagtcatcatagaaggtgtaccagctaatttagaaattaaggctgaagatattaataaggaaatgtttaaacgtcaagggggatatggtcgggggcgtcgtatgaaaattgaaaaagatactatagaaattgtgtcaggcgtcagaaatggctttactttaggaagtccaataactttagtagttactaacgacgatttcactcattggagaaaaataatgggcgtcgcaccaattagtgatgaagaaagagaaaatatgaaacgtaccattacaaaacctagaccgggccatgctgatcttataggtggcatgaaatataatcatcgtgatttaagaaatgtgcttgagcgttcatctgctagagaaacagcagcaagagttgctgtgggtgctgtttcaaaaattcttttagaacaattagatatccacttatatagccgtgtagtcgaaattggtggtattaaagacaaaggtttatatgatgtagatatgttcaaaaataatgtagataaaaatgatgtacgtgtaattgacgaaaatattgcgcaacaaatgagagataaaatagatgaagcgaaaaaagacggagattcaatcgggggcgtagttcaagtaatggctgaaaacatgcctattggagtgggaagttatgtacactatgaccgtaaattagatggacgcattgcacagggtgttgtgagtatcaacgccttcaaaggtgtaagttttggtgagggatttaaagcagctgaaaaacctggtagcgaaattcaagatgaaattcattataatcaagattcaggctattttagagctacaaatcacttaggtggatttgaaggaggcatgagtaatgggatgcctataattgttaatggtgtcatgaagcctattcctactttatataaaccactaaactcagttgatattaatactaaagaagacttcaaagctactatagaacgctcagatagttgtgcagtgcccgcagctagcgtagtatgtgaacacgttgtcgcttttgagttagcaaaagcagtactcgaagagtttcaatctaaccacatggaccaactcgtagcacaaattaaagagcgtcgacaactcaacatagaattttaa

SEQ ID NO: 307 - DNA, 1116 bp, Staphylococcus epidermidis
ttaaatcttcaaaggagcaaagacatgatacaaatcaaggatttaaacaaagtttacgacaatggtagttacgcagttaaagatttcaatttagatattgaggacaatgaatttgtagtatttgtaggaccttcgggatgtgggaaatcaacaacgttacgtatgattgcaggacttgaagatgtgagcaaagggacaattagtatcaacgataaagtaatcaacgatttacaacctaaagatcgtaagattgctatggtctttcaaaactatgcattatatccacatatgacagtttataaaaatttagctttcggcttaaaaatgcgaggaatcaagaagaaaatttatgacgaaaaaattcaacatgcagctcaaatattagaaattgaaaacctcctcgaccgtaaacctaaagccttatctggaggacaacgtcaacgtgtggcacttggtcgagctatcgttagagaagctcaaatctttctcatggatgaaccactttctaatttagatgctaaattacgaagtaacatgagaagcgaaattataaaaatacataaacaaatgaaagcaacaacgatttacgtgacacacgaccaaactgaagctatgacaatggcatcacgtatcgtcatattaaaacaaggcgaaatacaacaaattggtacgcctgaagaaatttatcgtcatcctgtcaatgaatttgttgccactttcattggtagcccatcaatgaatatggttccaatgacctacaacatggatgcttggtacttcgatggacaaaaagtggctgatgctacattacttcaacttgcatcgcatgcacaatacagacttggtatacgacctgaagacttacatcttgttaatgataacgaaataagtaattatccaatccaactttctcaattcactgtagacttagttgagttaactggttcatacaaattacttcactgtcatcacaatgagcataaaatcatagcagctgtagatagtaatttggattttgaattaggacaaacagtttccttcggtataaaaacggaagatgcacactttttcgattctgattcaggcgaaagagtacaagaggaggttttatcatga

SEQ ID NO: 308 - DNA, 612 bp, Staphylococcus epidermidis
aaggtagttcatactaagatgtatcaatggctttgggaaacttcactttatcaaaaatggttgatttcttttattttaatttgcaatatatttggtacgatatacggttatcattggtatagtagtcaattagctaacacaccaaattattttaaattatttgttccagatagtcccactgctacattatttttatgtttatcattattattcatactatttaataagcgttatgccctgattgacgctttagcttttataactctatttaaatatggtagttgggctgtaattatgaatattttgatgtttataaaaatgaatgatattgccataaacggacttatgttgctcatttctcacgcaattatgatattagaagctatctatttttatcctcgttttaaaatatctaaattggctggattgatgagtttcatatgggtgacgatcaatgacgtaatagattacatatacggacaatatccctactatgattttatcgccaaacatttaattgaagtaggggtattggcttatagtctcactatcatttcgtatattttatttttaaaattacaaaagtggttgaaagttaaaacatttgattaa

SEQ ID NO: 309 - DNA, 198 bp, Staphylococcus epidermidis
agaagtaatcaaggaggcatgagtatgtctaatttatggattatatttgcagttactgtactaatagcagtttattccgcaattgaagtatttacaaatttaaatcataaacaacaaccaagatttaaatattttactatcgcatttgttgtgtttattatcttagcgattatagaagttatatttcttgctcaatga

SEQ ID NO: 310 - DNA, 240 bp, Staphylococcus epidermidis
aaattaaatcaaaaacaaacagaacctaagataacatatatacttcaggttctgctaacaaatagggcattgatgtctaaatttagcccttttattaagatttatttaactttggtcgtaggtcctatcattgagaatttcgctcgaaaattctacggacaaaccaaattgaatttcgaagctagttcagcacatggaactctgattcgcttttgtataactatatttctgatacaataa

SEQ ID NO: 311 - DNA, 1332 bp, Staphylococcus epidermidis
ggagggtgtcaattggatataaaaatgcctaagcttggtgaaagtgtgcatgaaggtacgattgaacaatggttagtatcagtaggagatcatgtagatgagtatgaaccattatgtgaagttattacagataaagtaacagctgaagtgccttcaacaatttctggaacaataacagaattagtggttgaagaaggacaaactgtcaatattaacacggtgatttgtaaaatcgattcggaaaatggtcaaaatcaaacagaatcggcaaatgagtttaaggaagaacaaaatcagcattctcaatcaaatataaacgtgtcacaattcgaaaataatcctaaaactcatgaaagtgaggtgcatacagcctctagtcgcgcaaataacaatggacgattttcaccagttgtctttaaattagcttctgaacatgatattgatttaacacaagtcaaaggaactggttttgaaggtcgtgttactaagaaagatattcaaaatattattaacaatccaaacgatcaagaaaaagagaaagaatttaaacaaacagataaaaaagatcattcaacgaaccatggtgactttttacatcaatcctcaactaaaaacgaacactcaccatcatcaaatgaacgtgtcgtaccagttaaaggtattagaaaagctatcgcacaaaatatggttactagtgtcagcgaaataccacacggttggatgatggttgaagctgatgcaacgaatttggttcagactagaaactatcataaagctcaatttaaacagaatgagggttacaatttaactttctttgcgttttttgtaaaagctgttgcagaggctttaaaagtaaatccattactcaatagtacatggcaaggagatgaaattgttatccacaaagatattaatatctctattgctgttgcagacgatgataagttgtatgtgccagtcattaaaaatgcagatgaaaaatcaattaaaggtatcgcgcgtgaaatcaatgatttagctactaaagcaagattaggaaaattagcacaaagtgatatgcaaaacggtacatttacggttaataatactggttcttttggttctgtttcttcaatgggaatcattaatcatccacaagctgccattttacaagtagaatcagtcgttaagaaacctgtagttatagatgatatgattgcaattagaaatatggttaatttgtgtatttcaatcgatcatcgtattctcgatggtgttcaaacgggaaaatttatgaatcttgttaagaaaaaaatagaacaatattctattgaaaacacttctatttattaa

SEQ ID NO: 312 - DNA, 696 bp, Staphylococcus epidermidis
aaaataagtcatatactaaaaatgtatcatattttaattagaaaggggcttttaaatatgaagactgttttgattgtaggcgcaaatggtagagtatctatcgaagcgacaaaaattttcctagagaactcaagatttaatgttgatttatttttgagaaatgcgcatcgtatacctgattacgcctctaatagaattaaagtttatgagggagacgctaaaaatattgaggatttagaaagtgctttaaacaatgttgatgttgtttttgcaagtttatcgggatcacttgataaacaagctgaaactatcgtaaaagccatggataacaaaaatgttaagagactgatttttgtagcagctcctggtatttatgatgaactaccagaaccattcaatcaatggaataaagaacaatttggcgaaaaattgaatcgctaccgcaaagcatctgatattatagaaaattcagatttagattacacaataatacgtccaggctggcttacagataaaaatgaaaatgtatatgagatcacagcaaagaacgaaacatttaaaggtactgaagtatcacgtaaaagtgtagcatctttagcagtacaaattgccaaaaacccagaactacactctaaagaaaatattggtgtgaataaacctaatacagaaggtaataaacctgcttggttcaattag

SEQ ID NO: 313 - DNA, 1416 bp, Staphylococcus epidermidis
agaaaaatccatagaaacagtacgtggcgtagggtatgtgattcgatgattaagcgccaaaaattaaaatataaatggatgcttattacgacgctcattaccttcacgacaatattacttttctgcttaattattattttctttttaaaagatactttacgaagtagtgaaattgacgaagctgaaagaagttcaaatgatatcgccaatctgttccattctaaatctttaagtgatatatctgcattggatttaaatgcatccttagaaaattttcaagaaatattgatttatgatgataagggtaggaagttaattcaaacatcaaatgataatacacttgcttatgataacaaaattgatttcaaacatcctgaacgtatacatattcaaagaagccacggtattaattacttagtaataactgaacctatacgttcgaaagatttttctggatacagtgtattagtccattctcttcaaaattatgataatctcgttaaatcactttatatagttgcacttgcttttggattaattgcaaccattattactgccggcgtgagttatatcttttcttcacaaattactaaaccgatagttacaatgtccaataaaatgaatcaaattagaagagatggttttcaaaataaacttgaattaactacaaattatgaagaaacagataatttaattgatacttttaatgaaatgatgtatcaaatagaagaatcttttaatcagcaacgtcaatttgtcgaggatgcttcacacgaattaagaacgccactgcagattattcaaggtcatctaaatttaatccaacgttgggggaaaaaagatccagcagttttggaagaatctttgaatatttcaattgaagaagtgaatcgaataacaaaacttgtcgaagaactacttttacttaccaaagatagagtcaatcataatgttttggaatgtgaaaatgtagacgtaaatagcgagattcaatcacgtgtgaagtcactgcaacacctacatccagattatacttttgaaacacatcttgctactaagcctatccaattaaaaattaaccgtcatcagtttgaacaactcttactcatatttattgataatgcaatgaaatacgacactgaacataagcacattaaaattgttactcaactaaaaaataaaatgattatgattgatattactgatcatggtatgggtataccaaaagctgacttagaatttatctttgatagattttatcgtgtagataaatcacgtgctcgtagtcaaggaggcaatggattaggactatcaatagcggaaaaaattgtgcaacttaacggtggtatgattcaggtagaaagtgaactacaaaagtacacgactttcaaaatcagttttccagtactaaactaa

SEQ ID NO: 314 - DNA, 732 bp, Staphylococcus epidermidis
aatatgtcccaaatgatgtttgacaatttcctctcaagttctcgcgcaaaatggggtgagcgttcaggtttaacacttttcttaccacatgtttttgaaggacagggaccagagcattcatcggcacgcttagaaagatttctacaattagccgctgaaaataattcaactgtagttaatctatctagtgcaagtaattacttccatttactacgtgcacaagccgctagtttagataccttagaaatgagaccattaattgtcatgtcacctaagagtcttttaagaaataaaacagtagctaaacctattgatgagtttacatctggcggttttaaacctatcatcacagaagatatcgatgaacaaaaagtcaaaaaagtgattttagcatcaggaaagatgtatattgacctaaaagaatatttagctaaaaatcctaacgattctattcttctcatagcagtagaaagattatatccgttcccagaagaagaaattaaagaagtattaaaatcgttacctcatcttgaaaatgtgtcatgggttcaagaagaacctaaaaatcaaggtgcatggttattcgtgtatccttatctaaaagcacttgttgctaataaatatgatttaacttatcacggtagaatacaaagagctgcacctgctgaaggcgatggagaaattcataaacttgtacaaactaaaattattgaaagtagcattaacaattaa

SEQ ID NO: 315 - DNA, 567 bp, Staphylococcus epidermidis
cgtaaatttaaacaaacagataacttaaggagggaatataacatggcatatgcgacactagctggaggttgtttttggtgcatggttaaacccttcacctcatatcctggaataaaatcagtcgtttccggatatagtggaggacatgtagaaaatccaacatacgaacaggtatgcacaaatcaaacaggacatgtggaagctgtacaaattgaatatgaccctaatattacaacatttgaaaatatcttagacgtttactttaaaacatttgacccaactgatgacggagggcagttctttgatagaggtgaaagctatcaacctgtcattttttatcatgatgagaatcaactcaaagctgccgagttaaagaaacaacaaattgacgaagagggtatctttaaaaaacctgttatcacaccgataaaaccatataaaaatttctatcctgcagaagaatatcatcaagattactacaaaaagaatcctacgcattatgaacaataccaacgtggatctggtagaaaagcatttatcgaatcacactggggaggctcaaaatga

SEQ ID NO: 316 - DNA, 1683 bp, Staphylococcus epidermidis
ttttttaataacataggaggagatattatgaaaagaaattggtggaaagaagcagttgcatatcaagtatatccacgaagttttaatgatagtaatggagatggaataggtgatctacctggattaattgaaaaattagattatctagaaaatttaggaatagatgtcatttggttaagcccaatgtatccatcaccaaacgatgataatggatatgatattagtgactacaaaggcattatgagtgaatttggtacaatgaacgattttgatcaattgttatcaagcatacatcaaagagggatgaaattaatattagacttagtggttaatcacacatcagatgaacacccttggtttattgaatcaaaatctagtaaaacaaatgcaaaaagagattggtatatttgggcagatcctaaaccggatggatctgaacctaataactgggaaagtatctttaatggttcaacttgggagtttgacgaatcgactaagcaatactatttccatttatttagcaaaaagcagccagatttaaattgggaaaatccagatgtaagacaagctgtgtttgaaatgatgaattggtggtttgaaaaaggtattgacggatttagagttgatgccattactcatattaaaaagaattttgaagcaggagatttacctgtacctgatggcaaaaaatttgctccagcatttgatgtagatatgaatcagccaggaatacaagaatggctccaagaaatgaaagataaatcgttaagtcggtatgacattatgactgtaggcgaggctaatggtgttactcctaatgatgctgaagaatgggtaggagaagaaaatgggaaatttaatatgatattccagtttgaacatcttggtttatggagtactggcgatacgaaattcgatgttaaatcctataaacaagtcttaaatcgttggcaaaagcaactagaaaatgtaggttggaatgctttatttatcgaaaaccatgatcaaccacgtcgtgtttcaacctggggtgatgataaaaattattggtatgaatcagcaactagtcacgctactgcctactttttacaacagggcacaccttttatttaccaaggtcaagaaataggtatgactaattatccatttgaaagcattgaaagtttcaacgatgtcgcagtgaaaactgaatatcaaatagtcaaaaaagaaggtggagatgtcaatcaattactagataaatataaaatggaaaaccgagacaatgcaaggactccaatgcaatggaataattctatcaatgctggattcactactggtaagccatggtttcatgtaaaccctaactatacagaaattaatgttaaacaacaactaaatgataagttttcgatactttcttattataaagcgttaattcaactaaaaaaatctgatttgatttacacctacggtaagtttaatatggtcgatgctgaaaataagcaggtttttgcatatacacgcacatttaaaaacaatactgtattaattgtagccaatctcacaaatgaagtatcagaactaaacctaccttttgaattagatatttcatctgtagatataaaattgcataattatcacttaaatgatataaatttagaccatattaaaccttatgaatcattcgtcgttgaaatataa

SEQ ID NO: 317 - DNA, 240 bp, Staphylococcus epidermidis
tgtgacagtaagctaatggttaagaattattcattttatcaatttattatgaccgtgcgcggaagaaaagacgataaaggtgtttttgctgagcaaatttttgaagaccttgcctttccaaaacacgaagatgattttaatacattatctgaatatattgagacacatagcgaattcaccctaccaatgtctgtatttgatgacttatatgatgactatacagaatggttgaagttttaa

SEQ ID NO: 318 - DNA, 849 bp, Staphylococcus epidermidis
atagaattcaaaattgaaggagttgagttgaatatgaaacttgtattttatggtgctggtaatatggcgcaggcaatttttactggaattattaattccaacaatttaaatgcaaatgatatttatttaactaataaatccaatgaacaagcattaaaaagctttgcagaaaaattaggggttaattatagttatgatgatgaagcattactcaaagatgccgattatgtatttttaggtacaaagccccatgattttgaaaatttagctaatcgtattagagaacacattactaatgataataggtttatttctataatggcaggtttatctattgattatattcgtcagcagcttaataccaataatccattagctcgtattatgccaaatacaaatgctcaagttggacattcggttactggaataagtttttcaaataattttgatcctaaatctaaaaatgaagtggatgaattaatcaatgcatttggatcagttatagaagtctccgaagaacatctacatcaagttactgcaattacaggaagtgggtctgcatttttatatcatgtatttgaacaatatgtaaaagcaggtacagaattaggtttagaacgaaatcaagtcgaagaatctatacgcaatttaattattggaacaagtaaaatgattgagcgttcagacttaagtatgtctcaattaaggaaaaatattacatctaaaggtggtactacacaagctggacttgatgcactatctcaatatgatattgtatcgatgtttgaagattgtttaggtgcagctgtgaatagaagtatggaattatcacataaagaagatgaataa

SEQ ID NO: 319 - DNA, 366 bp, Staphylococcus epidermidis
agaatggtcaatgtagcagattattctcaatctaatttaggaaaaattgaaatagcaccagaagtattatctgttatcgcatccattgcgacatcagaagtagaaggtattacaggccattttgctgaactaaaaaaaacaaatctagagaagattagtcgaaaaaatttaaacagagatttaaaaatcgaagctaaagaagacggaatatacattgatgtattttgttctttaaaacatggcgtaaatatttctaaaactgcaaatcaaattcaatcagcaattttcaattcaattacgacaatgacagctattgaaccacagcaaattaatattcacatcagaagtatcgtcgcagaaaaataa

SEQ ID NO: 320 - DNA, 195 bp, Staphylococcus epidermidis
cataaggccaagatttgcgccgaagtttacaggagcctctgtaaattctttcttgttcttagtcatttaacaccctccacaaaaatgatgaaacgcttacatggttatcatagcattatttcatatattgttaaagtacatttacctattattatacaaaataggagcaagacagaatttactccaaattcatag

SEQ ID NO: 321 - DNA, 1035 bp, Staphylococcus epidermidis
tggtcaagcaattcatgtatagttggaggtaaaaaaatgatagattacaagtcagcaggccttacagaagaagacctcaaaaaaatatataaatggatggacttaggaagaaaaacagacgaaaggctatggttactcaatcgtgcaggtaaaattccatttgttgtcagtggtcaagggcaggaagcaactcaaattggtatggcatatgcaatgcaaaaaggtgatatctcatcaccttattatcgtgatttagcatttgtcacttatatgggaatttctccattggatactatgttatcagcttttggaaaacgtgatgacattaactcaggaggtaaacaaatgccttctcattttagtcacaaagaaaaaggcattttatctcaaagttctccagtagccactcaaataccacattctgtcggtgctgcattagcacttaaaatggataacaagccaaatattgctaccgcaacagttggagaaggcagttcaaatcaaggtgactttcacgaaggtatgaactttgctgcagttcacaaattacctttcgtctgtgtaataattaacaataaatatgcgatatctgtaccagattcactacaatatgctgctgaaaagttatcagatcgtgcattaggttacggtatgcatggaatacaggtagatggaaatgacccaattgcagtatacaaagcgatgaaagaagcaagagaacgagcgctagcaggtgaaggtccaacattgatagaagctgtcacttcacgtatgacaccacattcatctgatgatgatgatacatatcgtacaaaagaagaaagagacctattgaaacaagaggattgtaatataaaatttaaaacggccttactcgatcaaggcatcataaacgaaaattggttgagtcaattggaaaaagagcataaagaactcattaatgaagctactaaatctgctgaagcagcaccatatccttcagaagaagaagctttgacatatgtttatgaagagggaggtcaacgaaatgactaa

SEQ ID NO: 322 - DNA, 30549 bp, Staphylococcus epidermidis
atgaagagcaaaccgaaattaaacggtcggaacatctgctcttttttattgagcaaatgtatgagttattcattgtcaaaattatcaacattaaaaacgtataattttcaaatcacatcaaacaacaaagaaaaaacatcaagaataggagtggcaatagctttgaataatcgtgataaattacaaaaatttagtattcgaaaatacgcaattggaacattttctactgtgattgcaacacttgtgttcatgggtatcaatacaaaccatgcaagtgccgacgagttgaatcaaaatcaaaagttaattaaacaattaaatcaaacagatgatgatgattcgaatacgcatagtcaagaaatcgaaaataacaaacaaaattctagtgggaagactgaatcattacgttcatcaactagtcaaaatcaagcaaatgcacgactgtcggatcaattcaaagacactaatgaaacatcgcaacaattacctacaaatgtttcggatgatagtatcaatcaatcgcatagtgaagcaaatatgaataacgaaccattgaaagttgataatagtactatgcaagcacatagtaaaatagtaagcgatagcgatgggaatgcttctgaaaataaacatcataaactaacagaaaatgtacttgcagaaagccgagcaagtaaaaatgacaaagagaaagagaatctacaagagaaagataaatcgcagcaagtacatccaccattagataaaaatgcattacaagctttttttgacgcatcatatcacaattacagaatgattgatagagatcgtgcggatgcaacagaatatcaaaaagtcaaatctacttttgactacgtcaatgacttactaggtaataatcaaaatattccttcagaacagcttgtttcggcatatcaacaattagagaaagcattagaacttgcacgtacgttaccacaacaatctactacagaaaaacgtggtagaagaagtacgagaagtgttgttgagaatcgttcatcaagaagcgattacttagatgctagaactgaatattatgtttcaaaagacgatgatgattctggtttccctcctggtactttcttccatgcttcaaatagaagatggccttataatttaccaagatctaggaacatcttacgtgcttctgatgtacaaggtaatgcttatatcactacaaaacgacttaaagatggatatcaatgggatattttatttaatagtaatcataaagggcatgaatatatgtactattggtttggacttccaagtgatcaaacaccaactggtccagtaactttcactattatcaaccgtgatggttcaagtacatctactggtggcgttggatttggatcaggtgcaccactacctcaattttggagatcagcaggtgctattaattctagcgtagcgaatgattttaaacatggctccgctacaaattatgcattttatgatggtgttaataatttttctgactttgctagagggggagaattatacttcgacagagaaggcgctacacaaactaataaatattatggcgatgaaaacttcgcattgctaaatagtgagaaaccagatcaaataagaggattagatacaatatatagttttaaaggtagtggtgatgtaagttatcgtatttcatttaaaactcaaggagctccaactgcaagattgtattatgctgctggcgcgcgttctggtgaatataaacaagcaacgaactataaccaactctatgtcgaaccttataagaattatcgaaatcgagtacagtcaaatgtccaagttaaaaatcgtacacttcatttaaaaagaacaatcagacaattcgatcctacattacagagaactactgatgttcctattttggatagtgacggttccggaagtattgattcggtatacgacccattaagttatgtaaagaatgtgactggtacagtcctaggtatttatccatcttatcttccttataatcaggaaagatggcagggagctaatgcaatgaatgcctatcaaattgaagaacttttttcacaagaaaatcttcaaaatgcagcacgttcaggccgtccaattcaatttcttgtaggttttgatgttgaagatagccatcataaccctgaaactcttttaccagtaaatttatatgtaaaacctgagttaaaacatacaattgagttatatcacgataatgaaaaacaagatagaaaggaattttcagtatcgaaacgagcgggccatggtgttttccaagtaatgagtggaacgcttcataacactgtaggatcaggaatattaccttatcaacaagagatacgtatcaaacttactagtaatgaaccaattaaagatagtgaatggtctattacaggatatcctaacacgcttacattacaaaacgctgtgggtagaacaaataatgctactgaaaaaaacttagctcttgttggtcatattgatccaggaaattatttcatcactgttaagtttggtgataaagtagaacaatttgaaattagatcaaaaccaactccaccaagaatcattacaactgctaatgaattacgtggaaatcctaaccataagcctgaaataagagtaacagatataccaaatgatactactgctaaaatcaaacttgtgatgggcggaaccgatggcgatcatgatccagaaataaatccatatactgtccctgaaaactacacagtagttgcagaagcataccatgataatgatccaagtaaaaatggggtcttaacattccgttcatcagactaccttaaagatctaccattaagcggtgaattaaaggcaattgtttattacaatcaatatgtacaatcaaactttagtaatagcgttccgtttagtagcgatacaacaccacctacaattaatgaaccggcaggactagttcataagtattacaggggagatcatgtagaaattactcttccagtcactgataatactggcggttcaggtttaagagatgtaaacgtcaatttacctcaaggttggacaaaaacctttacaatcaatcctaataataatactgagggtacgcttaagttaattggtaatatacctagtaatgaagcatataatacgacatatcatttcaatattactgcaaccgataattctggaaatacaacaaatccagctaaaacctttattttaaatgttggtaagttggctgatgatttaaatccagtcggattatctagagatcaactacaattagtgacagacccttcttcattatctaattccgaacgagaagaggtaaaaagaaaaataagtgaagcaaatgctaatataagatcatatttattacaaaataacccaatactcgctggagtaaacggcgatgttacattttattatagagatggttctgtagatgttattgatgctgaaaatgtaatcacatatgagcccgaaagaaaatccattttcagtgaaaatggtaatacaaataaaaaagaagcagtaatcactattgctagaggacaaaactataccattggtccaaacttaagaaaatatttctcattaagtaatggttcggatttacctaatagagatttcacctctatatcagctattggatctttaccttcatcgagtgaaattagtcgactcaatgttggaaattataactatagagttaatgctaaaaatgcttatcataagactcaacaagaacttaatttaaaacttaaaatagtagaggttaatgcacctactggtaataatcgtgtatatagagttagtacttataatttaactaatgatgaaatcaataaaatcaaacaagcatttaaagcagctaattctggacttaatttaaacgataacgatatcactgtttcgaataactttgaccatagaaatgttagtagtgtgacagtaactatacgtaagggcgatttgataaaagagttttcatcaaatctcaataatatgaatttcttacgttgggttaatataagggatgattataccatttcgtggacttctagtaagattcaaggtagaaatacagatggtggattagaatggtcaccagatcataaatcacttatttataaatatgatgcaacattaggtagacaaataaatactaatgacgtgttaactttacttcaagcaacagctaaaaactcaaatttacgttcaaatatcaatagtaatgaaaaacagttagcagaacgagggtctaatgggtattctaaatctataattagagatgatggcgagaaatcttatttacttaactcaaatcctattcaagtattagacttagtagaaccagataatggttacggtggacgtcaagtcagtcattctaacgttatatataatgaaaaaaattcttctatcgtaaatggtcaagttccagaagctaatggggcatccgcttttaatattgataaagttgttaaagctaatgcggcaaataatggtattatgggtgttatctataaggcacaattatacttagcaccatacagtccaaaaggttacattgaaaaattaggccaaaatttaagcaataccaataacgtgattaatgtttattttgtgccttctgataaagtaaatcctagtataactgtaggtaattacgaccatcatacggtatattctggtgaaacatttaaaaatactatcaatgtaaatgataattatggattaaatacagtagcttctacaagtgatagtgcaattactatgaccagaaacaacaacgagttagtaggtcaggctcctaatgttactaatagcataaataaaattgtaaaagttaaagccacagataaaagtggaaatgaaagtattgtttctttcacagtaaatataaaaccattaaacgagaaatatagaataacaacttcatcaagtaatcaaacaccagtgagaattagtaatattcaaaacaatgctaacctttcaattgaagatcaaaatagagtaaaatcttcactcagcatgactaaaattttaggtacaagaaattatgtcaatgagtcaaataatgacgttcgtagtcaagttgtaagtaaagtaaatagaagtgggaacaatgctacagttaatgttacaactacattttctgatggtacaactaatacaataaccgttccagttaaacatgtgttattagaagttgtacctactactagaacaacagtaagaggacaacaatttccaaccggcaaaggaacttccccaaatgatttctttagtttaagaacgggaggtccagttgatgcgagaatagtttgggttaataatcagggacccgatataaatagtaatcaaattggtagagatttaacattacacgctgaaatattctttgatggtgaaacaacaccaattagaaaagatactacttacaaacttagtcaatctattccaaagcaaatatatgaaacaactatcaatggtcgatttaattcatcaggtgatgcatatccaggaaattttgttcaagcagtaaatcaatattggccagaacatatggacttcagatgggcccaaggatcaggcacaccaagttctcgtaatgcaggttcatttactaaaacagttacggtagtttatcaaaacggccaaactgaaaacgttaatgtactattcaaagtcaaaccaaataaacctgttattgatagtaatagtgtgatttcaaaaggacaattaaatggtcaacaaattttagttcgaaatgttccacaaaatgcacaagtcactctatatcaatcaaatggaactgttattcctaatacaaatacaactatagattctaatggtatagctactgtaacaattcaaggcactctaccaaccggaaatattactgctaaaacctcaatgacaaataatgtaacgtacactaaacaaaatagtagtggaattgcttcaaatacaactgaagatataagtgttttttcagaaaacagtgatcaagtaaatgttaccgctggcatgcaagctaaaaatgatggtattaaaataattaaaggtacaaactataattttaatgacttcaatagtttcataagtaatataccagcccattctactcttacatggaacgaggagcctaatagttggaaaaacaacatcggtactacaacaaaaactgttacagttactctacctaatcatcaaggtacgagaactgtagatattccaataacaatctatccaacagttacagctaagaatccagtaagagatcaaaaaggacgaaacttaaccaatggtactgacgtttataattatattatttttgaaaataataaccgtcttggaggaacagcttcttggaaagacaatcgtcaacctgataaaaacatagccggtgtacaaaatttaattgcacttgttaattatcctggcatatctacaccattagaagttcctgttaaagtgtgggtatataattttgatttcactcaacctatctacaaaattcaagtaggagatacattccctaaaggaacatgggcaggctattacaaacatcttgaaaatggagagggattaccaatagatggttggaaattttattggaaccagcaaagtacaggaactactagtgatcaatggcaatcattagcatatactagaactccttttgttaaaactggtacttatgatgtcgttaatcctagcaactggggtgtttggcaaacatcacaatcagctaaatttatagttacaaatgctaaacctaatcaaccaaccataactcagtctaaaactggtgatgtaacagtaacacctggtgctgtgcgtaatatactaataagtgggacaaatgattatatccaagcatctgcagataagattgttattaataaaaatggaaataaattaactacatttgttaaaaataatgatggtcgttggactgttgaaactgggtcacctgacataaatggtatcggaccaacaaataacggaactgctatatctttaagtcgattagcagttagacctggggattcaatagaagcaatagcgactgaaggttccggagaaactataagtacttcagcaactagtgaaatttatattgtcaaagctccacaacctgaacaagtagcaactcatacttatgataatggaacattcgatatattacctgacaattcacgtaattctttaaatccaactgaacgtgtcgaaattaattacactgaaaaattaaatggcaatgaaacacaaaaatcattcactattactaaaaataacaacggcaaatggacgataaataataaaccaaattatgtcgagttcaatcaggataatggtaaagttgtattttcggccaatacaattaaacctaattctcaaattacaataactcctaaagcaggtcagggtaacactgaaaacacaaatcctactgtaattcaagcacctgcgcaacatactttaacaatcaatgaaattgttaaagaacagggtcaaaatgtgactaatgatgatattaataatgcggttcaagtgccaaataaaaatagagttgcgattaaacaaggaaacgctcttccaacaaatttagctggtggtagtacatcacatattccagtagttatttattacagtgatggaagttctgaagaagctactgagactgttagaactaaagttaataaaaccgaattaatcaatgctcgtcgtcgactagatgaagaaattagtaaagagaacaaaacaccatcaagtatcagaaactttgatcaagctatgaatcgtgctcaatcacaaattaatacagctaaaagtgatgctgaccaagttataggcacagaatttgcaacacctcaacaagtaaattcagctttatctaaagttcaagcggcacaaaataaaataaatgaagctaaagcattattacaaaacaaggctgataatagtcaacttgtgagagcaaaagaacaattacaacaatcgattcaaccagccgcttcaactgatggtatgactcaagatagcacaaggaactacaaaaataaacgccaagcagctgaacaagcaatacaacatgcaaatagcgttataaataatggagatgcaacatcccaacaaattaatgatgctaaaaacacagttgaacaggcacagagagattatgttgaagctaaaagcaacttacgtgctgataagtcacagttacaaagcgcttatgatacgttaaatagagatgttttaacaaatgataaaaagccagcatctgtaagacgctataatgaagccatttcaaatattagaaaagaattagatacagctaaagcggatgcaagtagtactttgcgaaacaccaatccttccgttgaacaagttagagacgctttaaataaaataaatactgttcaacctaaagtgaatcaagcaattgctttacttcaaccaaaagaaaataattcagaacttgtacaagctaaaaaacgtttacaagacgctgtaaatgacatacctcaaacacaaggtatgacacaacaaacaattaataattataatgacaaacaacgtgaagctgaaagagcacttacatctgcacaaagagtgattgataatggggatgctacaactcaagaaattacttctgaaaaatctaaagtagagcaagcaatgcaagctttaactaatgctaaaagtaatctgagagctgataagaatgagttacagactgcatataacaaattaattgagaacgtatctaccaatggtaaaaaaccggcgagtatacgtcaatacgaaacagccaaagccagaatacaaaatcaaattaatgatgctaaaaatgaagcggagcgaattttaggtaatgataatccacaagtatcacaagtaactcaagcattgaacaaaatcaaagctattcaaccaaaattaacagaagctatcaacatgcttcaaaacaaagaaaataatacagaattagtcaatgctaaaaacagacttgaaaatgcagtaaatgatacagatccaacacacggtatgactcaagaaacaattaataattacaacgctaaaaagcgagaagctcaaaatgaaatacaaaaagcgaacatgattattaataatggagatgctactgctcaagatatttcttctgaaaaatctaaagtagagcaagtattacaagcattacaaaatgctaagaatgacttaagagctgataaaagagaattacagactgcatacaataaacttatacaaaatgttaataccaatggtaaaaaaccatctagtattcaaaactataagtctgcaagacgaaatatcgaaaaccaatataataccgctaaaaatgaagcacataatgttcttgaaaatacaaaccctactgtaaatgcagtagaagatgctttacgtaagataaatgcaattcaaccagaggttacaaaagctattaatatacttcaagataaagaagataatagcgaacttgttagagcaaaagaaaaattagatcaagcgattaatagtcaaccatcactaaatggtatgactcaagaatctattaataattacacaacaaaacgtagagaagcacaaaatatagcaagttctgctgacactattattaataatggggatgcatctattgaacaaataacagaaaataaaattcgagttgaagaggcaactaatgcacttaacgaagcaaaacaacatttaacggcagatacaacttctttaaaaactgaagtacggaaattaagtaggagaggcgacacaaacaacaaaaagcctagcagtgttagtgcttataacaatactattcattcgctacaatctgaaattacacagactgaaaatagagcaaatactatcatcaataagcctattcgttctgttgaagaagtaaataatgcattgcatgaagtaaaccaattgaaccaacgcttaacagatacaattaacttattacaacctttagcgaataaagaaagcttaaaagaagctcgtaatcgacttgaaagtaaaattaatgaaaccgttcaaacagacggtatgactcaacaatctgttgagaattataagcaagctaaaataaaagctcaaaatgaatctagtattgcacaaactcttattaataatggtgatgcatctgatcaagaagtttctacagaaatagaaaaattaaatcaaaagctgtctgaattaacaaattcaatcaatcacttaacagttaataaagaacctttagaaactgccaaaaatcagttacaagcaaatattgaccaaaaacctagcactgatggtatgacgcaacaatctgtacaaagctatgaacgtaaactacaagaagccaaagataaaataaactcaattaataatgtcttagctaacaatccagatgttaatgctatcagaacaaacaaagttgagacggaacaaatcaataatgaattaacacaggcgaaacaaggtcttactgttgataaacaaccattgattaatgcaaaaactgctttgcaacaaagtctagataatcaaccaagtactactggtatgactgaagcaacaattcaaaattataacgctaaacgtcaaaaagcagagcaagttatacaaaatgcaaataaaattattgaaaacgctcaacctagtgtacaacaagtgtctgatgagaaatctaaggtagagcaagcactcagtgaattgaacaacgccaaatcagcgcttagagctgataaacaagaattacagcaagcatataatcagttgattcaaccaacggatttaaataataagaaaccagcttctatcactgcgtacaatcaaagatatcaacaatttagtaacgaattgaacagcactaaaacaaatacagatcgcattttaaaagagcaaaatccaagtgtagctgatgtcaacaatgcactaaataaagtaagagaagtacaacaaaaattaaacgaagccagagcacttttacaaaataaagaagataatagtgcactagttcgagccaaagaacaacttcaacaggcagttgaccaagtcccttcaacagaaggtatgacgcaacaaactaaagatgattacaattcaaaacaacaagctgctcaacaagaaatatcaaaagcacaacaagttatcgataatggcgatgcgactacacaacaaatttctaacgccaaaacaaatgttgaacgcgctttagaagcattaaataatgcaaaaactggtttaagagcagataaagaggaacttcaaaatgcatataatcaattaactcaaaatattgatacgagcggtaaaacgcctgcaagtatcaggaaatacaatgaagctaagtcacgtattcaaactcaaattgattcagctaaaaatgaagcaaacagtattttaacaaatgacaatcctcaagtatcacaagtgactgctgcgttaaacaaaataaaagctgttcaacctgaattagataaagcgatagcaatgcttaaaaataaagagaataataatgcattggttcaagcgaaacaacaacttcaacaaattgttaatgaagtagatccaacacaaggcatgacaacagatactgctaataactataaatcaaaaaaacgtgaagctgaagatgaaatacaaaaagctcaacaaatcattaacaatggcgatgccactgagcaacaaattactaacgaaacaaatagagtaaatcaagcgattaatgcaataaacaaagccaaaaacgatttacgtgctgataagtctcaattggaaaatgcttataaccaattaatacaaaatgttgatacaaatggtaaaaaacctgctagtattcaacaataccaagctgctcgacaagctattgagacgcaatacaataacgctaaatcagaagcacatcaaattcttgaaaatagtaacccttcagttaatgaagtagcacaagcattacaaaaagttgaagctgtacaacttaaagttaatgacgcgattcatatacttcaaaataaagagaataatagtgcacttgtcacagctaaaaatcaacttcagcaatcagttaatgatcaaccattaacaacaggtatgactcaagattctattaataactatgaagctaagagaaatgaggctcaaagtgctatcagaaatgcagaagctgtcatcaacaatggcgatgcaactgcaaaacaaatttcagacgagaaatctaaagttgaacaagcactagcacatttgaatgatgctaaacagcaattaactgcagatactactgaattacaaacagcagttcaacaattaaacagaagaggcgatacaaataataaaaagccaagaagtatcaatgcatataataaagcaattcaatcattagaaacacaaattacttctgctaaagataatgccaacgctgtgatacaaaaacctatacgtactgttcaagaggtaaataatgcattacaacaagtaaatcagttgaatcaacaattaactgaagcaattaatcaacttcaaccgctatcaaataatgatgcattaaaagctgcaagattaaatttagaaaataaaattaatcaaactgtacaaactgatggtatgacacaacaatctatagaggcttatcaaaacgctaaacgcgtagcccaaaatgaatctaacactgctttagcattaattaataacggcgatgccgatgaacaacaaattacaactgaaacagaccgagtcaatcagcaaactacaaacttaactcaagcaattaacgggttaacagttaataaagaaccattagaaaccgctaaaacagcgttacaaaataacatcgaccaggtacctagtacagatggtatgactcagcaatctgttgcaaattataatcaaaaactacaaatagctaaaaacgaaattaacacaattaataacgttttagcgaacaatccagatgttaatgcaatcaaaacgaataaagcagaagcggaacgaatcagtaacgatttaacacaagctaagaataacttacaagttgatactcaacctttagaaaaaataaaaagacaacttcaagatgaaattgatcaaggtactaacacagatggaatgactcaagattcagtggataattacaatgatagcttaagtgcagcaattatagaaaaaggcaaagtaaataaattacttaaacgtaatccgacagtagaacaagttaaagagagcgttgctaatgcacaacaagtcatacaagatttacaaaatgctcgaacttcacttgttccagacaaaactcaacttcaagaagctaaaaatagattagaaaacagtattaaccaacaaacagatactgacggcatgactcaagattcgcttaacaattataatgataaattagcaaaagctagacaaaaccttgaaaaaatatctaaagttttaggtggtcaacctactgtagctgaaattagacaaaatacagatgaagcaaatgcacataaacaagcattagacactgcacgttctcaacttacattaaatagagagccatatatcaatcatattaataatgaaagtcatttaaataacgcgcaaaaagataattttaaagctcaagttaactcagcacctaatcataatactttagaaacgattaaaaataaggctgatactttaaatcaatctatgacagcattaagtgaaagtattgcagattacgaaaatcaaaaacaacaagaaaattatttagatgcatctaacaataaacgtcaagactatgacaatgcagtcaatgcggctaaaggtattttaaaccaaactcaaagtccgacaatgagtgctgatgtgattgatcaaaaagctgaagatgttaaacgtacgaaaactgcgttagatggaaatcaaagattagaagttgctaaacaacaagcacttaatcatttaaataccttaaatgatttaaacgatgctcagcgacaaactttaactgatactataaatcactctccaaacatcaattcagtgaatcaagctaaagaaaaagctaatactgttaacacagcaatgactcaactgaaacaaactattgctaactatgacgatgaattgcatgacggcaattacattaatgcagataaagacaaaaaagatgcttataataacgctgttaacaatgctaaacaactgattaatcaatctgatgctaatcaagcacaacttgatccagctgaaattaataaagttacacaaagagtcaatacgactaaaaatgatctaaatggtaatgacaaattggctgaagctaaaagagatgctaatacaaccattgatggtttaacttatctaaatgaagctcaacgtaacaaagctaaagaaaatgtaggcaaagcttctacaaaaacaaatattacgagtcagttacaagattacaatcaattgaatattgctatgcaagcattacgtaacagtgtgaacgacgttaacaatgttaaagcaaatagcaattatataaatgaagataatggtccaaaagaagcttacaatcaagccgttactcatgctcaaacattgataaatgcacaatctaaccctgaaatgagccgtgacgtagtaaatcaaaaaacacaagcagtaaatactgcccatcagaatttacatggacaacaaaagttagaacaagcacaaagtagtgctaatacagaaatcggtaacttaccaaacttaactaatactcaaaaagctaaagaaaaggaactggtaaatagtaaacaaactcgtacggaagtacaagaacaacttaaccaagctaagtcactagatagttctatgggcacgttaaaatcattagttgctaaacaacctacagtacaaaaaacaagtgtttatattaacgaagatcaacctgagcaatctgcctacaatgattccattacaatgggacaaactataattaataaaacagctgatccagtacttgataaaactttagttgataacgcaatcagtaacatttcaactaaagagaatgcactgcatggtgaacaaaaattaacaactgctaaaacggaagcaattaatgcacttaatacattagctgatttaaacacacctcagaaagaggctattaaaacagctattaacactgctcatacaagaactgatgtaactgcagagcaaagtaaggctaatcaaataaatagtgcaatgcacacgttgagacaaaacatttctgacaacgaatcagtaacaaacgaaagtaattatattaacgctgaacccgaaaaacaacatgcctttactgaggctctaaataatgctaaagaaatagttaatgaacaacaagccactcttgatgccaattcaattaaccaaaaagcacaagcgattcttactactaaaaatgctttagatggtgaagaacaattacgtcgtgctaaagaaaatgccgatcaagaaatcaatacgttaaatcaattgactgatgcgcaaagaaatagtgaaaaaggtttaatcaacagttctcaaactagaacagaagttgcttctcaattagcaaaagctaaagaactaaataaggtgatggaacaactgaatcaccttatcaatggtaaaaaccaaatgataaatagcagtaaatttatcaatgaagatgcgaaccaacaacaagcatattcaaatgcgattgcaagtgcagaagcgcttaaaaacaaatcacaaaaccctgaattagataaagtaacaattgaacaagcaattaataatattaattctgcaattaacaatctaaacggtgaagctaaactgactaaagctaaagaagatgctgttgcttcaataaacaacctaagcggattaacaaacgagcaaaaaacaaaagaaaatcaagccgttaatggcgctcaaactagagaccaagttgctaataaattacgtgatgctgaagcattagatcaatcaatgcaaacattacgtgacttagttaacaatcaaaatgcaatacattcaacaagtaattattttaacgaggattcaactcaaaagaatacttatgataatgcaattgataatggctcgacatatataactggtcaacacaatccagaattaaataaatctactattgatcaaacgattagccgaattaacacagctaaaaatgatttacatggtgtagaaaagttacaaagagataagggaactgctaatcaagaaattggacaattaggttatttaaatgaccctcaaaaatctggtgaggaatccttagtcaacggttcaaatacacgttctgaagtagaagagcatcttaatgaagctaaatcattaaataatgcaatgaaacaattaagagataaagtagctgaaaagactaatgtcaaacaaagtagcgattacattaatgattcaactgaacatcaacgtgggtatgatcaagcacttcaagaagcagaaaatattattaatgaaatcggtaatccaacattaaataaatcggaaattgaacaaaagttacaacaattgactgacgctcaaaatgcgttacaaggttcacatctattagaagaagctaaaaataatgcgattactggaatcaataaacttacagcattaaatgatgcacaacgtcaaaaagcaattgaaaatgttcaagcacagcagacaatcccagcagttaatcaacaattaactttggatagagaaataaatactgcaatgcaagctttacgagataaagtaggccaacaaaataacgttcaccaacaaagtaattatttcaatgaagatgaacaaccaaaacataactatgataattctgtacaagccggtcaaactattattgataaacttcaagatccaatcatgaacaaaaatgaaattgagcaggctattaatcaaatcaatacgactcaaacagcgttaagtggagaaaataaattacacactgaccaagaaagcacaaatagacaaatagaaggtttatctagtttgaacacagctcaaatcaacgccgaaaaagatttagtcaatcaagctaaaacaagaacagatgttgctcaaaagttagctgcagctaaagaaataaattctgctatgagtaatttaagagatggcattcaaaataaagaggacatcaaacgtagcagtgcatatatcaacgcagatccgactaaagttacagcttacgatcaagcactacagaacgcagaaaatatcatcaatgccacaccaaacgtagagcttaataaagctacaattgaacaagcgctatcacgcgttcaacaagcacaacaagatcttgatggtgttcaacaattagctaatgctaaacaacaagctacacaaactgtcaatgggttaaatagcttaaatgacggtcaaaagcgtgaattaaatctattaattaattcagctaatacccgtacaaaagtacaagaagaattaaacaaagcaactgaattgaaccatgcgatggaagctttaagaaacagtgttcaaaacgttgatcaagtaaaacaaagtagcaattatgtcaatgaagatcaacctgaacagcacaattatgataatgctgtcaatgaagctcaagctacaatcaacaacaatgctcaacctgttctagacaaattagctatagaacgtttaactcaaactgttaacactacaaaagatgcattacatggtgctcaaaaactgacacaagaccaacaagctgctgaaactggaatacgtggtttaacgagtctcaatgaacctcagaaaaatgctgaagtagctaaagtaactgcagcaacaacacgtgatgaagtgagaaatattcgtcaagaagcaacaacattagatactgcaatgcttggtttacgtaaaagcattaaagataaaaacgatactaaaaatagtagtaaatatattaatgaggatcatgaccaacaacaagcttatgacaatgctgtaaataatgctcaacaagttatcgatgaaactcaagcaacgttaagctcagatacaatcaatcaattggcaaatgccgtaactcaagctaaatctaatcttcatggagatactaaactacaacacgataaagatagtgctaaacaaacgattgctcaattacagaatttgaattcagctcaaaaacatatggaagattctttaattgataatgaatctacacgtacgcaagtccaacacgatttaacagaagctcaagctttagatggtttaatgggtgccttaaaagaaagtattaaagattatactaatattgtttcaaacggtaattacatcaatgcggaaccatctaagaaacaagcatatgatgcagctgtacaaaatgctcaaaatataataaatggaacgaatcaaccaacaattaataaaggtaatgtcactacagcaacacaaaccgtgaaaaatactaaagatgccttagacggtgatcatagattagaggaagctaaaaataatgccaatcaaacaatcagaaatctatctaatttgaacaatgcccaaaaagatgcagagaaaaatctagttaatagcgcatcaacattagaacaagttcaacaaaacttacaaaccgctcaacaattagataatgctatgggtgagttacgacaaagtattgctaaaaaagatcaagtgaaagcagatagtaaatatctaaatgaagatcctcaaattaagcaaaactatgatgatgcagttcaacgtgttgaaactattattaacgaaactcaaaaccctgaattacttaaagcaaacattgaccaagcaactcaatccgttcaaaatgcagaacaagctttacatggtgctgaaaaattaaatcaagacaaacaaacgtcttcgacagaactagatggattaacagatttaacagatgcacaacgtgaaaaactcagagaacaaattaacacttctaatagtagagatgatattaagcaaaaaattgagcaagcaaaagcactaaatgacgcaatgaaaaaacttaaagaacaagttgcgcaaaaagatggtgttcatgctaacagtgattatacaaatgaagattctgcacaaaaagatgcgtataataatgcacttaaacaagcggaagacattattaataacagctcaaatcctaacttaaatgcacaagacattactaatgctttaaataatattaaacaagcacaagataaccttcatggagctcaaaaattacagcaagacaaaaatacaactaatcaagccattggtaacttaaatcatcttaatcaacctcaaaaagatgcgcttatacaagctattaatggagctacatctagggaccaagttgcagaaaaacttaaagaggccgaagcgcttgatgaagctatgaaacaacttgaagatcaagtgaatcaagatgatcaaatttcaaatagcagcccattcataaatgaagactcagacaaacaaaaaacttataatgataaaatccaagctgcaaaagaaataattaatcaaacatctaatccaaccttagataaacaaaaaattgctgatacacttcaaaatattaaagatgcagtgaataatttacatggtgatcaaaaattagctcaatctaaacaagatgctaataatcaattaaatcatttagatgacttaaccgaagaacaaaaaaaccattttaaaccgttaattaataatgctgatactcgagatgaggtaaataaacaactagagattgctaaacaattaaatggtgatatgagtacacttcataaagtcataaatgataaagatcaaattcaacatttaagcaattacattaatgctgataatgataaaaaacaaaattatgataatgctattaaagaagctgaggatttaattcataatcatccagatacattagatcataaagcattacaagatttattaaacaagatagaccaagcgcataacgaattaaatggagaatccagatttaaacaggctttagacaatgctttaaacgacatagatagcttaaacagtctcaatgttccacaacgccaaactgttaaggataacatcaaccatgtgacaactctagaaagtttagctcaagaattgcagaaagcaaaagagcttaatgatgctatgaaagcaatgagagatagcattatgaatcaagagcaaattcgtaaaaatagcaattatactaatgaagacttagctcaacaaaatgcctataatcatgcagtagataaaataaatcacattattggtgaagacaatgcgacgatggatcctcaaataatcaaacaagcaactcaagatataaatacagctataaatggattaaatggagatcaaaaacttcaagatgcaaagacagatgctaaacaacaaattactaactttactggtttaactgaaccacaaaaacaagcattggaaaacatcattaaccaacaaacaagcagagcaaatgttgctaaacagttaagtcatgctaaattcttaaatggaaaaatggaagaattaaaagttgcagtagccaaagcgtcattagtaagacaaaatagtaactatattaatgaagatgtctctgaaaaagaagcatatgaacaagctatcgcaaaaggtcaggaaataattaattcagaaaataatccaacaataagtagtactgatatcaatcgtaccattcaagaaattaatgatgctgaacaaaatcttcatggtgataataaattaagacaagcacaggaaattgcaaagaatgaaatacaaaatctagacggattaaattcagctcaaataacaaaattaatccaagatataggcagaacaacaactaaacctgcagtaactcagaaactagaagaagcaaaagcaataaaccaagctatgcaacaacttaaacaaagtatagccgataaggatgctactctaaattctagtaactatctcaatgaagattctgagaaaaagttagcgtacgataatgctgtaagccaagctgaacaactcataaatcaacttaacgacccaactatggatataagtaatattcaagctattactcaaaaggtcattcaagcaaaagattcattgcacggtgcgaataaacttgcacaaaatcaagcagattcaaatttaataataaatcaatcaacaaatttaaatgataaacaaaagcaagcattaaatgacttaattaatcatgctcaaactaaacagcaagtggcagaaataattgcacaagctaataagttaaataacgaaatgggcacactaaaaacactcgtagaagaacagtcaaacgttcatcaacaaagtaaatatattaatgaagatccgcaagttcaaaatatttataatgactccattcaaaaaggtcgagaaatattaaacggcactacagatgatgttttaaacaacaataaaatagcagatgccattcaaaacattcatttaactaaaaacgatttacatggtgatcaaaaattacaaaaagcacaacaagatgcaaccaatgaattaaactatttaacaaatctaaacaattctcaaagacaaagcgagcatgatgagattaactctgctccttcaagaactgaagtttctaatgatttaaatcatgctaaagcacttaatgaagctatgcgtcaacttgagaatgaagttgctcttgaaaacagtgttaaaaaattaagcgactttatcaatgaagatgaagcggcacaaaatgaatatagtaatgcacttcaaaaagctaaagacattatcaacggcgttccaagtagcactttagataaagctacaattgaagatgctttattagaattgcaaaatgctagagaaagtttacatggtgagcaaaaacttcaagaggctaaaaatcaagctgttgctgaaattgataatttacaagcattaaatcctggacaggttcttgctgaaaaaacattagttaaccaagcatcaaccaaaccagaagttcaagaagccttacaaaaagcaaaagaacttaatgaagctatgaaagcactgaaaactgaaataaataaaaaagaacaaatcaaggctgatagtagatatgtaaatgctgacagtggtcttcaagcaaattacaattctgcgttaaattatggttctcaaattattgcaactacccaaccaccagagcttaataaagatgtaataaatagagcaactcaaacgattaaaactgctgaaaataatttaaatgggcaatctaaattagcagaggctaagtcagacggaaatcaaagcatcgaacatttgcaaggattaacacaatcacaaaaagataaacaacatgatttaattaatcaagctcaaactaaacaacaggtagatgatatcgtaaataactctaaacaattagataactctatgaatcaactacaacaaattgttaacaatgacaatacagtaaaacaaaatagtgatttcattaatgaagattccagccaacaggatgcttataatcatgcaattcaagcagcaaaagatttgataactgctcatccaactatcatggataaaaatcaaatagatcaagctattgaaaatatcaaacaagcacttaatgatttacacggtagtaataaactatcagaagataaaaaagaagcttcagaacaactacaaaaccttaatagcttgacgaacgggcaaaaagatacgattttaaatcatattttcagtgcaccaacaagaagccaagtaggagaaaaaattgcaagtgctaaacaattaaataatacaatgaaagcacttagagattctattgctgataataatgaaattttacaaagtagtaagtacttcaatgaagattctgaacaacaaaatgcttataatcaagccgtaaataaagctaaaaatataattaatgatcaaccaacaccagtaatggcaaatgatgagattcaaagtgtcctaaatgaagttaaacaaactaaagataatttacatggtgatcaaaaacttgctaacgacaagacagatgctcaagcaacattaaatgcgttaaattacttaaatcaagcgcaaagaggtaatcttgaaactaaagttcaaaactctaattctagaccagaagtacaaaaagtagttcaattagcaaatcaacttaatgatgcgatgaaaaaattagatgatgctttaactggtaatgacgcaataaaacaaacgagtaattatattaatgaagatacttctcaacaagttaactttgatgagtatacagatagaggtaaaaacatagttgctgaacaaacaaatccaaatatgtctccaactaatattaacactattgctgataaaattactgaagctaaaaacgatttacatggcgtacaaaaactaaaacaagctcaacaacagtccatcaatactattaatcaaatgactggtctaaaccaagctcaaaaagaacaattaaatcaagaaattcaacaaactcaaacccgttctgaagtacatcaagtaattaataaagcacaagctttaaatgattcaatgaatactttacgtcaaagtattactgatgaacatgaagttaaacaaacaagtaactacatcaatgaaactgttggtaatcaaactgcatataacaatgccgttgatcgtgtaaaacaaataatcaatcaaacatctaatccaactatgaatcctttagaggtggaacgtgcaacatcaaatgtaaaaatttctaaagatgcacttcatggtgaacgtgaattgaatgacaataaaaattcaaaaacttttgcagtcaatcacttagataacctcaatcaagctcaaaaagaagcattaactcatgaaattgaacaagcaactatagtttcacaagtaaataatatctataacaaagcgaaagctttaaataatgatatgaaaaaacttaaagatatcgttgctcaacaagataatgtgagacaatcaaacaattatataaacgaggatagtacacctcaaaatatgtacaacgatacaattaatcatgcacaatcaatcattgatcaagtagcaaaccctacgatgtctcatgacgaaatagagaatgcaatcaataacataaagcatgccatcaatgcactcgatggagaacataaattacaacaagcaaaagaaaatgcaaacttattgattaatagtttaaacgatttaaatgcaccacaaagagatgccataaatagattggttaatgaagctcaaacaagagaaaaagtagctgaacaacttcaaagtgctcaagctttaaatgacgctatgaagcatttaagaaacagcattcaaaatcaatcatccgtaagacaagagagcaaatatattaatgcaagtgatgctaaaaaagagcaatataatcacgcagttagagaagtcgaaaatattatcaatgaacaacatccaacattggataaagaaataattaagcaactaacggatggtgtaaatcaagcgaataatgacttaaatggcgttgaattattagatgctgataagcaaaacgcacatcaatcgatacctacattgatgcacttaaatcaagcacaacaaaacgcattaaatgaaaaaattaataacgcagttaccagaactgaagttgcggctattattggccaagcaaaactactcgatcatgctatggagaatttagaagaaagtatcaaagataaagagcaagtcaaacagtcaagtaactatattaatgaagattctgatgttcaagaaacatacgataacgccgttgatcatgtgacagaaatacttaatcaaacagtaaatccaactttatctattgaagatatagagcatgctatcaacgaagttaatcaagcgaaaaaacaactcagaggtaaacaaaaactttatcaaactatcgatttagctgataaagaattaagtaaattggatgatttaacatcacaacaaagcagttcaatatctaatcaaatatatactgctaaaacgagaacagaagttgcccaagcaattgaaaaagcaaaatcattaaatcatgcaatgaaagcacttaacaaagtatataaaaatgcagataaagtgttagatagtagtcgattcattaacgaagatcaacctgaaaaaaaggcgtatcaacaagctataaatcatgttgattcaatcattcatagacaaacaaatcctgaaatggatccaacagtaatcaatagcataactcatgaactcgaaacagctcaaaataacttacatggtgatcagaaacttgctcatgcacaacaagatgccgctaatgtaattaatggtctaattcatcttaatgttgctcaacgtgaggtaatgataaatacgaatacaaatgctacaacacgcgaaaaagttgcaaagaacttagataatgctcaagctcttgataaagctatggaaacactacaacaagtagttgctcataaaaataatatattgaacgatagtaaatatttaaatgaagattcaaaatatcaacaacaatacgatcgagttattgctgatgccgaacaactacttaatcagacaacaaatccaacattagaaccttataaagtcgatattgttaaggataatgtcctagctaacgaaaaaatactatttggcgcagaaaaactatcatatgacaaatcaaatgcaaatgatgaaattaaacatatgaattatcttaataatgcacaaaagcaatctataaaagatatgatttctcacgcagcattaagaactgaagttaaacaacttctgcaacaagctaaaatccttgatgaagccatgaaatcacttgaagataaaactcaagtagtgattacagatactactttgcctaattacactgaagcttcagaggataaaaaggaaaaagtagaccaaactgtatcacatgctcaagcgattattgataaaataaatggctcaaatgtaagtttagatcaagtacgacaagcactagaacaattaactcaagcatcagaaaacctcgatggtgatcagcgagttgaagaagctaaagttcatgctaatcaaacaattgatcaattaacacatcttaattcattacaacaacaaactgcgaaagaaagtgttaaaaacgcaacaaaactagaagaaatcgctactgttagtaacaatgctcaggcattaaacaaagtaatgggtaaattagaacaattcattaatcatgctgattctgttgaaaatagtgataattatagacaagccgacgacgacaaaatcatcgcttatgatgaagcacttgaacatggacaagatatacaaaaaactaacgcaacccaaaatgaaacaaaacaagcgttacaacaattaatatatgcagaaacatcgttaaatggtttcgaaagattaaatcatgctagaccacgagctttagaatatatcaaatcactagaaaaaataaacaatgctcaaaagtctgctttagaggataaagtaacgcaatcgcatgatttattagaattagaacatattgtcaacgagggcacaaacctcaatgacattatgggtgaattagctaacgcaatcgttaataactatgctccaaccaaagcaagtataaattatattaacgccgataacctacgcaaagataactttactcaagctatcaacaatgcacgtgatgcactcaacaaaactcaaggtcagaacttagatttcaatgcaattgatacatttaaagatgatatattcaaaactaaagatgcacttaacggtattgaacgtttaacagctgcaaaatcaaaagcagaaaaactaattgatagtttaaaatttattaataaagctcaattcacacatgcaaatgatgaaattatgaatactaattctattgcacaattgtctagaatcgtgaatcaagcatttgatttaaatgatgcaatgaaatctttaagagatgaacttaataatcaagcttttcctgtccaagcaagctcaaattatataaattcagatgaagatttaaaacaacaatttgaccatgctttaagtaatgctcgaaaagttcttgcaaaagaaaatggtaaaaatttagatgaaaaacaaattcagggactcaaacaagtgattgaggatactaaagatgctttaaatggtatccaacgtttatcaaaagctaaagctaaagcaattcaatacgtacaatctttatcttatatcaatgatgcacagcgtcatattgctgaaaataatattcacaactctgatgatttatcatctttagcaaatacattatctaaagctagtgatttagataatgcaatgaaagacttacgagatactatagaaagtaattcaacttctgttccaaatagtgtgaattatattaatgctgataagaatttacaaattgaatttgatgaggcgctacaacaagcaagtgcaacaagttctaaaacttcagaaaatccagcaacgattgaagaagtattaggtcttagtcaagccatttacgatacaaaaaatgcattaaatggtgaacaacgacttgcaactgagaagagcaaagatctaaaattaataaaaggattaaaagatttaaataaagcacaacttgaagatgtcacaaacaaggtaaattcagcaaatactttaacagagttatctcagctcactcaatcaacgttagaattaaacgataaaatgaaattattgagagataagcttaaaactttagtaaatcctgttaaagcaagtttaaattatagaaacgctgattataatttaaaacgtcaatttaacaaagctttaaaagaagctaaaggcgtattaaataaaaatagcggtacaaatgtcaatatcaatgacattcaacatcttttaacacaaatagataatgctaaagaccaattaaatggtgaacgacgtctaaaagaacatcaacaaaaatctgaagtatttattattaaagaattagatatacttaataatgctcaaaaagctgcaataattaatcagattagagcgtctaaagacattaaaataattaatcaaatcgttgataatgcaatagaattaaatgatgctatgcaaggtttaaaagaacatgtagctcaattaacagcaactacaaaagacaacattgaatatttaaatgctgatgaagaccataaattacaatatgattacgctatcaacttagcgaataatgttcttgacaaagaaaacggtacaaataaagacgctaatatcataattggaatgattcaaaacatggatgatgctagagcacttctaaatggaattgaaagacttaaagatgctcaaacaaaagcacataatgacattaaagatacgctcaaacgtcaacttgatgaaattgaacacgctaatgcaacatcaaattctaaagctcaagctaaacaaatggtaaatgaggaagctagaaaagcgctttctaatattaatgacgcaacatcaaatgatttagttaatcaagcaaaagatgaagggcaatctgcaattgaacacatacatgcagatgaattacctaaagcaaaactagatgctaatcaaatgattgaccaaaaagttgaagatataaatcacttaattagtcaaaatccaaacttatcaaatgaagaaaaaaataaactaatatctcaaattaataagttagtaaatggaattaagaatgaaattcaacaagctataaacaaacaacaaatagaaaatgctacaacaaaactagatgaagtcattgaaactactaaaaaattaattatcgccaaagcagaagctaaacaaatgataaaagagttatcacaaaagaaacgagatgcaataaataacaacactgatttaacaccttctcaaaaggcacatgctttagcagatattgataaaacagaaaaagatgcacttcaacatatcgaaaattctaattcaattgatgatatcaataacaataaagagcatgcatttaatactttagctcatatcattatttgggatactgatcagcaaccattagtttttgaagtacctgaattgagccttcaaaatgctctagtaacaagtgaggtggttgttcacagagatgaaactatttcattagaatctataaaaaaaaaaatgactttaactgatgaacttaaagtcaatattgtttcattaccgaacactgataaagtagctgatcacctaaccgctaaagttaaggttattttagctgatggctcatatgtcactgtaaatgttccagtcaaagttgtagaaaaagaattacaaatagctaaaaaggatgctataaaaacaattgatgttctggtaaaacaaaaaatcaaagatatagattctaataacgaattaacgtctactcaacgtgaagatgcaaaagctgaaattgaaagattgaaaaagcaagccatcgataaagtgaatcattcaaaatcgattaaagatattgaaacagtaaaacgaactgattttgaagaaatagatcagtttgatcctaaacgctttacgctaaataaagctaaaaaggatatcattactgatgttaatactcaaatccaaaatggtttcaaagaaattgaaacaataaaaggtttaacttctaatgaaaaaactcagtttgataaacaattaactgcactacaaaaagaatttttagaaaaagtcgagcatgctcataatttagtagaattaaatcaattacaacaagagtttaataatagatataaacatattttaaaccaagcacatttactaggtgaaaaacatatagcagaacataaattaggatatgttgtagtaaacaaaactcagcaaatactaaataatcaatctgcttcttactttataaaacaatgggcacttgatagaattaaacaaattcaactagaaacgatgaattcaattcgtggtgcgcataccgtacaagatgtacacaaagcattattacaaggtatagagcaaatcttgaaagtaaatgtaagtattataaatcaatctttcaacgattccttgcataactttaattatcttcattcaaaatttgatgctagattaagagaaaaggatgttgcaaaccatatcgtacaaactgaaacattcaaagaagttctaaaaggaacgggtgttgaaccaggtaaaatcaacaaagaaacacagcaaccaaaacttcataagaatgataatgatagcctattcaaacatttagttgataatttcggcaaaactgtaggtgttattacattaactggtttactttctagtttctggttagttttggctaaaagacgtaaaaaagaagaagaagaaaaacaatcgataaaaaatcatcacaaagatattcgtctttcagatactgataaaatagatccaattgtaataactaagcgtaaaatagataaagaagaacaaattcaaaacgatgacaaacattcaattccagttgctaaacataagaaatctaaagaaaagcaattgagtgaagaggatattcattcaatccccgtcgttaagcgtaaacaaaacagtgataaccaaagatacaaaacagaagaaagttacttctaa

SEQ ID NO: 323 - DNA, 570 bp, Staphylococcus epidermidis
aaccaattaaaaggaacgtgtttaaatatgagattaaacgaaaaaacaatcgatagaacagttatatataatggtagtattattgatttagaagtacatgatgttgaattacccgatggtagcacatctaaacgtgaacttgtatttcatcatggtgcggtggcagtgtgtgcaataactcctgaaaatgaagttttattagttaaacaatttcgtaagcctgcagatcaaccacttttggaaattcccgcaggcaaattagaaaagggtgaagatcgtaaagaagcggctattagagaactacaagaagaaacaggatatattgcttcagatttgcaatttgtcactaatatgtatgggtctcctggattttcaagtgaaaaactttctatatacttcacagaccaattaacggttggagaaaccaatttagatgatgatgaatttgtggagcttcacaaagtacctttaagtcaaatcgattcattgttaaaagataataaaattgaggatgccaaaacaatcattgcattgcaacatctattattaaattataatcattctaaataa

SEQ ID NO: 324 - DNA, 1170 bp, Staphylococcus epidermidis
tgtcagttaaaatatatttatacaagtaaaaagggggtaccatatatgattaatcaaaaacgtttattagattgttttctagaattagtgcaaattgattcggaaacagggcacgaagaaacaattcaaccttatcttaaagatacgtttgaaaaaatggggctccatgttattgaagatgaagcttcaaaaaataatagattaggtgctaacaatcttatttgtacgttaaaaagtaatataagtcatcagaatgtgccgaaaatttattttacaagccacatggatactgtcgttccaggaaaaaacatccaacctgtagtaaaagaagatggatacgtttatagcgatggaactacgatactcggggcggacgataaagccggtcttgcggcaataattgaagcgattaaacaaattaaggaatcaaatttgccacacggacagattcaaataattattaccgtgggagaggaatctggattagtaggtgctaaagcaatagatactcgccttcttgatgcagatttcggctatgctgtagatgcaagtaaagatgttggaactactgttatcggtgctccaactcaagtaaagatttatacaactataaaagggaaaaccgcccatgcaagcacacctaaaaaaggtattagcgcaataaatattgcatcaaaagcaatcagtcgaatgaaattgggacaagtcgatgcattaacaacagccaatataggtaaatttcacggaggttctgccactaatattatagctgatgaagtcactttagaggcagaagcacggtcacatgatgatcaaagcattaataaacaagtgaaacatatgaaagagactttcgaaacgacagcaaatgaattaggcggtcaagctgaagtgttagttgaaaaaagttatccgggatttgaagttagtgaagctgacaaagtaacacaatatgctatatctagtgcattagccctcggtctaaaaggtgatacttgtattgctggtggtggttcagacggcaacatcatgaatcaatatggcattccttctgtgattttaggagtaggatatgaaaacatacatactacttcggaaagaatagcaataaaggatatgtatatgctcacaagacaaataataaaaattattgagctagtagctgaataa

SEQ ID NO: 325 - DNA, 1902 bp, Staphylococcus epidermidis
agagggataaaaatgagtgatcgttttataaaattcaacgatgaacaattagatgcaaaacaagtaatgatgttacaagacttagcacgtttacttttaaaaaatgagcaaacgcaagttaaaatacaaaaattcccttactataatccttatagtaatacactcattgcgagttggttttggtctcatagaccgaaacatattgaacaagctggactaaaaacagatgtcttactcgcaacgtatggatatctgaatatggatctttcaatcatcaatcaagttttacacaacaacgattttgaacaccctaagttctttcatcaattatttaaacttttagaggacgtacgtatatttgaacatattagacaacaaagacctagtactacaaaaatgattgatttacgcatagaaacacgattatcttttacagaatctcaaattaatttctacaaaactaaaactgtatatactgatttactttttctttatttagaacatgcatttttaagtcaaaacttttttaatattccatccatacatccagcatttgatgatattttagttcatatgtatcagtacttaccaaatatttttcagaatcaaacatcagaagataatatgtatttagcagaacgtattatgtatcaagtggatgatttattaaaggaagatatgctaaatgaatattactacttacctcaaaaattatatgaagatatttatgcagatagttttgaagacttaaagcgtacagatgcgagcaatactgatggtaaagataatcaacagacagacgaagatgtagaaacagctgaagctgaaacaaaagccgcagacagtgagtctaaaggcggggcatatttagaaatggagctacatgagggtgaaaacagtgaagttatggctgataatgatacggctcgagaaggcgacagcactgatgatatgactgatatgatgaccaaaaaaggaaaagggtcagaaaatacacttgatcatgatgaaggtggatttataggacaaaaccaagcttttgctttaaaaggcattaataaagacgtaagtattgaatggaatatccctgatattacacctcaaaatgtgatagattatcaatattcaaaaaatgatgtacagtttgaaattaaagatttaatacaaattatcaaaaagaccatcgacagagaacatgaagatgaaagacataatttaacaaagggccgtttacaaaaagaccttattaattggtttattgatgatcaatttaagttattttacaaaaaacaggatttaagtaagacattcgatgcaacatttaccttactcattgatgcatcagcgagtatgcacgataaaatggatgaaacgattaaaggtgtcgtcttgttccatgaaacattaaaatctttgaatattaaacatgaaatactagcatttaatgaagatgcttttgaagctgaccaacgtcaacaaccaaatatcattgatgaaatcattaattataattactctatctttgaaaaagaaggcccacgtatcatgacattagaacctcaagatgataatcgtgacggcgtagctatcagaattgcgagcgagcgtttattacaaagaagtcatgaacaacgctttttaatcgtattctcagatggtgaaccgtctgcatttaattacagtcaagatggtattttagatacgtatgaagctgttgaacgtgcgcgtaaatttggtatagaagtatttaatgtctttcttagccaagagccaattactgaagacattgaacaaaccattcataacatatatggccaatttgctttatttgtagaaggtgtggaacatttaccgagtcacttatcaccattactaaaaaaattgttacttaaatctttataa

SEQ ID NO: 326 - DNA, 417 bp, Staphylococcus epidermidis
agaggagtaaaagtaatggctaaaatatattttgatgctgcgactaaaggaaatcccggccgaagtgcttgtgcgattattattaaagaaaattcacaaagatatacatttacccatgatttaggtaaaatggataatcatagtgcagaatgggcagcaatgttacacgctttggaacatgcacgcgaattaaaagtatctaacgcgttactttatactgattcaaaattaattgaagatagtatgatgcaaggtaaagttaaaaatgctaagtttaaagtttattttgaaaacatagaaatcttagagcaaagttttgatttgatgtttgtgagatggattccacgaaagcaattttttttttgtttatcaacttgctcaacaaacactataccaacttacatcacaataatctaa

SEQ ID NO: 327 - DNA, 759 bp, Staphylococcus epidermidis
ttaaccaaaaaggagagtcaaatgagtaaagaacaagagagattacaaaaaagaatcgctaatagcggatatacatctcgtcgaaaagcagaagtacttatcactgaaggacgagttaaagtcaatggacaaactgtaacagaattaggttccaaagtgatgccatcagatttagttgaagttgatggtattaaaatcgaacaagaagacaaaatttatattttattttataaaccaactcaagtcattacaagtgtctctgatgatcgtggacgtagggtggttacggattactttgatgatctagaatcacgtatttatccggttggacgattagattatgacacatctggagttttattattaactaatgatggagaatttactaatttgatgacacatcctcgatatcacattaaaaagaaatacgttgctaaattaaaaggttatttaatgagagaggaaattaagcaacttgaaaaaggaatagaattagaagatggttacacacaaccagcacaagttaaaataaaaaagcaagataaagaaaaaaatacgactttagttgaaattacaattagtgaagggcgaaatagacaagttagacgtatgtttgagtatttcggtcatcaagttaataagttaacaagaattcaatttggccctatagatttaaaaggtttgaacgccggtgaaggaagagttcttacaccacatgaagtaaaaatattaagacatttggcagaaaacggtaaataa

SEQ ID NO: 328 - DNA, 990 bp, Staphylococcus epidermidis
ttcaggcgaaagagtacaagaggaggttttatcatgagtaaaaacaaaaaacaaagccttcaatccgctcatcaaaaacctttgttaaaaagaatgtgggaacacaaagtactttacttaatgattttaccttgtttactctttttcttgattttcaactatattccaatgacaagtcttgttctggcattcaaagatttccgcttcgatactggtatcatcggcggtgattggaaagggctatactattttaaacgctttttctctgaccctcgatgtattcaaattattatgaatacgctaattataagtggcatgaaattgattttagctctaccatttccaattattttagccattatgtttaacgaaattaaagattctaaattaggtaagatcagaggtttatttcaaggcgtactttacatccctcattttttatcttgggttgtagttatcagtattttcaagaaattactcgctccagatgatggacttatgaatcaactgatccatcaatttggtggcgacgggtcgacttactttatgatgaaccctgagtatttccacaccatcatgttttctagttatatatggaagaatgtagggtgggattccattatttattttgcagcaattatgagtattaatcctgaaatttatgaatcagctgcgattgatggcgcgaatcgtttcaaacaaattatacatattaccttacctatgttaacaccaacaattgttattttattcatcatttctctaggcgatattttaaaagcagggttcgatcaaatttacctactcaaaacaccaggtaacgctaacgtttcagaaatactggatacatttgtgattcgtactggtattgagcaaggcgatttcagttacgcaattgcgattagtctattacagggtgtgataggacttatcgctgtcgtcattattaataaattcgcagataagaaactggatacatcactatattaa

SEQ ID NO: 329 - DNA, 246 bp, Staphylococcus epidermidis
ctagggggaaaaataagtatggcagaggtaaaagttccagaattagcagaatcaatcacagagggtaccattgcagaatggttaaaaaatgtaggcgataatgtagataaaggtgaagctatcttagaactagaaacagataaagttaacgtcgaagtagtttctgaagaagctggggtattatcagaacaattagccgaggaaggcgatacagttgaagtatgtcaagctgtagctgtagtatga

SEQ ID NO: 330 - DNA, 417 bp, Staphylococcus epidermidis
cgtttgatgaactcactgacttcatcaacgacttgcagtggtctcaagatcaaagtttcgaatgaggtggaaaaaaagatgtcagatgtttcattaaaattatcagcgaaagatatttatgaaaaagatttcgaaaaaactatggcaagaggctatagaagagaagaagtagacgcttttttagatgatatcattacagattatcaaaaaatggcggatatgaacaatgaagtagtaaagctttctgaagaaaatcacaaattaaaaaaagaacttgaggaattaagattacgtgttgctacatcaagaccacaagacaataaaaacttttcttcaaataattcaagcagtgcttcaaataatgtagatattttaaaacgtatttcaaaccttgaaaaagcagtattcggcaaataa

SEQ ID NO: 331 - DNA, 633 bp, Staphylococcus epidermidis
attatgatgaattatccaaatggtaaaccatactctaaaaataagcctttggacggacgtaagagttcgccattttcaagtaatattgaatatggtggacgaggtatgacactagagaaagatattgaacaatcgaatactttctatcttaaaagtggcatagcagttattcataaaaagccgactccggttcaaatagttaatgttcactatccgaaacgtagtaaggctgtaataaatgaggcttattttcgcactccttcaacaactgattataatggtgtctataatggatattacattgattttgaagctaaagaaactaagaacaaaacttcatttccactcaataatattcatgcacatcaagtagaacatatgaaaaatacatatcatcaaaaaggaattgtctttttaatgatacgttttaaatcacttgatgaagtgtatcttttaccctattcaaaatttgaaaaatattggcaaagatacattaataatattaaaaagtcgataactgttgaagaaattcggaaaaatggttaccatattccttatcaatatcaaccaagattgaattacctcaaggcagttgataagttgatattagatgaaagtgaggaccgcgtatga

SEQ ID NO: 332 - DNA, 1857 bp, Staphylococcus epidermidis
atgactaagaacaagaaagaatttacagaggctcctgtaaacttcggcgcaaatcttggccttatgctagatttgtatgatgattatctacaagatccatcatccgtacctgaagatttacaagtcttgttcagtacaattaaaacaggtgaagctcatatcgaagctaaacctaccactgatgggggtggttcacaagcgggagatagcacaattaaacgtgttatgcgcttaatcgataatattcgtcaatacggacatttaaaagcagatatttatccagtaaatcctccagagcgtcaaaatgttcctaaattggaaatcgaagattttgatttagataaagaaactttggaaaaaatatcatctggaattgtctctgaacattttaaagacatttatgacaatgcctatgatgcaattgttcgtatggaaagacgttacaaaggaccgatagcttttgaatacactcacattaataataataaagaacgtgtgtggttaaaaagaagaattgaaacgccttataaagcaagtttaaacgataatcaaaaaaaagaacttttcaaaaaactcgcacacgtagaaggttttgaaaaatatttgcacaaaaattttgttggggctaaacgtttttcaattgaaggcgtcgacacattagttccaatgcttcaacacacaatcacattagcaggtaacgaggggattaaaaacattcaaatcggtatggctcaccgtggacgtttaaatgtattaacgcatgtcttggaaaaaccttatgagatgatgatttcagaatttatgcatacagatccaatgaagtttttacctgaagatggtagtttagaattaacctcaggttggacttcagatgtgaagtatcacctaggtggcgttaaaacgactaactcatacggaatagaacagcgtatttctttagcgaataatccaagtcatttagaaatcgttgcacccgttgttgctggtaaaacaagagcagcccaagataatacacatcaagtaggagctccatctaccgacttccataaagcaatgccgattattatacatggtgatgcggcatatccaggtcaaggtattaattttgaaacgatgaacttaggtagtttaaaaggatattctacaggtggttcacttcatattattacaaataatagaatcggttttacaactgaacctattgatggacgttcaacaacgtactcttccgacgtagctaaaggttacgatgttccaatactacatgtaaatgccgatgatgtagaagcaacaattgaagctattgaaattgcaatggaattccgtaaagaatttcataaagatgtcgttattgacttagtaggttatcgtcgctatgggcacaatgaaatggatgaaccttctattactaatccagttccataccaaaacattagaaaacatgattcagttgaaattttatatggtaaaaagttagttgatgaaggaattatttccgaagacgaaatgaatgaagtcattgacggtgttcaaaaagaaatgcgaacagcacatgataaaattgataaaaatgacaaaatgaataatccagatatggaaaaaccagaatcacttcaactacctttacaaagtgatacgaaagatttctcatttgatcatttaaaagaaatcaatgatgcaatgcttgattacccaaaagattttcatgtgctaaaaaagctcaataaagtactagaaaaacgtagagaaccttttgaaaaagaggaggggctcgtcgattgggctcaagcagagcaacttgcatttgcaaccatattacaagatggaacttcaattcgtttaacaggtcaagaatag

SEQ ID NO: 333 - DNA, 231 bp, Staphylococcus epidermidis
caggtcaagaatagtgaaaggggaacatttagccatagacatgctgtgcttcatgatgaagacaatggtaatacattcacaccattgcatcatgtacctcaacaacaggctacttttgatattcataattcgccattatctgaagcagctgtagttggatttgagtatgtttataacgtcgaaaataaaggtaactttaacatatgggaagctcaatatggcgacttttag

SEQ ID NO: 334 - DNA, 909 bp, Staphylococcus epidermidis
tgcaagaagaagttggtgataaaggaaatgaagaaactacagatgaataaattaataaatataattaatacatcactgaataagtcaatacaatcatcaccattaaaaactaatttagaagaaagtatgaaatattcattaaatgctggtggtaaaagaatcagaccagtcatattattattaacactaaaaatgcttaacaaagattatcaacaaggactaaatagtgctttagcattggaaatgattcatacttattctttaattcatgatgatttaccagcaatggataatgacgattaccgtagaggaaaattaacaaatcataaagtttatggtgaatggaaagccattcttgctggtgatgcattattaacaaaagcttttgaattagtttctaatgatactaccattgaagatagtgtgaaagtaagtattataaaaagactttcaaaagcaagtggacatttgggaatggtgggtggccaagcgcttgatatggaaagtgaagggaagtcaattcgtttagaaactttagaatcaattcatgaaactaagacaggcgctttactaaatttttcagttatggctgcggtagacattgctcaagtagaacaaaatattgctaagaatttagatgaatttagtcatcatttaggaatgatgtttcaaattaaagatgatttactggatgtgtatggtgatgaatcaaaacttggcaaaaaagtaggcagtgatatagtaaatcataaaagtacttatgtttctttacttggaaaagaaggagcagaagaaaagttaaacaatcatcaatatcttgctatgaactgcttaaatcaaatttctgatcaatatgatacttctgaattaagtgatattgtagatttattctataacagagaccattaa

SEQ ID NO: 335 - DNA, 1692 bp, Staphylococcus epidermidis
ggatgcgatgaatttatgttacaaaccttatcaataaaacaatttgccattattgacgaacttgatataaacttttctgacggtctaacagttatgagtggtgaaactggctcaggaaaatctatcattattgatgccattggacagttaatcggtatgagagcttcttctgattacgtcagacatggtgaaaagaaagcaattatcgaaggtatctttgatatagacgagagtaaagatgcaattaatatactagaatcattagctatagatgttgatgaagattttttattagttaaaagagaaattttcagttctggtaagagtatttgtcgtattaataaccaaattgtcactctacaggacttaagaaaagtgatgcaagaactgcttgatattcatggtcaacatgaaacgcaatctttacttaagcaaaaatatcatcttcaactattagatgattatgcagacaatcagtattcagatttacttaatcaatatcaactttcttataaccaatataaaaataaacgtaaagaattagaggaattagaatccgcggaccaagctttattacaacgattagacttaatgaaatttcaattagaggaactaaccgaagcttcactgaaagaaggcgaagtggaccaacttgaatccgatattaaaagaattcaaaactccgaaaaattaaatctagctttaaacaatgcacatcaagttctaactgatgaaagtgcaatacccgataggttgtacgaattaagcaactacttgcaaacgattaatgatatcgttccagaaaaattcgtaagattaaaagaggacattaatcaattttactatttgctagaagatgcaaagcatgaaatttacgacgaaatggctaacactgaattcgatgagcaagttttaaatgagtatgaatccagaatgaatttacttaataatttaaaacgtaaatatggtaaggatattactgaacttattgcttatcagagtaaacttgcaaatgaaattgataaaatagaaaactatgaacaaagtacatcacaattaagggaagaaattaaaacgctttataacgaagtgatagatataggaaaaaaactttctcaagaacgtaggcgtgtagcgagagagttaagggaccatattgtttctgaaatacaaaatttacaaatgaaagatgctaaccttgaaatttcgtttaaaccattagatgaacctacaattgaaggtattgaatttgtggaatttttaattagtccaaatcgtggtgaaccacttaaaagtcttaataaaatcgcttcaggcggtgaactttcaagaattatgctagctctaaaaagtatatttgttaaatcacgcggccaaaccgcgattctttttgatgaagttgactcgggtgtatctggtcaagcagcacaaaaaatggctgaaaaaatgcgagatattgctcaatatatacaagtcatttgtatttcacacttacctcaggtagcttcaatgagtgaccatcatcttctaataagcaaggcatccaatgccgatagaactacaactcaagtcaaagaattgaaagatgaaaacaaaatagatgaaatagcacgtatgatttcaggagcaagtgtgactgagctcacgagagaaaatgcaaaagaaatgattaagcaaaatcacaatatttaa

SEQ ID NO: 336 - DNA, 348 bp, Staphylococcus epidermidis
aggaggcgtgatgatatgattgaaaaacaggatttcaatcatatagaggaccaacttgatcaactagcaagtaataaacaactcaaaacaccagaagctagggaacttttagatagttatttcgatttaattattaattattttaaacaaataaataacatagatgaaattcattttaatcaactcgatacatatccagtagttccaatgaattttgatgaacgctatcattatatggttgcacgtaaacaccattttatgggctatcgtcaaatgaaaacattgaaatcagaattaataaaaatgaatgcatcttatctaattagaaagcaacgtcaacaaaaataa

SEQ ID NO: 337 - DNA, 213 bp, Staphylococcus epidermidis
aggaggagcgacgtgataggcaaacactttattataactggagcaacgagtgggttaggttttgcaataaccaatgaattacttcaaagaggggcccatgttactatacttgcaagaaatatagataagttcaatcgaatcaaagaaaactattttaaacctgaacatatcaatgtgattaaatgtgatttaatgcaacgaaaagaatattga

SEQ ID NO: 338 - DNA, 741 bp, Staphylococcus epidermidis
gaggtagtagaaagtatgactaacgaaattttaatcgttgatgatgaagatagaattagaagattacttaaattatatttagaaagagaatcttttgaaattcatgaagcaagagatggtaaagaagcctacgagcttgctcttgaaaacaactatgcgtgcatcctcttagatttaatgcttcctgaaatggatggaattgaagttgcctctaaacttagagaacataaagatacacctatcatcatgcttactgcaaaaggtgaagaaacaaatcgtgttgaaggatttgaatcgggagcagatgattatattgttaagcctttctcacctagagaagtagtattgagagtaaaggcgttattaagacgtacacaaactgcaaacactgagcaaagcgaaccgcatgcacgcgatattattgaatttagtcatctagtgattgataatgacgctcatcgagtccttgcggatgatcaacaagtgaatctaacacctaaagagtatgaattactcatctatttagctaaaactccaaataaagtatttgatcgagaacagttacttaaagaggtttggcattacgaattttatggggacttgcgtacagtagacactcacgtcaaaagacttagagaaaagttaaatcgagtatcaagtgatgctgcacaaatgatacaaactgtgtggggtgtcggttataaatttgaggtaaaacctagtgatgaaccgactaaatag

SEQ ID NO: 339 - DNA, 1425 bp, Staphylococcus epidermidis
accatgtcagaaaaacaatacgatttagtcgtgttaggtggtggtacggcaggatatgtagccgccatcagagcttctcaattaggaaaaaaagtagcgatagtagaaaaatcactcttaggtggtacgtgtttacataaaggatgtatacctactaaagcacttttaaaatcggctgaagtcaatcatactattaaaaacgcgcatacatttggaattgatgtcaatcattttaaaattaatttccctaaaattttagaacgtaaagatgctattgttaagcaattgcatgaaggcgtcaatcaactgatgaaacatcatcatatagatatttataacggtattggacgaattatgggaacatctatattttctcctcaaagcggtacaatttctgtggaatatgaagacggcgaatcagatatactccctaataaaaatgtgcttatagctactgggtcgtcaccacagtctcttccgttcattaaatttgaccataaacaaatactatcgagtgatgatatcctaaggttaaatacactaccacaaagattagcaatcataggtggaggtgttattggtttagaatttgcatctctgatgaatgatttaggtgctgatgtagtagtaatcgaagcgaatgacagagttcttcctaccgagagcacacaagttgcgtcattactaaaagaagaattaactaatcgaggcgttacattctacgaaaatattcaattgaccaaagatcattttaaccaaactgataagggtgtaactattaatatttcagatgagcccgtccaattcgataaagtacttgttgcaattggtagaaagcctaatacaaatgatattggtttaaataacactcaaattaagacttctgatgctggtcatattattacaaatgcttatcagcaaactgaagataaacatatatacgcagcaggagattgtatagggcaattacaattggcacacgtcggttcaaaagaagctatagttgcagttgaacatatgtttgattgttctcctatacctatcaattatgacctgataccaaaatgtgtttatacaaacccagaaattgcttcaattggtaaaaatttagaacaagcaaaaaaagcaggcatcaaagcaaaaagtatcaaagttccttttaaagctataggaaaggcaataattgaggatgtaacccaatcaaaaggattttgcgagatggtagttaacaaagatgacgatgaaatcataggtcttaatatgatagggccacatgttacagaattaataaatgaaatgtcattgttacaatttatgaatggctcatctttagaacttggtttaacaacacatgcacatccttcattatccgaggtagtcatggaattaggtttaaaagctaatggtcaagcaattcatgtatag

SEQ ID NO: 340 - DNA, 912 bp, Staphylococcus epidermidis
gaggtggcagagacaatgaaagtttcacaagataaaagtgcgcttgtcattcgtattatctcattaatcattattattggcttagtaatcacaattatcctcccgatgattaatatctttgccttagcatttaactctggggtagatgctcaaaaaggtggcatcactttctacccgcgtaaattttcactagataattttaaggagatatttaaacaaggcacgttattaaatgcattatttattagtatcgcaaagacagtcataggaacgatactaagcgtcatattaacagctatggctgcatacgttctaacaatcaaaagtttaccgtttcgaagaatcatctcattcttcctagtctttacgatgttattcagtgtcggtgttgtaccactttatatcctattaaatcaacttcatttaactgatacattctgggtatacattttaccgtcactttatagcgtttataacattttaattatgcgtacattcttcaatcaattacctagtagtgtgattgaagccgctagagtagatggttgtaatgactttcaaatcttttggaaaattgtcttacccatgagtaaacccgtggtggcatcaattacattatttaacgccgtgagtcagtggaatgattggtttacaggtgcattcttcgtacgtaatccaaacctcaaaccgttagctactgttttacaagatatgttaacgaaacaagctgccattgcagatgctttaaaacaaaagtcaggttcatatgcgatgttagacaagttgacaattacaggggactcaatgcagatggcaatgattgtactattaacaattccagtattattcctcttcccatttgttcagaagcattttgtaaaaggtataactatcggttcgacaaaagagtaa

SEQ ID NO: 341 - DNA, 1380 bp, Staphylococcus epidermidis
ttgctgaaagataatttaaagagatggtttggttttgatgaatttaaagaggggcaagaagaaattattgatagtgtccttcatggaaggcatacacttggaattttaccaactggtagcggtaaaagcttatgttatcaactccctacatatatattagaaaaaccgacattaattatatcaccactcatttcgcttatggatgatcaagttatgcaaatgaagttaaaaggtgaaacacatgttgcatgtgtacattccggcatggacgaagtagaaaaaagagacaatattaaacgactaagtaaaagtcgatttatttatttaagtccagaatatatactgcaacctcataattttaagtacatcgctcatatcaactttggattaatagtattagatgaagcgcactgtttatcagagtgggggtatgattttagacctcactatgctttagttggtaaaattattcatcattttaattcagcaacagtgttagcactaacagctacagcaccacctcaattagaaactgatttatctcacattttatcactcaaattaaatgtagttcaaaaaagtatgaatcgagaaaatattagcttacaacactataattttaatgatgatgaggggaagattgaatggctgttaccatttttatctaattctgggcctacaattatatatgtttcttctaaaaaaagatgtttagaactagctcaaatgatttatgactcaggatatctaacaggtatatatcatggagatttaagttatcaggaacgccaaacagttcaacaacagttttttaataatgacatccccgttatagtagcaacaagtgcttttggaatgggaataaataaaaaagatattcgtacagtcatacattttcatttatcatcttcaccatctaactatttacaagaaattggtcgtgctggtagggatggtaaacaaagtcaagccattagtttatttcaacctgatgatagttttattctagaaacactactattcactgatattatcacagatgacgatattacaatgtttgagacgggaaaccacttaccagatgaaaaggaaaaaattttaagtactttaaatatacaattcacatttagccaacttaaagatatatttcatcaatcatatcaacgtaagcgactaggttatatgagaatgatgggctatactaatttagatcaatgtcgacgtaaatacttactagaattttttggcgaacatcctcaaagtccaaaacaatgttgtgatcaagattcaagattagagcctattcagatattgaatcgtaaaaaggtgaaaagaaaactaagttttaatgaaaaattatataatttgttcgaaacctag

SEQ ID NO: 342 - DNA, 1248 bp, Staphylococcus epidermidis
acaatggaagatatctacaaacttatagacgatatcaatctacaaaaaatagaaaacttagattctcgagtaaatgaggcattgagttcaaacaatgatgatgcattatttatacttggtgaaactttatataatttcggtcttacacctcaagggttagaagtttttagaacgttgtatcataaatacccagatgaaagtgaattactcatttactttatcgaaggtctcatgtctgaaaaccaaactgacgaagcacttgaatatttagcacaagtagaaccatctaccgaaaagttgatgctagaagccgatttataccaacaaataaatatgttagaagtagcaattgacaaattgcaagaagcattagatcttgaacctaatgatccaattattcacttcgccttagcagagctattatactacgatgggcaatacttacgagctacaagagagtatgaaacagtattagaaactggtgaatatgaagttaatggagtaaatattttttcgcgaatggcagattgtagtttacaaagtggtaattattcagatgctattagcttatttgatgaaattaatgaagaagagatgaattctgaagattactttaaaaaatcaattgcttatgaaaaaaacgatttaactcaagaagcaattaaaattatgcaaacattactttcaaaagatcctgattttatacaaggatatttttatcttcaatctctatttgaaaatgaaaaaaattatcctgatgctatagaaactggtaaggaaggattacgtttaagtcaattttacaaagaattaatggtttctacaggtagcttagaaattgagcatggagatgcaaatgaaggtgtagaattgctaaaacaagccttagaagtcgataatgcatatcatgaaccattgttgattttaagtgatttatatcgtaatgaagaagactatgaatcaattatacaattgttgacttatgtagatgaagaagatttagaccctattttcatgtggcatttagcatatgcatacggtcaagaagaacgagataaagaagcgcaacatttctttgaattagcatatccaacattacaaacccaagttgaatttttaagcgattattatttctatttattagaaattggacaaaaagaaaaagcaattttgattttaaatcaattattagaaattgatccaagcaatgaaaattggcatgacgagtcaatgagattgcaaatataa

SEQ ID NO: 343 - DNA, 444 bp, Staphylococcus epidermidis
caaatcatggatttaaactttgatttatatatgaatgatgttgttgaacaagcacgaaacgaaattgagcatgctggttatcaacaattaacttctgctgaggatgttgatcaagttttacaacaaaaggggacatctttagtcatggtaaattccgtatgcggatgcgcaggtgggattgcacgtcctgcagcgacacatgcattacattatgataaattacctcaacgattagttacagtatttgcaggacaagataaagaggcaacacaacaagctagagaatattttgaaggatatgcaccctcaagtccatcttttgctttgattaaagatggtaaaatcaccgagatgattgaacgacatcagattgaaggtcatgatgtaatggacgtaatcaatcagttgcaagcattgtttgataaatattgtgaagaaagataa

SEQ ID NO: 344 - DNA, 531 bp, Staphylococcus epidermidis
aatctaatggatcaatcattaatggattattattatcaatttcataagcatcaacattacttcctatgtcatgatattttagaagatgcttggaaatcacaaaatactttttcaaaacatgatgcagtagtaagtctcattttgtttgcaacagctaattatcactatcgtcgtgggaatttaaaaggcgcattaaaatcttttgaaaaagctttattaactattaaccacgctaaagatgacactcaattacaccttaatatcaatgaatttaaacaacttattgtgaaaatgattgaagcagtaaaattacaaaaacaatttactccgttacaattacctattgaaccagagtttcagacacttattaaacgtaaatatccggattatttgtttacctctcaaataattaaggaaccttatattgttgatcatcatattaaacgtgacagaactgaagtgataaaaaatagagaacgtgctttattccatagacagtatcgaaacaaaagcaataaaaaagaccagtaa

SEQ ID NO: 345 - DNA, 672 bp, Staphylococcus epidermidis
aacaacaaggaaggttatcaaataatgagttcaattaatattgcactagatggcccagctgctgcaggtaagagtacaattgctaaacgtgtagccagtcgtctatcaatgatatatgttgatacaggagcaatgtatcgtgccattacatataaatatttacaaaatggcaaacccgaaaattttgattatctgattaataacactaaacttgagcttacttatgatgaagtaaaagggcaaagaatcttactagataatcaagacgtcactgattatttaagagaaaatgatgtaacacatcacgtatcttatgttgcttctaaagaaccagtgcgttcatttgcagtgaaaatacaaaaagaattagctgctaaaaaaggtatcgttatggatggccgagatattggtacagttgtattaccagatgccgaattaaaagtttatatgattgcatctgttgctgaacgtgctgaacgtcgacaaaaagagaatgagcaacgtggcattgaatcaaatttagaacaattaaaggacgaaattgaagcacgagatcactatgatatgaatcgtgaaatttcgccattacaaaaagccgaagatgctattacacttgatacaactggcaaatctatagaagaggtaacaaatgaaatattgtctctactttaa

SEQ ID NO: 346 - DNA, 1332 bp, Staphylococcus epidermidis
aaaagagaggaagtttatcctatgactaaaccgatagtagcaattgtaggaaaaccaaatgtaggaaaatctacaatttttaatagagttgtcggcgaacgtgtatctatcgtagaagatacgccaggcgttactcgtgatcgtatttattcatctggcgagtggttaactcatgaatttaacatcattgatacaggtggtattgaaattggagatgctccttttcaaactcaaatccgtgcacaggcagaaatagcaattgaagaagcagatgtcatcatttttatggtcaatgttagagaaggacttacacaaagtgacgaaatggtcgcacaaatgctttataaatctaagaaacctgttgtattagctgtgaataaagttgataatcttgaaatgcgtaatgatatctatgatttctattctttaggctttggagatccatatcctatttctggttcacatggattaggacttggagatttgctagatgcagttgttgaaaactttaataaagaatcagaagatccttatgacgaagatacgatacgtctttccatcatcggtagacctaatgttggtaaatctagcttggtcaatgctattttaggcgaagaacgtgttattgtgtctaatgttgctggtacaactcgagatgccattgataccgagtactcttatgatggacaagattatgtattgattgatactgctggaatgagaaaaaaaggtaaggtgtatgaatcgactgaaaaatattctgtattacgtgcattaaaagcgattgagcgttcagaagtagtattagtagttatcgatgctgaacaaggtataattgaacaagataaacgtgtagctggctatgcacatgaggaaggtaaagctattgtcattgtagtaaataaatgggatacaattgaaaaagatagtaagacaatgaaaaaattcactgatgatgttagaaatgaatttcaatttttagattatgctcaaatcgcgttcgtatcagcaaaagaagggctaagattaaaaacattattcccttatatcaatcaagccagtgaaaatcataaaaagcgtgtccaaagttctacactaaatgaagttgttactgatgccatctctatgaatccaacacctactgacaaaggtagaagacttaatgtattctatacaactcaggttgcaattgaaccaccgacatttgtagtatttgtcaatgatgttgaattaatgcatttttcttataggagatatttagaaaatcaaatacgtaatgcttttggttttgaaggaacacctattcatattattccaagaaaaagaaattaa

SEQ ID NO: 347 - DNA, 183 bp, Staphylococcus epidermidis
gacttactactgcatcatgttttgaaaaagtattttgtgatttccaagcatcttctaaaatatcatgacataggaagtaatgttgatgcttatgaaattgataataataatccattaatgattgatccattagatttcacccataatttaaaagttgtatgtattcatgctataataatttag

SEQ ID NO: 348 - DNA, 546 bp, Staphylococcus epidermidis
agcacctattgcggtataaaaagatgcattaatatttcgcatacagaaaggaggtataccatgacattatcaataattgtcgctcacgataaacaaagagtcattgggtaccaaaatcaattaccttggcacttaccaaatgatttaaagcatgttaaacaactgaccactgggaatacacttgtaatgggacggaaaacttttaattctatagggaaaccattgccaaatagacgtaacgtcgtactcactaaccaagcttcatttcaccatgaaggggtagatgttataaactctcttgatgaaattaaagagttatctggtcatgtttttatatttggaggacaaacgttattcgaggcaatgattgaccaggtagatgatatgtatatcacagtaatagatggaaagtttcaaggagacacattctttccaccatacacattcgaaaactgggaagtcgaatcttcagtagaaggtcaactagatgaaaaaaatactataccgcatacattcttacatttagtgcgtagaaaagggaaatag

SEQ ID NO: 349 - DNA, 195 bp, Staphylococcus epidermidis
attgcttgttgttctgtattagtgagtatagctttcacttcccttagctatagactatttatatttatacccatttcacatgtttgtattatagcatttataagttgggaatttgaaataatcaattttagttttgagaaaactgataacttagacgttggtttaagttattatttatttactcttcttttttag

SEQ ID NO: 350 - DNA, 813 bp, Staphylococcus epidermidis
tttaaaagttgtatgtattcatgctataataatttagtgaaatatgcattaacgatgcaatttgatatagaggtagatgtaatgtatgaagtaaaactcgatgcatttaatggtccattagacttattattgcatctaattcaaaaatatgaaattgatatttatgatatccctatgaaagccttaactgaacagtacatgcaatatgttcatgcgatgaatcagctagaaattaatgttgctagtgaatatttagttatggcatcagaattactaatgattaaaagtaaattactattgcctcaaacgagcatcgaagaagatatagaagaggatcctcgtgaggatttagtaggaagacttattgagtatcaaaactataaagaatatactgaaatattaaatactatgaaagaagaacgcgatctttattttactaaacatccgacggaccttactcatttagagacaaatgaatcgtgggatcctaatcaaacgattgatttaactgaattgattgtagcttatcaaagagtaaaaaatcgagttgaacttaacactcctaaatctgtagaaattaaaaaagaaacctttacgattcaacaagctacagcacaggttaccgaacgattaaaacaacatgaatcgtttaactttttcagtttatttacatttcatgaaccggtcgaacaagttgttactcattttttggcaattttagaaatgtcaaaatcaggaatagttaatatcaaacaaactaaacaatttgatgacattgacataattagaggagtgaactatagcattggataa

SEQ ID NO: 351 - DNA, 1554 bp, Staphylococcus epidermidis
ctaaaattatgtttaatcataaagaatatcatcttttattatatttatttaagaattgaggttttaatcttgagtactaaacaaaaacacattccttgtttgattacaatattcggtgccacaggagatttgagtcatagaaagctatttccttctatattccatttatatcaacaagacaatttagatgaacatattgctattattggtataggacgtcgcgattataataacgaacaatttcgcgaccaagttaaagcgtcaattcaaacttatgttaaagatacagatagaattgatgagtttatgacgcatgttttttatcataaaactgacgtgagtgataaagaaagttatcagtcattacttcaatttagtgagcgactagattcagaatttgctttaggtgggaatcgtctgttttacttagcgatggcaccacaattttttggagtgatctcagattaccttaaatcttctggtcttactcaaactacaggatttaaacgcttagttatagagaaaccatttggcagtgatcttaaatctgctgaatcattaaataatcaaataagacgttcgtttaaagaagaagaaatttatcggatagatcactatcttggcaaagatatggtgcaaaatatagaagttttgcgattcgcaaacgcgatgtttgaacctttatggaataataaatacatttcaaatattcaagttacatcatcagaagtattaggtgtcgaagatcgtggtggctactatgaatctagtggtgcacttaaagacatggtacaaaatcacatgctacagatggttgctttacttgcaatggaagcaccgataagtttgaatagtgaagatatacgtgcagaaaaagtcaaagtacttaaatctcttagacaattaaaaccagaagaagttaaaaagaatttcgtgcgtggtcaatatgatcaaggcaatatagatggtaaacaggttaagtcatatcgagaagaagatcgcgtagcaaaggattcggttacaccgacatttgtatcgggtaaattaacaattgataactttagatgggctggagttcctttctacattagaacgggtaaacgtatgaaatcaaaaacgatacaagtcgtagtagaatttaaagaagtacctatgaatttatattatgaaactgacaatttactagattctaatttgctagtcattaatattcaaccaaatgaaggaatttcattgcatttaaatgctaaaaagaacattcaaggaattgatactgagccagtgcaattatcatacgcaatgagtgctcaagataaaatgaatacagttgatgcatatgaaaacttattgtttgattgtcttaaaggtgatgcgactaattttacacattgggaagaattaaaatctacttggaaatttgtagatgcaatccaagatcaatggacaatggttgaaccatgtttccctaactatgaagcgggtacaaatggacctcttgaaagtgatcttttattaagtcgtgatggaaatcattggtgggatgatatccactaa

SEQ ID NO: 352 - DNA, 828 bp, Staphylococcus epidermidis
atagaggagtgtcagttaatgagtggacttagaagtgtcactttaggaacaaacgatttatctaaaacgaaagaattatttaaccacatcattggtttacaacattcaactaaaaatgaacatgccataagatttggtgacgctaatttaagtcctggaacgcgtgttcactttgttgaagttccagaggaagattataaaaatctacacatagatagcgttggacttagaacaccttctgattctggattagtagaatatcaaaatatttttgacaagtttaatatatcctatagttcaatcactgaacttaatggtcttaaacattttacttttgaagatcataatcaacaaaaatttgatatttattctaacgagttaaatacgggtataggattaggtatgcctgcttttgatagtcctgttaaccctttacatcaagttcaaggcttaggtccagtcattattaaggtgaacgagttatctgtcaccacttcaattctcacacaagtatttcaattagatttatttgctgagtatcttccacatgaagatgcccaacaacctattcaagtgtttcgtataggtgagggtggtcttggtggtgaaatccacttatttgaaagcgatgaagatattcaaatgaatacacacgggccaattgagcaagtggaattctctacaaatgatacccaattgtatcttcaagcaaaaaatcgtttagatgagattggtgttccatatcaaactctcgaacaggatacttcagaatctcttagaatcactgaaaatagtggcatttcatttatttatacacttgaaaagtaa

SEQ ID NO: 353 - DNA, 891 bp, Staphylococcus epidermidis
ctatcggttcgacaaaagagtaaaggagacgaaacaatgactacaattctacaattaagcgatttacatattgggccccccaatgatgaaaaagatctaaaaactgacgatttaattcatcatatgatgacacactatcaacctgacatcacagtattaacaggtgaccaaatttggtctgaaggcgtcattgattcaggtcgcgtttataaaaaattaatggagtatttaaatcgatatgatacgcaaattgcaacgacatttggtaatcacgatacagaggggcatctcaaacgttcagatttacgcgctattgaggaccaatattctaccaactatgtacagaaaaatcatagcctcattgttgatgataaagaagcttatacaatagaagttgtaaacaacgatacagtcacacatgtgctttatgttattgatggaggagattataatccatttggcataggtgattatgattttataagacctgaacatgtgaattggcttagggaaacacatcaagcatatcaaactcaatttcaacacaactttcaacataacttattatttacacatattccattacaagaatatagagaagttgagaatattggtgaatatcatggcattttcaatgaacctattgcgtgctcaaaaattaattccggattatttagtcagatgttactaaacggtgatattgaaggtatgttctgcggtcatgaccatgacaatgattttacgattaatttatatgggattcgccttagctttggtcgtattggtggttacaatacttatggtgatttacaacgtggggctagattaattgagttgcaacctgacgctatatataaatcgaaagtgttagaatttgatgatcgtttctaa

SEQ ID NO: 354 - DNA, 393 bp, Staphylococcus epidermidis
aatatgagtcgtaaagatgcaagagtacaagcttttcaaactttatttcaacttgaaataaaagagacagatttaacaattcaagaagcaattgaatttattaaagatgatcattctgatttagactttgattttatatactggttagttactggagtcaaagatcatcaaatcgttttagacgaaacaattaaaccccatttaaaagactggtctatcgatcgtttactgaaatcagatcgtattattttaagaatggcaacttttgaaatattgcacagcgacacacctaaaaaagtagttgttaatgaagctgtagaactcacaaaacagtttagtgatgatgatcattataaatttgttaatggtgttttaagtaatataaatgattaa

SEQ ID NO: 355 - DNA, 918 bp, Staphylococcus epidermidis
acaagttaccgcttcaataggggtgccaacatgaatactatcattgaagaatatttaaatttcattcaaattgaaaaaggattaagtaacaatactataggagcgtatcgaagagatttaaaaaaatataaagattatcttgaagataacaagatttcacatatcgattttattgatagacaaattatccaagagtgtcttggacaccttatagatatggggcaatcttcaaaatctctcgcaaggtttatttctacaataagaagctttcatcagtttgcattacgcgaaaaatatgctgctaaagacccaactgttttaattgaaacacccaaatatgaaaagaaattaccagatgtgcttgaaatagacgaagtaatagcattactggaaacgcctgatttaactaagaataatggatatcgtgatcgtacgatgttggagcttttatacgccacaggtatgcgtgtaactgaaattattcaattaaatgttgaagacgtaaacttaatgatgggatttgtaagagttttcgggaaagggaataaggaaagaatcgttcccttaggagataccgtcatcgaatatttaactacatatattgaaaccgtaagacctcaattactcaaacaaaccacaactcaagcgctatttcttaacatgcatggaaagtctttatcaagacaaggcatttggaaaatcattaaacaatatggtttgaaagctaatatcaataaaacgcttacaccacatacattacggcattcatttgcaacacatctcttaaaaaatggtgctgatttaagagccgtacaagaaatgttaggtcactctgatatttctacaactcaactttatacacatgtatctaaatcacaaattagaaaaatgtatacgcagtttcatccaagagcttag

SEQ ID NO: 356 - DNA, 210 bp, Staphylococcus epidermidis
catgcggtgcttgcggtgcagctgctccagatatatatgattacgatgatgaaaggtattgcatacgtaatccttgacgataaccaaggtactactgaagtgcctgaagagttatatgaagatatggaagatccgctaggaggttgtcctactgactcaatcaaaattgaagacgaaccatttgatggtgacgcactgaaatttgaataa

SEQ ID NO: 357 - DNA, 969 bp, Staphylococcus epidermidis
ggagttgtacgcatgtataatccattcgacgaagcttatcatggcttatgcgaagagatattagaaatagggaatagacgcgatgatcgcacacataccgggacaatttccaaatttgggcatcaattgcgtttcgatttaaccaaagggtttcctttacttacaaccaaaaaggtttcttttaaattagtagcaactgaattattatggtttattaaaggagatacaaacattcaatacctacttaaatataataacaatatatggaatgaatgggcatttgaaaattatgttcagtctgatgattatcatggaccagacatgacagattttggacatcgttcccagcaagaccctgaatttaacgagcagtataaagaagaaatgaaaaaatttaaagaacgtattctaaacgatgatgcatttgctaaaaaatatggcaacttagggaatgtttatggtaaacaatggagagattgggaagataaaaatgggaatcattacgatcaattaaaatcagttatacaacaaattaaaaccaatccaaactctcgacgtcacattgtttcagcatggaatcctactgaaatcgattcaatggcattaccaccttgccacacaatgtttcaattttacgtacaagagggtaaattaaattgtcaattatatcaaagaagtgctgatatatttttaggtgttcctttcaatattgcaagttatgctttactgacacatcttgttgcaaaagaatgtggacttgaggtgggtgaattcattcatacatttggagatgcacatatttattccaatcatatggatgcaatacatacacaattatcaagagatagttatctaccacctcaattaaaaattaatacagataaatcaatttttgatattaattatgaagatttagaattgataaattatgaatcacaccctgctattaaagcacctattgcggtataa

SEQ ID NO: 358 - DNA, 705 bp, Staphylococcus epidermidis
ataggaggtagtaatattatggatctaattcaattaaaaacaagacctgttgttataagacgagaattgtttgatcattattcagagttaggtttggatgaacaagatttagttattttgataaaacttttatatgcatctgaaacttctaataagcaaccttctattgaatttcttcaaaaaggatcaactatggaacctcgtcaaattacttccgtaatacaaaacttaattcaaagagaattattagaactcaatgttagtaaagacgaagaaggtaaattcactgaatacatgaatttggatcccttctatcacaaattaaatcaattattaaaacatcaatacttaaaacatgaggaacaagataaaaaagagcagtttaagcaattgtttcagatagttgagcaatcgttcggcagaccactatcgccgtatgaaattgaaacattaaatcagtggattgatgtcgatcaccatgacttatcagttatacaagccgctcttgatgaggcacttagccaaaataaacttagttttaaatatattgatcgtattttattaaattggaaaaagaataatgtgaaaacagttgacgattcaaagaaaataagagaacagtttaacaaaccaaaaatgaaacatgttgttaaaaaggtgcctaaatttgactggttgaatggagagaatcctaatgataagtaa

SEQ ID NO: 359 - DNA, 246 bp, Staphylococcus epidermidis
ggcggtattttttggctcaatgatgagtacccgattataaatggtaatcaagcagctatcttaggtatgcattcaattattacacgcccaattgcagttgataaagatacaattgaaaatcgtccaatgatgtatatcgcattaagctatgatcatagaatcatcgatgggaaagaggctgtaggattcttaaaaacaatcaaagaactcattgaaaaccctgaagatttattacttgaatcataa

SEQ ID NO: 360 - DNA, 294 bp, Staphylococcus epidermidis
ccaggcgtcagctttttgctatcatcatactatgtttatagaaaaagaaaaaataatcgttctttaatttatggattaattacaggtacaatcgttatgactattgttttgagcatcttaaattattttgtgttacttccattatatggaatgatatttaatttaggtgatgtgcttaataacgtaaaaattgttattgtgtctggagtcataccttttaatttaattaaaggcataatcatttccattatatttgtgctgttatttagaagattaagacatatcatcaaataa

SEQ ID NO: 361 - DNA, 1101 bp, Staphylococcus epidermidis
aaacatataagaatagaggttgtaattatgacaaaaattgcatatacaggtggaggaacagtaggacacgtttcagtgaatttaagtttaattcctacttcgattgaaaaaggacacgaagcattttatattggttcaaaacatggtattgaaagggaaatgatagagtcacaactccctgatattcaatattatccaatatcaagcggtaaattacgtcgttatctatcttttgaaaatgcaaaagatgtctttaaagttttgaaaggaattttagatgcacgtaaaatacttaaaaaacaaaaaccagacttacttttttcaaaaggtggttttgttagtgttccggtagttatagccgcacgttctttaaaaattccaactatcatacacgaatcagatttaactcctggattagctaataaaatttctttaaaatttgctaagaaaatatacacaacctttgaagatacacttacatatcttccaaaagataaagctgattttgttggggctactgtacgtgaggacttaaaacaagggaataaagaaagaggatatcaactcactgattttgataaaaataaaaaagtgttattagtcatgggaggaagtttaggtagtaaaaaacttaataatatcattcgtcaaaatattgaggcacttctccatgattatcaaattatacacttaactggaaaaggacttgttgatgactcaatcaataaaaaagggtatgttcaatttgaatttgttaaagacgacttaactgatttattagcaatcactgatactgttgtaagtcgtgcaggttctaacgcaatttatgaatttttatcgctacgtataccgatgttactcatccccttaggacttgatcaatcaagaggagatcaaattgataatgctaaaaactttgaatctaagggttatggtcgtcatattcctgaagatcaacttacagaagttaacttattgcaagaattaaatgatattgaattacatcgtgaatctattattaaacaaatggaaacatatcaagagagttacacgaaagaagatttatttgataaaattattcatgatgcattaaacaagtag

SEQ ID NO: 362 - DNA, 999 bp, Staphylococcus epidermidis
aggaggataagtatgcaaactattgaaagcatcattataggtggcggtccatgcggattaagcgcggcaattgaacaaaagaaaaaaggtattgaaacattagtaattgaaaaaggtaatgttgttgaatcaatctataattatccaacacatcagacttttttctcatcaagtgataaattaagtatcggcgatattccttttattgttgaagatagtaagccaagacgtaatcaagcgcttgtatattatagggaagtcgttaaacatcatcaacttaacatacatccattcgaagaagttttaacagttaaaaaaataaacaataaatttgcaattacaactacaaaaggtgtatatgaatgtaaatatttaactgttgctacgggttattatggtcaacataacactttagaagcggaaggggcagaattaccaaaagtattccattactttaaagaagcacatccgtattttaatcaaaatgttgttattattggaggcaaaaactctgctgttgatgctgccttagaattagaaaaagctggtgctaatgtaactgttttatatcgtggcgaacagtaccctaaagcaattaaaccatggatattacccaatttcgaatcattagtcaatcacgaaaaaattacgatggaatttaatgcgacagtaaccaaaattaccgatcattcagtgacttatgaaaaagatggtcaacttatagaaattgataatgactacgtttttgctatgattggttatcatccagattacgatttcttaaaaacaataggtattgatatccataccaatgaatatggaactgctcctgtttataatcgagaaacattcgaaacaaacgtcgaaaattgttatatagctggtgttattgctgcgggtaatgatgcaaatactatttttatcgaaaatggtaaatatcatggtggtgtcattacacaaagcattttgacaaaaaaacaaacacctcttgaaacatag

SEQ ID NO: 363 - DNA, 1134 bp, Staphylococcus epidermidis
ttaatgatgagttatctttttaataattacaagcgtgacaatatagagtttgttgatgctaatcaaaatgaattaattgataaagataataatgtctacctagatttttcgtcaggtataggtgtgacaaatctgggttttaatatggaaatttaccaagcagtttataatcaactgaatttaatatggcattcacccaatttatacctaagtagtatccaagaggaagtggctcaaaaattaattggtcaacgagattatttagctttcttttgtaatagcggaacagaagcgaatgaggcagctatcaaactcgcacgtaaagctactggtaagtcggaaattattgcttttaaaaagtcttttcacggcagaacgtacggcgcaatgtctgcaacaggacagaagaaaattacagatcaatttggtccggttgttcctggattcaaatttgctatttttaatgattttaattcatttaaatcattaacttcaaataatactgctgctgtaattatagaaataattcaaggtgaatcaggagtactacctgctgatcctttatttatgaagcaattaaatgagtattgtaaacaaaaagatatccttataattgtagacgaggttcaaacgggcataggtagaaccggtaagttatatgctcatgaacattatcaattgtctccagatatcatcacattagctaaaggattaggtaatggccttcctattggaacaatgttaggcaaaaagaatttaggtcatgcatttggctacggttctcatggtacaactttcggtggaaatagattatcattggttgctgcaaaccaaacgctttctatcattaatgatgctgatttgctgaatgatgttcaatcaaaggggcaatttcttattgaaaacttaagaaaaagtttagtaaataaaagaaatgtaattgaagtacgtggtgtaggtttaatggtaggaatagaggtcactaatgatcctagtcaagtagtgcgagaagctaaacgtatggggttaatcattttaacagctggtaaaaatgtgattaggttattaccgccattgaccatcactaaaaaacaattagaaaaaggtatagaaatattaactgaaatcatttga

SEQ ID NO: 364 - DNA, 711 bp, Staphylococcus epidermidis
aggagagtgagtttaatgtctttaatatcaatgattatatatttcgtaatattaatggtcattccaatgtgggctcaacacaaagttaaatctaattatgaaaaatactcacaagtgagatccacaagcggtaaaactggtcgtgaagttgctgaagaaattttacatgctaatggcatttacgatgttgacgtcgttaaaggcgaaggtttcttaactgatcactatgacccaaataaaaaagttgtttgtttatctcctgcaaactacgatagaccatcagttgctggtactgcaattgcagcccatgaagtaggacatgcaattcaacatcagcaaggatacgcaccattaagatttagaacagcattagtaccattagctaatattggtagttctttaagctacattattattatggtaggtattgttttaacagctctcggtagtgtctttggctctacagttctatgggttggtgctggtttaatgtcacttgcagttttattctctatcgtgacattacctgttgagtttaacgctagttcaagagcgatgaaacaaataacagctttaaatatcgttaatgagaaagaatacaaacacgcgaaaaaagttttatctgcagcagcaatgacatatgtggcatctactgcagttgcgttagctgaacttgctcgtattatattaattgcaagatcaagtgattaa

SEQ ID NO: 365 - DNA, 1221 bp, Staphylococcus epidermidis
aacaaggtgagaacaacaatgagtcatgagatatttgaacaagcaaaacctattttaaaaaagattcaaaataaaggttttaaggcttatttcgttggcggatcagtacgtgattacatcatgcaacgacctatacatgatgttgatattaccaccagtgcaacgcctgacgaaatagaatctatattcgataaaaccataccagtggggaaagaacacggtacgatcaacgtggtctttcaaaatgacaattatgaaattactacattcagatctgaagatgaatacatcgatcatcgtaggccaagtgaagtgtattttgtaagagacttatatcaagatgttcaacgtagagattttacaatgaatgctatagcaatggatttaaattaccggttgtatgattattttaatggtcaacaagatataaacaatcgagtaattcgtactgttggtgtaccaagtgaaaggttttcagaagacgcgcttcgtatcattagaggattacgttttcaatcacaacttaattttcaaattgattcagacacattacatgcaatgtcttctcagatttcagatatacaatatttatccgttgaacgtgtagtagtagagcttaaaaaacttatcatgggaaacaatgttaaacaaagttttgaagtcatgcaaaacatgaaagcatttaattatataccttttttcaaatcatttgagatgtctcatcttcatatagatgagcccatcacatttgaactttggattgcaatcttaatcgtccaacaaccaaaagatatacaattaagcaccttgaaaatcagcaatcaagaaaaagcaactatcaaaaaatgggttacactcatccaaacattgcctaagatacagtcaaagcaatctttaataacattagtatatgattacaatttaaatgatattgaaatcctattatcattacatcatttgcttaaacaaaatgggcttacaacagccaatcatttaatcattaatgaaataagtattcgcgaagcaaatgaaaaattacctatccattgcagaaaagaattggcaataaatggtaaagatatactcaatcatacgaataaaaattcaggaccatggctaaaagatacacttagagaaatagaaatcgcagtcatatcaaatcaaatagtcaacactaaagaagaaatattagaatgggtggatgcacatgtcaaaatatag

SEQ ID NO: 366 - DNA, 210 bp, Staphylococcus epidermidis
ttatccattttacctaaatcatgggtaaatgtatatctttgtgaattttctttaataataatcgcacaagcacttcggccgggatttcctttagtcgcagcatcaaaatatattttagccattacttttactcctcttcagaattgtctactcactaaaatgtatctattctattgtatcaaactaaaaagacaaagcactaaaaattaa

SEQ ID NO: 367 - DNA, 222 bp, Staphylococcus epidermidis
tttaaggatggttattacatgttacatgaaacttggaaagaacgtacaccaattaaaaaagtagaagtgacaaatactgatgccaaaaaatttacagttgcagatatgctaactatcggcaaacagtatgatgttattaacgaaactgaagaatattatcaaattatagataattctggtttagtaggtggctattacaaagactactttaaagagatataa

SEQ ID NO: 368 - DNA, 282 bp, Staphylococcus epidermidis
gttacaataggaggatgtcacatggagattatagcaatttcagaaacacctaatcataatacaatgaaagtttcgttgagtgaaccacgtcaagataactcatctacaacatatactgccgctcaagaaggtcaacctgaatttattaatcgattatttgaaatagaaggtgttaaatcaatattctatgttttggattttatatcaattgataaagaagataacgctaactggaatgaattattaccacaaattgaaaacacgttcgctaaaagcaattaa

SEQ ID NO: 369 - DNA, 1164 bp, Staphylococcus epidermidis
tttaagaaaggatgggcacaaatgaaaatcggtataacgtgttacccgtccatgggtggttctggcattattgctacagaactcggtattaaaatggcagaacgtggccatgaagttcactttattacctcaaacataccctttagaatacgcaaacctttacctaacatgacgttccaccaagttgaagtcaatcaatatgccgtattccaatatccaccatacgatattacattaagtacaaaaatttctgacgttatacaagaatatgatttagacatattgcatatgcattatgctgtacctcacgctgtatgtggtatattagcgaaacaaatgtcaggtaaaaacgtcaaaattatgacaacactacatggcactgatataactgtgttaggttatgaccatactttacaaaacgcgataaaatttggcatagaacaaagtgatattgtaacaagtgttagccattctctagcacagcaaacttatgaaattatcaatactaaaaaggaaatcatccctatatataattttgtaagggaaaatgaattcccaactcggcataatgaagaattaaaagattgttatggtatttcacctgaagaaaaggtattgatacatgtttctaatttcagaaaagtaaaacgtattgatacagtgattgagacatttgcaaaagttcatgagagtataccatccaagttgatacttttaggagatggtccagaattaatcgatatgcgacataaagcacgagaacttgatgttgaaacacacgtactctttttaggcaaacaaaatgacgtaagcgcattctaccaactatctgatttagtactactcttaagtgagaaagaaagttttggattaactctcttagaagcaatgaaaacaggcgtcttacctatagggagtcatgcaggtggtattaaagaggtcatcagacatgaagaaactggatttatagtagatataggggatagtacacaagctgcaaaatatgctattaaacttttatcaaatccagagttatatcaaaaaatgcaatcacaaatgctgaaagatattgaagcaagatttagttcagatttaattactgaccaatatgaaaactattatcgaaagatgctagaacaaggtgagaacaacaatgagtcatga

SEQ ID NO: 370 - DNA, 1014 bp, Staphylococcus epidermidis
catatgtttatgaagagggaggtcaacgaaatgactaaattatcatacttagaagctatacaaaatgcacaagacttagcactaaatcattttagtaatgcatttatacttggcgaagatgtaggaaaaaagggtggcgttttcggcacaaccaaaggattacaaagtaagtatggtgatgaacgtgtaattgatacacctcttgcggaatcgaatattattggtactgctattggtgcagcaatgctaggtaagagacctattgccgaaatacaatttgcagatttcattttgcctgctacaaatcaaattataagtgaagcagctaaaatgagataccgttcaaataatgactggaattgcccactgactatcagagcaccttttggtggtggagttcatggtggattatatcattcacaaagtgttgaaagcatttttgcttcaactcctggattaactattgttattccttcatcaccttatgatgctaaaggtcttctattgtcctctatagagtctaacgatccagtcttatactttgaacataaaaaagcatatcgttttctaaaagaggaagttcccgaaacatattatactgtacctctaggtaaagcagatgttaaaaggccaggcgaggacatcactgtattttgttacggattgatggtgaattactgtttacaagctgcagatattttggcaaatgacggcatcgatgttgaagtagtcgacttaagaacagtttatccactagataaagcaactatcattgaacgctctcaacgtactggtaaagttcttcttgttactgaagataatctagagggaagcattatgtctgaagtatctgcaattatagctgaaaactgtctgttcgatttagatgcgccaatcatgcgattagctgcaccggatgtcccatctatgccattttcaccaacattagaaaatgaaattatgatgaacccagaaaagatacaggacaaaatgcgtgaactcgcacaattttaa

SEQ ID NO: 371 - DNA, 858 bp, Staphylococcus epidermidis
gaggcaattatggctaaacaaattatcgtcacagattcaacctctgatttatcacatgaatatttaaaacaacataacattcatgttataccattaagcctgacaatcgacgggaaatcttacactgatcaagttgatatctcttcaagtgagtatatcgatcatattgaaaatgatgcagacgtcaaaacaagtcaaccacctattggtcgatttattgaaacatatgagcaattagctcaagatgacgttgaaattataagtattcatctttcgtcaggcttaagtggtacttataatactgctgttcaagcgagccatatggtagatggcaatatcacagtgattgattctaaatctatttcgtttgggttaggttatcaaattaagcaaattgttgaattaataagtcaaggtacatcaacagaagaaatagtgaaggaaatgacacagttacgtgataacttgcaactgtttgtggttatcggtcagcttaatcaactcattaaaggtggaaggataagtaaaacaaaaggtttaattggaaacattatgaaaattaagccaatcggaactttaagagatggtaaacttgaactagtgcataattctagaactcaaaactctagtgtgcaatatttaaaaaaagaaattacagattttgttaaagatcataaaattaaatcaataggtattgctcacgccaacgttaaagatttcgttgataaaatcataaaatcatttacagagtcatttgattttagccaatttgatattaatgtaacaactccagtgatttctacacacactggacaaggtgcaattggacttgtggtattgagagatacgttgaactaa

SEQ ID NO: 372 - DNA, 627 bp, Staphylococcus epidermidis
ggggcacctataatgaatcgatggaaacgcatttcattgcttattgtttttacacttatttttggtataatagctttttttcatgaatcaaggcttggaaaatggatagataacgaagtatatgaatttatttattcatctgaaagtttcattaccacatctattatgttaggtgtaacaaaaattggtgaagtttgggcaatggttgcgctatccttattattagttgcttaccttatgctaaaacgtttcaagattgagacattattctttgtaatagtaatgagcttatctagtacactcaatccactattaaagaatatctttgatagggaacgtccaacattattgcgtttaattgacatttcaggctttagttttccaagcggtcatgctatgggctcaacttcattctttggaagcgctatatatgtaataaaccgtcatgattcgggtatctctaaaggcgtgttaatcggtttatgcgcacttttcattttattaatatcaacttctagagtgtatctaggcgttcattaccctacagatattattgccggcattattggtggtgtattctgcattgttttatcaacgttaatattgaaaaaacaactcgctgtataa

SEQ ID NO: 373 - DNA, 1347 bp, Staphylococcus epidermidis
gtgataactatgactgaatatttaagtgtttctgcactaactaaatatataaaatataaatttgaccaagatcctcatctacagtcagttcttattaaaggagaattatctaactttaaaaagcattcaagcggacatttatattttaatgtcaaggacaaagaaagtgtcatcagtgcaatgatgtttaaaggaaatgcttctaagttaggctttgagcctaaagaaggtgatgaggttttaattgaagctcgcgtttctgtttatgaaagacgaggaaattatcaaatatatgttaataagatgcaactcgatggtattggtaatttataccaaaagcttgaactactaaaaaagaaattgaaaaaagaaggctattttgatcaaagtaacaaaaaactcataccaaagtatccaaagaaaatagcggttttaacagcgagcacaggtgcagccattagagacatacatagtacgattaacaatcgctaccctttggtcgaacaaattcaaatcagtacccttgttcaaggcacgcaagctagacaagatataatagaaaagattcaatatgctgattcattagatgttgatacaataatagttggacgtggtggtggttcaattgaagatttgtggaactttaatgaagaagatgttgttaaaaccatctttaattgtcaaacacctattatatcagctgtaggtcatgagactgattttacattgagcgattttgtagcagatgttagagctgcgacacctactcaagctgctgttatagcaacacctgatcaatatgagttattacaacaaattaaacagtatgaatatacattatcaagatatataaaacaatatatcgaacatcagaagaaacaacttaatcacatatcatcatattacaaatttaagcaaccgagtttattgtacgatcaacaaattcagaaacgagatgaattagaaagacaattaaatcatctattaaatactaaagttgaaaagtcaaaacatcacctcaagttacttcaacaaagttttaattttaaaaatttaaatcagcagattactcaggaaaagcaatctatttatcaattgcattctagattgtccaaaataatgtccaataacattactaatttaaaaacagtgctaaaaaacaaattagaaagtcttaataatttaagccccaccaatacgatgcttagagggtacgcaattgtcaataaagacaatgaagtggttacaagcacacataaattgaatgaaaacgaccaaatatctttaacaatgaaagacggaagtgtcgatgcaacggttaagaaagtaaggtgtaatgatgagtaa

SEQ ID NO: 374 - DNA, 747 bp, Staphylococcus epidermidis
gaggaacatatgaaaaacatcatcgtaattaagctcggtggtatagctatagaaaatttaaacgacgcatttatacaacaaattaatgcttggcaccttgaaaacaaaaaaataattattgttcacggtggcggccaagtcatcagtaatttattaactaaaaacaatcattcaactattaaaattgatggcatgagagtaactgctaaaaatgatttacctatcatatatgatgctttaattaacatagttggccatcaacttttagaaagacttaaagaatctaatttagaattttttcaatttaaagaaaagataaaagaacttgtaagcgccgaatttttaaataaaaatatctatggttacgttggtaaagttaaagaaatcaacacgatgctattagaaaaaatgttatcacgcgacataataccaattatcactagtttgggtgtaaatgagcaaggggagtatcttaatgttaatgctgatcatctcgccaccgcaattgctaagaaactaaaagtcgaaaaattagtatatatgactgatgtccctggtgtaattgaaaaagataaaacgcttgctactcttacaattaatgaagcaaaaacaaaaattgaaaataaaataattacaggcggaatgatacctaaaattgagagtgcaatccaaacattagaatctggtgttgaatcgattttaattgcaaataatttacaaaaaggaacaatcataaggggtgattaa

SEQ ID NO: 375 - DNA, 669 bp, Staphylococcus epidermidis
ggtgcaaatatgacaaatattttaattgtagaagatgagcaaaatcttgctagatttatagagcttgagttaactcatgaaaattatactgttgatatagagaatgatggaaaggtgggtttggataaagcattatctaagccctatgatttatatatattagacttaatgcttccaaacataaatggtctagaaatttgtagacaaattcgtcaaaaaacaactactccaattatcatcattactgcgaaaagcgagacatatgataaagtagctggattggactatggggcagatgactacattgtaaaaccctttgatatagaagaattgcttgcaagaataagagcggtattgcgcagacagccagataaagatgttttagatatcaatggtattatcattgataaagatgcctttaaagttactgttaatggccatcaattagaattaactaaaacagaatacgatttactatatgttttagctgaaaatcgtaaccacgtcatgcaacgtgaacaaattctcgatcacgtatgggggtataatagtgaagtagaaacgaatgtcgttgatgtttatattcgttatttacgtaataaactcaaaccttttaataaagaaaaatccatagaaacagtacgtggcgtagggtatgtgattcgatga

SEQ ID NO: 376 - DNA, 615 bp, Staphylococcus epidermidis
attatgaatataattaagggaaatattgcaagtcctcttggattttcagctgatggtctgcacgctggctttaaaaagaaaaaattagactttggttggattgtttcagaagtacctgcaaatgtagctggtgtatttacaactaataaggtcattgctgcaccattaaaattaacaaaaaacagcatcgaaaaaagtggtaaaatgcaagctattgttgttaattcaggtattgctaattcttgtactggtaaacaaggagaaaaagatgcttttaaaatgcaacaactggccgcaaataaattacaaattcaaccagaatatgttggtgtcgcatctactggtgttattggaaaggtgatgccaatgtctattctaaagaatggcttttccaaactagttaaaaacggtaatgctgatgactttgcaaaagcgatattaacaacggatactcatacaaaaacatgcgttgtaaacgaagaatttggtagcgatacagtaacgatggcaggtgtagcaaaagggtcaggaatgatacatcctaatttggctacaatgctagcatttataacctgtgacgctaacatctcatcacaaacattacaacaggtttaa

SEQ ID NO: 377 - DNA, 2241 bp, Staphylococcus epidermidis
ggaccgcgtatgacggaaaataaagggtcttcccaacctaaaaagaacaacaatgggaagtccaatggaaaaaagaataggaatgtaaagagaacgattattaagattataggttttatgattattgcctttttcgttctattgctactcggtatcttgttgtttgcttattatgcgtggaaagctccagcatttagcgaatcaaaattagatgatccaattccagcaaagatttacgataaaaacggagaacttgtaaaaacacttgataacggacagcgacatgaacatgtgaatatcaaagatgttcctaaagacatgaaaaacgctgttttagctactgaagataaccgtttctaccaacatggagcattagattacaaacgtttatttggtgccattggtaaaaacttaacaggtggatttggttcgcaaggtgcgtctacacttacacaacaagttgtaaaagactcattcttgacacaacaaaaatctatcggtcgtaaagcacaagaagcttatctttcttatagattagaacaagagtacagcaaagatgaaatattccaagtttacatgaataagatttattattcggatggcgttactggaattaaggccgccgctaaatattacttcaacaaagatatgaaggatttaaatttagctgaagaagcttatctagctggtttacctcaagttcctaacctttacaacatttacaacaatcctaaggaagctaataatcgtaaagatactgtgctttatcttatgcataaacataaccgtattaatgataaacaatatgcggatgcgaagaagattgatcttaaagctaacttagttgaacgtactaaaaaagaacgtcaagtcactggaaatgaaaaaaatcctgagtatgattcttacgttaatttcgttcaatctgaattaatgaataacaagtactttaaggataaaaatttaggttcagttcttcaaagtggtataaaaatttatactaatatggataaagatgttcaacaaacgttacaagatcgaattaacaatggttctttctacaagaatgaagaccaacaagttggtgcaacaattctagatagtaaaactggtggattagttgcgatctcaggtggacgtaattataaaaatgttgttgaaagaaaccaagctactgaccctcaccctactggttcatcattaaaacctttcttagcttatggacctgcaatagaaaatatgaagtggtcaacaaatcatgcgattcaagacgaatcatcatattgggtagatggttctcaattcaagaactatgatacgaaaggccatggaacagtttctatctatgatgcattgcgtcaaagtttcaatattccagctttaaaaacttggcaacaagttaaaagtcaagctggtaatgatgcacctcagaaatttgcatctaaattaggattggattatagtggcaaaattggaccttctgaagtattaggtggatcttcatcagaattctcacctactcaactagcttccgcttttgcagcaatagcaaatggtggtacttataataacgcgcattcaatacaaaaagttgttactcatgaaggagatacaattgagtatgaacatacgagtcacaaagctatgaaagactatacatcatatatgttagctgaaattcttaaaggtacatttaaagcatatggttcggcttatggacatggtgtgtcaggcgtaaacatgggtgcgaaaactggtactggtacgtatggacaagaaatatacgaaaagtataatttacctgataatgctgccaaagatgtttggattaatggtttcagtccagaatatactatgtcggtatggatgggcttcaataaggttaaacaatatggaacaaattcatttatcggtcattcagaacaagattatccacaatacttgtatgaagatgtgatgtctagtatctcatctaaagatggtgaagatttcaaaaagcctaatgatgtacaaggaagttcaccggacagtctatctgtatcaggtcattctgataataatactactaaccgtagtgttcatggaagtagcgatacatcttcttcatcaaatggtggctctaactcagcatcaagtggaaacaactcgaatagttcgaatggtaccagtcaaggtaactcaggcaatgcatttacacgtctgttcaatttaaactctatattcgattataaagtttcataa

SEQ ID NO: 378 - DNA, 678 bp, Staphylococcus epidermidis
aaaggaatcataaacatgttagagttcaaacaagtgagcaaatctttcagagatggcaatcaaatgattcaggcagtaaaacctaccgatttaaaaataattcagggggaactgattgctatcgtgggaccctcaggttcagggaaaagtacatttttaactatggctggcgccttacaaagacctacgtcaggaaatatttacatcaataacaaaaatatatcaatattatctgaaaaacagttatctcaaataagaattaacgaaataggttttatattacaatcgacgaatctcgtgccttttttaacaatcgaacaacaattcaaacttcttggtaaatataaaaaagatacattaagtgaagatgaataccaaaagttggttaaacagctaaatttatcggatattaccaatcaattaccaaatcaaatatctggcggtcaaaaacagcgcgtggcaatagctaaagctatttacacaaatccatcaatcatactagcagatgaacctaccgcttcactagatacgaataatgcaatggctgtaatgaaaatacttcaaaaacaaacgaaagaaagaaataaaacatgtgtgattgttactcatgatgaacgtttaactcatttttgtgataaaacatatttcatggaggatggagttctttcactccaatag

SEQ ID NO: 379 - DNA, 480 bp, Staphylococcus epidermidis
atgaaacacatgcacagggggacacacgaagtggaacgcacatttttgatgattaaaccggacgctgtccaaagaaatttaattggtgagattatatctcgcattgaaaagaaaggtcttaagcttgttggcggtaagtttatgcaagtgcctatggaactagctgaaaaacattatagtgaacatgaaggaaaaccgttctacgacaagttaatttcattcattacttctgcacccgtttttgctatggtagtagaaggtgaaaatgctgtagctgtatctcgtaaaattattggaagcacaaatccaagcgaagcagctcctggtacaatccgaggcgactatggtttaaatctaggtcgtaatattatacatggttcagattcaacagaatcagcacaacgtgaagttaaattatggtttacaagtagcgaaattgctgattataaagaaccaagagaagattggctatacgaataa

SEQ ID NO: 380 - DNA, 588 bp, Staphylococcus epidermidis
ggtgtgaacatggaaacgacaataagcaaactaaacaaacatgtagaacaactgcttaagggcattaatgagtatgagcctattgaaatcaatagctctttaagtcatttattagatatgtactctatcccagatgaagctaagattgcttgcctcactattgatacatcaatgcgtcatttggacgctattggtgataatcatctatctaagaaagcaatattaataggggacctattaagcgctcatttctatactctattagcaaatattcaagattccgcttttcaacttgcaatgagcaaggccattgttaaaatcaatgaagataaatcatcaattaatcaaaatgatctcactgataaagagttgaaagatgcgattctagatatagaaacactatttccatatcttacaattaaccattttggaagttctgttgataaaatcaaattattcgctgaattgacttctaaatataaagattaccatcctgagtatctgggtaagtttaacagatatgaaatagataaatatattcaagaaattagcaaaagttataaaaaaagaggtaatgaaaatggctga

SEQ ID NO: 381 - DNA, 2721 bp, Staphylococcus epidermidis
ggagcggacattatgggaatagcaacatttgcagttgttgatttagaaacaactggaaatcaactggattatgatgaaatcattcaaattggtattacgtttgtgcgtcagaatcaagtaattgatacataccattcaatgatacgtaccgatttagaaattccaccgtttatccaagccttaacttctatagaagaagaaatgttagtacaggcaccttattttaatgaggtcgcagatgacatttatcaacttatcaaagactgtgtttttgttgcacataatatctcatttgatcttaattttataaaaaaagcttttgaaaaatgtaatattcaatttaaacctaaaagagtaatggatactttagaattgtttaaaatcgcattccctacagacaaaagctaccagttaagtgcattggctgaatctcatcatataccattaaataatgcacatagagcagatgaagatgcaacaacaactgctaaattgatgattaaagcttttgagaagttcgagcaattgcatttagatacacaaaaacaactgtactatttaagtaaaaatctcaagtatgatctttatcatattttgtttgaaatggttagaaattatcaaactaaaccgcctaacaaccaatttgaacaatttgaacaaattatttaccgtaaacaaattgatttaaaaaaaccggctgtcaattttgatggtaccttaaaagatttatataaaaatgtcactcaatcattaaatcttacatatcggccacaacagttatacctagccgaaattatacttgatcagttgatgcatagtgataaggcaatgattgaagctcctttgggtagtggaaagtctcttgcttacctgcttgcagcaacaatgtataatattgagaccggtcgtcatgtaatgatttcaacaaatacaaaattattacaaagtcagctattagagaaagacataccattactcaatgatgttttagattttaaaattaacgcgtcattaatcaaaagtaaaaatgattatatatctcttggtcttatcagccaaattcttaaagacgatacaaataattatgaagtaagtattcttaaaatgcagttacttatttggataactgaaacaaatactggggacatacaggaattaaatcttaaaggtggacaaaaaatgtatgttgaccaaaaaattgaaacatacgttccagttcgtcatgatatccattattataattatataaaaagaaatgctcaaaacatacaaattggtatcactaatcatgcgcacttaattcattcagacagtgaaaacactatatatcaactatttgatgattgcatcatcgatgaagcacatagattgcctgactatgcgctaaatcaagttactaatgatttaaattattcagatgttaaatatcaattaggacttattggcaaaaatgaaaatgaaaaactacttaaagcagtagacaaacttgagcaacgacgtattttagagaaactagatattgcacctatagacgtttttggactgaaaataaatatcaatgagttacatgatttaaatgagcaactattcactacaatttataatattattcaaacatcagacgtttatgatgatgacattcataagtatcattacgtttatgactttgaaacgggtgagattttaaaagatttacgtgcaatcatagataaattaaataaaacgatagaaatttttaacggaatgaatcacaaaacaatcaagtctgtacggaaacaattattatacttacatgacaaatttaaacttatcgaacaaagtataaaagatcatcatacaagctttatttcaattaaaaatttagcacaaaaatcaacaatccgactcttagtcaaggattatgatgttaaagatatcttgacgaaacaagtactcgaaaaatttaagtctcttacatttatatctggcacattaactttcaatcactcatttaaagcatttcaaaattggtttaatgaagatatagactttaatacatttgaaatttcaacacctttaacatcatccaaccatacaaatgtttttgtgcccaatgatgttgaaacgtacaattataaaaatttagacgattatgtagcttcaattgtagactatattgttgaatacatcacagtgacacagtcgaaatgtcttgtcttatttacaagctataaaatgatgcatatggttcaagatttgttaaatgaattacctgagttagaagattatgtcattttaacccaacaacaaaaccaaaattataaaattgttcaacaatttaataactttgataaatctatacttcttggaacatcaacattttttgaaggttttgattttcaagccaatggccttaaatgtgtaatgatagctaaattaccatttatgaataaacataatattaaatactggcttatggattctgaattcacatcaacttttaaagattatgtattacctgatgctgtaacaaggtttagacaaggtcttggacgtcttattcgacacgaagacgacaaaggacttattgtgtcatttgatgatcgactagtaaatagcacatataaaagcttttttgctcaatcactagaacattttaaacaacgaaaaggtaatattaaacagtttaataaattactgaatcaaatacagaggtctatcgataatgagagtaaaagctaa

SEQ ID NO: 382 - DNA, 1074 bp, Staphylococcus epidermidis
ggtgaaagcatggaacttaaaacatcatatgcaagtgataattatcccatcatcgttaaacatcacgcaattaactctttagaaagatacattaaaaatgaagaacaacgatttttcattatagataagcaagtctataatttatttgtagataaacttgaagctttggctcaaaaatttgatgctaaatgtatcgtaatcccttctggggaaacgtcaaaatcattcgaacattatcatcgtactattgaatatttactaagccatcaattaacacgtcaaacatgtattgttgccattggtggtggtgcaacaggagatttcgcagggtttattgctgcaactttacttagaggagtatcatttgttcaagtaccgacaactattttagcccacgattcaagtgtaggtggtaaagttggaattaattctgagcatggtaaaaatttaattggtgctttttatcgacccaaagctgtcatttatgatttagattttttagaaactctaccatattctgaaatactaagtggctatgctgaggtctataaacacgctttattaaacggtgagaaatcaacaaaaaatatcgaatctaattttacctcaaataaagttttacaagcgttaaaaaatctagattattatttatttgagggtataaaaacaaaactaaatattgttgttgaagatgaaaaagaaaaaggtaaaagaaagtttcttaatcttggtcatacattcggtcatgcaattgaatatgagcataaaatacctcatggtcatgcagttatgattggtattctttatcaatttattgttgcgaaccatttgttcgagacaaattataacattcaacactatattaattatatgaaaaaacttaaatatccattatctatcatcaaacaacttcattttgaagatacttaccattttatgcttctagataaaaaaaatgattacaatggtattcaaatggtcttacttaaaaatttagggaaaccagttgtcactcatgttgataaggatacacttttatcagctttcgaggaattacaatcttattttaagtag

SEQ ID NO: 383 - DNA, 906 bp, Staphylococcus epidermidis
ttgaatttaattggagtgaaagttttggacgttatcaagcaaatacaacaggcaattgtatatattgaggatcgtttgttagagccttttaatttgcaagaattaagtgattacgttggtctttctccgtatcatttggatcaatcttttaagatgatagttggtcagtccccagaggaatatgcgcgtgcacgtaaaatgacaatagcagcaaacgatgtagttaatggagctagtcgattaatggatgttgctaagaaatatcgttatgcgaattctaatgatttcgcaaatgattttagcgattttcatggtatctcacctattcaagctacaacaaaaaaagatgaactaaaaatacagcaacgactgtatataaaattatcaacgactgaaaatgcaccctatacatacagacttcaagagactgatgatatttctttagttggctattcaagatttattcctactgagcaattatcaaatccatttaatattccagactttttagaggatctattagtagatggttatattaaagaacttaaacgttataatgatacgagtccgtatgaattatttgtagtcagctgtcctctggaacaaggtttagaaatatttgttggtgttccgagtgaacgttacccttcacatcttgaaagcagatttttacctggtcgccattatgcattgtttaatttacaaggtgaaattgattatgctacaaacgaggcttggtattatattgagtctagcttgcaacttactttaccttatgagcgaaatagtttatatgttgagatttatccacttgatatttcatttaatgacccattcactaagattcaattatggttgcctattaaacaagaaatctatgatttagatgaaggttatcaaaattaa

SEQ ID NO: 384 - DNA, 1236 bp, Staphylococcus epidermidis
ggtgaaataatgaaaaagattttaatcgctaatcgtggtgaaatcgcagtaagaataataagagcggcacacgatttaggtattcaaacagtagctatatactcagaaggtgacaaagatgcattacatactcaaattgctgatgaagcatactgcgtcggtcctactttatcaaaagattcttatttaaatataccaaatattttatctatcgctacttctacaggatgtgatggtgttcatcctggatacggctttttggctgaaaatggtgattttgctgaattgtgtgaagcatgccaattaaaatttattgggccaagctatcaatcaattcagaaaatgggaataaaagatattgctaaagctgaaatgattaaagccaatgtacctgtagtaccaggaagtgaaggacttattcaaagtatagatgacgctaaaaaaatagctaaaaaaatcggctatccagttatcatcaaagccacagcaggtggtggtggaaaaggtattcgggttgctcgtgatgagaaagaacttgaaactggttaccgtatgacacaacaagaagctgaaaccgcgttcggaaatggtggtttatacttagaaaaatttatagaaaactttagacatatagagattcaaattattggcgatacttatggaaacgttatacatttaggtgaacgtgattgtacaattcaaagaagaatgcaaaagctcgttgaagaagcaccctcaccagtattaagtgaagataaacgccaagaaatgggtaatgctgcaattagagctgcaaaagctgtaaattatgaaaacgcaggtacaattgaatttatatatgatttagatgataaccaattttatttcatggaaatgaatacacgtattcaagttgaacacccagtaactgaaatggtaacaggagtagatttagtaaaattacaactcaaagttgctatgggtgaggcgttaccttttaaacaagaagatatttccattaacggtcacgctattgaatttcgaatcaatgctgaaaatccttacaaaaactttatgccatcaccaggcaagattacccaatatcttgctccaggcggttttggagtgagaattgaatcagcatgttatactaattatacgataccaccttactatgactccatggtggcaaaacttatagttcacgaacctacacgtgaagaatcaattatgacaggcattgcgtgctttaagtga

SEQ ID NO: 385 - DNA, 333 bp, Staphylococcus epidermidis
atgtatcaaatcattaaacaattgttagaggatattgatgaaatgaattataggtatcaacatgtaaaaattaatggcggttcattcgatttttataaagatgttgaaccctatgtcaaaaatattgataatcatttagaggcactcaactgttactcaaaaagcattacagaaacacaatatatgagccaacaaaagttagatatattgatattaaatatacaaaagctttctgtagattgtcattttcctagaacgagccgtaaattatttgtcgaaaaacttaaaagtgcccagtacgatttaaaaaatattttatcgaattatgtttag

SEQ ID NO: 386 - DNA, 1311 bp, Staphylococcus epidermidis
gtgaatcaaatgaataacagtgaaataattaatattaatggaccattcaaaggtgaaatagaagtacccggtgataaatcgatgacacaccgcgctattatgttagcttcattagctaaaggcatatcaaccatttatgaacccttaatgggcgaagattgtcgacgtactatggatatctttaaactattaggtgtaacaattgaagagcaggacaattctatcataatcaattcaccaggatatcaaaatttcataacgccacaccaagtgctctatactggtaattctggtactactacacggttacttgcaggtcttttaagcggattaggcattgaaagtgtgttatctggtgatgtatctataggcaaaagacccatggatagagtgatgaaacctctgttaaaaatgaatgctaatatatctggaattgataataattacacaccacttataattaagccttcaactattaaaggtataaattatcaaatggaagttgcaagtgcacaagttaaaagtgctattttacttgctagcctattttcaaaagaagccacgacacttacagaatttgatgtaagtagaaatcatacagaaacattgtttgcacactttaacattcctatatcaattcaaggtaaaacaatccaaaccataccttatgcaattgaacatatacagcctagagattttcatgttccaggagatatctcatctgctgcatttttcatagtcgcagccctaattacgcccggtagtgacattacaattcataatgttggcattaatcccactcgttcaggtatcatagatatcgttaaacaaatgggaggaaacattgaattaagtaatgtaagcaagggtgcagaaccaactgcatcaatacatgtaaaatatacaccgaacttgaatgctgttacaattaaaggcgacttagttccaagggctatcgatgaattaccagttattgcactactttgcacacaagcttcaaattcttgtattatcaaaaacgcggaagaattaaaagtgaaggaaacaaatcgtatagatactactgcagacatgctaaatttacttggttttaatttacaacccacacatgatggacttattatacatccatcagagtttagatcaaatgcaactgtagatagtcaaacagatcatcgtataggaatgatgttagctgtagcttcactacttagttcagaaccactcaaaatagagcaatttgacgctgttaatgtttccttcccaggttttttacctaaactaaagcttttagaaaatgagggaaaataa

SEQ ID NO: 387 - DNA, 804 bp, Staphylococcus epidermidis
aggatggaaattatggtacaaacagtttacaaaaattcagatcaaacagtttttgaagatgctaaagctttatttcaattaaataagaatatactactaaaagggccaacaggctcaggaaaaaccaagcttgccgaaacgttaagtcatgttatgaaattgcctatgcaccaagttaattgttcagtagatctagatactgaaagcttattaggttttaaaacaattcaaactaatgaagaaggtcaccaagaaattgtcttcatagacggtcctgtaataaaagcaatgaaagaaggtcacattttatatatagatgaaattaatatggcaaaaccggaaacattacctatacttaacggtgtattagattatcgacgtcaattgacaaatccttatactggtgaagtgattaaagcagcacctggatttaatgtaattgctgctataaacgaaggttatgtaggaacattaccaatgaacgaggctttaaaaaatagatttatcgtcatagaaatagattatatcgatggtgacattcttaaaacagtcattaaagagcaaagtaaattacaagatgaacaattgattcaagatattgttaaatttaatgaagatttacgtactatgaccaaacaaggtcaaatttctgaagaggctgcaagtattcgagctttaatcgaccttagtgatttagcaactgtcatgcctattgaacgtgctgtacaacgtacaattattgataaattagaggatgagcgagaacaacaagcgatacttaacgctatcgagctcaatttttaa

SEQ ID NO: 388 - DNA, 675 bp, Staphylococcus epidermidis
atggagagaatcctaatgataagtaagaaaaaagcattacaaatgattgacgttatagcagatatgtttcctaatgcagaatgcgaattaaaccatagaaatgcattcgatcttacaatagctgtattattatcagcacagtgtactgataatctagtcaatcgtgtcactcaatcattatttagaaaatatcgaacacctgaagattatttaaatgtgagtgatgaagaattacaaaatgatatacgctctattggattatatcgcaataaagccaaaaatataaaaaaattatgccactctttaattgaacaatttaatggtcaaatcccacaaacacataaagaattagagagtctagctggagtggggcgtaaaacagcaaatgttgtaatgagtgtcgcatttggagaaccttctttagctgtcgatactcatgttgagagagtttctaaacgtttgggaattaatcgttggaaagatagtgtaagacaagtagaagatcgattatgtgatattatcccaagagatagatggaataaaagccatcatcaattaatattttttgggagatatcattgttttgctagaaaacctaaatgtgagatatgtccgctgttaaatgattgtagagaaggacaaaaacgacataaagcaaagataaaggaggcgtga

SEQ ID NO: 389 - DNA, 240 bp, Staphylococcus epidermidis
ggtgtaatgatgagtaaagaaaagcaaagtttcgaagaaatgatgaaagaacttgaaaatatcgttcaaaaattggataatgaagcagtttctttagaagaatccctcgatttataccaacgtggtatgaaactatctgctaattgtgattcaactttaaaagaagcagagaaaaaagtgaatgaattaatgcaagaagaagttggtgataaaggaaatgaagaaactacagatgaataa

SEQ ID NO: 390 - DNA, 1332 bp, Staphylococcus epidermidis
aatttgatgatcgtttctaaaagaacgtttcggtcattatacattcctattttgatagaacaacttttcatactcatcatgggtcaagctgatacattgatgttaaacagctatagcactgatgccgttgctgcttcgggaatgataagccaaatactcatgctcatcacgtttctgattacaatcattcatgtgggtacaaatatacgtattgttcatttgaaggaacatcaaccttcaagtatttcacaagagatttatcataatttgttattcaatagcatagtatctatcgtatttacgattgtgattgggatcgcattcgaacttatcttacgactttttcaggtacctcaagatatattcaaactgacctatcaatttggaatgattatattgagtgtactcactttaacgacctgtcacatgtatattggtactgtattacgtgtcatgaatcatgcatcatcagctacacgcattactatcattagtaatgtgactaatatcattttgaacggtatcgtactctttattattccagaatatgtaggtaaccctgtattaggtgtcgcggtggtaacagcgttcagtcgtttattgggatgtactttagctttaattgcgctgatacaaattttccgtccattcaagcattacttcaagctgagctggaagaaaatatatcaggtttcgacattaggtatcccaacagcaggtgaacaaatttcttataattttgcacagacatttacaactgcatttattgcgatgttaggcactcaagtcatcgctgcgaaatctgtttctactgttttaagcggcctgtcttttagttgtgctatggcatttagtgctgctagccaaatttatttaggaaaatttatatcccgtcgacgttaccgtactttaaagaaagttgttataaaaagtatttggtttaatatcacacaatctttcatgattatgacgtgtgtatttataggatttatagtgtgtggacgttggataacacacgacatacaaacctatcatttaatcatttactatcttgttatactttttggattagaaccgatacgtgcaattaataatctaattgtagatttattaaacgtgacaggggatgtacgttatccagtcaccgtgagtgttgtgaccacatggttgttattattacctggaagttatctattagggattcattggagattaggttatacaggaattattttagtgagtattgctgatgaagcgctgagatttatcattatgtatcttagatggcgaaatgatcgttggcaagcacgaatgaagcagattggagtatag

SEQ ID NO: 391 - DNA, 1776 bp, Staphylococcus epidermidis
aacctagtgatgaaccgactaaatagtgttgttataaaactgtggttaactattattttaatagtagcgacagttttaattttattaagtgtttcattaatcacttttatacaatattactttacgcaagaaacagaaaatgcaattaaagaagatgccaaaagaattagttcacttgttgagaagtctcataacaaaacattagctatccaaaatagccaaacactcattgatggtgatggaccgggtggcctcattattatgaaagacatgagcgagaaaccagactcatcgtataaagacactaaaaaacaaatgtttaatgaaataaaaaagagtactaaatttaaaaaagtgtttaaagaaggtgagtatgaaactcaaaatattacaataaaaaataaaggtaattctcaatcttatcttttgctaggatacccaatgaaagctcaaaaaggtgctcaaagtcattatagtggtgtttttatatataaagatttgaaatctatcgaagatacaaataatgctattacaattattatattaataactgctattatatttactatagcaagcacaatatttgcattctttttatctaatagaataacgaaacccttacgtcaattaaaaacacaagcacaaaaagtttctgaaggggattatagtcaaatttcaactgtcgctactaaagatgaaataggtgatttatcacgtgcatttaacaacatgaacgtagaaattcaagaacatatcaaagcaatttcttcatctaagaatataagagatacattattaaactctatggtagaaggcgttctaggcattaataatcaacgtgaaatcatattgtcgaacaagatggctgatgatattatgcgtcacattgatgatttttcaaaagaatctattgaacagcaaattgaagcaacatttgaatcacaacagaatgagtatttagaattagaaattaatacaaggtactatgtatttatctccagttatatagatagaattcaaacaaatggtagaagtggtattgtcatggtcatccgtgatatgacaaatgaacataatcttgatcaaatgaaaaaagattttatagcaaatgtatcacatgaattacgtacgccaatctctttattacagggttacactgagtccatagtagacggtatagttaccgaaccagatgaaatacgtgactcattagcaatcgttttagatgaatctaagcgacttaatcgtttagtcaatgaattactaaatgtagctcgtatggatgctgaaggattatcagttgagaaggaattacaacctattcaacaccttcttgataaaatggagtctaaatatcgcatgcaaagtgaagaattaggtttaacaatgacgtttgattctaataatgacgaacaattatggaactatgatatggatagaatggaccaagtgttaactaatttaattgataacgcaacaagatatacacaagctggtgattctataaagatttctattgatgaagattcagatttcaatattttaacaataactgatacaggcactggtatagcgccggaacatctgaaacaagtatttgaccgtttttataaagtggacgctgctcgaaaaagaggtaagcaaggcaccggattaggacttttcatttgtaaaatgattattgaagaacatgggggacgtattgatgttgagagcgaattaggcaaaggtacttcatttattattagactacctaaatcaaaacaaattagttag

SEQ ID NO: 392 - DNA, 987 bp, Staphylococcus epidermidis
aatgggtggatgcacatgtcaaaatatagtcaagacgtcattagaatgttgtatgaacatcaatcaaattacatatcagggcaatatattgccgatcaactcaatatttctagagcaggtgtcaaaaaagttattgacctattaaaagaagatggttgtgatatcaagtcaataaaccacaaaggccatcaactgaattcattacctgatcagtggtatagcggtattgtaaaacctattctcgatgaacttggcctttttaatcatctagaagtttatcacactgtagattcaacacaattaaaagcaaagagagcactcgttggaaataaagatacttttttaattttgagcgatgaacaaaccgaaggtagaggtagattcaatcgtaattgggaatcatctaaaggaaaaggcttatggatgtcactagtgctaagacctgacgtacctttttctatgatacctaaatttaatttatttattgctttaggtattagagatgctattcaacaattttcgaacgaacgtgtaacaattaaatggccaaatgatatatatattggtaataaaaaaatttgcggatttttaactgaaatggttgcaaattatgatgaaatagaagcaataatttgtggtataggtataaatatgaatcatgttgaaagtgattttgacgaggatattaaagataaagcaacaagtatacgcatgcattccgatagtataattaatagatatacttttttaactgcattattaactcaaattatacatcgctttgatcaatttttacatcaaacttttgagtcaattcgagaagaatatattcacgctacaaatatatggcatcgtcaacttaaattcactgaaaataatcatcaatttttgggggaagccatagatattgattcagatggattccttattgttaaagatgaaaaaggtcaattacatcgacttatgagtgcagatatagatttataa

SEQ ID NO: 393 - DNA, 186 bp, Staphylococcus epidermidis
tgtaaagggattcaaactgtacactttttaattataacttctgctagatgcacacaaaataattacgctgttttctcaatgaaacattcgtttaatatattaattttttgcatgtactactcaagcctcatgcgattttcacttacatacatcataattaaaaatattcgaatacatacagaatga

SEQ ID NO: 394 - DNA, 393 bp, Staphylococcus epidermidis
acattgcacttgaaatgcaagtcactttattttgtaatatactatataagaatagcgataaaggagtacttctatatgaaatctatggagcaaatgcaacaagaagttgatgactatatcagtcagtttaaagctggttatttttctccacttgctaatctagcaagaatgacagaagaagttggagaattagcacgcgaaattaaccatcgttttggagagaaaaaaaagaaagatacagaagaagataatacaattaaagctgaattgggagacaatttatttgttttactgtgtattgcaaactctctaaacatagatatgacagaaagctttaatgacacgatgaataagtttaatacaagagataaaaatcgctttgaaagaaaataa

SEQ ID NO: 395 - DNA, 471 bp, Staphylococcus epidermidis
gaaatgaactttaaagaaataaaagaattaatcgaaattcttgatcaatctagtttaactgaaataaatattgaagataataaaggtagcgtagttaatttaaaaaaagaaaaagagactgaaatagttacaccgcaagttactcaacaaccaactcaaccgataaatcatacgcataatgaaacacaacaaaagccatcacatagctctaaagatgaacaaagtagtgataatgaatacaataccattaatgcaccaatggttggtacattttataaatcaccttcaccagatgaaaaagcatacgttcaagttggagataaagttacgaatgaaagtactgtttgtatattagaagctatgaaattatttaatgagattcaagccgaaacaacaggtgaaatcatagaaattttagtagaagacggacaaatggtagagtatggccagccgttatttaaggtgaaataa

SEQ ID NO: 396 - DNA, 186 bp, Staphylococcus epidermidis
ataaatattgtttgtaagctcaatgttaataatatttatcttatattaatttctttgttttcatttttgttaataaaagacttaaaatgttgtcttataaatgttttaagtcttttgttttttgaaaaattacaaacaaaaaattttgatttacgaaaacttaaatttgaaaaaagtttactttaa

SEQ ID NO: 397 - DNA, 981 bp, Staphylococcus epidermidis
gaggaatacgtaatgaaacgtctacttatcatacatactggtggcacaataagtatgtcacaagatcaaactaataaagtgataacgaatgaagaaaatccaatatcacaacatcaaaatatcattagtcaatatgcagaggttgacgaaatcaatcttttaaatataccctcgccgcatatgacaatttcgaatgttgtgcgattaagagacgaaatcattacatattctaaagaaaatatatatgatggatttgtcattactcatggaacagatacacttgaggaaacagcttttttaatagatttattaattgatattcaagagcctatagtaattactggagcaatgagatcatccaatgaaattggttccgatggtctctataattttatttctgctataagggttgcttcttcatctgaggctaatcataaaggtgttatggtcgtatttaatgatgagattcacactgctcgtaatgtgacaaagacacatacttcgaatattaatacatttcaaagtcctaatcaggggcctctaggtgtacttaccaagaatcgagtacaattttatcatcatccttacagacaaactacctaccaatatatcgatgtaaatttacgtgttccacttgtaaaagcatacatgggtatggaagatgatgtactatcattttattcacaacaacacgttgatggtatagtcatcgaagcactaggacaaggtaaccttccaaaaagttgtcttaatggactacagcaatgtctaaagaaaaacattcctctagttctcgtatctagatcattcaatggtattgttagtcctgtatatgcttatgaaggtggtggcgcagatttgaaaaataatggtgttattttttcgaacggtttaaatggaccaaaggcaaggctaaaattactagttggtttgagtcaagacatgactcaaaatcaattagagcgatatttcgaagagtaa

SEQ ID NO: 398 - DNA, 1404 bp, Staphylococcus epidermidis
agttataacgtgattgaattaattaaaatggaagggatgatagttgtgtctaataataattttaaagatgatttcgaaaagaatcgtcaatctattaatccagacgaacatcaaacagaattaaaagaagatgataaaacaaatgaaaataaaaaagaagctgactctcaaaacagtttatctaataactcaaatcaacaatttcctccgagaaatgcccaacgacgaaaaagacgcagagagacagcaactaatcaaagcaaacaacaagacgacaaacatcaaaaaaatagtgacgctaaaactacagaaggttcattagatgaccgttatgacgaagcacagttacagcaacaacatgataaatcgcaacaacaaaataaaactgaaaaacaatcacaagataatagaatgaaagatggaaaagatgcagctattgtaaatggaacatctgagtcaccagaacataaatcaaaatcaacacaaaatagacccggccctaaagctcaacaacaaaagcgtaaatcagaaagtacgcaatcaaaaccgtcaacaaacaaagataaaaaagcagctacaggtgctggaatagctggtgcagctggtgttgctggtgcagcagaaacatccaaacatcatcataataaaaaagataaacaagattctaaacactcaaaccatgagaatgacgaaaaatctgttaaaaatgatgaccaaaagcaatctaaaaaaggcaaaaaagcagcagtcggtgctggcgcagctgcaggagttggtgcggctggtgttgcgcatcataataatcaaaataaacatcataatgaggaaaaaaattctaatcaaaacaatcagtacaatgaccaatcagaaggtaagaaaaaaggtggtttcatgaaaatcttgttaccacttatagcagccattcttattctaggtgcaatagcaatattcggtggtatggctctaaataatcacaacgatagtaaaagtgatgaccaaaaaatagcgaatcaaagtaagaaagactcagataaaaaagatggtgcgcaatccgaagataacaaagacaaaaaatctgattctgataagaacgcagatgatgactctgataatagttcctcaaatcctaacgctacttcaactaataataacgataatgtagccaataataactcaaattatacaaaccaaaatcaacaagataatgcaaaccaaaatagcaataatcaacaggcaactcaaggtcaacaatcacatacagtatacggtcaagaaaacttatatcgtatcgccatacaatattatggagaaggaactcaagctaacgtagataaaattaaacgtgcgaatggattaagcagtaataatattcataatggtcaaacattagttattcctcaataa

SEQ ID NO: 399 - DNA, 624 bp, Staphylococcus epidermidis
aagtgcccagtacgatttaaaaaatattttatcgaattatgtttagtgaggaaaaaaatggttaaaactgtttatattactggttataaatcttttgaactgaatatctataaagacgatgcgccagaagtatattatttaaagcaatttatagctcataaattaaaacatcttttagatgaaggtttagagtgggtattgatacaaggacaaatgggtatagaattatggtctgctgaagtagtgattgaactaaaaaaagacttcccagatattaaactaggtataattacgccatttataggtcatacacaacgatggaatgataagaatcaagctaagtatacaaatattatacaacaagccgattttactgaaagcattcatcacactgagtatatgggtgcctatcaatttaaacaagcagatcaattcatgcttgatcataccgattacactattttaatttatgatgatgaacaagaggcaagccctaaatactttaaggctatgttagttgaatttatggaaaaaacaaactatacttgtgatattgtgacgtttgatgaactcactgacttcatcaacgacttgcagtggtctcaagatcaaagtttcgaatga

SEQ ID NO: 400 - DNA, 789 bp, Staphylococcus epidermidis
gaaggacaagtaaacacatctaacgatagttctaacgaatcttcacaaaaagatgaagctaaagagaaagaaacgccaaaacaatctactccgaattctagtgaaagtgaaaatacacaagataatagccagcaacgtatcaatgcaacaccatctgcacgtcgacatgcgcgtaaaaatggcgttgatttaagcgaagtatccggaaaaggcaatgatgttctaagaaaagatgatgttgaaaatagtcaaaaatcttcaagtcaaacagctaaaagtgaaagcaaatcacaaaacagtggttctaaacaatctaataacaatccatcaaaacctgttattcgtgaaaaaatgtctcgacgcaaaaaaactgctgcaaaaaaattattagaagtatcaaatcaaacagctatgcttactacatttaatgaagttgatatgacaaacgttatggatttacgtaaacgtaaaaaagaacaatttatcaaagatcatgatggtactaaattaggatttatgtccttctttactaaagctgccgttgcagctctcaaaaaatatcctgaagtaaatgctgagatagatggcgatgatatgattactaaacaattttacgatattggcattgcagtatccactgacgatggattactcgtaccatttgttagagattgtgataagaaaaattttgcagaaattgaacaagaaatcgctaatttagccgtaaaagctcgtgataaaaaattaggccttgatgacatggttaacgtttcgtttaccatcaattaa

SEQ ID NO: 401 - DNA, 924 bp, Staphylococcus epidermidis
agcatggaagttacatttttcggtacaagtgctgggttaccgacgaaagagagaaacacacaatccattgctttaaatctagaaccatattcaaattcgatatggttatttgatgtgggcgagggaacacaacatcaaattttaagacactctattaagttagggaagatagatcatatttttataacacacatgcatggtgatcatatttttggtctccctggacttttaacaagtcgttcgtttcaaggtggagaaaataaaccccttactattatagggcctaaaggtattcaaaattacatagaaacatctttacaactttctgaatcgcatttgaattatccgattacctatatcgaaatcaatcaacaattagcgtatcaccacaatggttttactgtacaagctgaaatgcttaaccatggcataccttcattcggatatcgtattgaagccccaatcacgcctggtacaatcaatgtagaggccttgagaggtattggactagagcctggtccaaaatatcaggaagtcaaattacaagaaacgttcgaatataaaggattaatttacaattcggatgattttaaaggtaaagctaaacctggtccaattatcagtatatttggtgatacaaaaccgtgtgaaaatgaatatgaattagcaaagaactcagatttaatgattcatgaagcaacttacattgaaggagataagaaacttgctaataattaccatcatagtcatatagacgatgtatttaatctaattaagcaagctaatgtaaataaaagtcttatcactcatatcagtaacagatataacattgatgaagttacatcaatatacaatgagttatcccttgatcaaacttctccacatttttatttcgttaaagattttgatactttcaaaatataa

SEQ ID NO: 402 - DNA, 204 bp, Staphylococcus epidermidis
ctaagggaagtgaaagctatactcactaatacagaacaacaagcaattcaacacatcgaccaattgatgaatatttattgtcaccaatgtccattaaaaaagcacaatagaaaaactcacggtaaaacacaagcacatcatttttgtataaatgaatgtacggtcggtaaacaaattaaacaaattggtaatgagttacaatag

SEQ ID NO: 403 - DNA, 195 bp, Staphylococcus epidermidis
ataaaaaaggttttaaatgttttttatttgatgatatgtcttaatcttctaaataacagcacaaatataatggaaatgattatgcctttaattaaattaaaaggtatgactccagacacaataacaatttttacgttattaagcacatcacctaaattaaatatcattccatataatggaagtaacacaaaataa

SEQ ID NO: 404 - DNA, 1425 bp, Staphylococcus epidermidis
acaagagaggtaagtaatatgacacaacaaattggagtagtgggtttagcagtaatggggaaaaacctagcttggaatattgaatcacgtggttatagtgtttctgtttataaccgatcaagacaaaaaactgatgaaatggttaaagaatcgcctggaagagaaatttacccaacatactcattagaagaatttgtagaatctttagagaaacctcgtaagattttattaatggtaaaagctggacctgcaacagatgccactatagatggtttattacctttattagacgatgatgatattttaattgatggtggtaatactaattaccaagatacgattcgtcgaaataaagctttagctgaaagtagtattaactttattggtatgggagtttctggtggagaaatcggcgcactcacgggcccttctttaatgccaggtggtcaaaaagatgcttataacaaagtcagcgatatcttggacgcaattgctgctaaggcacaagatggtgcttcatgtgtaacttacattggccctaatggtgcaggacattatgttaagatggtacacaatggtatcgaatatgcagatatgcaattaattgctgaaagttatgcaatgatgaaagatttattaggcatgtcacataaagaaatttctcaaacttttaaagaatggaatgctggagaacttgaaagttatttaatagaaattacaggtgatattttcaataaattagatgatgacaatgaagcacttgtagaaaaaatattagatactgcaggtcaaaaaggcacaggtaaatggacttcaattaacgcactagaattaggtgttcctttaacaatcattacagaatctgtatttgcgagattcatctcatcaattaaagaagaacgtgttactgcttctaaatctttaaaaggacctaaagcacattttgaaggcgataaaaaaacattcttagaaaaaatacgtaaggcactttatatgagtaaaatatgctcatatgcacaaggtttcgctcaaatgagaaaagccagtgaagataatgagtggaatttgaaattaggcgaattagcaatgatttggcgtgaaggttgtattattcgtgcacaattcctacaaaaaattaaagatgcctacgataataatgaaaacttacaaaacttattattagacccttacttcaaaaacattgttatggaatatcaagatgcactacgtgaagtagtagctactagcgtgtacaatggcgtgccaacacctggtttttcagcaagtataaattattatgatagttatcgctcagaggatttacctgcaaacttaattcaagcacaacgtgattactttggcgcacatacttatgaacgtaaagaccgtgaaggtattttccatacacaatgggtagaagaataa

SEQ ID NO: 405 - DNA, 3456 bp, Staphylococcus epidermidis
actaaaggggtaatacttatggcaataaatgaacaattagatactttatataaattaaaaaaagaattggaaaaatctaataacagacctttaattaataccattaatcaagtaataaaaaaagtttatttaaatcaatacaccgcaacatttgtaggacatttctcagctggaaaatcaacgttaattaatttgttattagaacaagatatactaccaagttctccagtaccaacaacgagcaatacagctatcgtttcagtagccaaggaagacgaaatcattgccaatcttacgcaacaacaatatacaaaattaaaaacgtacaacgatgttaaacaaatgaatcgacaaaatgtcgatgtagaatcgatagaaattaattttccatcaaacaaatttaatctagggtttacatttcaagatacaccgggtgttgactctaacgttgcaacgcatcagtcgagtacagagcaatttatgtatacaagtaacttgttgttttatacagtagactataatcatgtccaatcagcgttgaactttaaatttatgaaacgtattaatgaagttggtataccaattatttttgtgattaatcagattgataaacataatgaagaagaaattacatttgaaacttttaaatcaagagtcgaaaaatcaatcaaagactgggatatcaaacttcaagatacttattacgtttcaaagtttgatcatccacagaatgaaattgacaaactttcaaattttctagtatttatggatcaacatcgtgaatcaacagaagactatgttaatagaacaattcaattcattaccgacgcacaatacatatacattcaaaatgaaatgcaatctattcttgacacccttcaaattaatgaagaacaattcgaggaagcatatattcaatttcaacaaaatcaagaagtcagcgcagaagcacaattgctcaatgactctaatcaattatttaattatttaaaacagaagcgtaaagatatattagataatgcttatatcatgacgtacgatatgcgtgaatctttacggaattatttagaaagcatggcaactgattttaaagtgaatggattttttaataaaaggaagaaaaaagaagaagaacaaatcaaacgacttaatgaggcgaccactcaattgcaagagaaagttaatcaacaagtacgacaaccacttcgtgaagatatgtcatttttaactagattcataaataaacatgctgtgaatgaaaaaatactaaatcaagaatatgacgtcgttccgtcacttatatcagagctatatcaaactcaaacgagcattagcaacacatacgttttaacattttcagatgaagttataaaagctttgaataaaaaaatagaaaatgagtcaacaccactatttgaagaagctgtcaatcatgtacaagttaatgaattatcgagtgatgaaaatgaagataggtatgaatatgatagatacattgaacttaacacattaaaggattcgcttacatcccacaactacaaacattactatatccatttagacgattctttagataaattaattggaagaacagagactcattttgaacttaaacaagaaaattcaactgcttatcatcgtaaacatgagacacaacatcgtaacgagtttgttacatctaatcaagatattaagcgtgcattagatatcgttaaagatgtaccattatttgatcgcactaaacaagatatcaccgataccattctgagactcgataatcaaataacaaaagtaggtgtttttggtacatttagcgcaggtaaaagcagcttaatcaacgctctactaggtgataactatttagttagttctcctaatccaacaacagcggcaacgacggaattatcatatggtaaagagagtcaaatcacattaaaatctaaagagcaattactagaggaagttaatcatgtactagaattttatgaaatatcgtttaacaccttagacaactttattaagagcgatttagagaagttaaaatcgaaactagaaaagaaccaacttgcatttattagtgcaattgagaaacattatgaaatgtacacgtcaatgctagaacattcacttatacacacagtatcgcttgaagaaattaaaaagtggagtgccgaggatgagtatgccactttcgtgaaaactgtacaccttaagctacctttagattggcttaagggtaaaatcattattgattcactgggtttacattccaataatcaaagacacacgaatgaaactgaacaaattctcacttcttctgaccttattttgtatgtaacttacttcaatcattcatttacagataacgacaaagcctttatcgaacatatgaaagatatgaatcaattaaatgaaaatcaagcttttaaaatgataattaatgcggttgacctagctgaagataaacaggatatacaagccgttgaggattatgttgcagatgcactggggcaagttaacttacactctgatatatatagtgtttcaagtcgtcaaagtttaaatgggaataacattggcataaatgaattaagagaaagtatacaatactttgcaaaggttgaatctagaacaattttagagcagcagatgacttatcaattgcaacaaatgaataactcctttaaaaaaatgattaaagattttcacgatgacaacgcaaaattatcagctagacaacataaattaaatcactataaaaaccaaaccctattaaatcaagagttgattgatacaactgcacaacgtactttcaatgaagtagaagaacaagtatatcatctaaatgaacggttaaaactacaacttttagatgaggttaaatctgtgtttaatagtcagatgacacaaaataacgactttaatgaggaaaagaaaatttcaactaaaatatatttagatcaaattcatcaacgcttattcttagagcaatcacttatcacagaaaggattaaaaaatattttaattcacaactagaagaacaaatcctaccagtcatgaaaaagttaaatcagattcatgttattataaatgcaaaatttaatgttgagccatcactggttgatacggcgttacttcaaattgaacttaattcaatgttgcaatcactaccaaaacagttaactaaacgtaaaatagttaatccaaagtcacaaaaggatatacaagtacacatagctaatcaaactcttgaattattacaagatgatttgaactcattgcgccgacaattaaatgattatatccatgagatgactcaacttgccgaacatcaatttcaaatgttggagacatccattcaacaacaaattgatgagttactttcattcactatcgatgatacattaatacaacaactagaattgaaaacgacacaattagacaatattttatag

SEQ ID NO: 406 - DNA, 468 bp, Staphylococcus epidermidis
aaacaattattagtagaggagcattttatgatgaatggatacgaagcttatatgaaagaacttgcacaacaaatgagagctgaattaacagacaatggattcacaagtcttgaaacgagtgatgacgtcaatcagtatatgcaaaatatagataatgatgatacaacatttgttgtaatcaactcaacatgcggttgtgctgcaggattagcacgtccagcagctgttgcagttgcagagcagaatgaagtaaaaccagatcataaagtaactgtatttgctggtcaagataaagaagcaacacaaacaatgagagattacatccaacaagttccttcaagtccctcatacgcattatttaaaggtcaacatttagttcattttatacctcgcgaacatattgaagggcgcgacatcaatgatatagctatggatttaaaagatgcttttgatgataattgtcaataa

SEQ ID NO: 407 - DNA, 777 bp, Staphylococcus epidermidis
ataaatatattcaagaaattagcaaaagttataaaaaaagaggtaatgaaaatggctgaaaatcaagctaaaaaagaacaagttcatacagtattccaaaatatttctcaaaaatacgatcgactcaacaacatcataagtttcgaacagcataaagtatggagaaaacatgttatgagtactatgaatgtacaaaaaggcagtaaagctttagatgtgtgttgtggtactgcagattggactattgcattaagcgaagcagtaggctcaaaaggccaagtaactggtcttgattttagtgaaaatatgcttgaggtaggtaaacagaaaactgcttcattggaaaatatccagcttgttcatggtgatgctatgaatttaccttttgatgataactcatttgattatgttactattggttttggcttacgcaatgttccggattatttgtcagcactcaaagaaatgcatcgagttttaaaaccaggaggcatggtggtatgtcttgaaacaagccaaccgacattgccattattcaaacaaatctatagtttatactttaaatttgtgatgccaatttttggtaaaatgtttgctaagtccaaagaagaatatgaatggttgcaacaatcaacatttaattttcctgacaaacaaacattgaaaggcttattcttcgaagcaggatttaacgatatcattgtacgtagctttacaggtggcgttgctgcaatgcaccttggctataaagaaaacagttctagcaaaggtgattaa

SEQ ID NO: 408 - DNA, 186 bp, Staphylococcus epidermidis
gtccactcattaactgacactcctctatttatctttacagataacattataacgtattttgtaacacttgaatatgatgaacactcatataaagatagatatttatttgttgttgatttattatttattagaaaaataaaacatacagattggctaaatattttgtatgtattaaaatgtaattaa

SEQ ID NO: 409 - DNA, 1062 bp, Staphylococcus epidermidis
ggtgcatcattcatgtttttagcttggaatgaaataaaaagaaataaaattaaattcagtttagtcattggcatattagtacttataagttatttattattcctactgtcaggacttgcaaacggccttattaaaatgaatactgaaggtatagaaaagtggaatgcagacgctatcatattaaaaaaagaagctaatcaaaccgtagagcaatccttattcaatatatccaaagtacaaaatacttatgaaaaatcaaccacattaaaacaacaaggagttattatctcaaaccatcatcgggaagaaaacgcgttactttttggcgttacacacaaatcatttttaattccgcctataattaaaggtcatcaagttgaaagttcaaatgaaatagtcattgatcaaacattagctgataaggggttcaaaataggtgacatcttatctttatctcaatcagacgaaaagctaaaagtggtaggtattgtagaaagtgctaaatataatgcttcacccgtgctattctctaataatcaaaccattgagaaacttaatcccaaattatcaaaagataaaacaaatgctatagtaatcaaagactcaaattggaaaaatcataaacttaacaaagatttagaaagcatttcaatatcgcagtttattaaaaatcttcctggctataaagctcaaaatttaactttgaactttatgatcgttttcttatttataatttcagcaacagtaattggcgtattcttatatgttataacactccaaaaaacacacttatttggtgtacttaaagcacaaggctttaccaactgctatttagcaaaaatggtttttgctcaaactttcatattatctttaattggaacaatcataggatttctcttaacactattaacaggtacatttttaccgcctgtcgttccaattcattttaatttattaacgatgttgatatatggaattgttcttatcattatttctttattaggcagtctattttctgtgttgtctataataaaaataaatccacttaaagcaattggatag

SEQ ID NO: 410 - DNA, 552 bp, Staphylococcus epidermidis
actatagcattggataatattgcaatacttgaggcattactatatacttctggcgatgaaggattagaacaaaaacaaattattgacatattagacatcaacctcaatcaattagaagatttagttagtaaatatcattcacatggcttaacaattcaaagatacggctcaacttatgtacttacaacaaaaaaagaaacttttacatacatagaacaattagtcaaagaaaagtctaaaatgaaattatcccaagcagcaatggaaacactctctattattgcatataatcaaccgctgactcgtggagatatagaaatgattagaggaattaattcggatggagctgtaaagactttaatcgctaggggattagtagaagccaaagatgttgatcattctagaagccatcatttaataaccacagatttatttctaaatgtatttggaatcgaaaacttagatgcattacctactacagaagaagatgaagcagaaatggatgaattctttagtaatttagttaaccaaaaaggagagtcaaatgagtaa

SEQ ID NO: 411 - DNA, 1164 bp, Staphylococcus epidermidis
ttcaataaattaaaaggagactcggtcatgtttcaattattagcagtatgtccaatgggattagaagcagttgtagctaaagaaatacaagaattaggttacgatacacaagtagaaaacggtcgtatcttttttgaaggtgatgaaagtgctattgttagatgtaacttatggttacgtaccgcagaccgaataaaaattgtaatgggtcgattcaatgctactactttcgacgaattatttgagcaaacaaagtcattaccatgggagaccgtaattgacaaagaaggtaatttcccggttcaagggcggagtgtaaaatcaacattatatagtgtacctgactgccaagcaattactaaaaaggctatagtagaacgacttaagcatgctcatcaagaaaaaggatggctaagtgaaacaggcgccaaatatcctgtagaagtagcaatattaaaagataatgtattattgaccattgatactgctggttctggactcaacaagcgaggttatcgcattgctcaaggtgaagcacccattaaagaaacattggcagcaagcctcattcgtttagcaaattggaatggtaacacacctttaattgatcctttctgtggttcaggcaccattgctattgaagcatgtcttattgcacaaaatattgcacctggttttaatagggattttgtatctgaacaatggaatatgatgccacctaatatttatgacaaatttcgtgatgaagctgatcaattggctgactatgataaagacatacaagtatatgcttctgatattgatccagaaatgattgaaattgcaaaacgtaatgcagaagaagttggtctcggagatatcatacagttcaatgttaaagatgtgaatactttgtctattgataccgacaagcctgtagcacttgttggcaatccaccgtatggtgaaagaattggagatcgtgaagaagttgaagaaatgtatcgttatataggtacacttttgaaacaacatcctcatttatcggcctacatattaacaagtaacaaagaatttgaatacttagttaatcgaaaagcgactaaaagacgtaagttgttcaacgggtatattgaatgtacgtactatcagtattggggtaaaaagcaaagtaataaaaattaa

SEQ ID NO: 412 - DNA, 648 bp, Staphylococcus epidermidis
tatggtctttcagaagtaatgaatattagtcatcgcaatagatttattgctaaccctggttgttatgcaactgcaactgaattagcgctatatcccttaatcagcaatcatttaatccgtgttgattctataattgttgatgctaaaagtggtcttactggagctggtaaaaaattaaatcagtcatcgcattacgtaaatgtaaacaataattatgtgacgtataaacttaataaacatcaacatattcctgaaattgtacaaacgttgcagttttttaacaaaagtttacagaatattcagttttcgacatcgcttattccggttaatagaggtattgttgcaactatatacacacggcttgaaaacggagttaaaataaatcaaatagaatctacctacaaggatgtatataaaaataagcctttcataagaattaaagatggattaccacagttaaatgaagtaataggaacaaattacactgatattggttttgtttataacgaaaccacgggtgttttaacaatttcatcagttattgataatttaattaaaggtgccgctggacaagcaattcaaaacatgaatctgatgtttaatttcgacgaaactgatggtttaattttggcgcctttatatatctaa

SEQ ID NO: 413 - DNA, 1074 bp, Staphylococcus epidermidis
aaggcttattcttcgaagcaggatttaacgatatcattgtacgtagctttacaggtggcgttgctgcaatgcaccttggctataaagaaaacagttctagcaaaggtgattaacgtggcaaagttaaacattaacaacgaaataaagaaagtagaaaagcgacttgaagaagcaattataagttctgatcaaacattacaagaagcctcattccatttactatcttcagggggaaaaagagttagacccgcttttgttattttaagtggtcaatttggctctaacaacaaaccttcagaagacacgtatcgtgtagcagtagctttagaactaattcacatggctaccttagtccacgatgatgtgatagataaaagtgataaacgtagaggccgactcactatttcaaaaaaatgggaccaaagtacagctattttaacaggaaatttcttacttgctatggggctcaagcatttatctgaaatcagtgatactcgtgtccattcgaccatttctaaatcaattgttgatgtgtgtagaggagaactattccaatttcaagatcaatttaatagcaatcaaacaattactaattacttacgtcgtatcaaccgtaaaacagcacttcttattcaactgtctacacaagttggtgcgattacttccaatgcgtcaaatgacgttattcgtaaattaaaaatgatcggacattatataggtatgagtttccaaataatagatgatgtgctagattttactagttctgaaaagaaacttggtaagccggttggtagtgaccttatgaatggtcatattacattacctgtactattagaaatgcgaaaaaataagacttttaaagataaaatttcacaacttaatcctgacagtcctcaacatgcctttgaaacttgtataacaataattagacagtccgaaagcatagaacaatcaaaacaaataagtgaaaagtatttaaataaagcaatcaatttaatcgatgaattagaggatggtcctaataaagaactatttagaaagcttattaaaaaaatgggaagtcgaaataagtaa

SEQ ID NO: 414 - DNA, 564 bp, Staphylococcus epidermidis
atgaatgattctcttattcgtatcaaacaaaattttatagaatatattctgtttaactatcgttttaaatcaagaatcactgtgtgggtattaaattatttaaaggcaaatcaagataagctaaataatgtacatttcgtaaatagtaaaatcaataatcattataccttagaaattgcagaagtggatgcaactgcttctgcaattcaattgagcaaggataataaatcttatattaatacaaatcaaatttttaattatattgcaaatcatacattaagattagatatacaaatacattttgctaattgtcacatccgagaatctcgcttagatgatttaatattaatgcagctcatacattcacctagttattcatcttatgtacaagacttatattcaatttctatggataaaagaaaacaaacatttattattcaaaccttacaaaacaatattgatttaagtttacaaatgaatgaacctgattatttttatcaactcacacaaatacttaatgtattaaaatcaaaagatattcaatcaactttacatgaaaggtag

SEQ ID NO: 415 - DNA, 945 bp, Staphylococcus epidermidis
ggaagatgtccaatgattttaacattaactttaaatccctcagttgatatatcttatcctttagatcagtttaatttagatactgttaatagggtatctcaaacaagcaaaacagcaggcggtaaaggattaaatgttactagagtattgtctgaatttggtgaagacgtaatagcaagtggttttttaggtggagcattaggtcaatatattgaagaacaaatagaaactactcgtattaaacaagcatttttcaaaatcaaaggcgaaacacgaaattgtattgcaatactacatgaaggacaacaaactgaaatccttgaaaagggtcccacgattgaacttaaggaatcagaggaattcaagtcacatctattaaaacttttcaaagaaactgatgtggctgttatgtctggtagtctgcccaaaggacttaatactgattattatgcggatattgtgagattagcaaaagaacaaggaattttgaccattttagatagctctggtcaatcacttgaggaagttcttattagtaatgtgaaacctacagtaattaaacccaatatagatgaattatcacaacttttaaattacaaagtaaccaatgatattaaagaattgaaagcggcagtaagtcagccaatatttaatgatattgaatggattattgtttcattgggcagtgaaggtgcttttgcaaaacataatcaaaaattttataaggtgaatattcccaacattaaagtagttaatcctgttgggtcaggagattccactgtagcaggaattgcttctggactcattcatcaacaaaccgatgaagagttattaaaaaaagcaaatgcattcggaatgctaaatgcaatggaacaacaaacaggtcatattaatacagataaatttgacgaaatattcaaacaaatagaagttatagaggtgtaa

SEQ ID NO: 416 - DNA, 666 bp, Staphylococcus epidermidis
ggagggaatactgtgggtcaaaaaattaatccaatcggacttcgtgtcggtgttatccgtgattgggaagcaaaatggtatgctgaaaaagactttgcttcacttttacatgaagacttaaaaatccgtaaatttattgataatgaattaaaagaagcgtcagtttctcacgtagatattgaacgtgcagcaaatcgcatcaatattgcaatccatactggtaagccaggaatggttattggtaaaggcggttcagaaattgaaaaacttcgtaacaaattaaataccttaactgataaaaaagtacacatcaacgtaattgaaattaagaaaattgatattgatgcacgtttagttgcagaaaatattgcacgtcaattagaaaatcgtgcttcattccgtcgtgtacaaaaacaagctattacaagagctatgaaaaatggtgctaaaggtatcaaaactcaagtatcaggtcgtttaggcggagctgacatcgctcgtgctgaacaatactcagaaggaactgttccacttcatacattacgtgctgacattgattatgcacacgctgaagccgatacaacatatggtaaattaggcgttaaagtatggatatatcgtggagaagttcttcctactaagaacactagtgaaggaggaaaataa

SEQ ID NO: 417 - DNA, 252 bp, Staphylococcus epidermidis
gggagggataccatggctgataataacaatcaaaacggacaagacgctactcaacaatttataaatattttaaaatcgtttaaatggcgtattattggatttttagcatttttaattatagctatattattcctaactctcggattttggaagacaattttaattatagtgttatgtttaataggaatcggtatcgggtatattaaagaccgtacacaagatttcttaaacttcctaaatagatggagttag

SEQ ID NO: 418 - DNA, 564 bp, Staphylococcus epidermidis
ttgagttggtttttggtgtttttttacaacgttaacaccttccacaacgacacggtctttttttggttcagtagctactactttaccttctttacctttgtctttacctgcgataacttttacgttgtcaccttttttgatatgcatgtgggcacctccttaaattatgtgaatttatttgattggtattatagtacttctggagctagtgatacaattttcatgaagtttccttcacgtaattcacgagcaacaggaccaaagatacgagtaccacgtgggcctttgtcatcacggatgataacacatgcattttcgtcaaatttaatatatgaaccgtcttcacgacgaacacctgattttgtacgaactacaacagcttttacaacgtcaccttttttgacaacgccacctggtgttgcatttttaacagtacatacaataatatcaccaatgttcgctgttttgcgaccagatccacctaatactttaattgtaagaacttcacgagcaccagagttgtctgctacttttaagcgtgtttcttgttggatcattcgttaa

SEQ ID NO: 419 - DNA, 516 bp, Staphylococcus epidermidis
aggagggacacattcatggctcgtagagaagaagaaactaaagaatttgaagaacgcgttgttacgattaaccgtgttgctaaagttgtaaaaggtggtcgtcgtttccgtttcactgcattagtggttgttggagataaaaatggtcgtgtaggtttcggtactggtaaagcgcaagaggtaccagaagctatcaaaaaagctgttgaagcagctaaaaaagatttagtagttgttccacgtgtagaaggtacgactcctcatactataactggtcaatatggatcaggtagcgtatttatgaaaccagccgcacctggtacaggagttatcgctggtggaccagttcgtgccgtattagagttagcaggaattactgatatcttaagtaaatctttaggatcaaatactcctattaatatggttcgtgcgactatcaacggtttacaaaacttaaaaaatgcagaagatgttgctaaattacgtggcaaatctgtagaagaattatacaattaa

SEQ ID NO: 420 - DNA, 492 bp, Staphylococcus epidermidis
tttattcgcactgcaataatgaacgaagcatttatttttaggaggacaattattatgcgtcaaacatttatggcaaatgaatcaaacattgagcgcaaatggtatgttattgatgctgaaggccaaacattaggtcgtttatcatcagaagtagctgctatattacgcggtaaaaataaagtaacttatacaccacacgttgatactggtgattatgtaattatcattaatgcatctaaaattgaattcactggtaacaaagaacaagacaaaatgtactaccgtcattcaaatcacccaggcggtttaaaatcaatctctgctggtgaattaaaaagaacaaatcctgaacgtttattagaaacttcaattaaaggtatgttaccaagtacacgcttaggtgaaaaacaaggtaaaaaattatttgtatatggtggcgctgaacatccacacgctgcacaacaaccagaaaactacgagttacgtggttaa

SEQ ID NO: 421 - DNA, 1023 bp, Staphylococcus epidermidis
agaggtggcactatgaaagcgataggatttaagtcttcattccaattagatgaaggaaattgttttgaggaatttaactttgatatacctcatccatccggccatgaattattagtcaaggttcaaagtattagtgtgaatcctgttgatacaaaacagcgtacaatgccagttgacaaagcgccacgtgtacttggctttgatgctgttggtgtgattgaaaagataggagatcaagtgtcaatgtttcaagaaggggacgtcgttttttattcaggttctcctaaccaaaatggttcgaatgaagaataccaattaatagaggaatatttagtagctaaagcacctacaaatttgaaaagtgaacaagcagctagcctacctttaactgggctaacagcttatgaaacgcttttcgatgtttttggaatttcaaaagaaccatctgaaaataaaggtaaatcattgttaataattaatggagcaggtggtgtaggtagtattgcaacacagatagcgaaattttatgggttgaaggttattacaactgcttcgagagaggatactataaagtggtctgttaatatgggtgctgatgttgtactgaatcataagaaagatttaagtcaacaatttaaagataatcatattgagggtgttgactatatcttttgtacattcgatacagatatgtattatgaaatgatggttaacttagttaaacctagaggacatattgcgacaattgtcgcatttaattcgcaacaagatttaaatttattgaaatctaaaagtgtaacatttacgcatgaatttatgttttcaagaccattacaccatacagatgatgtaatcaaacatcatgaatatcttaaggatataacagaaaaggttgaacagggatattatcaaccaactaccacgaaagttatcgacggattagatgtagatagcctttatgaagcgcatcaaattttagagtctcattctatgattggtaagcttgttatcaatcttaagtaa

SEQ ID NO: 422 - DNA, 372 bp, Staphylococcus epidermidis
attaatatggcacgtattgcaggagtggatattccacgtgaaaaacgcattgttatctcattaacatacgtatatggtattggtacttcaactgctaacaaaattgtagaagaagctaacgtatcagcagatactcgcgttaaagatttaactgacgatgaattaggtcgtatccgtgaagttgtagatggctacaaagtagaaggtgacttacgccgtgaacaaaacttaaacattaaacgtttaatggaaatttcatcataccgtggaattcgtcatcgtcgtggcttaccagttcgtggacaaaaaactaaaaacaatgctcgtacacgtaaaggtccagttaaaacagtagctaataagaaaaaataa

SEQ ID NO: 423 - DNA, 840 bp, Staphylococcus epidermidis
gcgacaatggctcttaaaaaatataagccaattacaaatggtcgtcgtaatatgactactttagatttcgctgaaatcacaaaaacaacacctgaaaagtcattattacaaccgctaccgaaaagagcgggacgcaataaccaaggtaaattgactgttcgccatcatggtggtggacacaaacgtcaataccgtgttatcgattttaaacgtaacaaagatggaatcactgctaaagttgattcaattcaatatgatccaaaccgttcagcaaacattgcattgctagtttatgctgatggtgaaaaaagatatatcatcgcacctaaaggattacaaataggtcaaactgtcgaaagtggtgctgaggcagatatcaaagttggtaatgccttaccattgcaaaacattccagttggtacagtaattcataacatcgagttaaaacctggtaaaggtggacaacttgctcgttctgctggtgctagctctcaagtattaggtaaagaaggtaaatatgtattaatcagattaagatctggtgaagtacgtatgattttatctacatgtcgtgcaacaattggtcaagttggtaacttgcaacatgaattagtaaatgttggtaaagcaggacgctctagatggaaaggtgttcgcccaactgtacgtggttctgtaatgaaccctaatgatcacccacacggtggtggtgaaggtcgtgctccaatcggtagaccatctccaatgtcaccatggggtaaacctacgcttggtaagaaaactcgtcgtggtaaaaaatcttctgacaaacttatcgttcgtggacgtaagaaaaaataa

SEQ ID NO: 424 - DNA, 1965 bp, Staphylococcus epidermidis
attatgaatttcaatcaatttataaataaacaaaatataataatgactgaagatgaacataatgtatatgactttcttaaacatcataatcctaattggtcttctaattatattgatcatttattagatggacgtgataaagtaagtcaacgtttaattacatctttacatagggagaatttagtaaaaagtcgcgatcatagtcgtatacttaatcgacatcagtttgctggatacggagttaatgtgattgccattttagaaatctattttccaacatctaatatttatttgtatgcaccaataactggaatgcatgcattcgatcgcattgatgttgaaggacctttttattttaagaatctaagtaaagaagatgattttgaacgtgtactacatcctaatcaaatattagattggatattaattgaagatgaaaacttaaataacgaggctagcgtacaatttagaaatgatttaaataatagtgcagctaatatgacttttgctttaagtttccagcactatacgatgcgtaatgaaagagcgccattatataaccttattaaaaatgcaaatgatagttacttgcgttccgaacaatctgtcatcgaaggtcatccccttcatcctggtgctaagttaagaaaaggaatgaatgctgaggaaaactttatgtattcatcagaatttggtaatgttattcatctaagagccgtttttattcataaaagtataagtcgtattcaatcatcgaatgtagattacaatgttgccgtaaagcaaatgtttcccgacttaattaaaaccttagaaaaagaatttggcgaagattttaatttacaaaattatcatttaatgatggttcacccttggcaaataaaacatattttacaaagtgattatcgggatgaactaaatgaaaagttaatattgataagtaatcattcggtaccatattatgccggtctatcatttagaacgttagtacctaaacaacctgatttatccccgcacatcaagttatcgacgaatgtacatataaccggtgagattcgaacattgtctgaacaaacgacatataatggaccactagtgacgcaaattttaagagagattatgtcaaaagatgaagatttttcacattatcaatctacttatatcgatgaaaatgcagggattcacttttataatcgaaacgacaatgaggcaattcaaacagatagaagtgaacaattagggactttgtttagaaataatttatatcaatttatatctaatgaaacagtgccagtaattccatcaagtttggttgcgacctatccttataatactgaagcaccaatctgtacgttaatcaaaacgtatcaaaatacgtatcaatataaaaattatgaagaagcagcgaaacaatggattaaagactatagcaaagctcttcttggcttagttatccctctttattcaaaatatggaatttcgctagaggcacatttacaaaattcagtggcaacttttaataaagatggctcactaaatatgatttatatcagggactttgaaggattacgtattgataatgaacaattgaataatgctggatttaccactagacatttccatgaaaaatctagaatccttacaaattctaaaacatcagtatttaataaaatgttctattcaacagttcaaaatcatttaggtgaactcgttattacaatagctaaatattctaatagtaaagtccttgaacaagaaatatggcaaattatttcacaaacagtagaagacatttttaatcacatgactcacatttcaaaacaacatctcaacaacatcaagcgcactattttcgcatccgaaatcgattataagtgtgtcacaacaatgcgtttagaggatcaagcacatgaatatacgtatattaaagtgcataatccacttcatagaaagaatgatttataa

SEQ ID NO: 425 - DNA, 372 bp, Staphylococcus epidermidis
ctcatgggttacagaaaattaggtcgtacttctgatcaacgtaaagcaatgttacgtgacttagcaacttcattaatcgttagtgaacgtatcgagacaactgaagctcgtgctaaagaagttcgtagtgtagtagagaaattgatcacacttggtaaaaaaggtgatttagcatctcgtcgtaatgctgctaaaactttacgtaatgttgaaattttaaatgaagatgactctacacaaactgctcttcaaaaattatttggtgaaatcgctgaacgttatagtgaacgtcaaggtggttacactcgtattcttaaagtaggccctcgtcgtggtgacggcgctgaatcagtaattattgaattagtttaa

SEQ ID NO: 426 - DNA, 579 bp, Staphylococcus epidermidis
gaagctagtcaaaacgttgtattacaaaagaaaactgaagaagtagatggttataatgctatccaagtaggttttgaagataaacaagcatataagaaaggttctaaatctaataaatatgctaataaaccagctgaaggtcatgctaaaaaagctgacacagcacctaagcgcttcattcgtgaattccgcaacgttaacgttgacgaatacgaagtaggtcaagaagtctcagttgatacattcgaaactggtgacatcattgatgttacaggcgtttcaaaaggtaaaggtttccaaggtgctattaaacgtcatggacaaggtcgtggaccaatggctcacggttctcatttccatagagcgccaggttctgtaggtatggcatcagacgcttcaaaagtgtttaaaggacaaaaaatgccaggacgtatgggtggaaacactgttactgttcaaaacttagaagtcgttcaagttgacactgaaaatagtgtgattttagtaaaaggcaatgtacctggacctaaaaaaggtttagtagaaatcacaacttcaataaaaaaaggtaataaataa

SEQ ID NO: 427 - DNA, 372 bp, Staphylococcus epidermidis
cgaatgatccaacaagaaacacgcttaaaagtagcagacaactctggtgctcgtgaagttcttacaattaaagtattaggtggatctggtcgcaaaacagcgaacattggtgatattattgtatgtactgttaaaaatgcaacaccaggtggcgttgtcaaaaaaggtgacgttgtaaaagctgttgtagttcgtacaaaatcaggtgttcgtcgtgaagacggttcatatattaaatttgacgaaaatgcatgtgttatcatccgtgatgacaaaggcccacgtggtactcgtatctttggtcctgttgctcgtgaattacgtgaaggaaacttcatgaaaattgtatcactagctccagaagtactataa

SEQ ID NO: 428 - DNA, 330 bp, Staphylococcus epidermidis
ggaggtgcccacatgcatatcaaaaaaggtgacaacgtaaaagttatcgcaggtaaagacaaaggtaaagaaggtaaagtagtagctactgaaccaaaaaaagaccgtgtcgttgtggaaggtgttaacgttgtaaaaaaacaccaaaaaccaactcaattaaaccctgaaggtggaattttagaaacagaggcagcaatccatgtttctaacgtacaattattagatcctaaaacaaatgaacctacacgtgtaggatataaaacagttgatggtaaaaaagttcgtatcgctaaaaaatcaggcgaagaaattaaagctaataattaa

SEQ ID NO: 429 - DNA, 183 bp, Staphylococcus epidermidis
gttatggctaaattacaaattaccctcactcgtagtgttattggtcgtcctgaaacacaacgtaaaactgttgaagctttaggtcttaaaaagactaatagttcagtagttgttgaagataaccctgcaattcgtgggcaaatcaacaaagttaagcatttattaacaattgaagaaaaataa

SEQ ID NO: 430 - DNA, 222 bp, Staphylococcus epidermidis
tcaatggctaaacaagatgtaattgaattagaaggtacagtactagatactttaccaaacgcaatgtttaaagtagaattagaaaatggtcatgagattttagctcacgtaagtggtaaaatcagaatgaattacattcgtattctacctggcgacaaagtaactgttaagatgtctccgtatgatttatcgcgcggtagaattacttatcgttataaataa

SEQ ID NO: 431 - DNA, 201 bp, Staphylococcus epidermidis
aaggaggctaataaagtggctaaaacttcaatggttgctaagcaacaaaaaaaacaaaaattcgctgtacgtgaatatactcgttgtgaacgctgtggtcgtccacattctgtgtatcgtaaatttaaattatgccgtatttgtttccgtgaattagcttacaaaggtcagattcctggcgtacgtaaagctagctggtaa

SEQ ID NO: 432 - DNA, 585 bp, Staphylococcus epidermidis
ttgatgtataatctaaaattaacttttgctaaggaggtgacgtgcgaggtgaaaagacttaagaattttattctcggcttactcattgtggctatagttggcttcctattatttatgtatatagatgatagtcgcattcaaagttatcaagactacttcttacaatttaattggttccaaccactattgattgggcttgcaggattacttatattaatcggacttatattagtacttagtatttttaaacctacgcatcgcaaacctggactttataaaaactttgatgatggacatatttacgtatcacgtaaagctgttgaaaaaacaatttacgatacaatcgctaaatatgatcaagttagacaaccaaatgttgtaagtaagctttataacaaaaagaataaatcatttattgacatcaaagcagatttcttcgtaccaaaccatgttcaagttaagagtttaacagagagtatccgtgctgatatcaaaagtaatgttgaacactttactgaaattcctgttagaaaattagaagttaacgtacgtgatcagaaaacatctggtccacgtgtattgtaa

SEQ ID NO: 433 - DNA, 525 bp, Staphylococcus epidermidis
tttaaaaataaaggagaatgtattatggcagtagataacaataaagctaaacaagcatatgataatcaaacaggtgttaatgaacaagaaagaaaagagcaacaacaagctcaaaataatcaacctcaatttgaaaacaaattaactttctcagatgaagtagttgaaaaaattgcaggtattgcagcacgtgaagttaaaggaattttagacatgaaaggtggcttcacagatagctttactaacgctttctcaaacggtaacaatgtaactacaggcgtatctgtagaagttggagaaaaacaagctgctgtagatttaaaagttattttagaatatggtgaatctgcacctaaaattttccgtaaagtgacagacttagttaaagaacaagtaaaatatattactggtttagaagttgttgaagttaacatgcaagttgacgacgtaatgacaaaaaaagaatggcaacaaaaaaatgaaaaagataacaaagaaaacaatgaaagagaaggtttaaaataa

SEQ ID NO: 434 - DNA, 771 bp, Staphylococcus epidermidis
gaagtgaataaatcaatgaacaaatatgataggttagatgaaatcacaaaattagtaaataaacgaggttctgtaagaacaaatgaaatcgtcgaagatctaaatgtgtcagatatgactgtgcgccgtgatctcgcagagcttgaagaaaaaggtgttctcactaaaatacatggtggtgctcgtagtaattcagctttccaatataaagaaatgtctcatcaagaaaaacatacacgttttattgaagaaaaacgatttatagcaaagaatgcagtagatttaattgaagatggagatactattttcttaggtccaggtactacagttcaaaaattagctgaagaaataaatcattattcattaacaattattactaattgtttaccagtatttaatatattaataaaaaaacaaacgttacatttcagagtctatttattaggtggggaaatgcgtgatttaactgaagcatttgtaggtgagatgacaaatcagttattaagtcaactaagatttagtaaaatgttttttagtagtaatggtgttaaagatggtctagctatgacatcctcaatagaagaggcttatacgcaacaaattgcacttagccattcgttggaaaaatatttactgattgactcttcaaaaattggtaaggatgatttttcatcattttgtgagcttcgtgaactcaatgcagttttaacagataataatgacttggaaaagaaagaaaaaatagaatcatatgttgaggttattagctaa

SEQ ID NO: 435 - DNA, 507 bp, Staphylococcus epidermidis
tttaggtgtaaagatttgaaagcgctttttcaaaaacacatgtgtttaatcaccttaattcaaaaaaggagacttattatgacgattattattggttcagatgtagatggcaaacgcttaaaagaattaattaaagattatttggaagacaacgattatgatgttttagatgttacagaaggaaaagatttagactttgttgattcaacagtctctgtagctaaagaagttcaaaagtccgacgacaatctaggtattgctatagatgcctatggtgcaggtagttttattgtagcaactaaaattaagggaatgattgcggctgaggtttcagatgagcgttcagcttacatgacacgtagccataataatgcacgcatgattactatgggagctgaaattgttggagatacgcttgctaagaatgtcgcaaaagaatttgtcaatggtcattacgatggtggacgtcatcaaattcgcgtagatatgttaaataaaatgtgttaa

SEQ ID NO: 436 - DNA, 873 bp, Staphylococcus epidermidis
tatacagtcaatttgaattattgtagaatgtttagtgatataaaaatattaggagtggttgatgtgaatgggtcaaatcctatcattgagtttaaagatgtatcatttcaatatcaaagtgacgctgctttcacattaaatcgcgtttcattctcaataccagctggacaatggacttctattgtaggtcacaatggttcaggaaaatctactattgctaaacttatggtaggtatagaagaaccaagtgaaggacaaattctatttcaaaatctaccagtagactctcaaaataagcgagaagtgaggaaacatatcggaattgtttttcaaaacccagataatcaatttgtaggttctatagttaaatttgatgttgcttttggtcttgaaaaccaacttgttccttataaagaaatggtatctaaagttaatcaagttttaactgaagtagatatgataaataaagccgatgatgagccccattcactttcaggagggcagaaacaacgtgttgccattgctggggtacttgcacttaatcctgatgtgctgattttagatgaagcgacaacgatgctagatcctcatggaaagtcatctttacttaaccttgttaatgaagttaaagtaaataatcatgttacaattatttcaatcactcatgatttagatgaagcaatgcatgctgatcaaatcattgtattgaataaaggaactgtttttaaacaaggaacacctcaagatatttttaagtgcgaagatgcactaatatcggttggattggacttaccatttcctttgaaaatgaatcgacttttaggttttgattcaacttatgtaacttatgaagggttgattaaaaaattatga

SEQ ID NO: 437 - DNA, 981 bp, Staphylococcus epidermidis
tttatgacaaaatcacaacaaaaagtgtcatcaattgagaaattaagtaatcaagaaggtattatttcagctttagcatttgatcaacgtggtgcattaaaaagaatgatggcagaacatcaatctgaaacaccaacagttgaacaaatagaacaattaaaagtacttgtttctgaagaattaactaaatatgcgtcttcaattttattagatccagaatatggtttaccagcatcagatgctcgaaataatgactgcggactattacttgcatacgaaaaaactggatatgatgtgaatgcgaaaggtcgtttgccagattgcttggtagaatggtctgcgaaacgtttgaaagagcaaggggccaatgcagttaaatttttactttattatgatgtagatgacacagaagaaattaacatacaaaagaaagcatatattgaacgaattggttcagaatgtgttgccgaagatattcctttcttcttggaagttttaacatatgacgacaatattcctgacaataaaagtgcagaattcgctaaagttaagccacgtaaagttaatgaagcaatgaagttattctctgaagatcgttttaatgtggatgtacttaaagttgaagtacctgtgaatatgaattttgtggaaggattttcagaaggagaagttgtttatactaaagaagaagctgcacaacatttccgtgatcaagatgcagctactcacttaccatatatttatttaagtgcaggtgtatcagcagaattgttccaagatacattaaaatttgcgcatgattctggtgcgcaattcaatggtgttttatgtggacgtgccacatggtcaggagcagttaaggtatacattgaagaaggagagcaagctgccagagaatggttgcgtacggtaggatttaagaatattgatgatttgaatacagtattgaaaacaacagctacatcatggaaaaacaaataa

SEQ ID NO: 438 - DNA, 1776 bp, Staphylococcus epidermidis
attatacaaaaaagggagctgacccctatgaataaattaatagcatggatagaaaaaggaaagccattctttgaaaaaatatcacgaaatatttatttaagagcgattcgtgatggatttattgctgctattccaattatcttattctcaagtatatttattttaattacctatgtaccaaatgtgtttggttttacttggagtaaaactatggaaggtatattgatgaaaccctataactatacaatgggaatagttggtttgcttgtagcaggaaccacagctaaatctttaactgattcttacaatcgaaaactagataaagcgaatcagattaactttatttcgacaatgatggcagctatttgtggatttttattcttagctgctgatcctgttaaagatggtggattttcaagtgcatttatgggaacaaaaggtttattgacagcctttatttctgcgtttattaccgtgattgtttataatttctttgtcaaaagaaatattaccattaaaatgcctaaagaagtaccaccaaatatatctcaagtatttaaagatattttccctttatcagccgtaattttaattttgtatgctttagacttactttctagagcaatagtccacacgaatgtagcaaatgcagtattaaaagtatttgagccactatttactgcggcagatggttggattggggtaacactcatattcggtgcgtttgcgttcttctggtttgtaggtattcatggaccttctattgttgaaccagcgattgcagcaattacttatgcgaaccttgaaacaaatttacacttaatacaagctggagaacatgctgataaagtaattacaccgggtacacagatgttcgtagcaactatgggaggaaccggtgcaacattagttgttccatttatgtttatgtggttaacaaaatcaaaaagaaataaagcgataggtagagcatcagtcgtacctacattctttggtgtcaatgaacccatactttttggtgcaccactagtactaaatccggtattctttataccttttatttttgcacctatagtaaatatatggatttttaaattttttgttgatgttttaaatatgaatagttttagtatctttttaccttggactactcctggtccactcggtattgttatggggactggatttgcattttggtcatttgtgttagcaatattacttattgttgttgatgtgattatttactatccattcttaaaagtatacgatgaacaagtgcttgaagaagaattaggaaataaagaagcaaataatgaattaaaagaaaaagtatcagcaaactttgatacgaaaaaagccgatgctattttagcaactgcaggggcaagtgaagcggatactgatgatacatcttcagttgatgaaacaacttctacatcctctacagatactattagtgaacaaacaaatgttttagttttatgtgcaggtggaggtacaagtggtttactagctaatgctttaaataaagctgctgaagagtatgaagtaccagtaaaagcagcagcaggtggttatggtgcacatatggatattatgaaagattatcaattaattatcttagcaccacaagttgcttcgaattttgaagatattaaacaagatactgatcgcttaggaattaaattagccaaaactgaaggcgctcaatatatcaagttaacaagagacggtgaggcggctttagaatttgtaaaacaacaatttaacaattaa

SEQ ID NO: 439 - DNA, 405 bp, Staphylococcus epidermidis
aggaggcaaaatttaatggcacgtaaacaagtatctcgtaaacgtagagtgaaaaagaatattgaaaatggtgtagctcacatccgttcaacattcaataatactatcgtaactatcactgatgaattcggtaatgcattatcttggtcatcagctggtgcattaggattcaaaggatctaaaaaatcaactccatttgcagctcaaatggcttcagaaacagcttctaaaactgctatggaacatggtttgaaaacagtagaagtaacagtaaaaggacctggtccaggccgtgaatctgctatccgtgcactacaatctgcaggtttagaagtaactgcaatcaaagacgttactccagtaccacacaacggttgtcgtccaccaaaacgtcgtctcgtataa

SEQ ID NO: 440 - DNA, 747 bp, Staphylococcus epidermidis
aaacaaatgaaaaaaccagatattcaacagttaaaagatatcgtaaacaactctaatcaaattgttttctttacaggagctggtgtttcagttgcaagcggaattccagattttcgctcaatgggtggcttgtatgatgaaatatcaaaagatggacagtctccagagtatttgcttagcattgatcatttacatgataataaagaaagttttataaacttttatcatgaaagacttttaattgccgataaaaaacctaatattgttcatcaatggattgcacaactggaaaatcagcaaaaatcacttggcgtcatcactcaaaatatagatggtttacacgaagatgcaggtagtcacaatattgatgagctacatggtacacttaatcgcttttattgtattaactgttatgaggagtactcaaaatcatatgtcatgacacatcatctcaaatattgtgaaaaatgtggtaacgtcatcagacctgatattgttttatacggcgagatgttaaatcaaaaaacagtcttcaaggcattagataaaattcaacatgcagatacactcatcgtattaggttcatcacttgttgtacagcctgctgctggttttgtatcagaatttaaaggtgacaacctagttatcattaatagagatgcaactccatatgatcatacagctagcttagttatacacgatgatatgactaatgttatagaagaaatcttaaatagtaatagttaa

SEQ ID NO: 441 - DNA, 1065 bp, Staphylococcus epidermidis
tgcatggcgaatgttcgtgtcaatttatctaaaattaaatataatgccaaagtacttcaatcgttattagaacgtagacatatccatttcacaccagtaattaaatgtgtcgcaggggataaacgtattgtatcaagtattaagtctttaggaattactcattttgctgaatcaagactagataacattgaacaactcaaagatttagatattacatttacattgttacgacctactgttgaagcagatttggaaaagatgatttcaagagtagaaatgagtatccaaactgaattaaccacaatcaaaaaacttaatacgttagcaaaatcacttgatattaaacatcaaatcatgctaatggttgactggaaagatggtagagaaggggtcttgacctatgatgtggtgcgttatgttcaagaagtacttagattatctcacatacaacttgttggcttggcatttaattttatgtgctttaaatcagaagcacccaatgaaaaagatgttcgtatgataaacaaattcatacataatgtagaaaacgaaactcattttaagtttagaattatttcaggtggaaattcgagtatgttacctcaaacactgtacaatcatttagataaaatcaatgatcttcgtataggggaggcattattaaggggtatagatacgacgacaaatcattcaattaatagcttatatcaaaatgcgatagtattagaagcagaaattatagagataaaaccacgtctatatcaaaaaaataatcaatcttatttacaagctatagtagatatcggttatttagatacgtttattgaggggataaaacctcttgggaatgatataagaatattaggtgcatcaagtgatcatttgatgattgatttaaataaccaagatcattatcaaatcggtgataaacttcaatttagcttgaattatgaagcactgtctcagagcatgtatatgaaaaatttaactaagttatatagtagtgattcaaaaatagaatcccttgttcagaacttcgatatgcatatatattcccagtgctaa

SEQ ID NO: 442 - DNA, 237 bp, Staphylococcus epidermidis
aacgtgaagaattgggtggtgaaacaaatgaaagctaaggaaattagagacttaaccacttcagaaatcgaagaacaaatcaaatcttcaaaagaagagctttttaacctacgctttcagttagctacaggtcaattagaagaaacggcacgtattcgcacagtaagaaaaacgattgcacgtctaaaaactgttgctcgtgaaagagaaattgaacaaagcaaggctaatcaataa

SEQ ID NO: 443 - DNA, 453 bp, Staphylococcus epidermidis
ggaggtgccgaaatgaaattacatgagttaaaagcagctgaaggatcacgtcgtgtacgtaaccgtgtaggtcgtggtgctgcaactggtaacggtaaaacaagtggccgtggtcaaaaaggtcaaaaagcacgttcaggtggtaaagtaagaccaggatttgaaggtggacaattacctttattccgtcgtttgcctaaacgtggtttcactaacattaaccgtaaagaatatgctattgttaacttagaccaactcaataaatttgaagatggtactgaagttactccagctttattagtagaatctggtgttgttaagaatgaaaaatctggtatcaaagtactaggtaacggttcactagacaagaaattaacagtgaaagctcataaattctcagcttcagcagcagaagctattgatgcaaaaggtggagcacacgaggtgatctaa

SEQ ID NO: 444 - DNA, 387 bp, Staphylococcus epidermidis
cactctaaagaaaggagtattgaaatgatcagtaaaattgataaaaacaaagtacgtttgaaaagacgtgctcgtgttcgtactaaattatcaggtacagctgaaaagccacgtttaaatgtgtatcgttcaaacaaacacatctatgcacaaattattgatgacgttaaaggcgtaacacttgctcaagcatcatcacaagataaagatattgcaaacacatcagcttcaaaagttgacttagcaactactgttggtcaagcaattgctaaaaaagctaacgataaaggtattaaagaaatcgtcttcgatcgcggaggatatttataccacggacgtgttaaagctttagctgatgctgcaagagaaaatggattagaattttaa

SEQ ID NO: 445 - DNA, 285 bp, Staphylococcus epidermidis
ttgaaagaggaggttacaaaagtgagcgaaagaaacgatcgtaaagtttatgtaggtagagttgtttcagataaaatggacaaaacaatcactgttctagtggaaacttacaaaacgcacaaattatacggcaaacgagtaaaatactctaaaaaatacaaaactcatgatgaaaacaattcagctaaattaggagacattgttaaaattcaagaaactcgtcctttatcagcaacaaaacgttttcgtttagtagaaattgttgaagagtcagtaattatttaa

SEQ ID NO: 446 - DNA, 372 bp, Staphylococcus epidermidis
gtagaggaggaaatcctgatggaagcaaaagcggttgctagaacaataagaatcgcacctcgtaaagtaagacttgttcttgatttaatcagaggtaaaaatgctggagaagctattgctattttaaaattaactaataaagcttcatcaccagtgattgaaaaagtattaatgtccgctttagcaaatgctgagcacaactatgatatgaatacagatgaattagttgtaaaagaagcatatgctaatgaaggaccaactttaaaacgtttccgcccacgtgcacaaggacgtgcaagtgcaattaataaacgtacaagccacattacaatcgtcgtaagtgacggtaaagaagaagctaaagaagcttaa

SEQ ID NO: 447 - DNA, 1848 bp, Staphylococcus epidermidis
ctacatttactattatgggaattagcactatcagtatttcactcattttttatatcatacaacgtatttcgaatatggaggagagcaataatgaatcataaggaatggcttttagctgacaaaaacatccaatatcgaacgattaacgcaatgattaaggaacatattgtttctgaaggtatgcgtattaaagaaggtacgtgtaaagttgaaatttttctcaataatcaccttttatcgttaaaagtagcgcgaaaaagtgccttaaaaagatacgtttttactggtgacatagtattaaaaaataaaaaattgtctcaatcaattgaaagtttagaagaacttcttcaaatactaacggaaatatttcatatcaacatttcaaaacgattatacgatgaattaatacatagtagggatagtttgtatgaaacgtacaaacatttttataatagacaaacactcattcatcagagtatgaaatttagtaaattacccgattctataaattttattgcttggctgcaacatttacaagatagtggtattacagatgatttaagttactcggaaagtcttgtgatagaagggcatccaacacatcctttaacaaaaactaaattgcctctcagtactaatgaattgaaactttatgcaccagaatttgaaaaagttattccattaaatattatgcttattgaaaaaaatcatgtagtaacaacagcaataaatgatgatcaaaattttattctaaatcaagttattcctgaatatcgagatcgtttaaaatgctacctcgagccacttcgattaaatcttaacgattacagagtgatgttgatacatccttggcagtatgatcatactatcggcgaacaatttgaagaatggatagccaagaaaatcttactacctacaccatttactgttgagtccaaagctactttatcatttagaacaatggatttaattcatacaccatatcatgtgaaattgccagtaaatgttcaagctacaagtgctgttagaacagtttcatcagttacgactgtagatggtcctaagttaagccatgcattacaaggattgcttcaggaatttccagaacttcaagtcgcgatggaaccttatggagcttatgctcacacggcatctgatttatcaaaacaattagcgcttatcatacgtcaaaaacctacgatatatgattatggttgtacagttgtaacagctagtttagttaatcctaatccaattgataatcaggcagttgtagatagttatttaaaatggatagaaaatgaaatcacacttgatcatattaagcattttatagcaatttatacacaaaccttagttacaccgcttattgcgtatattcaaaattatggcatagcacttgaagcacatatgcaaaatacgattgttaatcttggacctaattataaaatgaaattcattgtacgtgatttaggtggttctcgtatagatttaaatacacttaaacagaaagttcctcaaatagatgttacaaatgaaagtcttattgcagatactattgaagaggttattgctaaatttcaacatgcagttattcaaaatcaactagcagaattgattcatcattttaatcagtatgatgaagtaatagaagaagaattatttgaaattgtgcgtgaagaaatcgaaatggcaatcgataatgacaagccacatgctgaaaaattgaaaaaaatattgtttgggtcaactatcacagtcaaagctttattaagtatgagaatggaaaataaagtgaaaaaatatttaaataccaagttagataatccaataaaaaaagaggtgtag

SEQ ID NO: 448 - DNA, 339 bp, Staphylococcus epidermidis
aaacttatttgggtgtgcggcgtaaagctgcacgcacacaataagaagggaggcgcccaaatggctcgtagtattaaaaaaggacctttcgtcgatgatcacttaatgaaaaaagtagaagctcaagacggaagtgaaaagaaacaagtgattaaaacatggtctcgtcgttctacaattttcccaaatttcattggtcatacttttgcagtatacgatggacgtaaacatgtacctgtatatgtcactgaagatatggtaggtcacaaattaggtgaatttgctcctacacgtacttttaaaggacatgcagcagacgacaagaaaacaagaagataa

SEQ ID NO: 449 - DNA, 1323 bp, Staphylococcus epidermidis
tgcaaaaggtggagcacacgaggtgatctaatgtttcaaacgtttgtacgtttctttacaactaaagaagtacgaaacaagattttcttcactctagcaatgttagttatttttaaaataggaacgtatattcctgctccaggagttaatcctgaagccttcaatcatccacagggatctcaaggtgccactgagttattaaatacttttggtggcggtgccttgaaacgtttctcaatatttgcgatgggaatcatgccttatatcactgcatccatcgtcatgcaattactgcaaatggatattgttcctaaatttacagagtgggcaaaacaaggtgaaatgggtagaagaaaaattaataacgtaactcgttattttgctataattttagcttttatccaatctataggtatggctttccaatttaataactatctcaaaggacaacttattatagaaaagtctgttatgagttatttattaattgcagttgtattaacagcgggaacagctttcttaatttggcttggtgaccaaatcacacagtttggtgttggtaacggtatttctcttatcatctttgcaggtatattatcaactttaccttcgagtctagaacaatttgcacaatcagtgtttgtgggtcaagacgatacttcacttgcttggctgaaaatactaggattgatagtagccttgattttactaacagtaggcgcaatatttgttcttgaagctaaacgtaaaatacctattcaatatgcaaagaaacaatctgctcaacgattaggttcacaagcaacttatctacctttgaaagttaactctgccggtgttattccagttatctttgcgatggcgtttttcttgttaccaagaactttgactttattcttcccgaaagcagaatgggcacagaatattgctgatactgccaacccgtcaagtaatattggaatgattatttatgtagttttaattattgcatttgcatatttttatgcttttgtacaagttaatcctgaaaaaatggcagataaccttaaaaagcaaggtagttatgtcccaggaattagacctggtgaacaaacaaaaaaatatattactaaagtactttatagattgacttttgttggttcaattttcttagcagctatagctattttacctattattgcgactaaatttatgggcttaccacaatcaattcaaattggtggtacgagtcttttgatcgttattggtgtagctattgaaactatgaaaactttagaagcacaagtcactcaaaaagaatataaaggctttggtggtagataa

SEQ ID NO: 450 - DNA, 291 bp, Staphylococcus epidermidis
ggaggtgctcgcataatggaagcaagagatgttcttaagcgccccgtaatcactgaaaaatcttctgaagctatggcagaagataaatacacttttgatgtagatactcgtgcaaataaaacacaagttaaaattgctgttgaagaaatcttcgacgttaaagttgatagtgtaaatattatcaactacaaacctaagaaaaaacgtatgggccgttaccaaggctatacaaacaaaagaagaaaagcgattgttaaactaaaagaaggttcaatcgatttatttaactaa

SEQ ID NO: 451 - DNA, 366 bp, Staphylococcus epidermidis
aaacaacagctacatcatggaaaaacaaataatgtaagggaggatattcaaatgaatagagatgaggtacaattactcggatttgaaattgttgcctatgctggggatgcacgttcaaaattattagaagctttaaatgctgctaaagatagtgaatttgataaagcagaacaacttgtagaggaagcgaatgaatgtattgctaatgcacataaagcacaaaccaatcttctagctcaagaggctaaaggcgaggatatcgcatatagtatcactatgattcatggtcaagaccatttaatgacaacattacttttaaaagatttaatgaagcatttaattgaattatacaaaaaagggagctga

SEQ ID NO: 452 - DNA, 669 bp, Staphylococcus epidermidis
ataatttgtaggagggcatttatgaatatcattttaatgggcttacctggtgcaggtaaagggactcaggcgagtgaaattgttaagaaattcccaataccacatatttctactggtgacatgttcagaaaagcgattaaagatgaaacagatttaggaaaagaagctaaatcatatatggatcgtggagaattagttcctgatgaagttactgtaggtatcgttaaagaaagaatttctgaagacgatgcaaaaaaaggattcttgttagatggattcccaagaactatagatcaagctgagtcattaaatcaaattatgtctgagcttgatagagaaattgatgctgtcattaatatcgaagttcctgaggaagaattaatgaatcgtcttacaggtcgtcgtatctgtgagaaatgtggtacaacatatcatcttgtatttaatcctccaaaggttgatggtatatgtgatatcgatggtggaaagttatatcaacgtgaagatgacaatccagaaacagtatctaatcgtttgagcgttaatgttaaacaatctaaacctattttagaatattacaacaacaaaggtgtcttgaaaaacattgatggttcaaaagatattgacgaagtaaccaacgatgtcattgatatcttagatcatttataa

SEQ ID NO: 453 - DNA, 828 bp, Staphylococcus epidermidis
agttgtataaggagtggcatcatgaagaataaattaatcattggacgatatcttcctatgcaatcaattattcatcagcttgatcctagagctaagttaatatttgtctttttctttattattttaatttttttctgtcattcactaggtacatatgcatggttgtttctttttataatattatttattaagttagcacgcattcctttttggtttttaattaaaggattaacacctatctttttcttcttggttttcactttttctatgcatgtgttatttactaatggaggtatcgtattatttcaatggaaatttatcactattgaatcaagtggtgttatggaaggaatttatatatcactaagattgatttttatagttatgattgcaacaatcatgacactttcgactagtccgattgatttaacagatgcttttgaaaaattatttgcacctcttaaagtgattaaagtaccagtacatcaattaagtatgatgatgtctattgctctaaggtttataccaacgttaatggatgaattagaaaaaattatacttgctcaaaaatctagaggatcagaaataagttcaggaagtttaataacacgaattagagcttttatacccatcatgattccattatttatttctgcctttcaaagagcagaagaactagctatagcaatggaagtcagaggttatgatattaacatcaaacgaacaagctataggttattacattggcaatataaagacacattaacagtcttacttttaatacctatcgctactatattatttattttaaaattttcaggagtgtaa

SEQ ID NO: 454 - DNA, 423 bp, Staphylococcus epidermidis
gagtctgaaaggaggcaacaatcaatgacaatgacagatccaatcgcagatatgcttactcgtgtaagaaacgctaacatggtgcgccacgagaaattagaattacctgcgtctaatattaaaaaagaaattgctgaaatcttaaagagtgaaggtttcattaaaaatgttgaatatgtagaagacgataaacaaggtgttattcgtttattcttgaaatatggtcaaaacaatgaacgtgttatcacaggtttaaaacgtatttctaaaccaggtttacgtgtttacgctaaagcaaatgaagtgccaaaagtattaaatggcttaggtattgcattagtttcaacttctgaaggtgttatcactgataaagaagcaagaaaacgtaatgttggtggagaaattatcgcatacgtttggtaa

SEQ ID NO: 455 - DNA, 867 bp, Staphylococcus epidermidis
aaaattatgagtatacaatttaatcaagtgagttatatttatcaacaagggacaccttatgaatttgaagctattaaaaacgtttcactaactcttgaacagggcaagtattatgcaattattggtcaaactggaagtgggaaatccactttgattcaacatttgaatgctttattaaagcccactacaggttcagtcaacattaatggtttagaagttacaaataaaactaaagacaagcacttacgtcacataagaaaagaagtaggtgtagtatttcaatttccagaatcccaattatttgaagatagtgttgaaaaagaaattgagtttggacctaaaaattttaatatgaacctaaaaaatgttaaagataaagcttttcaacttcttcttgaattaggcttttcaagaaatgtgatgtcatcctctccatttcaaatgtcgggaggacaaatgagaaaaatagccattgtttccattttggctatggatccacaagtaattattctagatgaaccgactgctgggttagacccaaatagtaaacaccaagtcatgtctttaataaagaaaatacaaatagaagaaaataaaacgattattcttgtttcacatgatatggatgatgtagcacgttattcagatgaggttgtagtaatgaataaagggacgatagtagaaaaatcaaatcctagaaatttatttaatcaaaaaacgcaattattaaagtggcatatagagttgcctaaagtagtgaaattacagaaagatatcgaaaaaaaatataatatgttatttccaaagcttgccacgaatgaagaagagtttgtgaagttgtataaggagtggcatcatgaagaataa

SEQ ID NO: 456 - DNA, 558 bp, Staphylococcus epidermidis
ataataaggaggtgccataacatgagtcgtgttggtaagaaaattattgacattcctagtgacgtaacagtaacttttgacggaagtcatgtcactgtaaaaggtccaaaaggtgaattagaaagaactttaaatgaaagaatgacatttaaacaagaagaaaacactgttgaagttgtaagaccatctgattctaaagaagacagaacagatcatggtacaactcgtgctttattaaataatatggtactaggtgtttctcaaggttatgaaaaaacacttgagcttgttggtgtaggttaccgtgcacaaatgcaaggtaaagatttagtacttaatgttggatactctcacccagttgaaattaaagcagaagaaggcattactttcgctgttgagaaaaatacaactgttaaagtatctggtgtttctaaagaacaagttggtgcgattgcttctaacattcgttctgtaagacctccagaaccttataaaggtaaaggtattcgctaccaaggtgaatatgtacgccgtaaagaaggtaaaactggtaaataa

SEQ ID NO: 457 - DNA, 1047 bp, Staphylococcus epidermidis
atgaagaggagatgtgtgttcatgagattaagtttacttgattatgtcccgttgttcgaagggcgtaccccaaatgacgccctaaagcatagtattaaattagcccaacacgctgagaaacttgggtacttacgatactgggttgcagaacatcatcaagtttattctgtcgtttctagtgcacctgaaataataatgatgtcgattttagaacacacacaacacatcagagttggtagtggaggtgtgatgttaccacattatagtccttataaagtagctgagcaatttaaaattatggaagcaagacacccccaacgtatcgatatggctatcggacgttcgccaagctttaaaaatgttaatgcagcactaaatgaaaacaaaaatgaaaaattaccattcaatactcagattactgatttgcttaaatacttcaataacgatacaactcaagaccatcgttttaaatcattattagctacacctatggttacttcatttcctcaactatatattttaggtatgagtaatagaagcgcaaaattagctgctcagcgcggactaccttttgttattgcacgaatgggacaatctgagacagaccttcatgaagctataagcacttatagaaaatattttaaagcttatcatggtgaaattaataatgcgaaaccatatgttattttagcaacttttgtggtaacagcttctaatttatctagagttaaacaattgctacatacgcttcaactttggttgatgcgtattaactatttaaatcaacctaagagttatccatcgattgaaacagcacagaacaagcattatagtcaacgagaattagaaaagcttgaaaagatgaaatcgaaaatcatatacggaatgccaaatgatgttgcggaacaacttaccttacttcatcaacaatttaaagtggatgaaatcatcatcttacctcatgtatttggtgaagacgctagaatggaattaattgagttaattgcgaatgaattgattccatcttgttcacgcgatgaattttag

SEQ ID NO: 458 - DNA, 648 bp, Staphylococcus epidermidis
aaagcgaaaggaggaaattgcataatggctaattatgatgttttaaaagtagacggatcaaaatcaggttcagttgaattaaacgatgcagtatttgctattgaacctaataatagcgttctattcgaagctattaacttacaacgtgcgtcattacgccaaggtactcacgctgttaagaatcgttcagcagtacgtggtggtggacgtaaaccatggagacaaaaaggtacaggtcgtgcacgtcaaggtacaatccgtgcgccacaatggcgtggtggtggtgtagtattcggaccaacaccaagaagctatgcatataaaatgccaaagaaaatgcgtcgtttagcattacgttctgcattatcttttaaagttcaagaaaatagctttacaattgtagatacttttggttttgaagcaccaaaaacaaaagaattcaaaaatgtattaactactcttgaacaacctaagaaagtattagttgtaacagaaagcgaagatgtaaatgttgaattatcagcacgtaacattcctggtgttcaagttacaactgctcaaggattaaatgtacttgatctaacaagcgctgacagtgtaatcattacagaagcagctgcgaaaaaagttgaggaggtgctcgcataa

SEQ ID NO: 459 - DNA, 558 bp, Staphylococcus epidermidis
ttgaaaggaggatccactttgaaccgtttaaaagaaaaatttaatacagaagttactgaaaacttagtgaaaaaattcaattatagttcagtaatggaagtaccaaaaattgaaaaaatcgttgtgaatatgggtgtaggtgacgcagttcaaaattctaaagttttagacaacgctgttgaagaattagaattaattactggtcaaaaaccattagtaacaaaagctaaaaaatcagttgcaacattccgtttacgtgaaggtatgccaatcggtgcgaaagtcactcttcgcggagaaagaatgtatgaattcttagacaaactcattgcagtttcattaccacgtgtacgtgacttccaaggtgtttctaaaacagcttttgatggtcgtggaaattacacacttggtgttaaagaacaattaattttcccagaaattgactacgataaagtaacaaaagttagaggaatggatattgttatcgtaacaactgctaacactgacgaggaagctcgtgaattgttaacaaacttcggtatgccatttcgtaaataa

SEQ ID NO: 460 - DNA, 807 bp, Staphylococcus epidermidis
atattgcgtatattagttgaaattgcttatcaaggtaaccaatttttaggttttcaaattcagcaacaaggacgaactgttcaacaacaatttgaaaagattcttaaacgaatgcataaacatcatgtacgaattcatccttcaagcagaacagacaggggtgtacatgcgtatcagcaattctttcatttcgataccgaattgaatattgataacaaacaatggcaatatgcgatgaatcgagctttaccagatgatatttacgttaaaaatgtacgaaatgtcgacgagtattttcattgtcgttatgactgcgtaggcaaacgctatcgttacaaagtttatcaaggtaatcatcgaaatccttttaagagtggtactgaaacatttgtttatgaaacattagactatgataaaatgaacaaagctgcgcaagaatttataggtacacatgattttaccggtttttgttcacagaaaacagaagttgaaagcaaagtaagaacactatatcagagcgaaattgttgctactaaagaagggtttgattacgtcgtaacaggttctggattcctttataatatggtccgtgtattggtagctttcttaattgaagtaggaaaaggaaagcatgaacctaatgacgtccctaagctcttagaggacaaaaatagaaataatgtgcctctcacagctccacctgatggattatatttagaaaagatttatttaagcccagaagaattgatacaagaatatggaaaagatataaaaatacactacaaaaaatcgttggaaaaacactaa

SEQ ID NO: 461 - DNA, 1044 bp, Staphylococcus epidermidis
cacaatagcataaactactattataaggatgatgatgatatgaataatgaacaaatagtatttaataaagtaccagacggaatgccacaagacgatacatttaaatatgaagatatagatgttattgaaccttcagaaaatgaattgcaattgaaaacattatatatatcggttgatccatatatgagaggacgtatgacaaatgctgattcttatatagatccgttcaaacaaggggaaccgttcaatggacatacggtatctaaagttttgaaatccaaggatagtaattttgatgaaggtgatatagtagtgggtatgctaccttggagaaaaataaatacagtaaatagtgagtatgttaacaaagtacctacttctgacgtaccattacatctttatcttagtgtgttggggatgcctggtcagactgcttatcatggattacttgatattggacaacctaaagaaggtgaaacagtagttatttcagcagcttcaggtgcagttggttcagttgtgggccaaattgcgaagcttaaaggttgcagagtcgttggtatagctggtggagataaaaaagtgaactatctaaaaaatgaacttcgttttgatgctggtatcgattacaaaaaagataatttccctgaagcgttaaaagaagcggtgcctaacggtatagatgtctacttcgaaaatgtaggtggatatattggcgatgaagtcttcaaacatctcaatacacatgcaagaattcctgtttgtggtgcgatttcatcctataatcatccagaaaaagatattggaccacgcattcagcaaacattgattaaaaatcaagcaatgatgagaggtttcatagtagcagaattcgctgatggttttaaagaagcgagcaaacaattagctcaatgggttcaagagaataaaattaaaacacaagtttcagtagaagatggttttgataaagtgccgcaagcctttagaaatctgctaactggtgataattttggtaaacaagttattaaagtggcaagtgaataa

SEQ ID NO: 462 - DNA, 1236 bp, Staphylococcus epidermidis
tccatattaatgataatgataattattatcaatgaaaaagacaggtggaatttgatggcaaaatatttcttttccagttcttttctgttatttttaggaaattggattggtcaagtgggtttaaattggttcgtactcacaacatatcataatgctgtatatttgggtttagttaatttctgtcgtcttatacctattttactattaagtgtttgggcaggatccatagctgataaatatgacaaagggcttctgttacggatcactattacttcatcattcataattacagcattattgtgtttacttacttatagtcttaacagtataccgattttcatcattcttttatatgcaacatttaggggcatactaagtgctgtagaaactccagtgagacaagcagttttacctgatttatctagtaaaatttctacaactcaagcagtttcttttcattcgttcattattaatatatgccgatcaataggaccagcaatagcaggtggattaatagctgtataccatacacccactacatttttagctcaagcagtgtgctattttatcgcagcagttttatgtatacctattcattttgaagtcatattaagtcaaaaagaaggaaaagcactaccacttaaagttgtactaaattattttaaaagtaatttagaaggtagtcagatattcattacgtctataattattatggcaacaggcttttcttacactacagttttaccagtattaacaaaccatatttttcctggtcaatcgcaagtgtttggtatagctatgactttttgtgcgattggaggaatagttgcaacaatagtcttaccatcaattttaaaacacttgagtacagtaaaaatgtattatctcagttcaatattatttggtatagctttactaggtattatcatacatcatttagtagttatgtttatctgtattacgttaataggcttgtttagtcaatgggctagaacaactaatagagtttattttcaacatagtgtaaaggactgtgatagagggaaagtattaagtattataatgatggatcgaggtatgattccgttaggtagtttaataatgagctttttcgcggatatgttcggtattttaactacatttactattatgggaattagcactatcagtatttcactcattttttatatcatacaacgtatttcgaatatggaggagagcaataatgaatcataa

SEQ ID NO: 463 - DNA, 540 bp, Staphylococcus epidermidis
aatgtgttaataggaggaataaaaatgaaaattgcaataggttgcgatcatattgttactgatacaaaaatggaagtttcacaacacttaaaatcacagggacatgaagtgatagatgttggaacttatgatttcacacgtacacattatccgatttatggaaaaaaggtaggagaaaaagttgcgagtggtgaagcagatttaggtgtatgtatttgtggtactggtgtaggaattagtaatgctgcaaacaaagtaccaggtgttagaactgctttagttagagatatgacatcagcgctttattctaaagaagagttaaacgccaatgttgtaagttttggcggtaaagtagcaggtgaattatttattttcgacatcgttgatgcattcattgaggcagagtacaaacctactgaagaaaataaaaaattaattgctaaaatcaatcatttagaagcacataacaatgaccaagctgatccacatttcttcgacgagttcttagaaaaatggaataaaggtgaatatcacgattaa

SEQ ID NO: 464 - DNA, 879 bp, Staphylococcus epidermidis
agagggctaatgatgaagtcaaaattcacaattctattatttacaatcttttctacaacagtattagttttggttattatttataacaaaactcaatcccaatcatacatttcgactcactattctaataataaaataaaaacaacagcaacactttttttacatggttatggtggtagcgaacgctcagaaacgtttatggtcaaacaagcgttaaataaaaatgtaaccaatgaggtgataaccgctagagtgagtagtgaaggaaaagtatattttgataaaaaattaagtgaagatgcagcaaaccctattgtcaaagtagaatttaaagataataaaactggaaattttaaagaaaatgcttattggattaaagaagttctatcacaactaaaaagtcaatttggaattcaacaatttaattttgtaggacattcaatggggaacatctcatttgctttttacatgaaaaattatggggacgatcgacatttgccacaacttaaaaaggaagttaatatagcgggagtttataacgggattttgaatatgaatgagaacgtgaatgaaattatcgttgataaacaggggaaaccaagtagaatgaatgccgcatatcggcaattgttatcactgtataagatttattgtggtaaggaaatagaagttttaaatatctacggagatttagaagatggctcacattcagatggacgtgtgtcaaatagctcttctcaatcgcttcaatatttactaagaggtagcactaagtcttatcaagaaatgaaatttaaaggtgcaaaggcacaacatagtcaattacatgagaataaagatgttgcaaatgaaatcatacaattcttatgggaaacttaa

SEQ ID NO: 465 - DNA, 576 bp, Staphylococcus epidermidis
agatacaaaattttagatgaagctaaggatttaaacgatttcttaggtattaattattatatgagtgactggatgcgtggttttgaaggcgaatctgaaataacacataatgccactggtgataaaggtggatctaagtatcaacttaaaggtgtaggacaacgtgaatttgatgttgatgttcctagaaccgattgggattggatgatttatccacaaggtttatatgaccaaattatgcgtgtagtaaaagattatccgaattatcataagatttatattactgaaaatggattaggatataaagatgtattcgacgaaaaagaaaaaacagtacatgacgatgcacgaattgactatattaaacagcatctaagtgtgatagcagatgcgattgcagatggtgccaatgttaagggatacttcttatggtctcttatggatgtattttcatggtcaaatggttatgaaaaaagatacggtttattctacgttgattttgaaacacaagaaagattccctaagaaaagtgcatattggtacaaagaacttgcagaaagtaaagaaattaaataa

SEQ ID NO: 466 - DNA, 450 bp, Staphylococcus epidermidis
aggaggaaaataataatgttactaccaaaacgtgtaaaatatcgtcgtcagcatcgtccaaaaacaactggtcgttctaaaggcggtaactacgtaacatttggtgagtatggattacaagctacaactacatcttggatcacatctcgtcaaatcgaatcagctcgtattgcaatgacacgttacatgaaacgtggcgggaaagtttggattaaaatcttccctcatacaccatatactaaaaaacctttagaagtacgtatgggtgctggtaaaggtgcggttgaaggctggatagcagttgttaaacctggtagaattttattcgaagtagctggtgtacctgaagaagttgctcgtgaagcattacgtttagcaagtcacaaacttccagtaaaatctaagtttgtaaaacgtgaagaattgggtggtgaaacaaatgaaagctaa

SEQ ID NO: 467 - DNA, 768 bp, Staphylococcus epidermidis
atgatagaaattgaaaaacctagaattgagacaattgaagttagtgaagatgctaaattcggtaaattcgttgttgaaccacttgaacgtggctatggtactacactaggaaactccttacgtcgtatcctactatcttcattaccaggtgcagccgtaaagtacatcgagattgaaggagttttacacgaattttcagcagtagataatgtagtagaagatgtttcaacaatcattatgaacattaaaaaacttgcattaaaaatttactctgaagaagataaaactttagaaattgatgttaaagatgaaggcgaagtaactgcaagtgacattactcacgacagtgatgttgagattttaaatccagagcttaaaatcgcaacagtgtctaaaggtggacatcttaaagtgcgtcttgttgctaataagggtagaggttacgcattagctgaacaaaataatactagtgatttaccaattggtgtaattcctgttgattcactatattcacctgttgaacgtgtaaactatacagttgaaaatacacgcgtaggtcaaagtagtgattttgataaattaactttagatgtttggacaaatggttcaatcacaccacaagagtcagtatcattagcagctaaaataatgactgaacacttgaatatctttgtaagtctaactgatgaggctcaaaacgctgaaatcatgattgaaaaagaagaagatcaaaaagaaaaagtaattgaaatttctatggaagaataa

SEQ ID NO: 468 - DNA, 408 bp, Staphylococcus epidermidis
aaggaggaaattacattggcacaagttgaatataaaggcacaggccgtcgtaaaaactcagtagcacgtgtacgtttagtacctggcgaaggtaacattactgttaacgaacgtgatgtacgtgactacttaccattcgaatcattaattttagacttaaatcaaccatttgatgttacagaaactaaaggtaactatgatgttttagttaacgtacacggtggtggatttactggacaagctcaagcaatccgacatggaattgcacgtgctttattagaagcagatcctgaatacagaggttctttaaaacgcgctggattacttactcgtgacccacgtatgaaagaacgtaaaaaaccaggtcttaaaaaagcacgtcgttctccacaattctcaaaacgttaa

SEQ ID NO: 469 - DNA, 867 bp, Staphylococcus epidermidis
aaaggagttttatatatgactaagaaattacctgatgactttatttttggtggagcaaccgctgcttatcaagcagaaggagctactcagactgatggtaaagggcgtgtcgcttgggacacgtatttagaggagaattattggtacacagctgaaccagcaagtgatttttataacagatatcctgttgacttggaattaagtgaacgctttggtgtaaatggtatacgtatctcaattgcttggtctcgtatttttcctaaaggttacggtgaagtgaatcaaaaaggtgtcgagtattatcataatcttttcaaagaatgtcataaacgtcatgttgaaccttttgtaacattacatcactttgacacaccagaggtacttcacaaagatggagatttcttaaatcgtaaaacaatagactattttgtagattatgctgaattttgttttaaagaatttccagaagttaagtattggacaacattcaatgaaattgggccgattggtgatggtcaatatttagttggtaaattccctccaggtatcaaatatgactttgaaaaagtattccaatctcatcataatatgatggttgcacacgcacgtgctgttaaactttttaaagatgaaaattataagggagaaataggtgttgtccatgcattacctacaaaatatccatatgatccatctaatcctgaagatgtgagagcagccgaacttgaagacattattcataataaatttattttagatgcaacataccttggtaagtactcacgtgaaacgatggaaggagtacaacacatcttatctgtgaatggtggtcaattagagatttctgatgaagatacaaaattttag

SEQ ID NO: 470 - DNA, 1521 bp, Staphylococcus epidermidis
attgataaatcaaagttcaaaggagagaaatttatgtcagaagaaatgaacgaccaaatgcaagttcgtcgtcaaaaattacaagaattaattgatttagggattgatccttttggtcatcgattcaatcgctcatctacttcaagtgagttaaaagaacagtgggaccaattctctaaggaagaattgcatgaaaaagaagacgaaagccacgtgtcaattgcaggtcgtcttatgactaaacgtggtaaaggtaaagcgggatttgcacatattcaagacttgaaaggtcagattcaaatttatgtaagaaaagatcaagttggagatgatcaatttaacatttggaaaatggctgacttaggtgacatcataggtgttgaaggtgtcatgtttaaaactaatacgggcgagatttctgtcaaagctaagtcatttactttactatccaaatcattacgacctttacctgataagttccatggtttacaagatatagaacaaagatatcgacaacgttatttagatttaattacaaatgaagatagtacgcaaacgtttattaatcgtagtaaaataattcaagaaatgagaaactatttaaataaacaaggattcttggaagtagaaacaccaatgatgcaccaaattgctggaggtgctgctgcacgtccgtttgttacgcatcataacgcattagatgctactctttatatgcgtatagctatagaactacatttgaaacggttaattgtcggaggtcttgaaaaagtctacgagataggcagagtttttcgtaatgaaggtgtatctacaagacataaccctgaatttacaatgattgaattgtatgaagcttatgctgattatcatgatataatggatttaactgaaaatatggtcagacacattgctcaagaagtgtttgggtcagctaaagtacaatataatgatgaagaaattgacttagaatcttcatggaaacgacttcacattgttgatgctgttaaagaagttaccggtgtagatttttataatgttaattctgatgaagaagctattagattagcaaaagaacatgatattgaaattactgaaaatatgaaatatggccatatattaaatgaattttttgaacagaaagttgaagaaacacttattcaaccaacgtttatttatggtcaccctattgaaatttcaccgttagcaaagaaaaatccaaacgatgaaagatttactgatcgttttgaattatttattgtaggaagagagcatgcaaatgccttcacggaattaaacgatccgattgatcaacgccaacgttttgaagcgcagcttgttgaaaaagaacaaggaaatgatgaagctcatgatatggatgaggattacatcgaagcattagagtatggaatgcctccaactggtggtctaggtatcggtatcgacagattagtaatgctattaactgattctccgtcaattagagacgtattactattcccatacatgagacaaaaatag

SEQ ID NO: 471 - DNA, 195 bp, Staphylococcus epidermidis
cgaacaaggtcgagtgacttcaatggaaatgtggcaaaagcaggtacagatatcaaagaaaacgatgaactcattattcgttttggacaaaaattagtcacagttaaagtaacaggattaagcgaccatgctacaaaagaaaatgcaaaaggtatgtatgatttgattaaagaagaacgtattaatgaagagtga

SEQ ID NO: 472 - DNA, 300 bp, Staphylococcus epidermidis; identical to SEQ ID NO: 233

SEQ ID NO: 473 - DNA, 810 bp, Staphylococcus epidermidis
tttaaaatgcccaatgttgtaggtgttcagtttcaaaaagcagggaaattagaatactacgcgccgaatcaattagatgtaaaggttggtgactgggttgttgtccaatctaaaagaggtatagaaattggccacgtaaagtttccattacgtgaagttgatgtagaagatgtcacattaccgctaaaaaatatcattcgtaaaatgaatgaagatgatcaagaaacatattatcgtaatgaacgcgatgccaatgatgcgttagaattatgtaaaaaagtagttaaagatcagcaattagatatgcgattagttaattgtgaatatacattagataaatctaaagtgatttttaattttaccgcagatgatcgcattgattttcgcaaacttgttaaagttttagctcaaaatctaaagactagaatagaattacgtcaaattggggtaagagatgaagcgaaattattgggtggtatcggtccttgtggacgttctttatgttgttctacatttttaggagatttcgaacctgtatccattaaaatggcgaaagatcagaacctatcattaaatccaactaagatttcaggagcttgtggtagattgatgtgttgtcttaaatatgaaaatgactactatgaagaggctcgaactcaattacctgatgttggagatatgattcaaacaccagatggtcacggaaaagtgataggattaaatattttagatatttctatgcaagttaaaatagagggtctagaacaacctttagaatataaaatggaagagatagaagtattgaattaa

SEQ ID NO: 474 - DNA, 615 bp, Staphylococcus epidermidis
gaaatgtctacatttataacgtttgaaggtccagaaggagcaggaaagacctcagtaattaaaaaagtaagcgaaagattagctaaagaatatgatattgttacaacacgtgaacctggtggagtattaactagtgaagaaatacgtcgtattgtacttgatggagatagtatagacattcgaactgaagctatgctgttcgctgcatctagacgtgaacaccttgttgaaaagattatcccatctttacaggcaggtaaaattgtcctttgtgatagatatattgatagttcattggcttatcaaggttatgcaaggggtataggaattaaagaagtaaaattattaaatgaatttgcaattaatggtttgtatccagacttaacgatttatttagatgttgatgcggaaattggtcgtcaaagaattctaaaaaataacagagaacaaaacagattagataaagaggaaaaagcttttcatgaaaaagtgatcgaaggatatcaaaaagtgattagtgataatcctcatcggtttattaaagtcaatgctaaccatagtttggataaagttgttgaagaaacataccaatctatcatcaaatatttaaaataa

SEQ ID NO: 475 - DNA, 321 bp, Staphylococcus epidermidis
gggagcttgactgcgagacctacaagtcgagcagggtcgaaagacggacttagtgatccggtggttccgcatggaagggccatcgctcaacggataaaagctaccccggggataacaggcttatctcccccaagagttcacatcgacggggaggtttggcacctcgatgtcggctcatcgcatcctggggctgtaatctgtcccaagggttgggctgttcgcccattaaagcggtacgcgagctgggttcagaacgtcgtgagaacagttcggtccctatccgtcgtgggcgtaggaaaatttgagaggagctgtccttag

SEQ ID NO: 476 - DNA, 597 bp, Staphylococcus epidermidis
cgtccaacagcatcaatttcatcaataaaaatgatacatggggcatttttcttagcattttcaaataaatcacgaacacgactcgcaccaacaccaacaaacatctcaacgaagtcagatccactaattgagaagaatggtgcaccagcttcacctgcaaccgcacgtgctaataatgttttacctgtacctggaggcccaacaagtaagacaccttttggaattcttgaacccatttgtttaaatttcttgttatcttttaagaaatctacaatttctattaattcttgtttctcttcgtcagctcctgctacatctgagaaacgaactcgacgtttattactgtcgtacatcttagctttggattttccaaagttcatcatacgaccaccgccgccgccaccttgggcttggctaaggaagaaaataaataataatgcaatgattaatacaggaatcagtgtcgttaaaatactaacgaatacactttgtttttcttcttctttaactgtaaatttaagattatcttgtttcttagctgtatctgtgattttttgtaaatctttttcattgttatataaaattgtcgatgagtaa

SEQ ID NO: 477 - DNA, 480 bp, Staphylococcus epidermidis
atggttaaagcttatttaggattagggagcaatattggaaatagagaactacaactcaatgaggctattaaaatacttcatgactatcaaggtattcaagtaactcaagtttctcatatttatgagactgaaccagtgggatatactaatcaaccgaaattcttaaacttgtgcattgagatagagactgaattgaatccacaatctttgttaaaatgttgtttaacaacggaacaacaacttcatcgtaaaagagaaatacgttgggggcctagaactttagatatagatatactactgtttggtgatcaaattattgaacaagataatttatcagtgccgcaccctagaatgaaagaacgttcgtttgttcttatcccgttaaatgatatagccaccaaacaaatagaaccgatttctaataaaagtatcggacaactagtagtacctgataatagtgtgaaaaaatataaggaataa

SEQ ID NO: 478 - DNA, 210 bp, Staphylococcus epidermidis
tttatcaatttattgttccatgtctttctgttgaaaactttaggagctatatattgtttcctaatcagttttaatttatatttaagccttttattatacccttcttatcttcatatgtattgttattcaatgaaggttgatattgcatctaatcaaagcaaatctactcactttattattctacaagaccatcaaaatgtaataaagtaa

SEQ ID NO: 479 - DNA, 1386 bp, Staphylococcus epidermidis
agtgtaaattttaatggagggttagcattcatgcaaagacatgcgattattctggcagcaggtaagggcacaagaatgaaatcaaagaaatataaagtgctccatgaggttgctggcaaaccaatggttgaacatgtgcttaacaacgtaaaacaagctggcgttgatcaaattgtaactattattggtcatggcgctgagagtgtgaaagatacattgggtaatcaatcattatatagttttcaggataaacaacttggaacagctcatgctgtgaaaatggcacatgaacatttagcagataaagaaggaactactctagtagtatgtggagatacaccacttattacataccaaactttacaatcacttattgaacatcatgaaagtacacaatcacatgttactgtattatctgcttctactatcaatccttatggttatggacgaattattagaaatcataatggaatattagagcgtattgttgaagagaaagacgcaaatgactcagaacgtgcgattaaagaaattagttcaggtatttttgcctttaataatcgagtactatttgagaagttagaacaagttaaaaatgataatgctcaaggagaatattatttacctgatgttttgtctttaattttaaaagacggaggtaaagctgaagtttattgtaccgaagattttgatgaaatcattggtgttaatgatcgtttgatgttaagtgaagctgaaaaggctttgcaacaacgtatcaatcgctatcatatggaaaatggtgtgacaatcattgatcctagttcaacatttattggaacagatgtgaaaattggaatagatacaactattgaaccgggcgtgcgcatcggaggtcatacaacgattgaagaagatgtgtggataggccaatactctgaaattaataatagcacaattcattcgaatgctaacataaaacaatcggttatcaatgactctattgttggagagaacacaacagttggacctttcgctcaactacgcccaggatctaatttaggttctgaagttaaagtaggaaactttgttgaagtgaagaaagcagatattaaagatggtgctaaagtatcacacttgagctacattggagatgctgaaataggtgagcgtacaaatatcggatgtggttctatcactgtaaactatgacggcgctaacaaatttaaaacaatagtaggtaaagatgcttttataggatgtaatacgaaccttatagcacctgtaacagtaggtaatcatactcttattgcagctggatccacaattacagataatatccctgaagatagtttagcattagcgcgtgcaagacaagtaaataaagagggctacctaaaaaaatag

SEQ ID NO: 480 - DNA, 897 bp, Staphylococcus epidermidis
aaaggagatttaacaatgacacatgattatatagtgagaggtttagcatacggtggggaaataagagcatatgctgcaatcacaacagagtcagtacaagaagcacaaacacgtcattatacatggcctactgcttctgccgctatgggaagaactatgacagctactgttatgatgggtgcaatgttaaaaggaaatcaaaagttaacagttactgttgatggcaaaggtccaattggcagaattattgctgacgcagatgctcaaggaaatgttcgtgcatatgtagaccatccacaaacgcattttccactcaacgatcaaggtaaattggatgtacggcgagcagttggtactgatggttccattcaggttgttaaagatgttggaatgaaagactacttttctggtgcgagtccaatagtatcaggtgagctaggagatgatttcacatactactatgccacaagtgaacaaacaccatcatcagtaggattgggtgtattagttaatccagacaactcaatcaaagcagcgggaggatttattattcaagttatgccaggtgctactgatgaaacggtgactaaattagaagaagccattagtcaaatgcaacctgtatcgaaattaattgagcaaggacttacacctgaaggaatattaaatgaaattttgggtgaaggtaatgttcaaattttaaattcaacgtcagcgcaatttgaatgtaattgtagtcatgagaaatttttaaatgctattaaaggtttaggagaggcagaaattcatagcatgattaaagaggatcatggagctgaagctgtatgtcacttctgtggtaataaatatcagtatagtgaaagtgaattagaagatttattagaaacaatgaaatag

SEQ ID NO: 481 - DNA, 546 bp, Staphylococcus epidermidis
attataatgcataaggatttaaagaatgttttgttatcggaagaagacattcaaaatatttgtaaagagatgggagctatcattactgaggattataaagatcgcccactcgtttgtgttggtattttgaagggatcagtcatgtttatggcagacttaattaaacgtattgatacacatttatcaatcgattttatggatgtttcaagttatcatggtggaacggaatcgactggggaagttcaaatattgaaagatttaggtgcttctatagaaaataaagacgtacttataattgaagatatattagaaactggtacaactttaaaatctattacagagttattgcaatcacgtaaagttaactctttagaaatagctacattattagataaacctaaccgtcgcaaagctgatatcgaagcaaaatatgttggtaaaaagattccagatgaatttgtagttggttatggtttagattatcgtgagttatatagaaatctgccatacataggcacactaaaagcagaagtttattctaaatag

SEQ ID NO: 482 - DNA, 417 bp, Staphylococcus epidermidis
tctcaatttaatattcacgtaacagatgaatggataattcaaattgcatatgataaattaataataatggctaaaagtgaaatggatcaatatatattagaccgtatatgtattagaaagccaggtacatatgaatttaatgattatcaaattgatattcatcctgacttaccacaacagttatatccgcttactgtgcgtgtccgacaaaatggagatgtgtataaattaaatggtcaaaaaggtcataaaaaagtgagtcgtttatttatcgataaaaaagtgactcttgctgaacgtcagcgcatcccactcattattaatcaagaaaatgcagtgttagctattggcgatttatatgttaaagaaaattttaaagaatttattttgatttcgaataatggagatgaattataa

SEQ ID NO: 483 - DNA, 891 bp, Staphylococcus epidermidis
atggaatataaagatatagcaacaccatctcgaacacgtgctttgcttgatcaatatgggtttaattttaagaaaagtttaggacaaaattttctaatagatgtaaatatcattaataaaattatcgaagcgagtcatatagattgtacaacgggtgtaattgaagttggaccaggtatgggatcattgactgaacaacttgcaaagaatgctaagaaggtgatggcttttgaaattgatcaaagattaatacctgtgcttaaagatacactttcaccatacgataatgtaacaattatcaatgaagatatacttaaagctgatattgctaaagctgtagatacacatctacaagattgtgacaagattatggttgttgctaatttaccgtattatattaccacacctattttacttaatttgatgcaacaggatgtacctattgatggttttgtcgtaatgatgcaaaaagaggtaggagaacgtttgaacgctcaagtaggtaccaaagcatacggttcgttatcgattgttgctcaatactatacggagacaagtaaagttttaacagttcctaaaactgtatttatgcctcctccaaacgttgattctatcgttgtaaaattgatgcaacgccaagaaccacttgtacaggttgatgatgaggaaggcttttttaagttagcaaaggccgcttttgcacaacgacgtaaaacaattaataataactaccaaaacttctttaaagatggtaagaagaataaagaaactatacgacagtggctagaaagcgctggtattgatcctaaaagacgtggagaaacactcacgattcaagatttcgccacattatatgaacaaaagaaaaaattctccgaattaacaaattaa

SEQ ID NO: 484 - DNA, 966 bp, Staphylococcus epidermidis
atgttaaataatgaatataagaattcatcaatgaagatcttttcgcttaaaggaaatgaacctttggcacaagaagtagcagatcatgtagggattgaattaggtaaatgttctgtaaaacgttttagtgatggagaaattcaaataaatattgaagaaagcattcgtggttgtgatgtttttattgttcaaccaacttcatacccagtcaatcttcatttaatggagttacttattatgattgatgcgtgtaaacgcgcgtcagcagcaaatattaacatcgtagtaccatactatggttacgctcgacaagatagaaaagcccgtagtcgtgaacctattactgctaaattagtagctaatttaatcgaaacagcaggtgccaatcgtatgatcgcattagacttacatgcacctcagatccaaggattcttcgatattcctattgatcatttaatgggtgttcctatccttgcacaacactttgagaatgatcctgatattaatccagaagaatgtgtagttgtgtcccctgaccatggtggggtaacacgagctcgtaaattagccgacattttaaaaactccaattgcaattatcgacaaaagacgtccgaaaccgaatgtggcagaagttatgaacattgtgggtgatattgaaggacgtactgcaattattatagatgacattattgatactgcaggaacaattactttagctgctcaagctttaaaagataaaggtgctaaagaagtctatgcttgctgtacacatccagtgctttctgggccagcgaaagaacgaattgaaaactctgcaatcaagcaacttatagtaacaaactcaattcaattagaagagaatagaaaacctaataatacaaaagaactttctgtagctggtttaattgcgaaagcaattattcgtgtatacgaaagagaatcagtaagtgtattatttgactaa

SEQ ID NO: 485 - DNA, 357 bp, Staphylococcus epidermidis
tataatgataaaaagaggtgtataaaaatgaaaatgattatagcgatcgttcaagatcaagatagtcaagagctttcagaccaactcgtaaaaaacaatttcagagctacaaagttagcaactactggtggatttttaagagcaggcaatacaactttcttatgtggggttaaggatgaccgtgtcgacgaggttctatctgtcattgataatacttgtggtaatagagaccaacttgtttcaccaataacaccaatgggtggtagtgcagattcatatattccttatccagttgaagttgaagtaggtggcgcgacagtatttgtaatgccgattgaagcatttcatcaattctag

SEQ ID NO: 486 - DNA, 882 bp, Staphylococcus epidermidis
atgaatatcaaaacagatggttggtctaaaaaagcacatattgttgtggctgtctcaacaggcattgatagtatgagtttattatatagcttattaaacgactatcaacatacatatcgtaaattaacatgtgttcatgttaaccacggattgcgtgaacagtcatatgaagaagaagcgtttttgagagagtattgccatcaacatcatattgacatttatataaagcgtttagacttaagtgatattgtagcagacggtaatagtattcaacaagaagcgcgtcaacgtcgttatgaatggtttggagatatcatagctcaattaagagcagatgtattgttaacagctcatcatcttgatgatcaacttgaaacgattatatatcgtttgtttacagggagatcaacacgtaattcattaggtatgacatacgagtcgtattttaatcaatacaaagtgtatcgtcctatgttaaatttaaaaaaaactgaaatattagcgtatcagtatgcgaaccaaattccatactatgaggacatgtctaatcaagatagaaaatatgttagaaatgacattagacaacgcatcatacctgcaattaacgagaacccgcatttaaacgcgcatcagctactcaaacttaaggattggcatgatattgaattgcaatcgttaaaagaacaagctgaaacgttcatcaataacgaagtttcaaaaagtaaatatttaacctattccttttctagaactgcttttaatgaattgaatgtgaatatcaaaagcgtagttatggatttgttattccaaaaattagattgtcatttagcaatgccacaacatgcttatgacgagtgttttgaacagattagaaatgaataa

SEQ ID NO: 487 - DNA, 408 bp, Staphylococcus epidermidis
caagcaatgaataaaaaagtagaacatatcggtaaccaatatacgtcacaagaaaataagaaaaaacaacgacaaaaaatgaaaatgcgtgttgtacgtagacgtattgctttattcggaggtattcttttagcgattatcctcattctacttgtattgcttgtcattcaaagacataataacgatcaagatgcagttgaaaggaaagagaaagaaactgagtttcaaaaacaacaagatgaagaaattgctttaaaagagaaacttaataatttaaatgataaagactatatcgagaaaatagcgagagacgattattatttaagtaataaaggtgaagtcatttttagattacctgatgataaaaaatcctctcagtcaaagacttcaaacgaaaaaggcaattag

SEQ ID NO: 488 - DNA, 378 bp, Staphylococcus epidermidis
aggagaatgaatatgaacgacatcatctttcttaatggaatgcgtttttatggttatcatggagtattagctgcagaaaatgatattggacaaatttttgttgttgatattactttaaaggttgatcttagttatgcaggtcaatcagatgatgtaaaagatactgtaaattatggagaggtttataaagatgtaaagtctattgttgaagggccacgttcatgcttaattgagcatctggctgaacgtattgcaaaacatataaattcacactataatcgtgtaatggaaacgaaagttagaatcactaaagaaaacccacctattcctggtcattacgatggtgttgggattgaaatagtgagggagaatgactaa

SEQ ID NO: 489 - DNA, 1881 bp, Staphylococcus epidermidis
agtcaagtgaaatcaatgattgcaaattacattagcgaagataatcgttttcaagaattagatgaagtcttcggccaagagaatattttagttacgggattatccccgtcagcgaaggcaacaattattgctgaaaaatatttaaaagatcataaacaaatgctactcgtaactaataatttataccaagcagataaaatcgaaactgacattttacaatatgtagatgactcagaagtttataaatatcctgttcaagatataatgactgaagagttttctactcaaagtccacaattgatgagtgagcgtgttagaacgttgactgcgttagcccaaggcgaaaaagggttatttattgtgcctttaaacggctttaaaaaatggctaacaccggttgatttatggaaagatcatcaaatgacgcttaaagtaggtcaggatattgatgttgatgcgttcttaaataaattagttaatatgggttatcgtcgagaaagtgtagtgtcacatattggtgagttttcattgcgtggtggaatcatagatatatatccgttgataggaacacctgtgagaatagagctatttgatactgaagttgattccatcagagactttgatgtagaaacacaacgttctaacgataatataaatcaagttgaaatcacaacagctagtgactacattattactgatgaagtgatacaacacttacaaaatgaacttaaaaaagcatatgaatatacacgccctaaaattgaaaagtccgtacgtaatgatttaaaagagacatatgaaagttttaagttgtttgaatctacctttttcgatcatcaattgttacgacgtcttgtttcatttatgtatgaaaaaccatcaacccttattgactattttcaaaaaaacgcgattattgtagttgatgagtttaatcgtattaaggaaacagaagaaacacttacaacagaagttgaagattttatgagtaacttaattgagagtggaaatggatttatcggacaaggatttatgaagtatgaaagttttgacgcattattagagcaacatgccgttgcatatttcacattatttacatcttcgatgcaagtaccattacaacatattattaagttctcttgtaaaccagttcaacaattttatggtcaatatgacattatgcgctcggaatttcaaagatacgtgcatcaagattacactgtcgtagttcttgttgaaactgaaacaaaagttgaacgtattcaatcaatgcttaatgaaatgcatattccaacagtatcaaatattcacgaagatattgatggtggtcaagttgtagtgacggaaggtagtctttctgaaggctttgaattaccttatatgcagttggtagtcatcacagaaagagaattatttaaaacaagacaaaagaaacaacgtaaacgaacaaaaacgatttctaatgctgaaaaaataaaatcatatcaagacctaaatgtgggcgattatatagtgcatgtgcatcatggtgtcggacgatacttaggtgtcgaaacactagaagttggagatacacatcgcgactatattaaattgcaatataaaggaactgatcaattattcgttccagttgatcaaatggatcaagttcaaaagtatgtggcttctgaagataagtcgcctagattaaataaattaggcgggacagaatggaaaaaaacaaaggcgaaagttcaacaaagtgttgaagatatagctgatgaattaattgatttgtataaagcacgtgaaatgtctgtaggttatcaatacgtcctagatactgcagagcaatcagcatttgagcatgattttccatatgaattaacacccgatcaatag

SEQ ID NO: 490 - DNA, 2106 bp, Staphylococcus epidermidis
cgcatgcagaaagcttttcgcaatgtgctagttatcgcaattattggcgttattatatttggcctcttttcatttttaaatggaaatgggaatatgccaaaacaacttacatatactcagtttgttaataagttgaataaaggcgatttaaaaactttagaaattcaaccagagcaaaacgtatatatggtaagtggtaaaacaaaaaaagatgaagattactcatcgacaattttatataacaatgaaaaagatttacaaaaaatcacagatacagctaagaaacaagataatcttaaatttacagttaaagaagaagaaaaacaaagtgtattcgttagtattttaacgacactgattcctgtattaatcattgcattattatttattttcttccttagccaagcccaaggtggcggcggcggtggtcgtatgatgaactttggaaaatccaaagctaagatgtacgacagtaataaacgtcgagttcgtttctcagatgtagcaggagctgacgaagagaaacaagaattaatagaaattgtagatttcttaaaagataacaagaaatttaaacaaatgggttcaagaattccaaaaggtgtcttacttgttgggcctccaggtacaggtaaaacattattagcacgtgcggttgcaggtgaagctggtgcaccattcttctcaattagtggatctgacttcgttgagatgtttgttggtgttggtgcgagtcgtgttcgtgatttatttgaaaatgctaagaaaaatgccccatgtatcatttttattgatgaaattgatgctgttggacgtcaacgtggtgcaggtgtaggtggcggtcatgatgagcgtgaacaaacattaaaccaactattagttgagatggatggttttggagaaaatgaaggtattattatgattgcggctacaaaccgcccagatatcttagaccctgcattgttacgtcctggtcgttttgatagacaaattcaagttggacgaccagatgttaaaggtcgtgaagcaattcttcatgtgcatgcgaaaaataaacctcttgatgaaacagtagatttaaaagctatttctcaaagaacgccaggtttttctggtgcagacttagaaaacttgctaaatgaggcatctttaattgcagcacgtgagggtaaaaataaaattgatatgcgcgatattgaagaagcaactgaccgtgttattgcaggtccagctaaaaaatctcgtgtaatttctgaaaaagaacgtaatattgtagcgcatcacgaagcaggtcatactatcatcggtatggtgcttgatgaagctgaaattgtacacaaggtaacaattgtccctcgtggacaagcaggcggttatgcaatgatgttaccaaaacaagatcgcttcttaatgacagaaccagaattactcgacaaaatatgtggtttattaggtggacgagtatctgaggatattaactttggtgaagtatcaacaggtgcttcgaatgactttgaacgagcaacgcaaattgcaagatctatggttacagaatatggtatgagtaagaaattaggaccattacaattctcaagcaatagtggtggacaagtattccttggtaaagatatgcaaggtgagccgaattattctggtcaaattgcttatgaaattgacaaagaagttcaacgaattgttaaagagcaatatgaacgttgtaaacaaatcttgttagaacatgaagaacaacttaagttaattgctaaaacactactttcagaagaaacattagttgcagaacaaattcaatcattattctatgatggtgttttaccagaagtagattatgactctgcaaaagttgtgaaaaatgaaaatagtgattatagtgatggaaagtatggaaaatcatacaacgacattcgtaaagaacagttagaagatgacgataaagaagatgatgacaaccatgaaaaagatgaagtaaaccaagacaacacagacagagaagctgataatacttcacatacgaatgaaccaggtcatcaacaatctccgaacatcgataaaccatacaatcctaacgatccaaatcatagacaatag

SEQ ID NO: 491 - DNA, 729 bp, Staphylococcus epidermidis
tgggtaagtgaggagcaggttagacgtatccaatgtctaaacctcgaaattcgaaaggtggaaatacgaatggcttcattaaagtcaatcattcgtcaaggtaaacaaacacgttctgacctaaaacaattaagaaactcaggtaaagtacctgcagttgtatatggttacggtacaaaaaatacttcagttaaagttgatgaagttgaatttatcaaagtaatccgtgaagtaggacgtaatggtgttattgatttaggcgtaggttctaaaacaattaaagtaatggtttcagattatcaatttgatccattaaaaaaccaaatcactcatattgactttttagcaatcaacatgagtgaagaacgtactgttgaagtacaagttcaattagttggtgaagctgtaggtgctaaagaaggcggcgtagttgaacaaccattattcaacttagaagttacagctacacctgaaaatattcctgaaactatcgaagtagatatcagtgaattacaagttaatgacagcttagcagtttctgatattaaaatctctggtgatttcacaatcgaaaataatccagaagattctatcgtaacagtagttcctccaacagatgaaccttctgaagaagaagttgaagctatggaaggcgaatcagcaactgaagaaccagaagttgttggtgaagacaaagaagacgatgaagaagaaaataaagaagactaa

SEQ ID NO: 492 - DNA, 855 bp, Staphylococcus epidermidis
tacaggagggataacatgacaactttatatttagtaggaacaccaattggaaatcttggtgatattacatttcgagctatagaaacattaaaaaaagttgatgtgattgcatgtgaagatacacgtgtaacacggaaattgtgtaatcattatgaaatacaaacacctctaaagtcgtatcatgaacataataaagaacaacaaactgactatttaatcaagcagttacaaactggcttaaatatagcgttagtatcagatgctgggttgccattaattagtgatccaggatatgaattggttgtcgaagcacgtaaaaataatataaatatagaaacagtaccaggtcctaatgctgggttgactgcacttatgtcaagtggattaccatctttcacatacacatttttaggttttttgccaagaaaagaaaaagaaaaaattgaagtgcttgaggatagaatgtttcaaaatagtactttaatactttatgaatcgccttatagggttactgatactttgaaagcaatagctaaaatagattcacaaagatggattactgttggtagagagctaacgaagaaatttgaacaagttcttacacttacagttgatgatatgttgaaattgattaatcatgacaaattacctcttaaaggtgagtttgtgatactgattgaaggtgcattacctaagagtggtgaatcatggtttgaaagctatacggttaaagaacatgttgattattatattgaaaccaaacatgttaaacctaaaaaagcaattaaatttgtcgctacagatcgacatatgaagacgggtgacatatataatatttatcataatattgattaa

SEQ ID NO: 493 - DNA, 960 bp, Staphylococcus epidermidis
attgtaaaactaaaaggagtgttttggatggcacaaaaacctgtagattatgttacacaaattattgggaatacacctgtagtcaaattaagaaacgttgttgatgatgatgcagctgatatttatgttaagttagaatatcaaaatccaggtggttcggtaaaagatcgtatcgctttagcgatgattgaaaaagctgagcgtgaagggaaaattaaacctggtgatacaatcgttgagcctacgagtggtaacactggtataggtctagcatttgtatgtgctgccaaggggtacaaagcagtttttacaatgcctgaaacaatgagccaagagcgccgtaacttattaaaagcttatggtgctgaactagtattaacaccaggatctgaagctatgaaaggtgcaataaaaaaagctaaagaattaaaagaagagcacggctattttgaaccacaacaattcgaaaatccagcaaatcctgaaattcatgaacttacaactggaccagaattagttgaacaatttgaaggtcgacaaattgatgcatttttagctggtgtaggaactggtggtacgttatctggtgttggtaaagtattgaagaaagaatatccaaatgtggaaatagtagctattgaacctgaagcttctccagtattaagcggtggtgaaccaggccctcataaattacaaggattgggagcaggtttcgtacctgatactttaaatacagaagtttatgacagcatcatcaaagtaggtaatgatactgctatggatatggcacgtcgtgttgctagagaagaaggtatattagcaggtatttcatctggtgctgcaatatatgctgctattcaaaaagcaaaagaattaggtaaaggtaaaacagttgtaacagtattaccaagtaatggggaacgttacttatcaacaccattatattcatttgataattaa

SEQ ID NO: 494 - DNA, 351 bp, Staphylococcus epidermidis
cctttgaatcgaaacgaattattcgaaagacttatgaaattagaacatcacgttgaacaacttacaaccgacatgtcagaacttaaagatttaacagtcgaacttgttgaggagaatgttgctttgcaagttgaaaatgaaaatttaaaacgattgatgaacaaaactgaagaatcggttgaaactcacttagataaagataattataagcatgtaaaaacaccatctccaagtaaagataatttagcaatgttatatcgtgaaggttttcatatttgtaagggtgaattattcgggaaacatcgtcatggtgaagattgcttattatgccttaatgtgttgagtgattaa

SEQ ID NO: 495 - DNA, 189 bp, Staphylococcus epidermidis
caactaaagcgaatcacttttggatattacaaaaattggacttattcaaatggttattcgtttaatttaaatgaattgtgtattaataataaacgtaagttgcataatctcatgaaaatgggaataaataaagactacaataacaaagagtctgaacatatattcaatgtccagactcaccttaaataa

SEQ ID NO: 496 - DNA, 867 bp, Staphylococcus epidermidis
agtttacttagtaagattattaggatagaagggtttgaaaagatgagatataaaagaagcgaacgtattgtatttatgacacaatacttcatgaaccacccaaataagttgatacccctcacttattttgtaaagaaatttaaacaagcaaaatcgtcaattagtgaagacgttcaaatcattaaaaatacgtttcaaaatgaaaaattaggaactattattactacagcaggtgctagcggtggagtaacctataagcctatgatgagtaaatcagaggccacagaggttgttgatgaggtgatagagcaattacaagagaaagaccgtttgctacctggaggatatttatttttatccgatttagttggtaatccttctctattaaataaagtaggtaagttaattgctagtatatatatgaacgaagaacttgatgctgttgttaccatagcgactaaagggatatcacttgcgaatgcagtcgcaaacgtattaaatttacctgtagtggttataagaaaggacaataaagttacagaaggttctacggtttcaatcaattatgtttcaggatcatctagaaaaatagaaacaatggtgttatcgaaacgaactttagctgagaattctaatgtcctcgtagtagacgattttatgagggctggtggctcaattaatggagtaatgaatttaatgaatgagtttaaagcccatgtaaaaggggtatcagtacttgtagaatcaaaagaagtaaaacaaagattaattgaagattatacttccttagtcagattgtcagatgtcgacgagtacaaccaagaatttaaagtggaaccaggcaacagtttgtctaaattttcttaa

SEQ ID NO: 497 - DNA, 333 bp, Staphylococcus epidermidis
agatatactaggggggctcactacatgaaagtgacagatgtaagacttagaaaaatacaaacagacggcagaatgaaagcactcgtttccattacgctagatgaagcttttgtaattcatgatttacgtgtaattgaaggaaactcaggtcttttcgtcgcaatgccaagtaaacgtacaccagatggtgaattccgtgacatcgcgcatcctatcaattctgatatgagacaagaaatccaagatgcagtgatgaaagtatatgatgaaactgatgaagttattccagacaaaaatgctacttcagataacgaagaatcagacgaagcttaa

SEQ ID NO: 498 - DNA, 207 bp, Staphylococcus epidermidis; identical to SEQ ID NO: 239

SEQ ID NO: 499 - DNA, 798 bp, Staphylococcus epidermidis
tataatctaaggataggagagataatgatgttaatcgatacgcatgtacatttaaatgatgaacaatatgatgaggatttaaatgaagtgatatctcgtgcgagagaagcaggcgtagatagaatgtgtgtagtaggttttgatacacctactattgaacgtactatggagctaatagataagtatgactttatctatggtattatcggttggcatcctgttgatgcaatagattgtactgatgaaagattggaatggatagaaagtctttctaaacatcctaaaattattggtattggtgagatggggttagattatcattgggataaatcaccttctgatgtacaaaaagaggtatttaaaaagcaaattacattagctaaacgtgttcaattacctattattattcataatcgtgaagcgactcaagattgcatagatattttgattgaagaacatgcagaagaagtgggcggaataatgcatagttttagtgcttcacctgaaattgctgatgtcgtgattaataaattgaacttctatgtttcgcttggaggacccgtcactttcaaaaatgcaaaacaaccaaaagaagttgctaaacacgtaccaatggatcgtttgttatgcgagacagatgccccgtatctatccccgcacccttatagaggtaaacgtaatgaaccagaacgtgttactttagtagcacaacaaattgcagatttgcgtggtatgacttatgaagaggtctgtcgccaaacaaccgaaaatgctgaacgtttattcaatttgaattaa

SEQ ID NO: 500 - DNA, 285 bp, Staphylococcus epidermidis
tgtgtagtgaggtggggcaatatgccaaaatcaattttggacatcaaaaattctattgattgtcatttaggaaatcgtattgtacttaaagccaatggtggacgtaaaaagacaattgaacgatcaggggttttaaaagaaacatatccatctgtttttattgtcgaattagatcaagataaacacaactttgaacgcgtatcttatacatacactgatgtgcttacagaaaatgtacaagtttcatttgaagaagataatcatcaagaagcagttgcacactaa

SEQ ID NO: 501 - DNA, 1608 bp, Staphylococcus epidermidis
catggaaagagcaagactatggaccgtcttctttgtggtgatgtgggatatggtaaaactgaagtggctgtccgcgcagcgtttaaagctgtcatggatggtaagcaagttgcgtttttagtaccaacaacgattcttgcacaacaacactacgaaacactacttgaacgtatgcaagattttccggtcgaaattcaattggtaagtcgattccgcacagctaaagaaataagggaaactaaagaagggctcaaatcaggatatgttgacattgtcgtaggtacacataaattattaggtaaagatattcaatataaagatttgggattgcttattgttgatgaagaacaacgttttggagtgcgacataaagaacgcattaaaactttgaaaaaaaacgttgatgtactgacgcttactgcaacaccaataccaagaacattgcatatgagtatgttaggtgtacgtgacttatcagtgattgaaacaccacctgaaaatcgttttcctgtacaaacttatgtcttagaacagaatacgaactttattaaagaggcattagagcgtgaattatctcgcgatggacaagtattttatttgtataacaaagtgcagtctatttatgaaaaaagagaacaacttcaaatgttaatgcctgacgctaacattgctgtagcacatggccaaatgactgaacgtgatttagaggaaacaatgttaagctttattaatcacgagtacgatattttagtaacgactacaattattgaaacaggtgtagatgtaccaaatgctaatactttaatcatagaagaggctgatcgttttggtttaagccagctataccaattaagaggacgtgtaggacgttcaagtagaattggttacgcttatttcttacatccagctaacaaagtgttaaatgagactgctgaagagcgattgcaagctattaaggagtttaccgaactaggttcaggttttaaaatcgctatgcgagatttaaatattcgtggtgcaggcaatttactcggtaagcaacaacatggctttattgattcggttggtttcgatttatactctcaaatgttagaagaagcagtaaacgaaaaacgtggcattaaagaaagatcgccggatgcaccagatattgaagttgaattgcacttagatgcttatttaccagctgaatatatacaaagtgaacaggctaaaattgagatttataaaaaacttcgaaaagtagaaacagaagaacaacttttcgatgtcaaagatgaattaatagatcgttttaatgattatccaattgaagtcgaacgattattagacattgttgaaatcaaagtccacgctctacatgcgggtgtcgaattgataaaagacaaaggcaaatctatacaaatcattttatcacctaaagcgactgaagatattaatggagaagaattgtttaaacagacgcaacctcttggtagagcaatgaaagttggcgtgcaaaataatgcaatgaatgtaacgctaacaaaatcaaaacaatggttagatagtttgaaattcttagttagatgtattgaagaaagtatggcgattaaagatgaagactaa

SEQ ID NO: 502 - DNA, 972 bp, Staphylococcus epidermidis
gtagtctttttacataatgaatatcataaagggagtaagtcgcttatggatgaacaacaacagttagctaacgcatatcattctaacaaattgtcacatgcatatttgtttgagggtgatgatgcacaaacgatgaaacgtgtcgcaatccattttactaaattaattctttgtaataatagtaatcaatgcgaactgaaagttgatacttttaatcatcctgacttttcatatgtgtcttctgatgaaaatacaattaaaaaagaacaaattgaacaacttgttcatcatatgaaccaactacctattgagggtcaatataaagtatatattattgaggattttgaaaaattaactgttcaaggggaaaatagtatactaaaatttttagaagagccccctgataatacaattgcgatacttttatcaacgaaaccggaacaaatattagacactatacattcaagatgtcagcatgtatattttaagcctattgataagcggcagtttatagagcgtttagtagagatgtcaatagcaagaccggtagcagaaatgctaagtacctatacaactcaaatagaagcagcatcgtcgttaaatgaggaatttgatttagttactttaagaaaatcaatcatcagatggtgtcaattaatattatctaataaagctatggctcttataggtgtcattgagttattaaaacaagctaagaatcgtaaattacaattacttactttatcagccgtcaatggctttttcgaagatataatgcatgcaaagatagaaatggataattattatacatttagtgatttaactgaagaaattgaaaattatgcaaatcaattaacttttaatcaattaatcctcatgtatgatcagattactgaagcgcataaaaagttaaatcaaaatgttaatccaacacttgtttttgaacaaatagtaataaaaggtgtgatttaa

SEQ ID NO: 503 - DNA, 261 bp, Staphylococcus epidermidis
aaggtgtttattatggataaacattttgtttatattgttaaatgtaatgacggaagtttatatacaggctatgctaaagatgtaaatgcacgcgtaataaagcataataacggtaagggtgctaaatatacaaaaataagacggccggtagagttagtttatcaagaaacatatacaacgaaatcggaagcattgaaacgtgaatatgaaattaaaacatatactagacaacaaaagttaaaaatgatacaggagggataa

SEQ ID NO: 504 - DNA, 186 bp, Staphylococcus epidermidis
ttggttattatacatctcttattggctaatatgaaatctattgctcatacatgtttattgagtattataaccatgagagatgataacaatatttttaccaaaagtttaaaaatgtattggtataaactatacataaaaaagtcccttttcactcaattcatacgtgagcaaaaagagacttactaa

SEQ ID NO: 505 - DNA, 846 bp, Staphylococcus epidermidis
gagtatattattgaaaaaggtgaaattatgattaaaacaaaaataatggggatattaaatgtgacacctgactcattttctgacggaggacagtaccactcagttgatcaagctgtgaagcgtgctaaagagatgatagatgaaggtgtagacatcatagacgttggaggtgtctcaacacgaccaggtcataaagaagtatcgcataaagaagtatcgcttaaagaagaaatgaatcgtgtattgcctgtggttgagtctatcgttaaatatgatgtgcaaatttcggttgatacatttcgaagtgaagttgcggaagcttgtcttaaacttggtgtttcaatgattaatgatcagtgggcaggcctatttgattcgaatatgtttaatgtggtatctcaatacggtgctgaaattgtacttatgcataatggtgacggtcatagagataaacctgttgttgaagagatgcttgtatcattacttgcgcaagcgaataaggctgaactagccggtataccacataataaaatctggttagatcctggaataggttttgctaaaacacgagaagaagaaaatgaagtaatggcaagattagatgaattagtagcgaccgaatatccagttttacttggaacaagtcgaaaaagatacattaaagaaatgatgaatcaagattcttctccttcagatagagatgaggcaactgcagctacaacggcttatggtataatgaaaggcgttcgtggggttcgagttcataatgtattattaaatacgcgactagcccaaagtatggattttctaaaggagaatgaatatgaacgacatcatctttcttaa

SEQ ID NO: 506 - DNA, 606 bp, Staphylococcus epidermidis
agatacataatattaatagtggaggtaacaataatgaaatgcattgtcggtcttggcaacattggtaaacgttttgaattaacaagacataatattggtttcgaagttgtcgatgatattctagaacgccaccaatttactttagacaaacaaaaatttaaaggtgcatatactattgaacgtttaaacggcgaaaaagtattatttattgagccaatgaccatgatgaacttatctggtcaagctgtagcccctttaatggattattataatgtcgatgttgaagatttgatcgttttatatgatgatttagatttagaacaaggacaagtgcgtctgcgccaaaaggggagtgcaggcggtcataatggtatgaaatcgataattaaaatgcttggtacagatcaatttaaacgtattcgaattggtgttggccgtccaacaaatgggatgtctgttccggactatgttttacaaaaattttcaaaagaagaaatgatcattatggaaaaggtaattgaacattctgcaagagctgtagaatcttttattgaaagttctcgttttgatcatgttatgaatgaatttaatggtgaagtcaagtga

SEQ ID NO: 507 - DNA, 405 bp, Staphylococcus epidermidis
aaaatgtcaatcgaagtaggaaacaagcttaaaggtaaaattacaggtatcaaaaagtttggtgcattcgtagaattacctgaaggaaaaagtggtttagttcatatcagtgaagttgccgacaattatgttgaaaatgttgaagaccacttatcagtaggtgacgaagtagaagttaaagttttatcaatcgcggatgatggtaaaattagtttatcaataaaaaaagctaaagaccgccctcgtaagcctcgtcacagtaaagctaatcacggtaaaccagttcaaaaaactgaagactttgagaaaaaattaagtaacttcttaaaagatagtgaagataaattaacgtcaattaaacgtcaaaccgaatcacgcagaggcggtaaaagttctagacgttaa

SEQ ID NO: 508 - DNA, 549 bp, Staphylococcus epidermidis
tttatgaaaataaacgaatttattgttgttgaaggtaaagatgatactgaacgagtaaaaagtgctgtagattgtgatactattgaaacaaacggtagtgcaattgatacatatactttagaagtgatacaacacgcgcagcaaactagaggtgtgattgtactgacagatccagatttcccaggtgataaaattagaaatactatacgggaacatgtttctggtgttaaacacgcatatgtagatagagaaaaggccaaaagtaaaagaggtaaaataggaatagaacatgcaaacattaaagatattcaagaagcattaatgcatgtaagttcaccacttgaagaagctaaagaaactattgataaaagtgtactcattgatttgggattaattatcggtaaagatgcaagataccgtagaaatatcttaggtcgaaaattacacatcggtcactctaatggaaagcaattattaaagaaacttaatgcttttggctatactgaagacgatgtcagaaaagcgctatttgaagaagaggagaattaa

SEQ ID NO: 509 - DNA, 1281 bp, Staphylococcus epidermidis
tgtattaggatacaaagaaataaagcacttaccttttggagacaaattatatcaaatgaagagaggaagacggtcatgacacatacaattacaatagttggtttaggtaattatggcattgatgagttacctttaggtatctatcgttttttagaaaaagagtctaaagtatatgctagaaccttaaatcatcctgtcatcaatacgctaaagaaagaaattgaattcgagagtttcgatagtatttatgaagcacatgaccgttttgaagatgtttatgaagcgattgtcacatcactaatagaattggcacaatctgaagatattgtttatgcagttcctggtcatcctagagttgctgaaactacgactgtaaaattattagagtatagtcattttaataaggatatctctgtgaaggtacttggaggaaaaagttttattgatgacatttttgaagcggttgatgtagaccccaatgatggttttacactgcttgatggtacgtcattaaaagaatcggccttaaatgttcgtacaaatacagtaattactcaagtttatagcgtaatgatagctgccgatttaaaacttactttaatggaaagatatcctgatgattttaatgtgaaaataattactggttctcatagtgatggagctcacgtaattgaatgcccactttatgaaattgatcgctacgacgattattttaataatcttacaagtttatttattccaaaaatcaatgaggatacattactttatcaagattttgattacgcagttcaaactattgatttactcgttgataatgaaaaagggtgtccgtgggataaagtacaaactcacgactcattaaaacggtatcttttagaagaaacgtttgaattatttgaagccattgataatgaagatgattggcatatgatagaggaattaggagatatacttttacaagtattattacattctagtataggtaaaaaagaaggatatattgatatcaaagaaattatagaaagtctcaacaccaagatgattcatagacatccacatatctttggtaatgcgcatgtaacttcgcaagaggatttaaaagacatttggtcacgtgctaaagaaaaagaaggtaaagtgcctcgtgttaaatttgagaaagtatttgcagaccacttcttgaaattgtatgataaaacaaaaaataggcaatttgacgaagatatctcaaacaatttttacaacaaggagagaaaattcatgagattagataaatattaa

SEQ ID NO: 510 - DNA, 543 bp, Staphylococcus epidermidis
gaaagagggatgactttgattattagggcattggagaagacagatttatcatttatacatcatttgaataatgagtattccattatgtcgtattggtttgaagagccttatcaatcattaagcgaattagaaaatttatatacaaagcatattttagatgaaacagagcgacgtttcattgttgaagagggatcaacatctgtaggcgtggtagagttattagaaattaactttatacatagaacttgtgaagtgttaattattatcgatccgcagtatgcaaataatgggtacgcgaaaaaagcctttaaaatggctattgactatgcttttttagtattaaatatgaataaggtatacttatatgtggatattaagaatgagaaagcagtacatatctatcaaagtaataatttcgaaatagaaggaacgttaaaggaacacttctatacaaggggagaatatagagattgctatgtaatgggcttgttaaaaaggaattgggttaataagaatgatgatgatttgtctcatataagatga

SEQ ID NO: 511 - DNA, 900 bp, Staphylococcus epidermidis
aggctttatgttaaaatcattttaataacaattcaaagcgagggcggaaaaatgatatatgaaactgcgccagctaagataaattttacgctcgacaccctttttaaaagagatgatggttatcatgaaattgaaatggtgatgacaacagttgatttaaatgatcgattatcttttgaaaagcgaactgataataaaattgttgtcgatattgagcataattatgttcctaacgataataaaaaccttgcgtataaagcagctgatttaatgtttgagagatttaatattaatgaaggtgtgacaatttcaatcgataaagatataccagtttcagctggactcgcaggtggttctgcggatgctgccgctacaatgagaggattgaatcgattgtttggtttaggtcaatctttagacgctttagctgcattaggcatacaaataggcacagacatacctttttgtatttataaccaaactgctgtgtgtacggggcgtggcgagcaagtaactttcctaaaaagaccaccttctgcatgggttgttttagctaagcctaacatcggaatttcatcacctgatgtatttaaagcactagatttaactgaagaacatatagttcataatgaaaagtgtaagcaagctttagagaacaatgattatcatttattatgcaatagtctttctaaccggttagagcctgtttctatggctatgcatcctgacattaaaaagattaaagataacatgctacaatgtggtgctgatggtgctttgatgagtggaagcggtcctactgtttacgggctagctcaaaaagaaagacaagctaaaaatatttataatgcagtgaatggttgttgtaatgaagtttacttagtaagattattaggatag

SEQ ID NO: 512 - DNA, 402 bp, Staphylococcus epidermidis
aaaaggagtgtcaaattcatcatgaaaataatcaactcagataaggtacccgaagcactaggcccatattcgcatgcaactgttataaacggttttgtctttacatcaggtcaaattccactcacacttgatggaacaattgttagcgatgatgttcaagaacaaactaagcaagttttagaaaatttaactgtggtattaaaagaagcaggttctgatttgaattctgttgttaaagcgacaatctatatttctgatatgaatgattttcaacaaattaatcaaatctatggaaactatttcgtcgaacaccaaccagctcgtagttgtgttgaagtgtcacggttgcctaaagacgtaaaggtagaaattgaattgataggtaaagtgaaggaattataa

SEQ ID NO: 513 - DNA, 1983 bp, Staphylococcus epidermidis
ggaggaccagtgatggctaaagatacattttatataacaaccccaatatactatccgagcgggaacctacacatcggtcatgcatactctacagtcgcaggcgacgtgatagctcgctataaaagaatgcaaggctatgatgttcgttatttaactggcactgatgagcacggtcaaaaaatccaagaaaaagctcaaaaagctggcaaaacagaactagaatacttagatgaaatgatttcaggtattaaaaacttatggagtaaacttgagatttctaatgatgattttattcgaactacagaagagcgtcataagcaagtcgttgagaaagtgtttgagcgattattaaaacaaggtgacatttatttaggtgaatacgaaggttggtattctgttcctgatgaaacatattatacagagtcacaacttgttgaccctgtttatgaaaacggcaaaattgtaggtggtaaaagtcctgattctggtcacgaagtcgaacttgtaaaagaagaaagctatttcttcaacattaataaatatacagaccgcttattagaattttacgatgaaaatccagactttatacaaccaccatctagaaaaaatgaaatgattaataactttatcaaaccaggtttagaagatttagcagtatcacgtacatcattcgattggggtgtacgtgtaccatctaatcctaaacatgttgtatacgtgtggattgatgcacttgttaattatatttcttcattaggttatctatctgatgatgaaacattatttaataaatattggccagcagacatacacttgatggctaaagaaattgtacgtttccactctattatatggccaatattgttaatggcgttggatttaccacttcctaaaaaagtttttgcacacggttggattttaatgaaagatggtaaaatgagtaaatctaaaggtaatgtcgtagatcctaatgtattaattgatcgttatggtcttgatgcgacacgttattacttaatgcgtgaattaccgtttggttctgatggcgtatttacaccggaagcctttgttgaaagaacaaattacgatcttgcgaatgatttaggtaatctagtgaatcgtactatctctatgataaacaaatatttccacggcgaattacctgcataccaaggtccaaaacatgaattggatgaaaaaatggaagcgatggcgcttgaaactgttaaatcattcaatgataatatggaaagtttacaattttctgttgctttatcaacagtatggaaatttattagtcgtacaaacaaatatattgatgaaactcaaccttgggttcttgcaaaagatgaaaatcaacgtgagatgcttggtaatgtaatggcacatcttgtcgagaacattcgtttcgctacaatcttattacaaccattcttgacgcatgcacctagagagatatttaagcaacttaatattaacaatccggatttacatcaattagatagtctgcaacaatatggtatgttgtcagaggcaattactgtaactgaaaagccaacaccaattttcccaagattagacactgaagcagaaattgcttatatcaaagaatcaatgcaaccacctaaatcaataaaacagtctgatgaacccggtaaagagcaaattgatatcaaagattttgataaagttgaaatcaaagcagcaaccattattgatgcggaaaatgtaaaaaaatcggagaaactattaaaaataaaagttgaattagataatgaacaacgtcaaatagtatctggtatagctaagttttatcgtccggaagacattattggtaaaaaagttgcagttgttactaatttaaaaccagctaaattgatgggacaaaaatccgaaggtatgattttgtcagctgaaaaagatggcgtacttaccttgataagcttgcctagcgcaattccaaatggtgcagtaattaaatag

SEQ ID NO: 514 - DNA, 750 bp, Staphylococcus epidermidis
catcctttttttaggagtaaagatatgttagaagataatgaacgcgttgaccatttaataaaagaaggatatgagattatacaaaatgatgaagtattctctttttctactgatgccctattgttagggtatttaaccgaagttcgcaaaaatgataaagttatggatttatgctccggcaatggtgttattccattattattagctgctaaatcaactcaacctattgaaggaatagaaatacaagagcaactagtgagtatggcacgtcgcagttttaaattgaatgatttgaacgatagactaactatgcaccatatggatttaaaagatgtatatcaaacatttcaacctgctcaatatacattagtgacttgtaatcctccttattttaaaatgaatcaaaatcatcaacatcaaaaagaagcacataaaatagcacgtcacgaaataatgtgtaatcttaaagattgtattgaagctgcaagacatttacttaaagagggtggtcgttttattatggttcatcgagcggaaaggctaatggatgtcttaaccgaattaagacatggtaaaattgagcctaaagcactgacgttagtgtatagtaaacatgataagcctgcacaaacaattgttgtggaaggaagaaaaggtggtaaccaaggtttagatatacgtaatccattatacatatataatgaggatggatcatatagcgatgagatgaaaggtgtttattatggataa

SEQ ID NO: 515 - DNA, 339 bp, Staphylococcus epidermidis
tcttctttattttcttcttcatcgtcttctttgtcttcaccaacaacttctggttcttcagttgctgattcgccttccatagcttcaacttcttcttcagaaggttcatctgttggaggaactactgttacgatagaatcttctggattattttcgattgtgaaatcaccagagattttaatatcagaaactgctaagctgtcattaacttgtaattcactgatatctacttcgatagtttcaggaatattttcaggtgtagctgtaacttctaagttgaataatggttgttcaactacgccgccttctttagcacctacagcttcaccaactaattga

SEQ ID NO: 516 - DNA, 1575 bp, Staphylococcus epidermidis
ttagatgtattgaagaaagtatggcgattaaagatgaagactaagagtgagacggcgtttaacggcgtcgttatacttaccttagcattaattattgtgaagatactaagtgccatttatcgcattccgtatcaaaatgttttaggtgatgacggtttatatgcttatcaacaaatatatcctgtcgtagcactaggggttattttatctatgaatgccattccaagtgctgtgactcaagtgataggtgttaatcgatccgatgaagtctatacaagggttatgtttcgattacaatgcataggttttatcgtctttattttgctttttatgtttgcgaatatgattacccgatggatgggcgattctaatttagcacccatgttaaagatggccagttttagttttattttaataggtgtcttaggagtgttaagaggattttatcaatcaaagcaagtaatgaccataccagcaatttcccaggttatagaacaggtaattagagttagtttaatcattgttgcaattattatgttttcaatgaaacattggtctatttatcaagcaggagcattagctatattggcatcttcgattggttttttaggttcaatgttatatttattacttaaaaaaccacttaaacttaagttatgctatcgctttaataatacttccattcaatggaagcagttgtttatttccatatccatatttgcattgagtcaacttatcgttattttatggcaagttgtggatagttttacaataatacgtttattacaacatagcggtattgcttttaaagaagcaattattcaaaaaggcatttatgatcgtggtgcttcatttatacaaatgggtttgattgtaactacgacttttagtttcgttcttatcccattacttactcaagcaattcgtgaacataatcaaattcatatgaatcgttatgcaaatgcatcaattaaaatcacggtagtaataagtacagcagctagtataggattaattaatctgcttccacttatgaatgttgtattctttaaaagtaatcatttaactctaactttgagtatttatatgtttacagtgatatgtgtttcgttaataatgatgaatatctcattattacaagttcaaaccagtattcgtcccattattatgggtgtgataataggaatactgtccaaaattattttaaatgttatattaatacctttttggggtatcgtgggtgcaagtgtgagtacagtcttatcactactactttttgtcataatattgcaagttgcagtcttaaagtactaccgttttaatcgtatatctttatttatcgttaaacttattttaggtatgataattatgagtatagttgttcaaactgtcatgcttgccttaccttcaaaaagtaggatgttaggattactagaacttatagttagctcaattataggcatagtgattataatgttgtatattgttatatttaatgtattaggatacaaagaaataaagcacttaccttttggagacaaattatatcaaatgaagagaggaagacggtcatga

SEQ ID NO: 517 - DNA, 1371 bp, Staphylococcus epidermidis
gatgaaaaattaaatttagagagagttattaatatgaaaagaccaataattcaaaaattaaatcacttgatagagaaaaaagctatctctatgcatgttcctggacataaaaacatgacaatcggctacttaaataggcttgatttagcaatggatatgacagaaattactggattagatgatatgcattatcctgaaggaattattttagaaagcatggagaattttaggaaacataaaaactatgatgctttcttattagttaacggaacgacttcaggtatattatcggttatccaagcgttttcgacaagaaaaggtaaatatttaattagtagaaatgttcataaatcagtatttcacggtttagacataacacaacaacaagcgacaataactaagacagatgtcagtaagaaaacgaatcaatatgtaaatccaaagataaatcaagataaaaatcaatattataaacttgccatctgtacataccctaattattacggtgaaacttttgatatttctcaatatatcaaacaattacatcacagagggataccgatattagtagatgaagcgcatggtgcacattttggtttagatggatttccagaatcctcaatgaattttaatgctgattacgttgtgcagtcatatcacaaaacactccctgcactaacaatgggatcagttatatatatacataaagatgcaccattaagacaacaagtcatagattatttaacttatttccaaacgtcaagtccttcgtacctcattatgtctagtttagaattagcgaataaattttataaagaatatgattctacattatttgaccaacgaagaaagatgttaattgatttattagtaaatatgggatttacagttatagaaccagaggatcctttaaaattggttgtgagttttgagggtgttgaaggttatgatgtgcaaaaatggtttgaggataaagaaatttatgtagaattagctgatatgtatcaagtgttactcgttctccccctatggcatgaaggagataaatttccttttaagttgttgattgaaaaaattagagaaattaacgtgccaaaaaaatgtacgcgcgacataaaacctcttaattttatgacgggttttagcgaatacaaaactgttcattttcaaaatacgaaagaagtgtctattaaaagggcagaaggtaaagttttagcacaacatatcgttccataccctccaggtataccggtgatgtttaaaggagaagtcgtgacgtctcatatgatagacttattaaataaatatgataaacaaaatattaaagttgaaggtttaaatcataaaaaaatattagttaaggatgaataa

SEQ ID NO: 518 - DNA, 1401 bp, Staphylococcus epidermidis
atgaatacatcacaaaagtttaggggagataatcgcttattattagggattattttaggggttattacattttggttatttgcacaatcacttgtaaatctagtcgtgccattacaatcatcatacaatagtgatattggtactattaatatagcagttagcttatcggcactattttctggtctgtttattgtaggtgcaggagatattgcagataaaattggtagagtaaaagtgacatacataggcttagcacttaatattgttgggtcggttttaatcattattacgccattaccaagtctattgattattggacgtgctattcaaggattgtcagcggcatgtataatgccagcgacactcgcaatcattaatgaatattatatcgggacagcacgacaacgtgcattaagctactggtccatcggttcatggggaggtagtggtgtttgtactttgtttggtggtttaatggcaactaaccttggatggcgctcaatctttattgtttcaattattctgacaatattatccatgtttctcattaaacatacacccgaaacaaaagcagagcctataggagatcaaccgacagagacaaagaaatttgatgttgttggtttaatcatcttagtggttagtatgttaagtattaatgtgataataactcaaacctctcaatttggtttgttctcaccatttattttgggacttattgcaatttttgttatatcgttaattatattcgtgatttacgaaaataaaatcaaacaaccacttgtcgattttgatatctttaaaaacaaaggttatacaggtgcaacgatttcaaactttatgttgaatggtgtagctggtggtacattgattgtagtaaatactttttatcagcaaaaattagattttaactctcaggaaacaggatatatttcacttacatacctaattgcagtattaattatgatacgtgtgggtgaaatgatattacaatcgttaggacctaaaagacctttgttactcggaagtgccttgaccgtcataggattaatattattatctttgacgtttttacctaatgcttggtatatagcgtcaagtgtcattggttatttattatttggtaccggtttaggtgtttatgcaacaccatccacggatacagctgttgcacaagcaccagatgataaagtaggcgtcgcatccggtgtatataagatggcatcatccttaggaaatgcatttggtgtggccatctcaagtacagtttacagcgtacttgcagcccaacttaatctgactttaggtggttttactggagtaatgtttaatgcgcttatagcattattagcattcctttctattttgttcttaataccgaaaaaacagtctaatgtataa

SEQ ID NO: 519 - DNA, 231 bp, Staphylococcus epidermidis
ggcataattccatatatatatgagagtacaacaatacctactaataacactgctaaaattgtacccatagtgactaaagttttgactgcattcttaggtgctggatttttaaaatttgttactgcattggatattgcctctacacctgtaagtgatgatgctccagatgaaaatgcttttaaaagtaaaaataacgtaacaccgggcacagtactacctacagtggaatga

SEQ ID NO: 520 - DNA, 1245 bp, Staphylococcus epidermidis
acttacatgttgataggtatagtgttatttgcttttatgagagctcttggtgaattattattaagtaactctaaatttaattcattcgtagatattgcaaatgaataccttggtccatttggtggatttgtaattgggtggacctattgggtttgttggattgtctctagcatgtcggacctcactgcgatgggacaatattttgcttattggtatccacaagtcccacactggttgacagtactatttattgtactcctacttatatcatttaatttgcttggcgccagattatttggagaacttgaattttggttttctataattaaagtcgttacaattattacgatggttattgtaggtttagttctgatttttttatcatttaaaacagaatatggacatgcttcttttggtaatttgatacatcatggcgggatgtttccacatggtgcagctggatttttaatgtccttccaaattgctgtatattcatttatcggtatagaacttataggagtcacagctggcgaaacaaaaaatccagaaaaaacaattcctaaagcaataaataacgttcctatacgaattttattattttatataggtggtttacttgtaatcatgtctgtcattccatggtttaaagttgatcctgatagtagtccgtttgttaaattattcacactaattggtgttccctttgctgctggcatagttaattttgttgttttaacagcagcagcatctgcaacaaatagcggaatatattctaatagtagaattttatttggtttagcgaaacaaggtttaggtcctaaagtattgacaaaaactaattctaatggtgtaccttatctctcaatgttagtatcttcaataacattgttaatcgcagctttattaaattttattttcccagatgctattaaattatttatttatgtaacgacactatctaccgtcctattccttgtagtgtggggaatgattatcgtttcttacatcgcatacgtaaagaagaatcctgaacaacatcaatcaagtgcatttaaattatggggcggaaaaattattgcctatattgtgttatcttttttcatatttatctttattttgctattctttagcaaagatactagagtagctatttttatttcaccattatggtttatcttcttgttcttttattataagaaatacaagaataatgctgaatctttagccgatagacagcgacattaa

SEQ ID NO: 521 - DNA, 1584 bp, Staphylococcus epidermidis
acaaattatttatgcttatccaaaaggtggggagcgtatattgtttctaaaacaaatcttggtgagaaatggggattgctagctggagggtctttattagtcgactatatattaacggtggcagtgagtatttcttcaggagcagatgcttttgttgctgcatttccccacttatatcattttaaagtgcttattgcatgtttattagtactctttattttaatgatgaatttaagaggtttgactgaatcagcaactgtattatcatatccagtctacttatttattataggtttaattgttttgatagtcgttgggacatttcgcgtagctactggacaaatcgcaccacatattcattccactgtaggtagtactgtgcccggtgttacgttatttttacttttaaaagcattttcatctggagcatcatcacttacaggtgtagaggcaatatccaatgcagtaacaaattttaaaaatccagcacctaagaatgcagtcaaaactttagtcactatgggtacaattttagcagtgttattagtaggtattgttgtactctcatatatatatggaattatgcctcaaactgaaacgaccgtgctttcacaacttgcgtcccaaatatttggtgaaaatgtagcgttttattttatacaagctactacagttatgattttggtattggctgctaatactggttttacagcatttcctatgctagctgcatcaatgtctaaagacaaatatatgccacgtatgtttactgttcgtggtgatcgtctcggttattcaaactcgattattatattaggtgtattagccatcattttaattatcctatttgaaggaatgacagagaacctcattccattatatgcagtaggtgtttttattccatttacgcttgctcagtttggtatggttttaaaatggcttcgggaacgtcctgaacgatggggaataaagcttactatcaatttaattggtggtacgattacgtttatcgtattcatgattttactcattactaaacttaatcaagtatggccaattcttttatttttaccttttattgtatttatttttattagaattcatgtacattatgagaatatagcatgtgaattacgatctgaaattgatatacacgatattcctgttgtagatcgcaatttagctattgtacctattcaaagtattacaactgtagttgataaatctatttattatgccaaattattagctaatgatgatgttattgcagtgcatgtgacatttggtgatgaagatgagcaggcttttatgactaaatggaaaaaacattttcctgatgtaagacttgtgattttacattcagagtatagaagtattattcatccgatttcacgatttatagataaaattcgtaaaaaagcgaatgataaaaattatttaattacagtagtcgttccagaatttatccctaaaaaggcttggcagcacttattgcacaatcaaacgagtttacgtttaaaattgcatttaatttatcaaaaaaacgttactctgtgtactattccattcaaattaataaaataa

SEQ ID NO: 522 - DNA, 261 bp, Staphylococcus epidermidis
gtgtgtatcgcatgtcttaaatgtggctttttaatgcttaggtgttattttaatgttttttctttttatcagaacggtaagttatacttattaaagataaccaaaccagtaacatggttatggctagatagacacttacaactaaatatttcgaatgtaaaggtaaccatgataaaacaaacccccaagttgcatctcctaatattatcaagggaagtagataaaaaagaatattcattgctacaaatcccaacaaaatga

SEQ ID NO: 523 - DNA, 279 bp, Staphylococcus epidermidis
aacaacttagcaccaaatccactacctaatgcgccagaacctgcaattgctattttcatatattccatctccttacaattctatattgtttttaaaatactactttactacataccagtcaatataatacggttaatttgtaagaattttctgttaattaagaataagtattatctctcaaacgtacattgctcattcgacattttattaccaatttgcacagtgaatcgtttctttgttaatttattattctatttcagttgcgtttttaaaatatga

SEQ ID NO: 524 - DNA, 792 bp, Staphylococcus epidermidis
ttccatataaatcttctaaggaggaacactttaatgaaagcgttaatcgttgatgatgaaccacttgcaagaaatgaattacaatatcttttaaatcttaatgatgctatagatgaaattgaagaagcagaaaacatagaagaaacattggagaagttactctacaacacatttgacttaatattcttagatataaatttaatggatgaaagtggtattgatttagctcaaaaaattaataaaatgaagcgatcaccacatattatctttgcaaccgctcacgagaaatttgcagtcaaagcctttgaattaaatgcaaccgattatatattaaaaccttttgaaaaagaacgtattaatcaagctgtaaataaagttgacatggctaaagataaaccaaaaaacaaagataaaactatcacacctaaatatattgattatagtgatgatgagcgcgctcaaacacatgtacttccaattgaagtggatgaacgtattcacatcttaaatttcacagacattatcgcattatctgttaataatgggattacaacgatagatacaacaaaacaaagttatgaaacgaccgaaacacttaatcattacgagaaaaaactaccttcctctctatttattaaaatacatcgcgctactatcgttaataaagaacatatccaaacaatagagcattggtttaattatacgtatcagctgacgttaacacatgaatttaaatatcaagttagtcgttcttatatgaagacttttaaacaacaactcggtcttcaataa

SEQ ID NO: 525 - DNA, 705 bp, Staphylococcus epidermidis
gcaatgattgaacatttaggaattaatacaccttattttgggatattagtatcattaataccatttgtcatagcgacttatttttataaaaaaacgaatggtttctttttactagcacctttattcgtaagtatggttgcaggtattgcttttttgaaattgacaggaattagttatgagaattataaaatcggtggcgacattattaatttcttcctagaaccagctacaatatgctttgcgattcctttatatcgcaagcgcgaagtattaaaaaaatattggttacaaatatttggtggtatagctgttggtacaattattgccttgttattaatttatcttgttgcaataacattccaatttggcaatcaaattatagcatctatgctacctcaagctgcaacgacagcaattgcattacctgtatctgacggtatcggtggtgtcaaagaattaacctcactcgcagttattttaaatgcagttgtcatttctgctttaggtgctaaaatagttaaattatttaaaatatctaaccctattgccagaggacttgcactagggacaagtggacacactttaggtgtcgcggcagctaaagaattgggtgagactgaagaatcaatgggaagtattgcagttgtcatcgttggcgttattgttgtagcagtagttcctatacttgctccaatcttattataa

SEQ ID NO: 526 - DNA, 1791 bp, Staphylococcus epidermidis
atgaggattgacgttatgcttaatttatttattttattacttgaacgcgtgggattaattattttactcgcatatatactcatgaatattaatcattttaaaacaatgatgagcgaacgtgacaaatggcgttcaaaattccaactaatcattatttttggtatattctctatgatttcaaattttacaggaattgaaatagaaaatggccatatcgtatctggtgatatttattaccacttaagcaaagacgcctcaatggccaatacccgtgtattaacaatcggtgtttctggtctaataggtggaccgtgggtagctataattgtaggcattatttcaggattatgtcgtttatatattggcggggctgacgcatatacctatcttatttcatccatagttatcgctatcatatctggttactttggtcatcaaacaataaaacaaaatacatatccgtccattaaaaaaggtgctattatcggtgcaataactgaaattattcaaatgggctgtatattattatttacaaataacttacatcacgcaattacattagtcagttttatagcactaccgatgattatcattaatagtttaggtacagccatatttttaaccatcattttgtcgaccatcaagcaagaagaacaaatgcgtgcagtccagacgcatgatgtattacaactcgctaacgaaacactaccttactttcgatctggacttaatgaaaaatcagcccaacaagctgctgaaattattttaaaattaatgcaagtgtcggcggtcgctattacaaataaaaaagatattttaacacatattggtgcaggcagtgaccatcacgtagcacgtaaagagataattactgatttatctaaagaagtgattcaatctggaaaattaaaagtcgctcatacgagagaaggaattggatgtcaccatcctaattgccctcttgaaggagccattgtcgtccctctttatatacataatgaagtcgcagggactttaaaattttatttcacagataacaatattatttcaacttcagaccaacagctcgcaaaaggtctcgccaatatattttcctcacagctagaactaggtcaagctgaaatgcaaggacaattattgaaagacgctgaaattaaatcattacaagcacaagtcaatccacatttcttttttaatgctattaacactatatcagcactagtaagaattgatagcgaaaaagcacgacgtttactgattcaactcagtcagttcttccgctctaatcttaatggtgcacgtaataatacgattactttacaaaaggaattacaacaagtagcagcatatttatccttagagcaagcgcgctatccaaatagatttaacatacactatcgaattgatgatcagtgtcaagatgcgctcatcccaccttttataattcaaatattagtggaaaattctattaaacatgcatttaaaaatcgtaaaaagaataatcatattgatgtggatgttagcatgaagcaagactacttaagtatatctgttcaagataatggtcaaggcataccagctgatcaattagatactattggatatacgacagtaacgtctaccactggtactggtaatgccttagtcaatcttaataaaagacttactggactatttggaacaacatcggcactgaacattcaatcttctcaatcaggcacgactgtaagttgtttaattccatataaatcttctaaggaggaacactttaatgaaagcgttaatcgttga

SEQ ID NO: 527 - DNA, 276 bp, Staphylococcus epidermidis
acaaaaaatgagcaagttgagcaatttttagctaaagaaagccaatggcaagattgttataaatttttgagaaatttaatttttaatgaaactgaacttgaagaaaattataaatggatgcatccttgttatacgataaacaataaaaatgctgtgctaatacatggatttaaaggttatgtagcgttgctttttcaaaaaggagcaatacttgaagaaaagtatcatacattgattcaacaaactgaaagactacaggctgaagctgtcccctaa

SEQ ID NO: 528 - DNA, 975 bp, Staphylococcus epidermidis
aagtatctagataaatgggaggaattgacattgaagaagtatcttaactatacactgattctgattgcattatctctcatcgtgttatctggatgcagtttaccaggcttaggtgatggaaatgctaaagatgatgtgaaaattacaacgactgaaacaagtgaaactaagattataggtcatatggaaaaattattaattgaacatgaaactgatggaaaaatcaaaccgacgttaattggtaacctagggtctagcattattcaacataatgcgttacaacgtggagatgcaaatatgtcagcggtacgttacacaggtactgaattgacgagtgtattagcagctaaacctactaaagatcctgataaggccatgtctgaaacacaacgcttatttaaaaagaaatatgatgaaaagtattatcattcacttgggtttgcgaatacatacgcattcatggtgacaaaagaaacggctaaaaagtatcacttaaaaaaagtatcagacttagagaaatataaagatgaactacgtcttggaatggatacccaatggatgaaccgtgcaggtgatggatatcctgcttttgttaaagattatggatttaaatttgatagtgcgcgtccaatgcaaattggtttagtatatgatgcattaaaaaataataaattagatgtagcagttgggtattcaacagatggacgtattgcagcttatgatttgaaaatattggaagatgatcgcaaattcttcccgccttatgacggtagtccacttgcaaatgaacaattaataaaggataatccagaaatcgataaggcactaaaaaaattagaaggtaaaatctcaacagaagaaatgcagaagttaaattatgaagcggatggaaaaggtaaggaacctgcagtgatagctgaagaatatttaaagaaacatcattactttgaagaaaagaaaggtggtcataagtaa

SEQ ID NO: 529 - DNA, 954 bp, Staphylococcus epidermidis
aattgtaaggagatggaatatatgaaaatagcaattgcaggttctggcgcattaggtagtggatttggtgctaagttgtttcaacatggttatgacgtcactttaattgataattgggaacctcaagttactacaatacaacaggacggtctacatatcgatattaatggtgaagcgcatcatttcaggctacctatgtatagactaacggaaattcctaaagcaacgtcctatgatattgtttttctatttcctaaatctatgcaattagaagaggtgcttagtcatattcaaccccatcttcatgataatacaattgttgtgtgcactatgaatggtttgaaacatgaacgtcttatacaacaatatgtttctatagatagaattgtacgtggagtaacaacgtggactgccggtattgatcaacctggtcacacgcacttaatggggcaaggtcctgttgaaattgggtgtctcgtgcccgagggaaaagaaagcgtagatatcattgttaatctgctacaaaatgcagaattaaaaggtgtaaaaagtgaacatttacatcaatcaatttggaagaaaatatgtgttaatggaacagctaattcattatgtactatacttgaatgtaatttggcagcactgaataatagtgatgacgctaaaaatttgatatataaaattacacaagaaattgttcatgttgcaacagttgatgatgttcatcttaatgttgatgagatttttgattacttaattgctttaaatgataaagtaggcccacactatccttctatgtaccaagacttaattaaagataatcgaacaactgaaatagattatattaatggagcagttagtaaattagggaaagagaatcatattgctacacctgtaaatgattttgtaacaaatcttgtacatgctaaagaaaatcaacgtggtgcacaatga

SEQ ID NO: 530 - DNA, 195 bp, Staphylococcus epidermidis
ccaatgacacttgacgctatataccaagcattaggtaaaaacgtcaaagataataatattaatcctatgacggtcaaggcacttccgagtaacaaaggtcttttaggtcctaacgattgtaatatcatttcacccacacgtatcataattaatactgcaattaggtatgtaagtgaaatatatcctgtttcctga

SEQ ID NO: 531 - DNA, 1533 bp, Staphylococcus epidermidis
agtagaggatgctcaatgaagataaaactgtttgtcattgttgtcatttttttgatgactattttatcgataatttcaataacaacacgagaaatcgcacatagtaagaatgagacgatattgacacatgcttctcaaaaacatattgataaaatggttgagacagcaatgaagaaaggagatatccccggactagcaatattgatcatcaaagacaataaaatctttttaaataaagggtatggttatgccaatattgaaaaaaaagcaaaggtaaatccacatactcaatttgaaattgcatccaatactaaagcttttacaggttatgcaattctacaactagctcaagaaggaaaaataaatttaaatgacaaagtaagtacatttatacccggatttaaaatgaagtatgaagacaaagaaagagatattactattgaacagctattagctcaaactagtggtatccctggagatatcactgaagaaaatcgttactctaaacagtacgatagtattgaaaatatcgttaattttgcaaaaggaaaacgtctgaaccatgtacctggagaaacttttgaatattcgaatatgaattatgatattttaggtcttattattcaaaatgttacccatcaatcctatacatcatacatccaaaagcatgttttagcccctttaaagatgaaacataccacttttaaagtaaataataccaaatctaataacgaagcattaggttatatatgggaagataatgaaaataaagttgcacaaccagagtttaacattggggatactcctgcggcatatatgatgtcaagtacaagtgatttagcaaaatgggtccaactacagatccaccctacttcaaaatcacaagccaagttaattcgtcaatcgcatcaggtattatctaactcattaaatagtgagcctaacgcagatagctacggttcgggatggtttataaatactgatgaccatctcgtatttcataccggcgttttagataatttctcttcacaaattttattaaatattcgtaaatcttatggcattgtcgtattagccaatacaaattcaaatcaagtgactcgtttagcggaacatttaaatactcaaattatgaataatcgtcattacacaactatagaagaaaaagtgaaccaaacgaaagatatgcaacttatcatttccacattggccgatatattcatggtcatatttagtatcttagtttttagtaaaatcttaaaattacgtgaaggccacatcttcatccgtaaatgtttacgaacttcaatcatgttcagcatcattttgttgggatttgtagcaatgaatattcttttttatctacttcccttgataatattaggagatgcaacttgggggtttgttttatcatggttacctttacattcgaaatatttagttgtaagtgtctatctagccataaccatgttactggtttggttatctttaataagtataacttaccgttctgataaaaagaaaaaacattaa

SEQ ID NO: 532 - DNA, 1383 bp, Staphylococcus epidermidis
aaatatataagcaaaggcctttgtcttttgtttaactttagtcattatttgtttaacaattgcatcagaggtctttttttaggtcatggaacaagacattctttatataggaaggggaaaacaattatgttaagtattaaaaacttaaccaagatttattcagggaataaaaaagcggtagataatatttctttggatattcaatctggtgaatttatcgcttttattgggacgagtggtagtggtaaaacaactgcactacgcatgattaatcgtatgattgaggcgacagatggacagattatgatgaatggaaaagatgtccgtaatatgaatcctgttgaattgcggagaagtatcggttatgtcattcaacaaattggtttgatgccacatatgactattcgagaaaatattgttttagtacctaaacttttaaaatggtctaaagagaagaaagatgaaaaagctaaagaacttattaaactggtagatttacctgaagaatatttggatcgttatccagctgaattgtcaggagggcaacaacaacgaattggtgttgtgcgcgctttagcagctgaacaagatattatattaatggatgaacctttcggtgcattagatcctattacacgcgatacattacaagatttagtaaaggaattacaacaaaaattaggaaaaacatttatttttgtcactcatgatatggatgaggctattaaattagcagacaaaatatgtattatgtctaagggaaaagtcgttcaatacgatacacctgacaatattttacgatatcctgcaaatgactttgttagagattttattgggcaaaatcgcttgattcaggatcgtcctaatatgaaatctgtggaaagtgctatgatcaaacccgtcactgttaaagcagatgattcattgaatgatgcagtaaatattatgagaacacgtcgagtagacactatttttgtagtcaataatcaaaataaattattaggatttttagatattgaagatatcaatcaaggattacgtgcgcgtaaagaattaattgataccatgcaaagggatgtctacaaagtacatatcaattcaaagttacaagactcagtgcgtactattctaaaacgtaatgttagaaatgtacctgtggtcgataatgatgaacatctcattggtttaattacacgtgcaaacttagtcgatattgtgtatgactcaatttggggcgaagaagattctgatagttatgagatcccaaatgaaagcttagatgagaataatcacgatttaccacaaaatcaaactgatacacgaacaaatataaatgaagatgtgaatgattatcatgatgctcaacatagaggtgaggattaa

SEQ ID NO: 533 - DNA, 855 bp, Staphylococcus epidermidis
caaaaaggaagtatcactatgcataaacgacttttcatcactttattaggttttatcattttactagctggatgcgattattctaaagaagagaaccaaactggtatattttataacgtttttgtaaaatctatggatggatttcttcattttcttggcagagtctttcaggataactatggctttgctattatttctattgtactcatagttcgtttcatcctattacctttcatgttaatacaagttaagaatatgcatatgatgcgcgaaaaaacaaaagtcgtccaaccagaattggatgctataagagataaaatgaaacacgcaacatcacaagaagaacgtaatgcagccaatcaattgcttatgaaaaagtatcaatcgtatggaattaatccattaaaaaatatgttagggtgtcttcctgttcttatacaaatgcctatattaatggggctttatatgagtttgaagtacccttcgagtcacggaattactgaatacccacatttcttatggtttgatttaacgcaacctgatttgattatgacaataatcgcagcaatcatgtattttgttcagccacttgtaaactcaatccattatccaaaagatcaaagaaaaacatattactttatgatggtattttcaccgatattcataacatatgcgtctctacattctgctgcagctttgggcttatattggagtataagcgctgcttttctaatagtgcaaatgcattttgctcactctcattataagaaagtggcactacatgaagctaaaaaactcaaacaaaaattagagcaaaataaagacaatagtgagttattaaccgaagagtcataa

SEQ ID NO: 534 - DNA, 474 bp, Staphylococcus epidermidis
agaaaacagaggggaatggttattttggaacaaacgcatctcgttaaaaacaaaacggttgataacaagaagtcaatgaaatacagtatttttcaacaagcattaacgattgcagtgattttacttatatcaaaaattattgaatcatttatgcctattccaatgccagcttcagtaattggacttgtactattatttatcgcattgtgtacaggcattgtgaaattaggtcaagttgagactgtgggaactgcattaaccaataatattggattcctattcgtaccagctggtatttcagtcattaactctttaccaatccttaagcaaagccctattttaattattttacttattattatttcaacacttttattattaatttgtactggctttgcgtcacaattattagtgacgaaatcacttttcccttctaaagagaaaaatgaagaaacaagtcacgtaggagggtaa

SEQ ID NO: 535 - DNA, 699 bp, Staphylococcus epidermidis
gtaatgaaaggtaatttgttacattcaatcatcgaatattactcactgaactgggcctttcttctagaactgttcttcaaacatctattaatgtcggtatatggtgtgttgtttgcatgtataattggaattcctattggtattttcatagccaagtataaacgtttatcgtggccggtaattacaattgcaaatattatacaaactgttccagcaatcgctatgttagccatacttatgttggctatgggattaggaccaacaactgttgttgtaactgtattcctatattcgttattacctattattaaaaatacttatactggtattgtagaagttgatgaaaatattaaagacgctggtaaaggtatgggaatgacggggaatcaaatattaagaatgatagagttaccattatctttatctgttattattggtggtgttagaattgcacttgttgttgctatcggaatagtagcgattgggtcatttatcggtgctccaacactaggtgatattattattcgtggtacaaattcaacagatggaacaacattcatcttagcaggtgccataccaattgctttaatagcaattatcatagatataggattacgttatctagaaaaacgtttagatcctactcgtaaaaacaaaaaagattcaatgcaaaaacatcaagtacaaaaattacattaa

SEQ ID NO: 536 - DNA, 351 bp, Staphylococcus epidermidis
gttttcaggggtattttagatatatttatagttttgggtaattataataagattggagcaagtataggaactactgctacaacaataacgccaacgatgacaactgcaatacttcccattgattcttcagtctcacccaattctttagctgccgcgacacctaaagtgtgtccacttgtccctagtgcaagtcctctggcaatagggttagatattttaaataatttaactattttagcacctaaagcagaaatgacaactgcatttaaaataactgcgagtgaggttaattctttgacaccaccgataccgtcagatacaggtaatgcaattgctgtcgttgcagcttga

SEQ ID NO: 537 - DNA, 1065 bp, Staphylococcus epidermidis
ggggtttttattatgaaagcagcagtatggtatggacaaaaggatgtacgcgttgaagatcgcgaacccaaagcaataaaagacaatgaagtgcaagttaaagtctcttgggccggtatctgtggtactgatttacatgaatatttggaaggacctatctttatttcaactgatcaaccggacccactacttggtcaaactgcacctgtgactttaggtcatgaattttcaggtgtcgtagaaaatgttggtaaaaacgtatcacgttttaaaaaaggggatcgtgtggtagttaatccaacagtgtctaaaagagaaaagccggaaaatgttgacttgtatgatggttattcatttataggactaggttctgatggtgcatttgccgagtttactaatgctcctgaaacaaatgtttatcatctaccagataatgtttcagcacgagaaggtgctcttgtagaaccaacagccgttgctgtccaagcagttaaagaaggcgaattattattcggtgatactgtagcagtatttggcgctgggccaattggtttgttaactattgttgcagcaaaagctgctggtgcaagtaaaatatttgtctttgacttatcagaagaacgtttagcgaaagctaaaagtgtcggtgcgactcacgtgtataactcaggtaacgtcgatccagtacaaacggtttatgaacatactgacaacggtgtagatgtgtcatttgaagttgctggtgtaggtattactttacaacaatctattgaagtaacacgtccacgtggtactgctgtcatcgtatcaatcttcggtcatcccgtagaattcaatccattattacaaatgaataaaggtgtcaagttaacaactacaattgcttatacaccaactacattccaacaaacaatagatttaatcgctaacggtagcttaaatgttaaagacgtcgtaacagatcaaattgaattagataatattgttgaaagtggcttcaatcaacttgtaaacgataaatctcaagctaaaattttagtccgtttaaatggtgaccaaaaataa

SEQ ID NO: 538 - DNA, 645 bp, Staphylococcus epidermidis
ggattaataatgaaagcattcttacaagaatacggtagtcaacttttatcaaaagcagtagaacatttttatatttctatgtttgcattattgttagcgattgtagtagctgtccctttaggtattttattatcaaaaacgcaacgcacagctaatgtggtattaacagttgctggcgtgcttcaaaccattcctactttggctgtgttagctatcatgattccaatatttggggtaggaaaaacaccagctattgttgcattatttatctatgtattattaccaattttaaataatacagtattaggtgttaaaaatatcgataaaaatgtcattcaagctggtcaaagtatgggaatgactaaatttcaattaatgaaagatgtagaaatgcctttagctttaccacttattattagtggtattcgtctatcaagtgtatacgtcattagttgggcaacactcgcaagttatgtaggtgcaggtggacttggggatcttgtatttaatggattaaatctctatcaaccacctatgattattagtgcagcgattgttgttactttattagcattagttattgactttatactttcattagttgaaaaatgggttgtacctaaaggattaaaagtatctagataa

SEQ ID NO: 539 - DNA, 345 bp, Staphylococcus epidermidis
gttaaagaggtaggagtcatgttcattcaatttaaaagacttttgattggtagacctaaaagaaacagagacttaaaaaacgagaaaatttcaaaatttaaaggattagctatcctatcatccgatgcattgtcatcagttgcatatggtcctgagcagatattaattacattatcggtgataggagctgtggcatcttggtatacgctgcctattgccggagcagttttaatattattaacagctctaattttatcttatagacaaattatttatgcttatccaaaaggtggggagcgtatattgtttctaaaacaaatcttggtgagaaatggggattgctag

SEQ ID NO: 540 - DNA, 255 bp, Staphylococcus epidermidis
ggtacaccattagaattagtttttgtcaatactttaggacctaaaccttgtttcgctaaaccaaataaaattctactattagaatatattccgctatttgttgcagatgctgctgctgttaaaacaacaaaattaactatgccagcagcaaagggaacaccaattagtgtgaataatttaacaaacggactactatcaggatcaactttaaaccatggaatgacagacatgattacaagtaaaccacctatataa

SEQ ID NO: 541 - DNA, 663 bp, Staphylococcus epidermidis
aactcatcctcactacaaaccttcaaaatatttaaaagcagtatttgtaacaataaaacattaattttctataaatatgggtataaatcactgttgaagttttatttgaaaggatgtcattatatgggaattagaagtaaactaactaataatattacaaataaagtagggaactcattattgaacatagaggaaattaaagagaaaggtgatttgccaactacacaggaagaacttagacaacgcagagaaagagctgaaactctagttaaaaagaaatcgctactttcctccggtgctagtattgtccctattccaggacttgattttggagtagatcttaaattaatgagagatattatagaggatgtaaataaaatttatggtttagatcacgatcaagttaattcattgagtgatcaagtgaaagaaagaattatgtctgcagcggcaattcaaggaagtcaatttattggacgtaaggtatctgaggcgttgcttaaagttgtgattaaagatgtagctaaacgagcagctgccaaacaaacaaaatggttcccgtttgttgggcaagctgtatctgcatccattagctattattttatgagcaaattaggtaaagatcatattaataaatgtgaaaaagttatcaataacttatag

SEQ ID NO: 542 - DNA, 1074 bp, Staphylococcus epidermidis
atgaagcgattttttcaacttatcatttctgctatagttattggtattttatgtttaatgattagtcattggtttaaatcaaaagataatacccactcaaatgagaaattatatgtttacaattggggagaatatattgatcctagcttaattaagaagtttgaaaaagaaacaggtatacaagtcgtatatgaaacctttgattcaaatgaagcaatggaagcgaaaattcgaaatggaggcacacactatgatgtagcttttccaagtgaatatactgttcaaaaattaaaaaaagctaaactgcttgagactttaaatcatgacaaaattccaaatatcagaaatttagacaatgattatatgaacttgtcatatgacccaaacaatcgatattcaattccatatttctttggtaccgtaggaattttatatgataaagagaaatatcctaatgaaacgttcgatagttgggacgatttgtatcattctcaattcaaaaatgatattttattagtagacggtgcacgcgagataattggaatgggattaaataaattagggtatagtcttaatgacaaaaatccgacccatatttatcaagcagaaaaagatttgcataatttagcacctcaagttagagggatagtaggcgacgaaattactatgatgcttcaacaaaacgaaggacatgttgcagtagtttggagtggcgttgctgcaccacttgtacaggaaaatactcgttataattacgtgatacctaaagaaggctctaacctatggtttgataatatggtgatacctaaaactgcacaaaataaagaaggtgcgtataagtttatgaatttcttactagacgcgcaaaatagtgcccagaatacggaatgggtagggtatgcaacacctaataaagcagctcgaagtaagttgcctaaaaaggtaagaaatgattatagattttatccatcaaatcaagaacagcaacggttagaagtctataaagatttaggtcaaacgtctctcagtgaatataatgaaagctttttaaattttaaaatgtctttaaaatag

SEQ ID NO: 543 - DNA, 957 bp, Staphylococcus epidermidis
tttactatatcattatattatatgagaaatttaaggaggggaattatgaacaaagatcaaactttgtcacatactacgggccgtgtatccttcaaagaattacaacaaattattaaaatggcccttgttcaaggtaatttaatacctgcttttgcaggcgcatggcttgcaatagtaatgacaaaccattccttcctatcttccattccacaaatactattgatgctagttggctctacgctaattatggggggcgcttgtgctttaaataattattatgatcaagatattgatcgcattatgcctagtaagcaaagtagaccaacagtaaatgatagaatatctgatagaaacttattaatgttaagttttgggatgatgttaataggtgaagcatgtttattcttattaaatataccttctggtgttttaggattaattggtattgttggatatgtatcttactattcaatttggtctaagcgccatacaacttggaatactgttgttggaagttttcctggagctgtaccaccattaattggttgggtagctatcgatggatcattaagtttagcagcagtagcactctttttagttgtcttttgttggcaacctatccatttctacgctctagcaattaaacgtagtgatgagtatgcgcttgcaaatattcctatgttaccatcagtgaaaggtttcaaacggacaagagtaagcatgtttatttggttagtgttattattaccattgccattcttattatctaatttaggtgtaacttttgttgttattgctacactacttaatttaggatggttagctttaggttttacaacgttcagaaaagaatctaatcaaactaaatgggcaacgcaaatgttcgtttattcattgaactacttagtagtattctttgcactcgttgtagttgtttcattaatcaagatgatataa

SEQ ID NO: 544 - DNA, 1242 bp, Staphylococcus epidermidis
gtaaagtttttagcttctcaattattcaaaggaggtttttttatcgattacttaggtgttgatattagtaaaagaagtagtgtagttgcacattataaaaatggaaaattccaaaaagagtttttcatccaaaataataaaaatggttacaattatttactcaagtatttgaatgacttacaccacccacaactcatttttgaatctacaggtatctattcaagaggtatgcaacgattttgttgtgtaaatcaaattaactatattcaaatgaatccgttagaagccaaatttaaaacgagcactctaagatcatggaaaactgatcaggcagatgctcataagcttgcttgtttaggaccgacgcttaaacaaacaggcaacttacctatacatgagttaatattctttgaattaagagaacgcgtccgttttcatctagaaatcgagaatgaacaaaatcgacttaaatttcagatccttgaattactccatcaaacattccctggtttagaaagattatttagtagtcgatattcaatcattgcactcaacatcgcagaaatctttactcatccagacatggttcttgatatcgacaaggatgtactgattacacatatattcaattctacagataagggaatgtcaatggataaagctacaaaatatgcacttcaattaagagtgattgctcaagaaagctatcctaatgtcgatagacattcctttctagtcgaaaaattacgcttacttattcaacaattaaaacaatctattcatcatctcaaacaattagatgatgccatgattcaattagcacaacaactcgattattttgaaaatattcattcgatacctggtattggtaagctaagcacagctatgattattggggagattggtgatattaagcgatttaaatcaaataaacaactcaatgcttttgttggcattgatatcaaacgatatcaatcaggtcatacacactgtagagataccatcaacaagcgtggtaataaaaaagcgagaaaacttttattttgggtgattatgaatataataagagggcagcatcattatgacaatcatgtcgtcgattattactacaaactaagaaagcagcctaatgagaaacctcataagactgccatcattgcttgtataaatcgattattaaaaacaattcattatcttgtaatgaatcataaattgtacgattatcaaatgtcaccacattag

SEQ ID NO: 545 - DNA, 1725 bp, Staphylococcus epidermidis
ataattatgtctaaattaattaaagggattgctgcatcagatggtgtggcaatcgcaaaagcttacttaattgtagagccagacttatcctatgacagtaacgaaaaagttactgacatagaaagtgaagttgaaaagtttaatgacgctatcgaagcttcaaaaatcgaattaactaaaataagaaataatgccgaagctcaattaggtgctgataaagcagcgatttttgatgcacatttacttgttttagatgatccagaattaatacaacccattcaagacaaaattagaaatgacaaagtcaatgctgcaactggtttggatgaagtaacgacacaatttatttctatttttgagtcaatggataatgaatacatgaaagaacgtgcagctgatatcagagatgtttctaaacgtgtattggctcatattctaggtgtagatttacctaatcctagtttaatcaatgaaagtgctgtcattgtaggtaatgacctcacaccttcagatacagcacagttaaataaagaatttgttcaaggttttgtaactaatatcggtggtagaacaagccactctgcaattatgagtcgttcattagagattgcagctgttgtcggtactaaatctatcactgaagaagttaaacaaggtgatatgattattgtagatggtatgtccggagatgttatcatagatcctacagaagatgagttaattgcttatcaaaataaacgtgagcgtttctttgaagataagaaagaacttcaaaaattgcgcgatgctgatacagtaacagttgacggtgttcatgctgaactagctgctaatattggtactccagatgacttatcaggagttattgataacggtgcacaagggataggtttataccgtacagaattcttgtacatgggtagagatcaaatgcctactgaggaagaacaattcgaggcttataaaaaggtacttgaaactatggacggtaaacgtgtagttgtacgtactttagatattggcggagataaggagcttccatacttagatttgcctaaagaaatgaatccattcttaggttatcgtgcgatacgtttatgtttagcacagccggaaatctttagaccacaattacgtgcattactacgtgcttcagtctatgggaaattgaatattatgttcccaatggtagcaacaattaaagaattccgtgacgctaaatcaatgcttcttgaagagaaagaaaatcttcttcgcgaaggttacgaagtttcagatgatattgaattaggtattatggttgaaattccagctaccgcggcacttgctgatgtatttgctaaagaagtagatttctttagtataggaacgaatgacttaattcaatacacattagctgctgaccgtatgtctgaacgagtttcatacttatatcaaccatataatccttcaattttacgattagttaaacaagttattgaagcttctcataaagaaggtaaatggactggtatgtgtggtgaaatggctggagatcaaacagctgtgcctttattattaggtttaggtttagatgagttctcaatgagtgcgacttctatcctaaaagctagaagacaaatcaatggtttaagtaaaaatgaaatggctgaactcgctaatagagctgttgaatgctcaacgcaagaggaagtcgttgatttagttaaccaattagctaaataa

SEQ ID NO: 546 - DNA, 1053 bp, Staphylococcus epidermidis
atatatttgttctttattgattcatttccaccttactatgtaaagagcctgagacttaaaagtctcaggctctttttatttcgttatcgtaacaatcccataccatgttatgctttaattattatgaaatacggagatgatgatatgtctattcccattataattgatactgatcctggtatagatgatgctacagcaattagtatcgcactttcacaccctcaatttgacgttaaaatgatatcaactgtgaatggtaatgtaggtattgagaaaacgacagcaaatgcattaaagctaaaaaggttttttaatagttctgttcctgtacatagaggggcatcccaaccattgattaatgacatctttgaagctacatcaattcatggtgagtctggtatggatggttacgagtttccacaaataaatcaagatgatttaacatcaattcatgcagttgaagcaatgagaaatctattagtaaatactcaagaacctttaaccttgattgccataggtccactaacaaatatcgctattcttttaactagttatcccgaagttcaaccatttattaaggaaattgttttaatgggtggtagtaccggtagaggtaatgtaacgcctttagctgaatttaatatatattgtgatccagaagctgctcaaattgtatttaactctggattacctttgactatgattggtcttgatttggctcgtgaagcattgtttactcaccattttgtaaaagacttcaaagatacaaatgcaacttcaaacatgttatataatttatttcagcactataagagtgaagattttgaaataggatttaaattatacgatgtattcactatattatatttgttggatccagaagcctttaatgtcaaggaggcgtatactcaaatagaattaaatggcaactttacaaggggagccacagtggtagactttaatatggagcatcccaattgtacagttgttttaagtcctgttgaaagacagtatgaggatttattcttaaacgccctttcttattgtaaataa

SEQ ID NO: 547 - DNA, 705 bp, Staphylococcus epidermidis
gtgtcattgttatatgaaggtaaagctaaaagagtattcacgacaaatattgatggacaattacgagttgaatataaagatgaggtaacagcaggaaacggtgcaaaaaaagatactatgattggcaagggtaagttaaataatcaaattacttctattatatttgattatttaactcataatcatattgacaatcactttattaaacaactttcacaaacagaacaactcgtccaacaagttgatattatacctttagaagttgttgttagaaacattgccactggttcgatcacaaaacgtcttggttttaaaaaggggcatacatttgaagaacctctagtagaattcttctacaaaaaagatgaacttaatgatccgcttattactgatgaccatgtaaaattactcggcatagcgaacgatgaagaaataaaacaacttaaacaaatggcaaaagatattaatcaagtactgattcaattgatgaatgaaatgagtttgagacttgtagattttaaggttgaatttggtaaaaccaatggtggaaaaattttacttgcagatgaaatctctcctgacacttgtagaatatgggataaaaatacggatactaactttgataaagatgtatatagaaacaacactggctcgttgattgaaacttatcaaacatttttaaataaattggaggatcttaaataa

SEQ ID NO: 548 - DNA, 222 bp, Staphylococcus epidermidis
agccaattgtttttacgatatttctttttcacactgaacccaacaccaaatgttgcaatgagaagtataaatgttaaaatcatcaatggaacattagcaacacctaatgcgaaactaaataaagttaaaaaaatgacagccaatattgagaagatccagaaaatacctttagattttttttgttgcatcccataccccaccttttacttatcttttcaataa

SEQ ID NO: 549 - DNA, 234 bp, Staphylococcus epidermidis
gaggacaatacaacaatggcagtatttaaagtattttatcaacataataaagatgaagtcatcgttcgtgaaaatactcaaacaatttatgttgagggacaaactgaggaacaagtgagacgttatttgaaagaccgaaattttaatattgaatttattactaaattagagggcgcacacttagaatatgaaaaagaacattcaacacactttaatgtggagaacgccgaataa

SEQ ID NO: 550 - DNA, 258 bp, Staphylococcus epidermidis
acttcaaatacaaaaatggccaatacggtaaagattaatgttcccacgatagcttcaatctttctaaagccaaatttcatgatgaataataataaaaatacatcaaatacagtgattaatgcgcctacaattaatggtatgccgaagattaaatctaatgcgatagcgctgcctataacttctgcaatatcagtagcgataattgctaattctgcaataatccagaacataattgctacaggcttatttaaaaaatga

SEQ ID NO: 551 - DNA, 294 bp, Staphylococcus epidermidis
cggatgaatacaatcgtaaaacatacagtaggttttattgcttctatcgtactaacgcttttagcagtttttgtaactctatacactaatatgacattccatgctaaggtaactatcatctttggttttgctttcattcaagctgcccttcaattattaatgttcatgcatttaactgaaggtaaagatggacgtttacaatcgttcaaagttatctttgcaattatcattactttagtaactgttatcggaacatactgggtaatgcaaggtggacactcttctcacttataa

SEQ ID NO: 552 - DNA, 240 bp, Staphylococcus epidermidis
actaaattaacgaggtgccttatgtataaagattataacatgactcaacttactctaccaatggaaacttcagttcttatccccacaaatgatatttcacgacatgtaaatgatattgtagaaacaattctagagactgaattcagacatcatcgtgatgcaatatcataccatccaaaaataatgttaaaagtagttttatatgcctatacccaatctgtgttttcaggacgtagatag

SEQ ID NO: 553 - DNA, 1905 bp, Staphylococcus epidermidis
tataataaaacagttgcaattaaaagtgggagtatacacaagaaaggaatttataaaatgactaatttaagagaagatgttcgtaatatagcgattattgcgcatgtcgaccatggtaaaacaacattagtagaccagttgcttaaacaatcaggtatatttcgtgaaaacgaacatgtcgacgagcgtgcaatggactctaatgatttagaaagagaacgtggtattacgattcttgctaagaatacagcgatagattataaaggaacgcgtatcaatatattagacacacctggccacgccgattttggtggtgaagttgaacgtatcatgaaaatggttgacggtgtcgtactagtggttgacgcatatgaaggtacaatgcctcaaactcgttttgttcttaaaaaagctttagaacaaaacttaaaaccggttgtagttgtgaataaaattgataaaccagctgctagacctgagggagttgtagatgaagtattagacttattcattgaattggaagcgaatgatgagcaattagacttcccagttgtttatgcttcagctgtgaatggaacagcaagtttagactctgaaaagcaagacgaaaatatgcaatccctatacgagacgattattgactatgtaccggcaccagtagataattcagatgaaccattacaattccaaattgctttactagattataatgattatgtaggtcgtataggcgttggacgtgtgttcagaggtaaaatgcgtgtaggtgataatgtatcactaattaaattagatggtacagttaagaactttcgtgtgacgaaaatatttggttactttggtcttaaacgtgaagaaattgaagaagcacaagcaggagacttaatagctgtttcaggtatggaagatattaacgttggtgaaacagttacaccacatgatcatcgtgacccattaccggtgttacgtattgatgaaccaaccctagaaatgacttttaaagtaaataactctccgtttgctggacgtgaaggtgattatgtaacagctcgacaaattcaagaaagattagatcaacaacttgaaacagatgtttctttaaaagttacacctactgatcaaccagattcatgggttgttgctggtcgtggtgaactacacttgtctattcttattgaaaacatgagacgtgaaggctttgaattacaggtttctaaacctcaagttattttaagagaaatcgatggtgtgttaagtgaaccatttgagcgtgtacaatgtgaagtgccttctgaaaatgccggggcagtgattgagtcattaggtgcacgaaaaggtgaaatgttagatatgatgacgacagacaatggtttgacgcgtttaatctttatggtacctgcacgcggtatgattggttatactactgaatttatgtctatgacacgaggttatggaattattaaccatacatttgaagaatttagacctcgcgttaaagctcaaatcggtggtagacgtaacggtgcattgatttctatggaccaaggtcaagcaacatcttatgcgattattaacttagaagatcgtggtgttaactttatggaaccaggtactgaagtatatgaaggtatgattgttggtgaacataaccgtgagaacgatttaacagtaaatattactaaagcaaagcatcaaacaaacgtacgttcagctactaaagatcaaacacaaacgatgaatcgtcctagaattttaacattagaagaagcgttacaatttatcaatgatgatgaattggtggaagtaactcctgaaagtattcgcttaagaaagaaaatacttaataaatctgcccgtgaaaaagaagcaaaaagagttaaacaattaatgcaagacgaacaataa

SEQ ID NO: 554 - DNA, 264 bp, Staphylococcus epidermidis
ataatgaaaacgattgaactacatatcactttacaaccacaagttttagatacacaaggacaagctttaaaccgagcagttcacgatctcggttatgaacaagtgaatgacattcgagtaggtaaagttttatatatgacagttaatgaaccaactgacgaggctgttgataatattattacgacactaagtgaaaagttatttgctaatacagtcattgaagaatatagctataaagttatcgatgaaaaggagaaagcataa

SEQ ID NO: 555 - DNA, 243 bp, Staphylococcus epidermidis
attatttatttaatacgatttgagattatatcttttatctttgaatttcttacaaaaaggagtttagagctaaaagttcttaaactagtaaaaagagacaatttctatattatttcatatagaaattgtctcttttataattttcaaactataataagcttgttgatatactatcttacttatataagttcctttaatacaaatcatattccttctataactagccaattgtttttggtttag

SEQ ID NO: 556 - DNA, 198 bp, Staphylococcus epidermidis
aaattattttatatgactatgcatcacttaaaagaacattcaatcaataaactaaaacaatatatcctactattaacctacctaaaatcagacacatcttatagacatattattcaacttaattctttctatataagatcatatttttctataagtaatattctttttttgtatctaattgataagatttatcaataa

SEQ ID NO: 557 - DNA, 747 bp, Staphylococcus epidermidis
gtgaaaagttatttgctaatacagtcattgaagaatatagctataaagttatcgatgaaaaggagaaagcataatatgaaatttgcagttcttgtgttccctggttcaaactgcgatagagacatgtataacgcagctattaaatcaggtgttgatgcagcgtatgtcgattatcgtgaaacgactttagatggttttgatggtgttttaatacctggtggtttttcatttggcgattatttgagatcgggagctatggcaagtgttgctccgattattaaagaagttaagcgatttgcgaaagaaggtaagcctgttttaggagtatgtaatgggtttcaaattttaactgagattggattgttaccaggcgcattacttcataatgattcacatttatttataagtagaaacgaaactttaaaaattactaataatcaaacaccttttacgcatttatatgtgaaaaatgagaatgttgtttatcctgtagcacacggtgaaggtcattattattgtactgatgaaatatatcgtgaactcaacgataacaatcaaattatccttaaatatacgaataaccctaatggctcttatgaggatattgcaggaatagttaataaagagggaaacgtttgtgggatgatgccacaccctgaacgcgcacttgaaacattattaggaacaaatagtggtgtgaaattgtttgaatcaatggtgaaaagttggagggaacaaaatgtctaa

SEQ ID NO: 558 - DNA, 1827 bp, Staphylococcus epidermidis
aagcgatatcatatagattttcaaactttatctaattggagtgatgtttctatgtattatacaaatagtaattatgaagcgtttgctcggcctaaaaaacctgaaaatgttgataataaatcagcctatttgataggggctggattagcttctttagctgcagcatgttttttaattagagatggacaaatgaaaggcgagaatatccatattttagaagagttagatatctcaggaggaagtttagatggcatcaatatggagcatcatggctatgtagtacgtggtggcagagaaatggaaaatcattttgaatgcttatgggatttattcagaagtataccatcacttgagcaaactaatgcttctgtgttagacgagttttattggttaaataaagaagaccctaattattctaaatgtagagcgattgaaagtggaggtaagcgtattgatactgatggtgattttacattaacaaaaaaagcaattaaagaaattttaaatttatgtttgatgaaagaagaagatttagacgatgttaaaatcactgatgtcttttcaagagactttttaaattctaatttttggctttattggaaaacaatgtttgcattcgagccatggcattcagcgatggagatgcgtagatatcttatgcgttttgtgcatcatattggtggtttagcagattttagtgcattaaaatttactaagtataatcaatatgaatctttagtattaccgatgatagaatatctaaaatcacatagcgtgaactttgaatttggagtacaagtgaataatattttagttgatgcaacaccatctactaaaattgctagagaaatcattttaactagagatgataaagaagaatctatcccgttgacagttaatgacttggtatttgttactaatggaagtattaccgaaagttcaacctatggtgataatgaccatcctgctcctataacacattctttaggtggtagttggacattatggaaaaacttagctaatcaaagtcctgaattcggaagacctgagaaattctgtgatcacattccagctaaaagttggttcgtatcagcaacggcaacaacagataataaaaaaataatctcatatatcgaacaattatgtaaaagagatgttttatcaggtcggacagtcacaggcggtatcatttctgtcgctaattcgagttggcaacttagttttacagtgaaccgtcagcaacaatttaagaaacaacctaaaaatcaagttagtgtatggatttacgcattatactctgacgaaaaaggagacttcattaaaaaaccaatcacggaatgtactggtagtgaaatctgtcaagaagtgttatatcatatgggtgttccacaagaggaaattgttgaattagctcaatcagaatgtaacacgattcctgtttatatgccatatgtaactgcatatttcatgcctagagcatacaaagatcgaccgttagtagtaccgaatggctctaaaaatttagcatttattggaaactttgcagaaacagcacgggatactgtattcactacagaatattcagttagaacagctatggaagctgtttatcaattattggatgttgatagaggtgtacctgaagtttatgcctctgaatttgatgcacgcgtactgatggatgcattttatgaattaaatgatcgtaaatctttacatgaacttgttaataaaaactttattaaaagatcagtattaaatacagtgctgaagaaaatacgtggtactttcattgaagaattgttacgtaaacataaattactatag

SEQ ID NO: 559 - DNA, 609 bp, Staphylococcus epidermidis
gtcatgagtcatgatgcaaatactattgattctcgtacacacgaaggcgaattaaataaacttggcttttggattttccttacagctgaatttgcgttattcggtaccctatttgcaacgttattaacgttacaacatggtggcggatatggcggtaaattaactaccgacttattcgaattacatttgattttaataatgacttttgcattattaattagttcttatacttgtggtattgcaatttattacatgcgacaagaaaaacaaaacttaatgatgttttggatgattatcacagttatcctaggtcttgtattcgtaggtttcgaaatttacgaattcgcacactatgcttctgaaggtgttaacccaactattggctccttctggtctagtttctttatactactaggtacgcacggtgcacacgtatcattaggtattgtttgggttatttgtttgttaattcaaatcggcactcgtggtttggattcatacaatgctcctaaattatttatagtaagtttatactggcacttcttagatgttgtttgggtcttcatctttactgccgtatatatgatagggatggtgtatagcggatga

SEQ ID NO: 560 - DNA, 894 bp, Staphylococcus epidermidis
cacatgatccagaaattattaaacgatatccaacaagacgattacgcgtggaagatggatgtcttaaagaaatggaaggtgaacacattgtttgaaagatggaaaaaacgccacaccttcgttgatgatgtaaatattattactaagttacttttaggtatcgcattattctttttcattatatttatccataacttcgactttatgatttatatcgtcatattaatgtttatgttcttacttttatttaacggtacagaatttaaaataactgcaatatttattttagttacaaccctctttgccttgatgtcatcattatttatgattttatatggtgatggagaacatatgcttgtaaaatttggtattttgcaaataagtacagaaagtattgtacgaggtcttcatctatctatgagaacaattaccgtttcaatttttggtatactaatcgcattgacttcacaaattgtaatgattttttatagtttaatgcaacatttaaaggtaaagccaaagtttgcttatgcttttatggcagcgattagaatggttccacttataataagttctcttattcaattaagacgttccctaaaaatgcgttatcaaatgatagatgcatctaactataaaggaatcaagcgtcttaaccatttagtcatacctttattaagtcaaaatattcgacgtgcacatcaactttcagttgcaatggagtctaaaggttttaaagatggtccgagaacatactactatcgggtaccattttcatataaagatatcgtatttattgcttgtatattaattatcattactttgtcatttgtcttatcatcataccttccaattactggtattcatgatgtccgttttggacaattagactaa

SEQ ID NO: 561 - DNA, 633 bp, Staphylococcus epidermidis
cttctgacgcacaactttcctagagaaggttgtgcgttttttaggaggatgttttttatgtcaaaaggtttgaaactatctgaaattcttgtgacagttttaatttcagtagtatttgccatcatttataacttatggtggtttgtttacaatattgtacaagttgcgggtattcacttagaacaacttacatatggtgtatggtttatggcagcagtcgtttgttacttaatcattcctaagccaggtatagcattattagcagaaatcgcagctggagctggtgaaacgattgttatgggaaaatttgatatacctactatcatatatgcgatattacagggattggcttgtgaaattatatttgctatttttaaatacaaatcacgttctgctgctgtagcaatgcttgctgggttagcaactgctttaatctctttcccagtggattacttctatggttacttaaacgaagttgctggatggaacttactactatttatagttttccgttcaattagcggaattgtattagctggtttagtttcatactggattgtcaaagcattagataaaaccggtgtaactaaattctttagaccagcatcacaacaagattacgataacctataa

SEQ ID NO: 562 - DNA, 1224 bp, Staphylococcus epidermidis
agtgtgaggcaaacaataaagatgaaattaaataaatttaaaatcgtattttttattatcgtattattaactttagtcgtgtcaataggtatattaggtgttgaatggacaagacacctagaattaaaaaaacaaacgttaagtcaagaaagtggaaatacgaattatatagaaaagagagataagactgttgagaaacctaaaaaaataaagactaaatatgataaaaaagatcctacttccaaatcgataaacaaatatttagaaaaaactcaatttaatggaactgtagctgtatttgataatggaaaagttaaaatgaataaaggatatggttatcaagatatagagaaaggcaaaaagaacactgcaaatacaatgtatttaataggatcagcgcaaaaatttacaacaggtttaatgctgaagcaacttgaagtcgaaaataaagtgaatttgcaagattcagtcactaaatatattccttggtttaaaacaaataaagaaattacaattaaagatttaatgttacataaaagtggactatataaatatgaagcttcaactaatatcaaaaatttagaacaggctgttagagcaattcaagctcgaggtattgatgatacagtttatcataagcatcaatataatgatgctaattatttagttttagctaaagttattgaaaatgttactggaaaaccatatgttaaaaattattatgaacgattaggtaataaatataatctcaaacatactgctttttatgacgagaaacctcttcaaagtgagatggcaaaaggctataagtttaaaaataatactttttcattccttaaacctaatatattagatcaatattatggagctggtaatttatatatgacgccacatgatatgggcaaattaatttatacgttacaacaaaataaaatctttaatgcacgtcaaactcgacctattttacatgaatttggaactcaagaatatccagaagaatatagatatggtttttacataactccgtatttaaatagagtcaacggggtattctttggtcaaatttttactgtttactttaatgatcggtatattgtcattttagggacgaatgtaagtaatacacctggattagtgagtaatgaagacaaaatgagacacattttctataatattcttgaccagaaaaagccttataatacagcaggtgttaaagttgagtaa

SEQ ID NO: 563 - DNA, 669 bp, Staphylococcus epidermidis
ataaactttaaaagtttatgctacaatatccataatcatattaaaaggaggcatattatgacccaatatactttttcacctaaggattttaaagcttttgaagtcgaaggtttagaccaaagaatggaagcacttaatgactatgtcagacctcaacttcatcaattaggatcttattttgaagaatatttcactacacaaacaggtgaaactttttatgctcacgtagctaaacacgcacgtagaagtgtcaatccacctatcgatacatgggtagcttttgctcctaataaacgtggttataaaatgttaccacactttcaaatcggattgtttagaaatcagcttttcattatgttcggtatcatgcacgaaggtagaaataaagaagaaaaagtgaaaatatttgataaacattttgataaactgacatctttaccaagtgattatagtgtttctctagatcatatgaaaactgaaaagcactatatcaaggatatgagtaatgaagagttgcatgctgctatcgatagagttaaaaatgttaaaaaaggtgaattttttgttgccagaacattatcaccaaccgataaaagattaaaatctgataagtcttttctaaaatttgttgaggaaacttttgatgaatttttaaaattttatcaataa

SEQ ID NO: 564 - DNA, 873 bp, Staphylococcus epidermidis
gagtggtttaaggtggttgctaaaattttagatggtaaacaaatagcaaaagaatatagacaaagacttaaaaatcaagtcaatgacttaaaagaatatggttttactccaaaattatcagtcatattagttggtaatgatggtgcaagccaaagttatgtaaaatcaaagaaaaaagcagcagaaaaaattggaatgatatcagaaattattcacttagacgaatccacatcagaagaagtagttttaagcgaacttaatcgattaaacaatgacgatactgttagtggtattttagttcaagtaccattacctaaacaggtaagcgaacaaaaagtacttgaagctatcaatccggaaaaagatgtagatggtttccatccaattaatattggaaaattgtatattgatgagcaaacctttgtaccatgtacacccctgggtattatggaaattttaaaacacgcagatattaatttagaaggaaaaaatgcagttgttattggtcgtagtcatattgttggccaacctgtttcaaagttattgttgcaagctaacgcaactgttacgattttacattcacgtacaaaaaatatgaatgcacacttaaaacaagcagatgtgattgttagcgcagtaggacaacctggtttagttactaaagaaaatgtcaaaaaaggcgcagtaattatagatgttggtaatacacctgatgaaaatggaaaattaaaaggagatgtagcatatgatgaagtaaaagaaatagctagtgcaattactccagtaccaggtggtgttggtcctttaactattacaatggtacttaataatacacttcttgcagagaaattaagacgtggcttaacaaaataa

SEQ ID NO: 565 - DNA, 276 bp, Staphylococcus epidermidis
gttgtacttaaatcattattggctaaaatttgttgtacgagttcattattattaagtgtgttttctaaattggcaattgacgtatcattactaaaagatacgagcgcaataaacattgaaacaatagttaatatgagtaagaatacccaactaaaccaacctaatattttttcagttagccgatttgctggacgcttaatttgtgtatattgctctcctaacattcgttacaactccttaacttacttatcacattattatattaaaaaattctaa

SEQ ID NO: 566 - DNA, 1113 bp, Staphylococcus epidermidis
atggctcctaagttacaagcccaattcgatgcagttaaagttttaaatgagactcaatcgaaatttgaaatggttcaaattttggatgaagacggaaatgtcgttaatgaagacttagtacctgatttaacagacgaacaattagtggaattaatggaaagaatggtatggactagaattcttgatcaacgttctatttcgttaaatagacaaggacgtttaggtttctatgcaccaacagcaggacaagaagcttcacaattagcatctcagtatgctttagaaagtgaagacttcattttacctggttatcgtgatgtgcctcagattatttggcatggcttacctcttacagacgcattcttattctcaagaggacacttcaaaggtaaccaattccctgagggagttaatgcacttagccctcaaattattatcggtgcacaatatattcaaactgccggtgtagcgtttggacttaaaaaacgtggcaaaaatgcagtcgcaattacttatacaggtgatggtggttcatcacaaggtgacttctatgaaggaattaactttgcatctgcatacaaagcacctgcaatttttgtaattcaaaacaataactatgccatctctacaccacgtagtaaacaaacagctgcagaaacattagcacaaaaggctatttcagttggtatccctggaattcaagttgatggtatggatgctttagctgtttatcaagcaacattagaagcacgtgaacgtgcagtagcaggagaaggtcctactgttatcgaaactttaacttatcgttatggaccacatactatggctggtgatgatcctactcgttatagaacttcagatgaagatgctgaatgggagaaaaaagacccattagtacgtttcagaaaatatttagaagctaaaggtctttggaatgaagacaaagaaaatgaagtggttgaacgtgcaaaatctgaaataaaagcagctattaaagaggctgacaatacagaaaaacaaactgttacttctctaatggatatcatgtatgaagaaatgcctcaaaatttagcagaacaatatgaaatttacaaagagaaggagtcgaagtaa

SEQ ID NO: 567 - DNA, 1551 bp, Staphylococcus epidermidis
ttcagacgtaaaaataaaagaaaacgtttcagatatcaaacaaaaatgggaaggggctatagttcaatgtctaactactcaggattaaatgaagaatgtggcgttttcggtatttggaatcatcctgaagcagcacagttaacatatatgggtctacatagtttacaacacagaggtcaagaaggtgcaggtattgtagtttcaaatcacgaaacgctaaaaggtgaacgaggattaggcctattaactgaagcaattaaagacgaacatatgtcaaatataaaaggttatccacatgcgataggacatgttcgttacgcaacctctggtaataaaggcattgaaaatattcaaccatttttatatcacttttatgatatgagcgtaggtatatgtcataacggtaatttaattaacgctaaatcattacgtcaaaatttagaagaacaaggtgcgattttccattcttcttcggatactgaagtcattatgcacttaattcgtcgtagtaaggcgccgacatttgaagaggcattgaaagagagtttacgactcattaagggtggatttacttttgccatcctaacaaaagatgcgttgtatggtgcagtagatcctaatgctattcgaccattagtagttggaaaaatggagaacggtgcttatattttagcaagtgaaacatgtgcgattgatgttttaggtgctgaatttatacaagatattcatgcaggtgagtatgttgttattacggatgaaggtatagaagttaagacttacacacgacaaacaacaactgcaatttcagctatggaatatatttattttgcgagacctgattcaacgattgcaggaaaaaatgttcatgcggtacgaaaggcatcaggtaaacggttagcacaggaaaacccagcaaaagcagatatggtaataggcgtacctaattcatcattatctgcagcaagtggttatgctgaagaaataggcctaccatatgaaatgggactagttaaaaatcaatatgttgctcgaacttttatacaacctactcaggaattaagagagcaaggtgtacgtgtgaaactgtcggctgttaaggatattgttgatggtaaagatatcgtacttgtagatgattcgattgttcgaggtacaacgattaaacgcatagttaaaatgcttaaggattcaggagctaaccgcattcacgtaagaattgcttctcccgaattcatgttcccttgtttttatggtattgacgtatctacaacagctgaactcatctcagcaagtaagtctcctgaggaaattaaaaatcatattggtgcagattctcttgcttatttaagcgttgatggcttaatcgagtctataggacttgattatgatgcgccatatcatggcttgtgtgtagaaagttttacaggtgattatccagcaggactttacgattatgagaaaaattataaaaagcatttaagtgaacgtcaaaaatcatatatagctaataataaacattattttgatagtgagggaaatttacatgtctaa

SEQ ID NO: 568 - DNA, 1422 bp, Staphylococcus epidermidis
tggaggggtaaaaacatggtagttggagatttcccaattgaaacagatactattgtaataggagcaggtccaggtggatatgtcgcagccattcgcgcggctcaattaggacaaaaggtaacaatcgttgagaaaggtaatttaggtggtgtatgcttaaacgttggttgtataccttcaaaagcattactacatgcttctcatcgctttgttgaagcgcaaaattcagaaaacttaggggtaattgctgaaagcgtttcgttaaactatcaaaaagttcaagaattcaagacttctgtagttaataaattaactggcggtgttgaaggacttttaaaaggtaacaaagtagagattgttagaggtgaagcttatttcgttgataacaatagtttacgtgtcatggacgaaaagagtgctcaaacttacaatttcaaacatgcgattatagctacaggttcaagaccaattgaaattccaaattttgaatttggtaaacgtgttatcgattcaacaggagctttaaatctacaagaagtacctaacaaactagttgtagttggtggcggatatatcggttctgaattaggtactgcttttgcaaactttggctctgaagttactatccttgaaggtgcaaaagatattttaggcggatttgaaaagcaaatgacacaacctgttaaaaaaggtatgaaagaaaaaggtatcgaaatcgttactgaagcaatggcaaaatctgcagaagaaactgaaaatggtgtcaaagtaacttatgaggcaaaaggtgaggaacaaactatcgaagctgattatgtattagttacagttggccgtcgccctaatactgatgaattaggattagaagaacttggtctgaaatttgctgatcgtggattactagaagtggacaaacaaagtcgtacttctattgaaaatatctttgcgattggagatattgtacctggattaccattagctcacaaagctagttatgaaggtaaagttgctgctgaagcgatagatggtcaagccgcagaggtagactatattggtatgccagcagtttgctttacagaaccagaattagcacaagttggttatactgaagctcaagcaaaagaagaaggtttatcaattaaagcttctaaattcccttatgcagctaatggacgagctttatcattagatgatacaaatggttttgttaagttaattacacttaaagaagatgatacgcttattggagcacaagttgtaggtactggcgcatctgatattatctctgaattaggtttagctattgagtcaggtatgaatgctgaagatatcgcattaactgtacatgcacacccaactttaggtgaaatgacaatggaagctgctgaaaaagcaattggttatccaattcatactatgtaa

SEQ ID NO: 569 - DNA, 210 bp, Staphylococcus epidermidis
tcaatattcaattcatcatatttcatcggaagttcaattaaattaggtactattccacttaatacattaagtaatgtgcttttacctgatccggaaggaccgagtaaaagcactttttctttatttttaatctcaagatttaagttattgaatattttcctatcaccattcggatactttaaacgtaaatttttaacacgtaacaattaa

SEQ ID NO: 570 - DNA, 321 bp, Staphylococcus epidermidis
gttatgaacaaattactacagtcattatcagcacttggagtttcagctacattagtgacacccaatttaaatgcagaagccactactaatactgaacctcaattaaaaggtgttaacgatatcgttattgaaaaaggacaagaatataatttacttaaaggcataagtgcttacgataaagaagacggcgatcttactcataaaatcaaaattgatggtcaagttgatacatccaaagcaggtaagtataaagtaaaatatcaagttaccgattctgatggtgctgaaaaaacttctataagaaatattgaagtaaaatga

SEQ ID NO: 571 - DNA, 1071 bp, Staphylococcus epidermidis
ctaataataaacattattttgatagtgagggaaatttacatgtctaaagcatatgaggaatctggtgtaaatattcaagcaggatatgaagcagtcgaaagaataacaagtcatgttgaacgtacattgcgcaaagaagtattaggtggtttaggtggatttggtgcaacatttgatttgtctcaattaaaaatgaaagcgccagttctggtatcaggtactgacggtgtgggtacaaagttaaaattagcaattgactatggaaagcatgacacaattggtattgatgctgtcgcaatgtgtgtaaatgatattttaacaacaggtgctgaacctttatactttttagactatattgccacgaataaagtagtgccaagtactatagagcaaatcgttaaaggtataagtgacggttgcgaacaaaccaatacggcacttataggcggtgaaactgctgaaatgggagaaatgtatcatgaaggtgaatatgatattgctggttttgcagtaggagcggtagagaaagaggactatattgatggttcaaatgttgaagaaggacaagcaattattggtttagcttcaagtggtattcattcaaatggctatagtctagttagaaaaatgataaaagaatcaggagttcaattacatgatcaatttaatggtcaaacctttttagaaaccttccttgcaccaacaaaattgtatgtaaagcctattcttgaattaaagaaacatattgatatcaaagcgatgagccatattactggtggaggtttctatgaaaatattccgcgtgcccttcctaaaggtttatcagcaaaaatagatacacaatcattcccaacgttggaagtctttaattggcttcaaaaacagggcaacatttcaacgaatgaaatgtataacatatttaatatgggtattggatatacaattattgttgacaaaaaagatgttcaaacaacattaacaacgttacgtgcaatggatacaactgcatatgaaattggtgagattataaaagatgatgatacacctattcatttattggaggtagaatag

SEQ ID NO: 572 - DNA, 957 bp, Staphylococcus epidermidis
agaaatccaaataaaaatagcaaaacgactaagacagagcaatttaaacaggtgaataaggatgctgagaaccctaaacctaaagaaaggatagggacttggattggaaaagatattaaaacactaacgcatcattatggacaagctgatcggtcttatccatataaaaatgggttaaaaaattatgtctttaaacagaaagatgaatattatattgtaagtactaataaaggaacaatcacatcagtttatgccacaggtaaaggtgtgaaagtgagcccacttaaaataggtgaaagttcatctcatatttttgaagatactagtattaatccagaaccaactgtcaaaacgaaaggtaaaacttataaatttgaaatgtctgatgaagacttaaagacacagacgttaattaaatatggagatgtttatgctcaaatatattctgatcaacaaactaataaaattttggcagtgagatttttagatgcaaatacattggcaacactacaaccatataagttaaatagagcagaagatgagggacaaattagtgaaagttccgacgataaaattccacatgaacaaaaccctaatcaattgattacactctatgaagtaacgaataaaatgagagaaatgaaaaatttaaattcacttaaagttaacaacgatattgctcgtattgctgctatcaatctgtatgaagcaacggataaaggatcaaacagtgtggagtttactgagaatgctttaacacaacaactggatgaacgccatgtaagttataagtcagcaagtcaaaatgtaggttatgattttgacgatgtacctacacttattcatagttggattaattctgatattcatcgctcacgcttgttaagtaataaatatgatgaaatgggtggagaagtgatgagtgattattattcattaatatttgtagaaaagtaa

SEQ ID NO: 573 - DNA, 1227 bp, Staphylococcus epidermidis
tatatgaaaaattttaaaaatataatgcgatatattggaaagacttctaaatttatcgattatccattgttaataacttatgttgtcctctgtttgattggattagtaatggtttatagcgcaagcatggttgcagctacaaaaggtacgttaaccgggggagtaccagtttccggaacatacttctacaatcgacaacttttatacgttatcatgagctttgttatcgtattttttatggcttttattatgaatgttaaagtattaaaaaagcctaatgttcaaaaaggtatgatgattggtatttttatacttttactactaacattagtaataggaaaaaatatcaatggttctaaaagttggattaacttagggttcatgaacttacaagcttcggagttattgaagatttcaataattctatacataccatttatgattgaaaagaagatgcctgcggtgaggcataatataaaattaatattaggaccaattttgtttgttgtaacttgtctgatacttgttctttttcaaaaagatgttggtcaaacaatgctgattgtgatcatattcttctcaattattttttactcaggtatcggtgtgcagaatatgttaaaatggggcgctttggtagctattggttttatcatcgtagctacatttatgttcatgttagatatggttccaagttatttgcaagcacgttttagtacgttaaccaatccatttagtcaagaatcaggcacaggatatcatatttctaattctcttttggcaattggcaatggtgggttgttcggacgtggtctaggaaatagtattatgaagcttggttatttgccagagccacatacagactttatatttgctattatttgtgaagagatgggattaatcggtggcttaatcgttttaattttagagtactttattgtatatcgcgctttccaacttgctaataaaacgcaatcgtatttttataaattagtttgcgttgggatagctagttatatcggaagccaaacattcgtaaatatcggtggtatttctgctacaattccacttactggtgtaccgttaccatttattagttttggtggttcatcgatgattagtttaagtatagctatgggattactacttattacagcaaaacagataaaacaagatgataaacgactgaaacaacgtaaggtagatattaaacgtcgatataattaa

SEQ ID NO: 574 - DNA, 552 bp, Staphylococcus epidermidis
gtggttagaaagatggatattggatacaaattacgtaatttaagaagaataaaaaatttgacacaagaggaattagcagagcgaactgatttatcaaaaggatatatatcacaaattgaaagtaatcatgcttcacctagtatggaaacatttttaaatttaatagaagtacttggtacttctgcaagtgacttttttaaagaaccgtcagatgagaaggtactttataagaagaaggaacagaccatttatgatgagtatgataaaggttatatcttgaactggcttgtagcgaattctaatgaatttgacatggaaccattaatcctaactttacgaccaaatgcctcatataaaaactttaaaccatctgaatcagatacttttatctattgtttaaatggtgaagtatcacttcaattaggaaatcaagtatataaagcttgtaaagaagatgtactttattttaaagcgaaagataaacatcgcttatataacgaaacagataaagaagtgaaggttttaatcgttgccacagcttcatatttatag

SEQ ID NO: 575 - DNA, 537 bp, Staphylococcus epidermidis
ttgaatagaaaagtagaaaaaagattagcgtggattgcaaatatcttgagcctattatttttaatttttggtattctatcgatatttgttattaataacacatcaaatcaacaacaatataatgaattaatgaagcagttttcaggtaataatcaagatatgtcatctgaaatgtttttagtttctcttattgcgtcattagtcattttaggtttttcaacgctattaggttttgttggtacaatggtaattgaaggtataaaaaaccttgctgctactttactcatagcagcggctatcgtaggtttatttacgactaatttaatcgcaatggttttatggatgattgctgcgattagactttttgcaaaaaaagataaaacagatgtaaatgaaaatgctacggctcaacttcgtcaaaaccattcaaagagccaaagtgattggaatcatcaacaaaaccaacaacataaagatgcttgggatcctgaacaagaaatcaacaaacaaaaaaaggacgatccatatatatattaa

SEQ ID NO: 576 - DNA, 423 bp, Staphylococcus epidermidis
tataatttgaagataaaggagtttgatttatttatgaaacaatcatttattaaaattggtgaaggtttaaccgatttattcgaatttacaactcttatagaatataatcataagcgaatcaatcgtattgtgtatttccatacacctcattctgagaaacaattatcgtccgttgcaataataatgaaccctactgctgaaaaacatttccaggctatgtatatcatgacaaatgccttaaaatatccctatccagagggcaacaaaaaattcaatatgattaattcagctgcagaaaattatgacataccagttgtaggtatcgacgtacaacctcctgatgtatatccagacttagaattatattttaactaccttatcagtgttttgcgtcttcaaagatggataccacctttgcaataa

SEQ ID NO: 577 - DNA, 228 bp, Staphylococcus epidermidis
agccatatgaaatggtcaataacacaattgagaaaatatcaaggtaagccatttgaatttaatcaaacggttaattttgagcatttaagagaatcattagatttaattgatctttcagatatcaatgttgaaggacagttgacagtcaaatcaaatgaagtgattgcagacatgcatgttactggaacttacacgatgccttgtgctgtcttcaccacgcgcggatgg

SEQ ID NO: 578 - DNA, 633 bp, Staphylococcus epidermidis
cagttcatgaattttaaaaagactgtagcaattgtcctaacgtcagcagtgttattagctggatgtactatagataaaaaagaaattaaaaaatatgatgatcaagtacaaaaagctatggaccaagagaaaaccgttaatcaagtaagtaaaaaaataaacgaattagaagagaaaaagcaaaaattatttaaaaaggtaaatgataaagatcaaagcacacgtaaaaaagcagctgaagatatagttgaaaatgtaaaacaaagacaaaaagaatttgaaaaagaagagaaggctctagataattctgaaaaagaatttaaacaagccaagcaatatcttgaacatgtagaaaacaaagcaaagaaaaaagaagttgaacaacttgatagtgctattaaagaaaaatataaatcacatgatgcttatgcaaaggcttacaaaaaagcacttaataaggaaaaagaactgttttcttatttgaatgaagataatgcaacacaatcggaagtagacggaaaatcgaaagatctttctaaagcatataaagaaatgaataataaatttaatgcttactcaaaagccattgagaaagtaaaaagagaaaaacaagatgtagaccaattaaaataa

SEQ ID NO: 579 - DNA, 477 bp, Staphylococcus epidermidis
gtaaggatgaaacttatgaacgtacccattttaccaacgataagtacatcgtgtattgttattagtgcgattttagtcgctattggttgggcattgatttggaaacgtcaagttcataagcataaaaacattatgctatgggctgcctttttcgctttaacattctttattatttatgcagcaagaactatttttatcggtaatacagctttcggtggaccaagttctattaaagtttattacactattttcttagttttccatatcattcttgcaacagttggtggcgttttaggcttaattcaaatcattttagccttcaaagataaacttcatattcacagaaaaattgggccttgggcttcaataatttggttctttaccgcaattactggtgttgcagtttatgtattgttatatgtattgtatccaggtggagaaacaacatcattgcttaaagctacattaggtctataa

SEQ ID NO: 580 - DNA, 672 bp, Staphylococcus epidermidis
tggaggacgaatatggataaagagtatgtcgtaattggactagggcgttttggtggtagtattgttagagaacttaacgcattagacatggatgttatggctattgatagagacgaaaatcgtgttaacgaatatagtgatatagcaacacatgcagttgttgctgatacaactgatgaggcagtaatgaagagtttaggaatacgtaatttcgatcatgttattgtcgctattggtgagaatatacaatctagtacactaacgacgttaattcttaaagaattaggtgttaaaaaggttactgctaaagcccaaaatgattatcatgctaagattttaaataaaataggtgccgatactgttgtgcaccctgaaagagatatgggaagacgtattgctcataatgttgctagtgctagtgtccttgactacttggaacttgctgatgagcattcaatcgttgaattaaaatctacagaaaaaatggcaggacaaacaattattgaattagatattcgagctcaatatggtattaacattatagcaattaaaagagctaaagaatttatagtctctccagaccctaacatcaatattgaaataggggacattttaattatgattggtcatgataatgacttaggtcgctttgaaaaaaatataagcaagtaa

SEQ ID NO: 581 - DNA, 1314 bp, Staphylococcus epidermidis
gaggacaagaacgtggcatttgaatttagattacccgatatcggggaaggtatccacgaaggtgaaattgttaaatggtttattaaagccggcgatacaattgaagaagatgatgtattagcagaagttcaaaatgataaatctgtagtagaaattccttctccagtaagtggtactgttgaagaagtgttagtagatgaaggaacagtggcagtagtaggagatgtcatcgttaaaattgatgcacctgatgcagaagaaatgcaatttaaaggtcatggcgatgatgaggattctaagaaagaagaaaaagaacaagaatcaccagtgcaagaagaagcttcatcaactcaatcacaagaaaagacagaagtagatgaaagtaaaactgttaaagcgatgccgtcagtgcgtaagtatgcacgtgaaaatggtgtcaatattaaagctgtaaatggttctggtaaaaatggacgaatcacaaaagaagacatcgatgcatacttaaatggtggtagttccgaagaaggttcaaacactagcgcagcatctgaatcaacttctagtgatgtcgttaatgcttctgcaacacaagcattaccagaaggcgacttccctgaaactacagaaaaaatacctgcaatgcgcaaagcaattgctaaagcaatggttaattctaaacacactgcacctcatgttacattaatggatgaaattgatgtgcaagaattatgggatcaccgtaagaaatttaaagaaattgctgctgaacaaggtacaaaacttactttcttaccatatgttgttaaagcattagtttctgcacttaaaaaatatccagcacttaatacttctttcaatgaagaagctggagaggttgtacacaaacattactggaatattggtattgctgcagatacggataaaggattattagtaccagtagttaaacatgccgatcgtaaatcaatattcgaaatttctgatgaaattaatgaactagctgtaaaagcacgtgatggtaaattaacttcagaagaaatgaaaggtgcaacatgcacaattagtaatatcggttccgctggtggacaatggttcactccagttatcaatcacccagaagtagctatcttaggaattggccgtatcgctcaaaaacctatcgttaaagatggagaaattgtagctgcaccagtgttagctttatcattaagctttgaccatagacaaatcgatggtgctactggacaaaatgctatgaatcacattaaacgcttattaaataatccagaattattattaatggaggggtaa

SEQ ID NO: 582 - DNA, 564 bp, Staphylococcus epidermidis
atgaaatggaagtgtgagtcaatgcgtgtaattgcgggtaagcataaaagtaaagcgctagaaagtttagaggggcgaaatactcgtccaactatggataaagttaaagaaggtatttttaatagtttatatgatgtttctggtttaggattagacttatttgccggtagtggtgcacttggcattgaagcattatcccgtggtatggataaaatgatttttgtagatcaaaattttaaagcggtcaaggttataaaagctaatcttaatcaattagatttaatgtcacaagctgaagtctataaaaataatgctgacagagcacttaaagcacttgctaaacgagaaatacaattcgatgttatctttttagacccaccttataataaagggcttataaatgaggcgatttctcgtatagcagagtttaacttattaaaagaaaatggtattatcgtttgtgagtttagtcataatgaaaaaataacaattgcgccatttcaaatgattaagcgttatcattatggtttgacagatactttgttacttgaaaaaggagaataa

SEQ ID NO: 583 - DNA, 240 bp, Staphylococcus epidermidis
tgtatgactgatacagtgattatttatacacaagatgactgtccaccttgtgcttttattaaaaattatttagtaaataaaaatataaaatttacagaaaaaaatatcaaaaaccaaaaatataaaaatgaaatgatggattacgatgcttttgctacaccttttattttgcttaaagggatgccaatgtatcaagtagatatggaaaaattgaatgatgaattgaatattacaccttaa

SEQ ID NO: 584 - DNA, 450 bp, Staphylococcus epidermidis
ataaaggatgattctgtgattactgaagaaacattagacattttagatgatattgaggatatctcggatatgattgtacaatctgatatttatgtctcataccgacgagctaaaatgcaattagatgctgatgatgaggcaagtctactttatcaagcttttctaaaagtgaaagataagtatgatgatgtgatgagatttggaaaatatcatcccgattacaaagatattatgttagaaactcgaaaacgaaaacgtgcttatgaaatgcttccagtagtaatggagtataaagcaaaggaagtggcattacaaaatttaattgacgaagtgatgtccaaaatagcattagctgtttctgagcatgtaaaaattgaaacaggtaatcctttcttccaaactggacatgatggatgtgcatctggtggcacatgtaactgttcattgtaa

SEQ ID NO: 585 - DNA, 903 bp, Staphylococcus epidermidis
  unsure (6): Identity of nucleotide at the above locations are unknown.
ttttcnggtgaagacgttggtgttaacggtggtgtattccgtgttactgaaggtttacaaaaagaatttggcgaagatcgagtatttgatacaccattagcagagtctggaattggtgggcttgcactaggcttagcagtgactggcttccgtcctgttatggaaattcaattcttaggattcgtttatgaagtatttgacgaagtagctggtcaaattgctcgtactcgtttccgttcaggtggaactaaaccagcgcctgttacaattcgtacaccttttggtggtggcgtccacactccagagttgcatgctgataatttagaaggtatcttagctcaatcacctggtttgaaagtagttattccatcaggtccttatgatgctaaaggattattaatttcttctattcaaagtaatgatccagttgtatatctagaacatatgaaattatatcgttctttccgtgaagaggttcctgaagaacaatacaaaattgacattggaaaagccaatgttaaaaaagaaggtaatgatattactctaatatcttacggggcaatggtacaagaatcactaaaagctgctgaagagttagaaaaagatggttattcagttgaagttattgacttacgtactgtacaaccaattgatatagatactttagtagcatcagttgagaaaactggacgtgctgtagttgtacaagaagcacaacgtcaagctggtgtgggtgcacaagtggcagcagaattagcagagcgagcaattctttcattagaagctccaatagctcgagtagccgcatcagatacaatttatccatttactcaagctgaaaacgtttggttaccaaataaaaaagatattatagagcaagctaaggcaactttagaattctaa

SEQ ID NO: 586 - DNA, 183 bp, Staphylococcus epidermidis
tccaattacgacatactctttatccatattcgtcctccactatataaaagaggaatgattactaacattcctcagagtcttattatttctttccttccacatatgctttgtcgaaaacaaataatcttaataataatattaacgatggaattaataaaagtaaacctaaaacaaaaacaataa

SEQ ID NO: 587 - DNA, 192 bp, Staphylococcus epidermidis
ttacagcaagatatagataatatgaagcgatacacccataagagcagagtcttttattataaagttgatagaaaggtgactctttatacgaaatatgacaaaaaagttcaggtcagtgaaagaataacgttgactacaatgggattaaactacaatttatgttttgtatctaacactatgattgagctgtaa

SEQ ID NO: 588 - DNA, 504 bp, Staphylococcus epidermidis
aaatttagggagtgggcatttatgattcaaataaaaggagcagtcaatttccctatttcattggatagtacgacttggatatttgacgatagaaaagttactattgatgatttagaacgtggggtatttgatggtactagacccatcaactttgatgataacaaggaatggaaccgtgctattttagaaggacaaacaaatccaccaacgcttgattctgaaattaaatataaaaaacgatcggttttagatgaaacatttgtgataaatatgacaccatttttcaaaaacgccgaacctatggaaaatgctagcacaataaaactttctaataaagattattccatcaatgtacccatggacttattaccttatttgttctttcaattttctagtaatggcaaacgtttatatagtgataatgctgttgatagtttcatatatattcctgaagaaggatactctcatcaatttaagtatgtcacacatatagaggtgatttaa

SEQ ID NO: 589 - DNA, 339 bp, Staphylococcus epidermidis
tacttggcactactttattcgtggcaatatagtctaaaaagtataaaggttcagcacctgttgttaaaatatcatttacacacattgcgacagcatcaataccaattgtgtcatgctttccatagtcaattgctaattttaactttgtacccacaccgtcagtacctgataccagaactggcgctttcatttttaattgagacaaatcaaatgttgcaccaaatccacctaaaccacctaatacttctttgcgcaatgtacgttcaacatgacttgttattctttcgactgcttcatatcctgcttgaatatttacaccagattcctcatatgctttag

SEQ ID NO: 590 - DNA, 519 bp, Staphylococcus epidermidis
cagatactttgttacttgaaaaaggagaataatatgagtaagacaagagcagttattcccggtagttttgatccaattacatatggtcacttagatatcattgaaagaagcgccgaccgctttgatgaaatccatgtttgtgtactaaaaaatagtagtaaaggtggaacgtttgactcagaagaacgcatgacgttgattgaagagtcggttaaacatttgcctaatatacaagtgcatcattttaatggattgcttgttgatttttgtgatcaagtaggtgcaaagacaattattcgaggtttaagagctgtaagtgactttgaatatgaactacgacttacttctatgaacaaaaagttaaatagtaatattgaaacaatgtacatgatgacaagtgcaaactattcatttataagttcaagtattgttaaagaagtagctgcatatcaagcggacatttcaccttttgtaccacctcatgtcgaaagagcattaaaaaagaaatttaatgtttaa

SEQ ID NO: 591 - DNA, 3465 bp, Staphylococcus epidermidis
ggagtgtcttggcttttgaaacaaataaagaaattacttgttgctaaccgtggtgaaatcgccattagaatttttagagcggcagcagaattaaatatcagtacagtagcaatttattctaatgaagataaaagttcgttacatagatataaagcagatgaatcctatctagttggaagtgatttaggacctgctgaaagttatttgaatatcgaacgtatcatcgaagtagctcttcgcgcaggtgtcgatgcaattcatcctgggtatggttttttaagtgaaaatgaacaatttgcacgccgatgtgctgaggaaggcattaaatttataggtccgcatcttgaacatctagacatgtttggagataaggttaaggctagaacaactgctattaacgctaacttacctgtaatcccgggtacagatggtcctattgaaagttttgaagctgcagaacagtttgctaatgaagcaggttacccacttatgattaaggccacaagcggtggcggtggtaaaggtatgcgaatcgttcgtgaatcaagcgaattagaagacgctttccatcgtgcgaaatcagaagccgaaaagtcatttggtaatagcgaagtttatatcgaaagatatattgataatccaaagcatatagaggttcaagttattggtgatgaattcgggaatatcattcatttgtatgaaagagattgctccgtacaacgacgtcatcaaaaggttgttgaagttgcaccttcagtaggtctttctaacaaattaagagagcgaatttgtgatgccgcaattcaactgatggaaaatataaaatacgtcaacgctggaacagtagaatttttagtttctggggatgaatttttcttcattgaggttaatccacgtgttcaagttgagcatacaattactgaaatgattactggtatagacattgtgaaaacgcaaattttagttgctaatggagaatcgttatttggagataaaatctctatgccacagcaaaatgaaattcaaacattagggtatgcgatacaatgtcgtataacaactgaagatcctactaatgattttatgccagattctggcacaattattgcatatcgatcaagtggcggttttggtgtgagacttgatgcaggggatggattccaaggtgcagaaatttcaccttactacgattcactattagttaagctttctacacatgccgtttcatttaaacaagctgaagagaaaatggaacgttcattacgcgaaatgcgaattcgtggcgtaaagacgaatattccatttctcatcaatgttatgcgtaatgataaatttagaagtggtgattatactactaaatttattgaagaaacacctgaacttttcgatattgcaccgacattggacagaggtaccaagactttagagtatattggtaatgtgacgataaacggatttcctaatgtagaaaagcgtccaaaaccagaatatgaatctaccaaaatcccaaaaatttctcaaaagaaaatcaatcagttatttggaacaaaacaaattcttgagcaacatggaccaacaggtgttacaaattgggttagagaacaagaagatgttttaattaccgatactacatttagagatgcacaccaatctttacttgcaacacgtgtaagaacaaaagatatgatgaacattgcatctaaaactgctgaagtttttaaagatagtttttcattagaaatgtggggtggtgcaacatttgatgtcgcctataatttcttgaaagagaatccatgggaacgtttagaaagattgcgcaaagccattccgaatgtgttattccaaatgttattacgagcttcgaacgcagtaggttataaaaactatcctgataatgtaattaagaaattcgttcatgaaagtgcaaaagctggtgtagatgttttccgtatattcgactcattgaactgggttgatcaaatgaaagtagcgaatgaagctgttcaagaagctggaatggtatctgagggtacaatttgctatacaggtgatattttaaatgctgaacgttccaatatttatactttagattattacgttaaaatggctaaagaactggaaagagaaggattccatatattagcaattaaagatatggctggtttattgaaaccgaaagcagcttacgaattaattggtgaattacgtgaggcaacacatcttccaattcatttacatacacatgatactagtggaaatggattgttgacatataaacaagcaattgatgctggcgtagatattatagatactgctgttgcatctatgagtggtttaacgagtcaaccaagtgcaaattcattatattatgcactaaatggatttccacgtaatttaagaactgatattgatgggttagaagagttgagtcattactggtctgtagtcagaccttactatgcagactttgagagtgatatcaaatcaccaaatacagaaatttatcaacatgaaatgccaggtggccaatattcaaacttaagtcaacaagctaaaagtttaggattgggcgaacgttttgatgaagtcaaagagatgtatcgtcgtgtcaacttcctgtttggagatcttgtaaaagtaacaccatcttcaaaggtagttggagatatggcactatatatggtgcaaaatgatcttgatgaagatacggtcatcaatgatggttataaattagatttcccagaatctgttgtgtcattctttaaaggtgacattggacaacctgtcaacggattcaacaagaaattgcaagatgttattttaaaaggacagcaaccaattactgaaagaccaggtgaatacttggagccggtcgattttgaagcaatccgtcaagaattaagcgacatacaacaagacgaggtaacagaacaagatataattagttatgtactttatccgaaggtatataaacaatatattcaaacgaaagagcaatttggtaatgtatctttactggatacaccgacattcttatttggcatgcgtaatggtgaaacagttgaaattgaaattgatactggtaaacgtctaattattaaattagaaacaatcagtgaaccagatgaaaatggtaagcgtacaatttattacgctatgaatggtcaagcaagacgtatctatattcaagatgaaaatgttaaaacgaatgctaatgttaaacctaaggcggataaatcaaatccaaatcatattggtgctcaaatgcctggttctgtaactgaagtcaaagtgtctgtaggcgatgaagttcaagctaatcagccattattaatcactgaagcaatgaagatggaaacgacgattcaggcaccatttgatggaattattaaacaaatcaatgttgctaatggagatgccattgccacaggagatttattagtggaaattgaaaagcaatcataa

SEQ ID NO: 592 - DNA, 1152 bp, Staphylococcus epidermidis
tcgcaaaagtggaggaaatgcaaaatgaacttcagtaaacttaaatttggcgcgacaataggaatcattggcggagggcagttaggaaaaatgatggctcagtctgcacaaaaaatgggttataaggtgattgtcctagatcctaatgaagactgtccttgtcgttatgtcgcacatcagtttattcatgcaaattatgatgatgagcaagctttaaatcagttaggtgaaaattctgatgttgttacttatgagtttgaaaatatttcgtctgaacaattaaaaaaactcactcagttatatcatattccccaagggtaccaagctattgaactattacaagataggctaaccgagaagcaaacattactagaagcaaatactcaaattgttccttttgtacaaattcacacaaatcaagacttattaaaagccatagaaaaattaggctttccgtgcatagtgaaaacacgttttggtggatatgatggtaaaggacaaattttggtaagaaatgattcggaattagacgaagcataccagctagttgagaagcaagaatgtgttgctgaacaatatcttgatattcaaaaggaagtatctcttacagtaacaattggaaatgaacaacaaacaacatactttcctcttcaagaaaatgaacatcaaaatcaaatattatttaaaacagtcgttccagcaagatctgataaagaaaatgaagcacgtaaggaagttgagaaaatcactcgcgcaattcattttgtgggaacctttacagtagaattctttattgataaagaaaataacttatatgtaaatgaaattgcaccaagaccacataattctggacactattctatagaagcttgtgattattcacagtttgatacacatattttagccataactggtcaaaaacttccgcaagctattgaattattaaagccaacagtaatgatgaatttattaggtcgcgatttggatttacttgaaaatgaatttagcagacatccagattggcatattcacatttacggtaagaaagaaagaaaacctgatagaaaaatgggacacatgactttactgacggatgatgtcaatcaaacagaacaatatatgttaatgaaatttgaagggagagacaagtaa

SEQ ID NO: 593 - DNA, 2007 bp, Staphylococcus epidermidis
tcatggaggtggacattaatgaattttccatgggatcaactactagttaaaggaaattggatgattatctcagcacaaattgctgcgccattcttagtcatcggccttatagcagttatatcttatttcaaattatggaaatatctatataaagaatggttcacatccgtagaccataaaaaaatcggtatcatgtatttaatttctgccgtattaatgttcgttcgtggtggtatcgatgcgttaatgttacgtactcaattaacaattccagataacaaattcttggaagcaaaccactataatgaagtatttactacgcacggcgtaattatgattatatttatggctatgccatttatctttggtttatggaatgttgttattccattacaacttggtgcacgcgatgttgccttccctgtaatgaataacgttagtttctggctattcttcgctggtatgattttattcaacctatcatttattgtaggtggatcaccagctgctggttggactaactacgcaccacttgctggtgaattcagtccaggtccaggtgttaactattatttaattgcaattcaaatatctggtatcggatcgttaatgactggtatcaacttctttgttacgattctaagatgtaaaactccaacaatgaagtttatgcaaatgccaatgttcagtgtaacaacattcattacaacattaatcgttatattagcattcccagtgttcactgtagcacttgctttaatgactgctgatagaatttttggaactcagttcttcactgtagcaaatggcggtatgccaatgctttgggcaaacttcttctgggtatgggggcaccctgaagtttatatcgttattttgccagcattcggtatgtactcagaaatcatccctacttttgcccgtaaacgtttattcggtcatcaaagtatgatttgggcaactgcaggtatcgcattcttaagtttcttagtttgggttcaccatttcttcactatgggtaatggtgcgttaattaactcattcttctctatctcaacaatgttaatcggtgttccaaccggagttaaactatttaactggttgctcacattatacaaaggtagaattacatttgagtcacctatgctattctcattagcattcatccctaacttcttattaggaggggttactggtgtaatgcttgcaatggcatcagctgactatcaatatcacaacacttatttcttagtagctcacttccactatacattggttactggtgtagtatttgcctgcttagctggtttaatcttctggtatccaaaaatgatgggctacaagttaaatgaaacattaaacaaatggtgcttctggttcttcatgatcggatttaacgtttgtttcttaccacaattcattctaggtttagatggtatgccacgtcgtctatacacttacatgccttctgatggttggtggttactaaacttcatctcaactatcggtgcagtattgatggcaattggattcttattcctagttgcaagtatcgtttatagtcatatcaaagctccacgtgaagctactggagataactgggatggacttggtcgtactttagaatggtctacagcatcagctattccacctaaatacaactttgctatcactcctgattggaatgactacgatacattcgttgatatgaaagaacatggtcgtcattatttagacaaccataactacaaagatattcatatgccaaacaatactccagtaggattctggatgggtatatttatgactattggtggtttcttcttaatcttcgaatctattgttccagcacttatctgtttagcaggtatcttcattactatgatttggagaagtttccaaattgatcatggttaccacatccctgcttcagaagttgcagaaactgaagctcgtttaagagaagctcgaattaaagaaagggaggctgtaagtcatgagtcatga

SEQ ID NO: 594 - DNA, 1701 bp, Staphylococcus epidermidis
tgtggagaacgccgaataatgaaacaactacattcaaatgaagtaggtgtatatgcacttggtggtttaggtgaagttggaaaaaatacctatgctgttgagtacaaagatgaaattgtaatcattgatgctggaatcaaattccctgacgataatctgttaggaattgattatgtaattcctgattacacttacttagaacagaaccaagataaaattgtcggtctgtttattactcatggacacgaagaccatataggtggtgtgcccttcctattaaaacaaattaatgtacctatttacggtggtccattagcattaggtctcattcgcaataaactagaagaacatcatttgcttagaacgactgaattacatgaaatagatgaaagtagcgtaattaagtctaaacattttgaaatttctttctatctaaccacacatagtattccagaagcatatggcgttatagtcgatacacctgaaggtaaaattgttcatacgggagacttcaaatttgactttactcctgtaggtgagcctgctaacatagctaaaatggctcaattaggtcatgaaggtgtgttgtgcttactatcagactcaacaaacgcactagttccagattttactttaagtgaacgtgaagttggacagaatgtcgataaaattttcagaaattgtaaaggtcgtattatctttgcaacttttgcttctaatatttatcgtgttcagcaagcagttgaagcagcaattaaatataatcgtaaaatcgttacatttggacgttcaatggaaaacaatatcaaaattggtatggaactaggatatatcaaagcgccaccagaaacgtttatagaacctaataaaataaatagtgtacctaaacacgagttactcattctttgtactggttctcaaggtgaacctatggctgcattatcaagaattgcaaatggtacacataagcaaataaaaattataccggaagacactgtagtatttagttcttcgcctattccaggtaacactaagagtatcaatcgtacaattaatgcgttgtacaaagctggtgcagatgtgattcatagtaaaatttcaaacattcacacttctggacacggttctcaaggtgatcaacaattaatgttacgtctgattcaacctaaatacttcctgccaattcacggtgaatatcgtatgcttaaagctcatggtgagactggtgttcaatgcggtgttgatgaagataatgtatttattttcgatatcggtgatgtacttgctttaacacatgattctgcacgaaaagcaggaagaattccttccggcaatgtacttgttgatggcagtggtataggtgatattggcaatgttgtcatcagagatcgtaaattactttcagaagaagggttagttattgttgttgtgagcattgactttaatactaacaaattactatctggccctgatattatttcacgcggttttgtttatatgcgggaatctggtcaattaatttatgatgctcaacgtaaaattaaaggcgatgtcatttctaaacttaacagcaataaagatattcaatggcatcaaattaaatcttcaattatcgaaacattacatccttatctttatgaaaaaacagctcgaaaacctatgattttacctgtgataatgaaagtaaatgaagataaataa

SEQ ID NO: 595 - DNA, 1401 bp, Staphylococcus epidermidis
cctaatattttatttaggttaatatattctcatatattaatgggggtgattttattgaattccaataataacaatcatgaacaacaacgaagtttagatgaaatcaataacaccataaacttcaatcataatgatagtgcaagtcaaaaatttctggcttttttaggaccgggattgcttgttgcagttggttacatggatcctggaaattggattacatccatgcaaggaggagcacaatatggctataccttgttattcataatcttaatctctagcttatctgctatgctgttacaaagtatgactgtgagattaggaatagcaactggtatggatttagcacaaatgacacgtcattttttaaataagcctgtagcaattatgttctggattattgcagaattagcaattatcgctactgatattgcagaagttataggcagcgctatcgcattagatttaatcttcggcataccattaattgtaggcgcattaatcactgtatttgatgtatttttattattattcatcatgaaatttggctttagaaagattgaagctatcgtgggaacattaatctttaccgtattggccatttttgtatttgaagtttatatttcttctccacatataatagatatgcttaatggttttgtgcctcataaagaaattattacaaaccaagggatactttatattgcactaggcatcataggtgctactattatgccacataacttatatttacattcttctattgtacaatctcgaaaatatgatagacacagtattcatgaaaaagcacaagcgattaagtatgctaccatagactctaatatacagctatccatcgcttttgtagtcaattgcttattacttacacttggtgcagcactattttttggaactaaaactgaagatttgggtggtttttatgatctttatttggctctaaaaacagaacctgctttaggtgcaacgcttggcggtattatgagtactttatttgctgttgcccttttagcttctggtcaaaattcaactataacaggaacgttagcaggccaaattgtgatggaaggatttcttaaattatccattccaaactggttacgtcgtcttatcactcggtctttagcagtgatacctgttatcatttgtcttatagtatttaaaggaaatactgaaaaaattgaacaattacttgtcttttctcaagtgttcttgagtattgctttgccattttcgttaataccgcttcaattagctacaagtaatcaaaatcttatgggtccttttaagaataagacatggattaacatcatttcttggttactcataattgtcttaagtggacttaacgtatatcttatcattcaaacattccaagaattatga

SEQ ID NO: 596 - DNA, 900 bp, Staphylococcus epidermidis
gtctgtattttgaaccagaagcaatacacatcatggtaccaggtgaaactgaagaagaatttgataagcgaattgaaagttatgaggactatcatcatgcataatatcaataaatggttactggttccttacttattatggatggttatatttattatcattccagtcattttacttgtttacttttcttttatagatattcatggtcactttagtttcacaaattatgagcaggtattttcaacaagatatttaaaaatgtttattgattcaatatggtatgccgctttaattactatgattaccttaataataagttacccagctgcgtactttatttcttattcaagatttcaaaatatactgcttatgttgttaattatccctacttggattaatttacttcttaagacctatgcatttattggtttgttggggcatgatggagttattaaccaagctctacatatatttcaaatacctaaattaaatttgttgtttacaagtggtgcatttttattggtggcgagttatatttatatcccatttatgattttgcctatatttaacagcatgaaagcaattcctaacaatattttgcaagcctctaatgatttgggcgcgagtacatttactacgtttcgtaaagtaatcgttcctttaacaagagaaggtattaaaacaggtgtgcaagtaacatttataccagctctttcactgtttatgattactaggttgattgccgggaacaaagtaatcaatgtaggtacagcaattgaagaacagttcttaactatacaaaattatggattaggttccactatagcactttttctcattatttttatggcctttttactcattattacaaaatcaaaatcatctaatgggaaggggtga

SEQ ID NO: 597 - DNA, 303 bp, Staphylococcus epidermidis
aaagttttcagaaccaaaaacaaaaagcatctacagtcaagaaaaattgatgtggagcctgtttttggatttatgaaggctattttgggttttactcgaatgtccgttcgagggataaataaagtcaaaagagaactaggatttgtgctaatggcacttaatataagaaaagtaacagctcaacgagctgaaaataatcaaaaaaataataaaaaagacaatttctatataatttcaatagaaattgtcttttttatttatcttggaactttaagtcccacactctttatttatgtgagatag

SEQ ID NO: 598 - DNA, 513 bp, Staphylococcus epidermidis
caatccaaaagtttcgaaagggtgtacaaagtgaaagtagcagtcattatgggcagttcctcagattggaaaattatgaaagaaagttgttcgatgcttgaagaatttgaaataccgtacgaaaagaaagtcgtttcagctcatcgtacgcctcaaatgatgttcaatttcgctagtcaagcacgccaaaatggttttgatattatcattgccggtgcagggggagcagcacacttacctggaatggtagcttccatgacaacattacctgtgattggtgtgccaattgaatctaaaagtctaaaaggattagattcattactatctatcgtccaaatgcctggtggtatcccagttgcaaccacagcaattggaaaatcaggtgctaaaaatgctgggatattagcggcaagaatgttaggaataacaaatgaatcagttcaaaataatttggaaaattatgaaaaatctttagtcgcaaaagtggaggaaatgcaaaatgaacttcagtaa

SEQ ID NO: 599 - DNA, 222 bp, Staphylococcus epidermidis
ttgataactggagtgaaccattgtccaccagcggaaccgatattactaattgtgcatgttgcacctttcatttcttctgaagttaatttaccatcacgtgcttttacagctagttcattaatttcatcagaaatttcgaatattgatttacgatcggcatgtttaactactggtactaataatcctttatccgtatctgcagcaataccaatattccagtaa

SEQ ID NO: 600 - DNA, 1155 bp, Staphylococcus epidermidis
cgaatgttaggagagcaatatacacaaattaagcgtccagcaaatcggctaactgaaaaaatattaggttggtttagttgggtattcttactcatattaactattgtttcaatgtttattgcgctcgtatcttttagtaatgatacgtcaattgccaatttagaaaacacacttaataataatgaactcgtacaacaaattttagccaataatgatttaagtacaactcaatttgtgatttggttacaaaatggagtttgggcaattattgtttattttattgtttgtttgctcatctcgtttttagcgttaatttctatgaatataagaattttgtctggttttctttttttaatagctgctatagtcacaattccgcttgtattgttgattgtaactctaatcattcctatcttattctttatcattgcaatgatgatgtttgctagaagagatagaatagaaacagtgccatcttattataatgaatatgatcaaccatactatgatgagagaggtttttatgaaccagagtcaagaaatgaacatggatataatgatgatgtgtatgaacctatgcatactaaaaaggaagatagaaatacaagacgtcaattcaatagaaatgctcagcaacaagattcctataatggtataactgataatcaacccgatgaagatacatcttccgatcaactttattcagacgaatatgtagataatgaagataaatattctcaatttccaaaaagagcagttgaaagtgaatatgcatctcaacaaactgaagatgaaccaacagtcatgtcaagacaagctaagtacaataaaaaatctaaaaatacggattttgaagatgcgcaacaggaacatatggaaggtaatcaatttgatgacgtaggagttgttgaaccacaaattgatcctaaagaactaaaagcgcaaagaaaaagagaaaaagcagaaatacgtgctaagaaaaaagaaaagagaaaagcatataataaacgtatgaaagaacgaagaaaaaaccagccaagtgctgttaaccaacgacgtatgaattatgaagaacgtcgacaaatgattaataatgaacaagaagatacagataataacttaaatcaacaggaagattcaaaaaaagaaaattaa

SEQ ID NO: 601 - DNA, 288 bp, Staphylococcus epidermidis
ctgtacaaaggagagtttaatatggaacaaaaatcatatgtaatcacagacgaaacagggattcatgctcgccctgctacaatgctagtacaaactgcatcaaaatttgattcagatattcaattagaatataacgggaagaaagttaatttaaaatcaatcatgggtgtaatgagcttaggtgtaggtaaagatgctgaaataactatttatgctgacggtagcgatgaaactgacgcaattcaatctatcactgatgtcttatcaaaagaaggtttagctgaataa

SEQ ID NO: 602 - DNA, 1149 bp, Staphylococcus epidermidis
agaagtgaaggttttaatcgttgccacagcttcatatttataggaggaaactgtatgaatccattgctttcttttaaagatgtcagtaagggctttgaagatgtacaaatactaaatgaaattaatattgatattgaaccaggctatttttatacactattaggtccctcaggttgtggaaaaacaacaattttaaaactcatagcaggatttgaatatcccgatagtggagatattatatataaagataaacctattggtaaaatgccaccgaataagcgtaaggtaaatactgtattccaagactatgcattgtttccacatttaaatgtattcgacaatattgcatatggtttaaaattaaaaaaattaagtaagtcagaaattaagcgtaaggttactgaagcacttcagttggtgaaattaagtggttatgaacataggcaaatacaaggtatgagtggtggacaaaaacaacgtgtagccatagcacgggcaattgttaatgagcctgaaatattattattagatgagtctttatccgcattagatttaaaattacgaactgaaatgcaatatttattgagagaacttcaatcccgtttaggtataacctttatatttgtaactcatgatcaagaagaggccttagcattaagtgattatatttttgttatgaaagatggcaaaattcaacaatttggcacaccaatagatatatacgatgaaccagttaaccgatttgttgctgattttataggagagtccaacatagttcacggtacaatggttgaagattttgtcgttaatatttatggtcaaaattttgattgtgtagatatgggaataaaagaaaataaaaaagttgaagttgtaattagacccgaagacatttcacttgtttcacaaaatgatgggctatttaaagccaaagttgattctatgctatttagaggtgtacattatgaaatttgttgtaaagatagaaaagggtatgaatgggtaatacaatcaacaaaaaaagctaatgtaggtagtgaagtaggtctgtattttgaaccagaagcaatacacatcatggtaccaggtgaaactgaagaagaatttgataagcgaattgaaagttatgaggactatcatcatgcataa

SEQ ID NO: 603 - DNA, 2208 bp, Staphylococcus epidermidis
aaagttggagggaacaaaatgtctaaatttatcgaaccaagtaatgaagagattaaacttgaaaaactttatcaagatataggattaagtgataaagaatatgacaaagtggttgaaattcttggtagagaacccaacttcacagaagtaggaattttctcagtgatgtggagcgaacattgctcatataaacattctaaaccatttttaaaacaatttcctacgacaggagagcacgtattaatgggaccaggagaaggtgcaggtgttgtagatataggcgataatcaagccgtagtatttaaagttgagtctcacaatcatccatctgcaattgaaccatatcaaggtgcggcaactggagtcggaggtattattagagatattgtttcaattggtgcccgtccaattaatttactaaatagtcttcgttttggtgagttaactgtaaaacaaaatcaacgattacttaaaggtgttgtaagtggtattggtggatatggcaactgtattggtattcctactacggctggtgagattgaatttgatgaacgctatgatggcaatccattagtcaatgctatgtgtgtaggaatcattgatcatgatatggtccaaaaaggaacagctaagggtgttggtaattccgttatatatgtaggtttaaaaactgggcgtgacggtattcatggtgcaacatttgcatctgaagaacttactgaggaaagtgaaagtaaaagaccttcagtacaaattggagatccatttgtaggcaaaaagctaatggaagcaacattagaagcaattacttttgatgaactagtaggtatacaagatatgggagcagctggtttaacttcatcttcatctgaaatggcagctaaaggtggtagtggtttacatttaagacttgatcaagttccaacaagagaacctggaatttccccatatgaaatgatgttttcagaaacgcaagaaagtatgctgttagttgtagaaaaaggtacagaacaaaagtttttagatttattcaataaacacgaactagatagtgcagtaatcggtgaagtaacagacactgatagattcgtgcttacatacgatgatgaagtgtatgcagacattcctgtgcaacctcttgctgatgaggcaccagtgtatattttagaaggagaagaaaaggaatataatacatcaaaaaacgattacagcaatatagatgtacatgatacatttatcaagttattacaacacccaacaatagcatctaaacatcatttatatgaacaatacgatcaacaagtaggagcaaatacaattattaagccaggtttacaagcttcagttgtgcgcgtagaaggaacacaaaaagctattgcttcaactatagatggtgaagcacgttatgttttcaaccaaccttatgaaggtggaaaaatggttgttgctgaagcctatcgaaatttaattgcagtaggggcgacaccattggctatgactgattgtctaaactatggttctccagagaagaaagaaatctatcaacaattaatagattcaacaaaaggtatgtcagaagcttgtaaagtgcttcaaactcctgtagtttcaggaaatgtttcattatataacgagacacgtggaacctctatcttccctacacctgtcgtaggtatggttggtcttattgaagacgtgagctatctaaaagagtttaaacctaaagcaggagataagatttatttagttggtgaaacgcgtgatgactttggtggtagtcaattggaaaaattgttgtatggatcagttaatcatgagtttgaatctattgatttaagtgatgaagtttcaaaaggaaaattaatcaaacaggctattcgtaatggcattgcatctcatgtacaaacagttggtaagggcggcttattagttactttagctaaaattagtgcccattatgatttaggtatgcaagctcaattggatgttaccaatgcacaattatttagtgaaactcaaggacgatatattgttgttgttaaagaagggcaaactttggatatagatcaagctcaagaaattgggcatttaactcatcagcagttatttgatatatctaattcagacgtaaaaataaaagaaaacgtttcagatatcaaacaaaaatgggaaggggctatagttcaatgtctaactactcaggattaa

SEQ ID NO: 604 - DNA, 1260 bp, Staphylococcus epidermidis
aaagaaaggggtaatctattgaaagttttaatagttggagctggtggacgtgaacatacattagcttctaaaatcaatcaatctccaattgtagataaggtttacgcgattccaggaaatgatgcaatggtcaatattgctgaagtgcacagtgaaattgctgaatcagatcatcaagctattttacattttgctcagcataacgcaattgattgggtaatcattgggcctgaacaacctttaatagatgggttagctgatttattaagaaatgcaaatattaaagtgtttggtccaggacaagatgccgctcaaattgaaggttcaaaattatttgccaagcaattaatggacaaatatcgtattcctacagcagaatataaagaagtaagttcacgtaacgaggcgttgcaatatgttgaaacttgtgatttaccaatcgtaataaagaaagacggtttagcagcaggtaaaggggttattattgcttttacgagagaagacgcattagaaggggtcaaaaaaatttatcaagaagaaaaagggaaagtcgttttcgaaagttatttagaaggagaagagttttctttaatgacttttgtaaatggagattatgcggttcctttcgactgtattgctcaagatcataagcgagcatttgataatgatcaaggaccaaatactggtgggatgggcgcatattgccctgtaccccacattgatgcatctgttcttgaacaaaccaataaggagattgctcaacctattgctaaagctatggcacaagaaggtcatgacttcttcggattactatatattggtgcaattttaacaaaagatggacctaaagttattgaatttaatgcacgttttggtgatcctgaagcacaagtattattaacacgtttagaaagtgacttaatgcaactcattatcgatttggaaaattgccaacccattcattttaactggaaagatgaagctgttgtaggagtaatgctagcatctaaaggataccctggttcatatgaaaaagggcatgaaataagtggttttaatctagattctcattattatgtgagtggattaaagaaagaaggtcaatgttttgtgaattctggtggaagagttatcctagctataggggaaggtccaacagttgaaaaagcacaagcaaatgcatatgaacatgcacgacaaataaaaagtgataatcttttttatcgtaatgatattgggaataaagccatcactaagtaa

SEQ ID NO: 605 - DNA, 1176 bp, Staphylococcus epidermidis
actaaaattattggtaagccctacatttgtagtattaggaggtcaaaaaaagtgtcaaaatttaagtctttgcttctattatttggcacactaattttacttagtggttgttcaaatatagaagtttttaatgcaaaagggccagtagcaagcagtcagaagttcttgattatctattcaataattttcatgcttgttattgttgctgtagtgctttccatgttcgctatttttatttttaaatatagctacaaaaagaatagcgaatctggtaagatgcaccacaattctctaattgaaacaatttggtttgtggtacctattttaatcgtaattgctttagctattcctacagttaaaactttatacgattatgaaaaaccaccagaaaaagacaaagatccacttgtcgtttacgcagtaagtgctggctataaatggttctttgcctaccctgatcaacatattgaaactgttaacacattaacaattcctaaagatcgaccagttgtattcaagcttcaatctatggatacaatgacaagtttctggattccacaattaggtggtcagaaatatgccatgactggtatgactatgaattggactttaacagctgatcaattaggtactttcagaggtcgtaactcaaacttcaatggtgagggattctctcgtcaaacatttaaagttcactctgtaagtcaaaatgattttgataagtgggtaaaagaggctaaaggtaagaaaactttaagtcaagatacttttgacaagcaactcttaccaagcacatctaacaaagaattaacatttagtggaactcatatggcgtttgttgaccctgcggctgatccagagtatatcttctacgcttacaaacgttacaactttgaacaaaaagatcctaacttcacagctgaagaggatttatacaaagatgtaaaagataaaccaatcaaacctgctcgtaaggttcatataacaaaccctaactatgaacgtcacggtatgaaacctatgattctcggcaacaatgaaaaatacgataatgagttcaaaaaagaagaggatcataactctaaagaaatggaaaaaatttctaagggagcaaaagacgaaaatgcgtctaaacttcacaaaaaagaacacgatgatcatggaggtggacattaa

SEQ ID NO: 606 - DNA, 255 bp, Staphylococcus epidermidis
gaaatgaatataattcctagaacgagtttaattatttatttaaaacatatgaaacatgagcgacaaattagaaaatatggacacatcgtgcactcaaaccgtcaacgaaaatatgttgtgatgtatataaatgaagcagatgctgacaatattgttcataaacttatgcaactcaagtacgttcacgaaattcaaggttccccatataaatatttgaaaaaaacatatgaaaaagaaaaacatgaaatacaatag

SEQ ID NO: 607 - DNA, 1329 bp, Staphylococcus epidermidis
acgatcttcatatataataattttgaggtgaacagtatgtcttttcttaggaaacacaccgaaattatatttagttatatcatcggtatcgtttcactttttacaggtctcattatttttattaacttacctttaatcaaacaatttaaaggtgacaaaaaggttgatacgcatgtgcataacgtatgggaattcctaaatgccttttttgccgagattataaaagtgatgagtaaatttattggtggctttccaattacaagtgccatagtaatcatcgtatttggtattctagtgatgctgttaggtcacactttatttagaactattaaatacgattatgacatttcaattttctttttagttattggcattatgtactttatcattacattattgctaatgacacaagtgtatggcttttttgctatcgtctttattattccttttacagttcatattggttacatagtttataaagatgagttgaaccaagacaatcgaaagaaccattatatgtggattattgtaacttatggaatgagttatcttattacccaaatttcgctatatggacgtattgacgcaaatgaaattgaatcaattgatattttaagtgtaaatacattcttcattattatgtggttattaggtcagatggctatatggaatttcttattcctaagacgttcattaccactcactaaagaagaattaggcgaagaggaacctgaactttcaagaactaataaaggcaatgtatctaatcaaactaaagttcacttaaaacaactacaaaataagacaaccgagtatgcacgtaagactagaagaagtgttgatttagataaaattagagccaaaagggacaaatttaagcaaaaaattaacagcatagtagatatacaagaggacgatattccaaattggatgaaaaaacctaaatgggttaaacctatgtatgttcaattgttttgtggtgtaattattctgttttttgcttttctagaatttaataatagaaacgcattattcttaactggtgaatgggagttatcacaaacacaatatgtagttgagtgggtaacattattattgctacttttcattattattatttatattgcaactacattaacttattatttaagggataaatattattatttacaactctttatgggcagtattttattctttaaatttcttacagaatttatcaatattatggtacatggattattattatcaattttcattacgccaatcttattattaatgcttattgcaatgattgttgcttattctttacagttgagagaaaaataa

SEQ ID NO: 608 - DNA, 846 bp, Staphylococcus epidermidis
tatgtagtaataggagatgatacgatggctttatatgattttgcaaaagggttgatactagaagcaggaaataaagtaaggttgatgatgcaagaagagttagacattaaaactaaatcgaacccaaatgatttagttacaaatgtggataaggcgacagagaattatctatatgaaacgattcttcataattatccagatcatcaggttattggcgaagaggggcatggtcataatctcgagtatttaaagggggttatttgggttattgatccaattgatggaacacttaattttgttcaccaaaaagaaaattttgccatctctattggtatttatcatgatgggaagccttatgcaggttttgtttatgatgtcatgaaagatgttttatatcatgcaaaggttggacagggtgcatttgaaaatacacataaacttgaaatgattcaaaatactgaacttaaaagaagtattataggtattaatcccaattggctgtcgaaaccaatactcagtgatatttttagttcaatagtgaatgaggcaagaagtgcacgagcatatggtagtgcagcattagaaattataagtgtagcgaagggtcaattggcggcttacctaacacctagactacaaccgtgggattttgcaggtggattgttgattttgaacgaagtaggtgggataggaactaacttattaggcgataaattagacttcaatcaaccgaattcaatattaatagcaaatcctagccttcatcgtgaaatattaaatcatcatttaaatcagcaaagagatacacttattacactccatgaaaaaaggtttggaaagagatag

SEQ ID NO: 609 - DNA, 633 bp, Staphylococcus epidermidis
agcaataaaatctttgagtatctattaatgtacttgtgtctatcttatctgatatattatttaataaggaaggtgtatgacatgataacaatgaaagatattataagagatggtcatccaacacttcgtgaaaaagcgaaagaattaagcttcccactttctaacaatgataaagaaacattgcgcgcaatgcgtgaatttctaatcaatagtcaggatgaagaaaccgcaaaacgttatggtttacgttctggcgtaggtttagctgctccacaaattaatgaaccaaaacgtatgattgctgtctacttacctgatgatggaaacggtaaatcgtatgattatatgctcgtaaatcctaaaataatgagttacagtgtacaagaagcttatttaccaactggcgaaggttgtctaagtgttgatgaaaacatcccaggtttagtgcatcgtcatcatagagtcactattaaagctcaagatattgatggaaatgatgttaaattacgtctcaaaggctatcctgcaattgtatttcaacacgaaattgatcatctaaatggcattatgttttatgattatattgatgccaatgaacctctaaaaccacatgaagaggccgtagaagtctaa

SEQ ID NO: 610 - DNA, 1149 bp, Staphylococcus epidermidis
aaaggagaaatgcaaatgaaaagtgttggactgataactgaatataatccttttcataacgggcacttatttcacgctacattgtcaaaacaacgctctgaaactaatgtaactattgctattatgagtggcaattttgtgatgcgtggagaaccagcaatctaccataaatttaaacgcactaaaatggctttatccgccgtagatttagtcgttgagctaccattgataggtagcctatcttctagtgatacctttgcggaaatagctattaaaacagctcagtatctcgatatagatattatatcttttggcagtgaaagtgcatccttaaaagatttacaatatcttgcaacacaaatgattgactatgaaaaacatccagattttaaagagaaattaaaacaaggtaaaagctatccacgaatcttaagtgagttaacacataacgacacacttttacaatctccaaacaatattttaggaataagctaccttaaagcaatgcagcaatttgcgcctcacatgtcagcattgactattaaaagagaaggttcacttcatcatcaaaaagtaattgatcaccatcattttgcaagtggaacatctattaggcgttcgctaatgaatgataatgtagactggaaaaatgtggtcccaaatcaaatacaatctttatattgtaaacctcatactacggttgaggatacatttccttttatcaaacaccaattaattacacaaccaaaagagagccttcattctatttacacaataaatgaggggtttgaaaatcgcttgcaaacaatgattcatcgaagcgattcctttgagtctctattatcaaaccttaaaacaaaacgttatacgcagacatatattcaacgtgtattaatgaatgtgttattaaatataacaaaagatgatgttaacaaggaaattaacgctgttagagttttaggaatgagtgaaaaaggacgctcatatttaaaatatttaaaagctaattatccaaatcgtcactacattactaatgtaaatcaaaagactgcacactattttaaaaatgaaattaaagcgactcatgtatataatctattaagtaatcaatcacagacagactttaacacacctttagtacgcatttaa

SEQ ID NO: 611 - DNA, 1023 bp, Staphylococcus epidermidis
aacaaaatgatttacgcttatatcggtataacagtattatgggtatttttattttgttatattattatcgcctccattgattttggtgcaggatttttcgcattgcattctaaaatgacaggtaatgagaaaaaggttaatcatttaatccatagatacctcaatccagtttgggaagttacaaatgtctttttcgttttcttttttgtaggatttataggtttttttcctgattctgctaaatacttaggaacagttttattagtacccggatcaatagctttaattcttatttctatacgaagtagtttttatgcttttgaaaattatggtcaagatactaaactgccctggattgtattatatggtttaacagggctgttaattccagcttctctagcaactgctctaacaatttcagaaggtggttatatctatgagcatggcacacatattgatttagactggatacaattattattaagtccatttgcatggtctgtagtattcttagccattgtttcagttctttatatttcatcaggttttttaacatattatgctcataaagcaaatgatcaacctgcttatgatatgacacgacaatggcatattttttgggggccacctatgattgtgatttcattatttgttttcttatctcttagaattcaaaattctgatcactttagaactgctatttttaattattggtggatgtttgcaatcagctttatattttttataatagctggattactgactatatttaaaaagaaacacggtctagcttttatcatggttatattgcaaatgttatttgcattctttggctacggaatgagtaaacttccatatttactttatccgtttattaaaattacagactcccatgtcaatccggaaatgggattatcattagttattgtttttgttttaggtttacttttattaattccatcgttaatattattattaagattatttgttttcgacaaagcatatgtggaaggaaagaaataa

SEQ ID NO: 612 - DNA, 939 bp, Staphylococcus epidermidis
gaggattcgattatggctcattcaaaaaaatggtttattaatggtacgttggcaacagccggtattataagcagtctattttactttttaaaaaataaaaataaatcaccgcaacaattaaaatctattccacctttcttctcaggacaagcaccttacatatttgcacatagaggtggcatggcaatgcgaccagagcaaacacagttggcatttgataatgctgttgaatatggattggatggctttgaaacagatgtacgactaactaaagatgaacaactcattgtttttcacgatgcacttgtcgaccgtacaactaatggttcaggtaaagtgagtgaacatactctagctgaactaaaacgattagatgcgggatatcattttactgacatcaataatcaaacaccttatcgcgggcacgataaagctaagattttatcattcgaggaactgcttgaattgtaccctaatatgtatatcaatgtggatttaaaagatgcgccagacacatatgaaggtcgtatcgcaccaaaagtgatttacgataatatcatcaaacatggggcgcaacatcgagtgctcgttacaagcttccataaaaaacaaattcaacgtttcactgagtataaccaagctgacattgctatcggtgctagtgaaggcgaagttgctgaaggttttattaaatttaacggcatgttaggtcacacatttaaaccacaagcagacacattccaaatgccagttgcatataaaggaatttcattaacttctaagcgtttcattcaatggcttaacttaaataatattgtacccggttactatggtgtgaatagtatagatttaatgacagatttatatcataaaggtgttcatactttagttacagatcgcccagatttaggtcaacaatttaaagaaactttaaaataa

SEQ ID NO: 613 - DNA, 204 bp, Staphylococcus epidermidis
gatggcactgtttctattctatctcttctagcaaacatcatcattgcaatgataaagaataagataggaatgattagagttacaatcaacaatacaagcggaattgtgactatagcagctattaaaaaaagaaaaccagacaaaattcttatattcatagaaattaacgctaaaaacgagatgagcaaacaaacaataaaataa

SEQ ID NO: 614 - DNA, 288 bp, Staphylococcus epidermidis
ggggaatatgtcatgtctaaccaatcgaagttaaatagtgcggcatatgaccaattgaataaagatgcagacagaatattacatctaattaaagttcaaatggataacttaactttaccttcttgtccactttatgaagaggttttagatactcaaatgtttggtttacaaaaggaagttgatttcgcagttcaacttggattagttgataaagaagatggtaagcaattaatgttaagacttgaaaaagaactttctaaattgcatgaagcatttacgaatgtttaa

SEQ ID NO: 615 - DNA, 1404 bp, Staphylococcus epidermidis
ttgttacgtgttaaaaatttacgtttaaagtatccgaatggtgataggaaaatattcaataacttaaatcttgagattaaaaataaagaaaaagtgcttttactcggtccttccggatcaggtaaaagcacattacttaatgtattaagtggaatagtacctaatttaattgaacttccgatgaaatatgatgaattgaatattgatcatgatagtggcgttatatttcaagatccagataatcaattttgtatgccaaaagtatatgaagaacttgcatttgttttagaaaatagaaatattcctagaagtgagatggatcaagaaatcgaagacgcactaaagtctgtagaccttaatgttactcataaaacatatgtcaataatctaagtggtggcatgaaacagaagttagctattgttgaaacaatactacaaaaatcaaagacactttttttagatgagcctactgcaatgctcgacgtgaaagcaactgaagatttatggaagaaattaatcaatctttgggaagatcaaacagttttaattgttgagcataaggttgaacatatttggcaacatgttgaccgcgtattgttattaaattatgatggtgaaattgttgctgacgacaccccagaacaaatcttggatcattatgaagcgttattaactgaatatggagtttggcaccctagagcatggcacagtgcaccacgccccatcccattacctaatcaaacaaagaacctcttatttcattttgacgacgggcaaattattagaggtaaaaagacacttttttcatccaaggagcttaaactgtattcaggtgaatggttaacaatcactggtaaaaatggtgctggtaaaacctctttactagaagctatgttacaactgattaaatatgaaggtgacatgttttatcgcgatcaattattatctaaaattaaacaagcggcaaagcatatgtatttggtatatcagaaccctgaattacaatttattactaattctgtttatgatgaagtgtatattcattataatcacttagatcctaagcatgcgaatgatgaaaccatggatctgttaaaattattacatttagatcaagttaaggatcatcatccttttgaaatatcaacaggtcaaaagcgtcgtttaagtgttgcaacagcattaagttcaaaggcagagattattttactagatgaaccaacattcggcctagatagtcataatacatttcaacttattaagttatttcaagaacgcgttaatcaaggtcaaacaattatcatggtgacacatgatccagaaattattaaacgatatccaacaagacgattacgcgtggaagatggatgtcttaaagaaatggaaggtgaacacattgtttga

SEQ ID NO: 616 - DNA, 222 bp, Staphylococcus epidermidis
aataaatgcttatatattttcctagctaaaatgataatgacttttttatttaatcacacgactacacttaaacgattaaaagattttaaatactttaactgtaatttaataatactttggttatctgtgacacatccagttacttttaagaattacaatgcaactaatattatgatattcataatgtcaacgaatacaaatacttgttcaagaacgttataa

SEQ ID NO: 617 - DNA, 1356 bp, Staphylococcus epidermidis
atggattcagtagaaatagctcgattgttgacgggtatgacacttgcagtgcatatcatatttgcaacaattggtgttggtatgccacttatgtttgcaatagcagagtttattggcataaagaaaaatgatgcgaattatatcacattggctaaaagatggtcgaaaggctacacgataaccgttgctgttggagtcgttacaggtactattattggtttacaactttcacttgtctggccaacatttatgaaaatgggcggtcatgttatcgcattaccactattcatggaaacttttgcattcttttttgaagcaatctttttaagtatttatttatacacttgggaaagatttaaaaataaatggacacattttttcatatctatacccgttattataggaggttcattctcagcattctttattacatcagtcaattcatttatgaataccccagctggttttgaaattaaaaatggtcgtatggtaaatgttcagccattagaagcaatgtttaattcatcgtttatggttcgtgctttacatgtagttgcaactgcaggtatgacgatggcgtttatattagcagccatcgcagcgtttaaattattacgtcataatcatacagaagatagaacataccatacaaaagctcttaatttaagcatgattgttggattcatcaataccgttctttcgatgattgcaggagatttatctgctaaatttttacacaaagttcaaccagataagcttgcagcatatgaatggcattatgatacgcaatctcatgcgaatttagttcttttcggtgtattaaatgaaaaaacacatgaagtttcaggagcactagagattcccggattacttagttttttagcagataatagctttaatacaaaagttaaaggtttaaatgaatttcctaaaaatgaattacctcctatgatagtgcattactttttcgatttgatggtatcaatgggaatattctgttttatcatttcaggactatatatgttatttttaattgttaaaaagttacgtaaatatgtaactagtaatatgatgttatacgctatcttgttaactggtcctgcatcaatgttagcgatagaatttggttggttcttaactgaaatgggtcgtcaaccgtggattatacgaggatatatgcgcgtatcagaagctgctacccaggcggggggaatcacattagtaacgacgctattcggtttactatatcttttattactagttacttcggcttatgtactaattagaatgtttaaaaatcaacctgcttataaagatgtagaaaaagtgattaaagagagaggtgaaacaaaatga

SEQ ID NO: 618 - DNA, 309 bp, Staphylococcus epidermidis
aaaataaaagtatatgaaggagaggacactatggaatatcaatatccattagatttacattggactaatgatgaaatgatgaaagtaattcatttctttaataaaatcgaaaattattatgaggcatctgtaaaaggtgacgaagttttaaatgcttataaaaattttaaacatattgtgcctggaaaagctgatgaaaaacagatttttaaagaatttgaaaataaaagtggttataatagttacaaagtagttcaagaaattaaaaaaaatccaaatcaaactttatttagtaaagatttcgactaa

SEQ ID NO: 619 - DNA, 831 bp, Staphylococcus epidermidis
tgggaaggggtgattagtgtgaaatggtacggaaaattatatatagctctattaataagtgtgctttatattcccattttctttttaatgatttattcttttaattctgcgggtaatatgagtcacttcgaacattttactttagaacattaccactccctttttcataatgatcggttgatgtcggtgatttttaatacagttgcagtggcacttttatctgcatcgattgctacagttataggtacatttggtgcgatcgctttatattacttacgcaacaaacggtttaaggttacgctattaacgatgaataatgtattaatggtatcttcagacgtagtcattggtgcttcttttttaattatgttcactgcaataggacatttcacaggtttaggtttaggattttcaacagtgctagcatctcatatagcgttctgtattccaattgttgttatcatcgtcttaccccaattatatgaaatgaatgataacatgttaaatgcagcaagagatttaggtgctaatgaatcacaattattaactagcattatcatacctaatattatgccctcgattataggaggattctttatggcattaacatattctctagatgattttacggtaagcttctttgttactggaaacggatttagtgtattgtctgtagaagtttatgctatggctcgaaaaggtataagtatggagattaatgccatttctacaataatatttattgctattatgtttggagtatttggatattactttattcaacatatcgttaatcgtcagaaaaagatgaagcgaggtgttaatgaatga

SEQ ID NO: 620 - DNA, 1512 bp, Staphylococcus epidermidis
ctaaaatcattaaatagaggagtatcttatagaatgaaaaaagcaatattaagcgtttctaataaaagtggaattgtagagtttgcaaaagcattaactaatttagactatgaactgtattctacgggtggtacaaaacgtgtattagaagatgcgaatatcaatattaagtccgtgtcagaattaacacaatttccagagattatggatggtcgtgttaaaacactacatccagcagtccatggtggtattttagctgatcgagataaagaacatcatttagagcaattacgagaacaacatattgatttaattgatatggtagtagtcaacctatatcctttccaacagactgttgctcaacctgatgtaacagaaactgatgcaatagaaaatattgatattggtggacctacaatgttaagagcagctgctaaaaactttaaacatgttacaactatcgtacatccttccgattacaacgaggtaattgagagaattaaaaatcatcaattggacgaagcatatagaaaatcgctaatggttaaagttttccaacatacaaatgaatatgatcatgctattgttaactatttcaaagacaataaagaaacactaagatatggcgaaaatcctcaacaatctgcatattttgttagaacatctgatagcaaacatacgattgctggtgcaaaacaattacatggtaaacaattgagttttaataatattaaagacgcagatgcagcgctcagtttagtaaaaaaattcaacgagccaactgctgtagcagtaaaacatatgaacccgtgtggagtaggaattggacagtcgattgatgaagcatttcaacatgcatatgaagcggataatcaatcaatatttggcgggattatagcattgaatagaacggtagatgttaaattagctgaagcattacattctatctttttagaagtagttatcgcacctcaatttactgaggaagctttaaaaatattgacacaaaagaaaaatattcgtttattacaaatagatatgacaattgataacgctgaacaagaatttgtttccgtttcaggtggttacttagtacaagataaagataataaagatgtgactcgaaatgacatgactgttgctaccgacattcaacctacagaagcacagtgggaagctatgctcctaggttggaaagttgtaagtgccgttaagagtaatgcagtgatattgagtaacaacaaacaaacagttggtataggtgcagggcaaatgaatcgtgtaggttccgctaaaattgcaatcgaaagagcaatagaaattaacgataatgttgcgcttgtttcagatggtttcttcccaatgggagatacagttgaatatgctgccgaacatggtattaaggcaattattcaaccaggtggttcaattaaagatcaagattccattgatatggctaataaatatggcattacaatggttatgacaggtatgcgtcattttaaacattaa

SEQ ID NO: 621 - DNA, 939 bp, Staphylococcus epidermidis
tactttaaattaatgatggggtgtttatcattgtttagaaagcaaaaccttaaatggttaggtgttttagctacgattattatgacctttgtacaattaggtggcgccctcgtaactaaaacgggatcagaagatggttgtggctcgtcttggcctttatgtaacggcgctctacttccagaaaatttaccaatacaaacaattatagaactgagtcatcgtgcagtatcagccatttcacttatagttgtattatggcttgtaattacagcttggaaaaacattggatatattaaagaaatcaaaccactctctattattagtgttggttttttattagttcaagcacttgtaggtgctgctgctgtgatatggcaacaaaatccttatgtattagcgctacattttggtatttcacttatcagtttctcttctgttttcttaatgacattaattattttctcaattgacaaaaaatatgaagctgacattttatttattcacaaacctttacgtatcttaacttggttaatggctatcatcgtatacttaactatttatacaggtgctttagttagacatactaaatcaagtcttgcttatggtgcttggcctattccatttgatgatatcgttcctcataatgcgcatgattgggtacaattttcgcacagaggtatggcgttcatcacttttatctggattatgattacatttatacacgctattaagaattattcagataatcgaactgtacgttatggttatactgcatcatttatacttgttatccttcaagttattacaggtgctttatcagtcataactaatgtcaatttaattattgcgttattccatgctttgtttatcacttacttattcggaatgattgcttattttattttactaatgttaagaacgacgagaagtctaaaataa

SEQ ID NO: 622 - DNA, 597 bp, Staphylococcus epidermidis
tacacctattcatttattggaggtagaatagtgaccaatatagcgatttttgcctcaggatcaggtagtaactttgaaaatattgtaaaacatatccaaacagggcaattatctggtatcaatgtaacggcactgtatacagataatgaaggggtaccctgtattgatagagctaaaaatttaaatattccaattcatattaacaagccaaaagacttttcatccaaatctttatatgaacagcatctacttaaattattatccagtgaggaagttcagtggattgtattagctggttatatgagactagttggccaagacttattacaagcttatgaaggacggatattaaatatacatccctcattattgcctaaattcaaaggtttagatgccataggtcaagcgttagaaagtggagatactgtaactggatcaactgtccattatgtagatagtgggatggatacgggagaaattattgaacaacagcaatgtgatataaaaccggacgatactaaagaacaattagaagatagagtaaaacatttagaatatgaactttatccaagagttatagctaaaatcattaaatag

SEQ ID NO: 623 - DNA, 1188 bp, Staphylococcus epidermidis
gagaggtattcatttatgaaacttgctacgctaaataaaggcaaagaaacaaagtatttaaaccactatccattaatagatgaagaagatttatttgaacatgatcatcttaaagaaggtgatttgataacactggtgacagagcaacaacaatatatagctactggatatattggaagacaacataaaggattaggatgggtattgagttataatcaaaatgaagagattaacactttgttttttaaacgtttatttgaagctgcattagaagagcgacaatactatttcaacatagaaggtacaaatgcatttagattatttaatgctgaaggtgacggtgtaggtggcctgacaattgataattataacggacatcttttaattcaatggtattcgaaaggaatatataaatttagatttcctatcttagaagcaatcaaagaggtatatgaatacacttcaatttttgagaaaatgcgttttaaaggtacttcctacactggtggctttgtagaaggtaatgctcctgaatttcctatcgttgtagaagaaaattttaccttttataatgtagacctaaacgatggtcttatgactggtatatttttagatcaaaaagaagttagaaaaaaattaagagatcagttttcagaaagacgacacgtacttaacttattcagttacactggagcgttttcagtaatagcagctgaaaatgcaaactcaacaacaagtgtagacttagcaaatcgctctagagggctaactgaagaaaattttggtttaaatggtattaatcctaaatctcaatatatttatgttatggatacgtttgatttttataattatgcaggacgacatggacatcaatacgatacaattgttattgatccacctagctttgcgagaaataagaaaaaaacattctctgttcaaaaagattataatttattaattgaaggagcccttaacattttatcgccaggaggtacattactattatgtacgaattcaagtgcattttctcttaaggcatttaaaaacgtaataaagaaaacattagcccaaaataatattgtatatgaaataaatgaagtaatggggttacctaaagattttaaaactcatcctcactacaaaccttcaaaatatttaaaagcagtatttgtaacaataaaacattaa

SEQ ID NO: 624 - DNA, 810 bp, Staphylococcus epidermidis
tttttattatctgttgaatgcattgatctatttggttgttctggtgcacctgattgtgctggcgtacctggttccactggtttacctggttccactggtttacctgattccgctggtttacctggttctgctggcgtacctggttccgctggtttacctggttctgctggcgtacctggttccgctggtttacctggttctgctggcgtacctggttccgctggtttacctggttctgctggcgtacctggttctgctggcgtacctggttccgctggtttacctggttccgctggtttacctggttccgctggtttacctggttctgctggcgtacctggttccgctggtttacctggttctgctggcgtacctggttccgctggtttacctggttccgctggtttacctggttccgctggtttacctggttctgcttttgttggaccatactcaacaatttcgtcaacaggttgtttagtgactttttctgttgatttaccttcgccaactttttctcctgtaataggattaactaatattggtgttgtaattgtttttgttcctggttcacctttttgtttaacgcgctcttcacctggttttaaatcaggattaaatacacgtttcttatcaaatggaatctcttccgttgatgtgattggattaccaactttcggaccatattttgtcacatcatccactggtggggtaacaacttcacctgtatcaggatttttaactcctggtttacctggaacttcagttttactatctacaggtgcatttggatcaaattcatctttatga

SEQ ID NO: 625 - DNA, 378 bp, Staphylococcus epidermidis
gtcatgacatctatagtagtagtaagtcatagtcataaaatcgcagaaggtgttaaacaattaatcaatcaaatgactgacggtggtgttgaccttattgccgttggtggcttaagtgacgatgaaatcggtacatcatttgatcaaatcgtctctgtaattaatggacttgaaaatgatgcgctttgtttctatgacattggttcagcaggcatgaatttagacacagctttagaaatgtacgaaggtgaccacaaaattgttaaaatggaagcgccaatcgttgaaggaagctttattgcaagtgtaggaattaaatcaaatatgagtatggatagtgttatctctgaagtaagagctaaatatcctgaagaataa

SEQ ID NO: 626 - DNA, 1617 bp, Staphylococcus epidermidis
aaacttggatcatattccactaatcccacaatcacgtgtatccaatattccacatcatcaatttttggagatgattcaatgaagacctataagccgtaccgacatcaattaaggcgttcgctatttgcctcaacgattttcccagtatttatggtgatgattattggtttaataagcttttatgctatttatatatgggtcgaacatcgcaccattcatcagcatacctatcaaactcaaaccgaattacaacgtatcgacaaacattttcatacgtttgttacgcagcaacaaaaacaatggcgtcatgttgatttatcacatccagctgatatcacaaagatgaaacgccaactattaaaacaagtccatcaacaacctgcgatattgtattacgatttaaaaggttcttcacaatctttcacaaacaattatgaacaattagacacaacaaagatgtatttaatatcaaaatatcgaattgattttaaagacgatacttatatccttaaaatatatatgtcaagcacaccactacttaaaaacattaagaaaaatagtggacaatctgcactcattgttgattcatatgatactgttttatatacaaatgacgaccgattctctatcggtcaaaaatatcaaccaccacagtttgggtttataaacgagtctttaaaactcaattctcatcatgcgcatcttattatatataaagatattcatgaaaccattgaagatggaattgcattactagttgtcatgggtgttgttcttattctgcttgttatttttggatatataagcgctgatagaatggcaaagcgccaatctgaagatattgaagcgattgtccgaaaaattgatgatgctaaaaatcgacatcttggtagttacgaaccgttaaaaaaacatagtgagttagaggaaataaataattatatctatgacttgtttgaatcaaatgagcaattaatacaatctattgaacagaccgaacgtcgtttacgtgatatacaattaaaagaaattgagcgacaatttcaaccccatttcttattcaatacgatgcaaacgatacaatatttaattcctctttcacccaaagtagcacaaacagtcatacaacaactatcacaaatgctacgttattctctacgcacagcatcgcacacagtcaaattagcagaagaattaagctacattgagcagtatgttgccatacaaaatatccgcttcgatgatatgatacagctttacatcgatgctactgagggtgtacaacatcaaacaattggtaagatgatgcttcaaccactcgtagaaaatgccatcaagcatggtcgtgatagtgaacctttaaagataacaattcgtatcagacttacgaagcgcaaattacatattctggttcatgataatggcatcggtatgtctccatcacatttagaacacgtgcgccaatcccttcatcacgatgtttttgatacgacacacctaggtttaaatcatttacataatagagccatgattcaatatggaacatatgcacgtctgcacattttctcaagaagccagcaagggacattaatgtgttaccaaataccacttgtctag

SEQ ID NO: 627 - DNA, 7215 bp, Staphylococcus epidermidis
tgtaagttgtttatgagttattatgggaatgaatatgaaagaaggactctaatgaatattgaagcactatattttcaaaaatatttttattttaaacatttaaatcaatcaagttcagaacacagggtgacatactgggtaaagttaagtcgcgacattgagttacgtagattaatgtatgcattattagatgtcgttcaaagtcaacctgtgttgcgtacacagtttgtgacagatgattttaatcaactcaagataaatttaagagatttttttccatttattgaaattaaagaagttaatgaaatgtcgcaaagcatagatttagaagcattctttacacgtaatttaaattcctaccatttcaatcaattacctctgtttaattttaagatttatcaatttcttgatgaagcctacctacttttagattttcacgctactatttttaatgaaagtcaattaactccatttttacaacaattaaatatcgcttatacccactctttaaaaagtgaatatagtatctcggatttttataattggattaaagaaatgaatcaaaagatggatcaaaatcaagttgtgtgtccatcaaagcacttcaacgtattgaatgcagacggtgataattacgcttacatacctgttaagaatacatgtgaaaagaaaaaaatgtgttctttgcatgcagaactaccatctttagacattgatgtgtggattgtaagtatttacttagcgcatcattttataagtcagtcttctgatgtgacgttaggcatccatttttcgatagataataaaaatactgagaatatgatggttttaaacacagacattgccccacttaatttaagtattagtcaaagtgacgtcgtaaaagatatggtagatgagtgttccgctctacttgaagagcttcaaatgtgtggtgcgtcttttgttgttcaacctaaagcagtacaaatagatgtagaaacgatgattcatattgaaaaagtacaagaacaatttgagcttaatcatatatgtcatcatatacatcgtctatacaatgaagcatcatcattcgcggatttagagttttatcctcatgtgcaggatggttttgatatagtttataatgacaacgtttatgatgatttaactgtacatacgttagtcaaattaattaatgggatttatatgcaaattacacaaaatccatcattattaattaaagatataaaactcagtgatcgctcagatttagctaaatataatgacatcaatcttcaaaacaatgacattaattatagtgaggtcacttataaaaccgtggttgaaagattcgaacgtcaagtgcaccaacatcccgatagtattgcgttgcaatatgaacaacgatcgatgacatatcatcaattaaatcaatgtgcgaatcttttagcatatagattgcgtttaaatcatcagattgaacctaatgatatggtggcattaatagcagaacgcagcttagaaatgattattggaatgttagggatcttgaaagctggtgcaggctacataccaattgatccggattatcctgaagaaagaatgaattatattattgaggacgcaaaacctaaagcggttgtaacatatcgtacatcatttcaatcaggtttacctcaaatggatatagaattgatagttgattcaagagaacatgatattgataacccgagaggcattaattgttcagaagatatcgcttatgtcatctatacatcaggaacgactggtaaacctaaagggacactggtgccacatagaggaattgatcgcttagtacacaatccaaattatgtcgaattgaacgaaaatacaaccgtcttattatcaggaacagtagcttttgatgcagcaacctttgaaatatatggtccattattgaatggtggacggttagtcattacatctaaagatacgttgttaaatcctcaattgttagatcaagctattactgaaaataaagtcaacacgatgtggttaacgtcatctttatttaatcaaattgctagcgaacgtatcgaagcactagaatctttaacttatttgcttattggtggggaagtgttaaatgctaaatgggttcacttattaaattcgcgtgagtgtcatcctcaaataatcaatggttatggaccgacagagaatacaacatttactacaacttttgcgattccacaagagatgccttcacgtatacctattggtttacctattagtggaacgacagtttatgtcatgcaaggtgatcgtatttgtggcgtaggtgttccaggtgaattgtgcattggtggtgcaggtttagcaaaaggttatttaaatcaacctaaacttactgctgaacgttttattcagtcaccttttaataatgaaatgctttatcgaagcggtgatttagttcgccttcaagaagatggctatattgattatattagtcgtatcgataagcaagttaaaatacgtggttttagaatagaattatcagaaattgaaaaagcattagaagctatacgtgatattaataaagctgtagtcatcgttcgagagcaagaccaagataaacaaatagtggcatattatgaagcatcgcaattaaaatcaacaggtcaattaaaagatattttaagtgaaacattacctgaatatatgatacctgtacattttatgaaggtagatcgtatacctatcacgatgaatgggaaattagatgtgcgtgcattacctgaaattaatctaaagaataatagaaattatgtagaaccacgtaacgatattgaacgcactgtttgccgtattttcgaagagattttacatgttgatcaagtaggtgttaaagataatttctttgaactaggtggacactctcttagagcaacattagttgtaaaccgtattgaagaaaggttaaaaaaacgtcttaaagtaggtgatttaatgaaatcgcctactgtagagcaacttggacaacaaattgaagaactgcaaaatgatgtctatgaagtgattcccaaagcaaatgaatcgtatcaatatgatttaagtgcgtctcaaaaaagtatgtatcttttatggaaggtcaatcctaaagacacagtgtataacattccattcttatggagattatcttctgaacttaatgttatgcaattgcaacgtgcattatctaagttgattgaacgtcatgaaatattacgaacacaatatgtaattgatgacaatgaagttaaacaacgtattgcgacacatgtttcgcctgattttgaagaggtaacgacatctctaacgaacgagcaagatattattcaatcatttatggaaccgtttgatttagaacaaccaagtcagatgcgagttaaatatatacatggaccacaacaagattatttatttatggatactcatcatagtattaatgatggtatgagtaacacgattttactatctgatttgaacgctttataccaagataaatcattacctgaacttaagcttcagtataaagattatagtgagtggatggtgcacagagacttatctaaacaacgtcacttttggttacagcaatttgaaaatcaggttccaatattaaatatgcctacggattatcctagaccaagtattaaaacaaccaacggtaatatgttgacgtttcattacaatcgtcaaatcaaacagcaattgaaatcttatgtagaacaacatcaagtgacagactttatgttctttgctagtgcaatcatggtattattgcacaaatatacacgtcaggacgatatcgctattggtagtgtaatcagtgcgcgtactcatcgcgatactgaaaatatgttaggtatgtttgctaatacacttgtatatcgtggtcgaccacatgatcaaaagacatgggatcaattgatggctgagatgaaagagatgtgtctaggggcatatgaacatcaagaatatccttttgaaagcttagtcaatgatcttgttgatgaaagagatgcttcacataatccgttatttgatgtgatgctcgtacttcaaaataatgaaacaaatcatgcgaattttggacatagtcaattgacacatattccacctcagtcaacaacagctaaatttgatttgtcatttattattgaagaagatcaagatgactatgtcgtcaatattgaatataatacagatttatataaacaagagaccattcatcatattgctgaacaacttcaaatgattattaaacatgtaatatctaccgaaaacctaaaaattcaagatattgatgaaaatgatgacttattaatttggttggacaagcatgtgaatgattgttctttagacttgccaaaaaataagtcaatacagcaacttttacatgatgtcatgaaagcgaaagcagatgatgtagcacttaaaatgaatggacaatcgatgacgtatcaagaacttgatgattattctaatagtatggctcaaacattgatacaaaatggcattcaaaaaggggaacgtgtagcccttttaactgaacgaagttttgaaatggttgctagtatgattgctgtattaaaagttggaggttcttatgtacctattgacgtcacttatcccgataaacgcattgaatttattattgaagacgctgaagtcgcagcagtgctcacatatggaaaagcaatatcctcacatataccagtaattaaaattgaagatattgataacactgaaaataataaaaggttaaatatagaatatgcagggaatttggaagatgatatgtatcatatttatacatctggaacaacaggaaagcctaaagcagtatcagtgaaacaacgtaatatattaaatttagtatgtgcttggacaaaaagactcaatttatccgatgatgaagtctatctgcagtacgctaattatgtgttcgatgcttcggcaactgatttctactgtagtttattaaatggatatccgcttgtcattgcaacatcagttgagcggaccaatacagatttattagaaaagttaatttcacaagaaaatatcaccatcgcatctattccactacaggtatataatgtgatgcatcatttctatattcctaaagtgattacaggaggtgcgccaagtactccagcatttgttcaacatatttctaagcattgtgatatgtacgttaatgcctatgggccttctgaaaatacagttatcacatcttgttggatatacgaaaaaggtgacgccataccatcgactattccgattgggaaaccgttagctaatgttgatatttttattatgtcaggcggtaaactatgtggcgttggtattccaggtgaattatgtattgcaggagaaagtttaacttcaggatatttaaacagacccgaactttctgctgaaaaatttataaataatccttttgggccaggacaactttatcgaagtggtgatttagcacgattgatgccagatgggcaaattgaatttcttggtagaatagacaagcaagttaaagtacatggctatcgcattgaactaggtgaaattgaaaatatcattaattcagtagatactgttacagatagcgttgttattttagctaaacagggtgagcgtgaagtgctgcatgcttattatgttggaagtcaagaagatgaaaatcatatttcacaacatttaaatcaatatttgcctaaatacatgattcctaagacattaacagctattagcgaaattccattaacaggaaatgataaggtggatgagtcaagattacctgtacctaatgtacacaaaaataaatttgttgcaccacgtaataatatcgaacgagaaatagcacaaatcgttagcggagtgttggacgtatcgtctatgagtatagatgatgacttctttgaaatgggtggtacatcactagatgctatggtggtagtatcaaaactaaaatcaaatggcatacacattacaatgcaagatgtatatcaatttaaaactgttcgttatatagctaatcacacagaaaaacgccaagcactaccagaagtagtattaccagatcatctaccacaattacaatctttggttgaaagacgataccaactaaaatcacaacacctaacgcaatcatctctaggtcatgtattgctaactggtgcaacagggttcctaggcgcatatttaattgatgaaatgcaagatgatgctgatcaaattacatgtattgtcagaggtcatgatatcaatcaagctaaaactaacttggaaaataatttaaattgttattttgatacggctcatgtggataaattaatgaagcacattgatattattttagcggatttatcagaacttgaccatcttattatcgattcagccattgatacaattattcatgctggagctcgtacagatcactttggcgatgatgaaacatttttcgatgtcaatgtaagaagtacacaagcattaattgatttagctaagaataaaaaagcgaaattaatctatatatcaacgataagtgtgggtacggtatttgaagtacatcaagacgatattacattttctgaaaaagatttatataaaggccagttatttacatcaccatacactaaaagtaagttttatagcgagattaaagtgttagaagcggttaatgaaggtttagcagctcagattataagattaggaaatctgacaagtgcttctactggaccattaaatatgaaaaatttaacaactaatcgttttagtattgtcatgcatgatttattaaaaatgccgtttataggagaaagtatatcgaaagctaaagttgaattttcatttatcgatgtcacagcgcgccatattattaaattggcaagatccaatgcaatacctattatttatcatgtatacgcaccatgttcgataactatgaaacaagtaattgacaatgccaaagggtcagaaatgactgtagtaagtgatagtgagtttgaacagaaattacatgaattaggtatgcatgaattgattggtcttaatagtaatggagataatcaaatttcaggtgtgacagattcaaatatgactcaaacagtaatgaaagaattacaaggtgagtggccacatctttcttaccaatggttgcagcagtggtaccatttattgtttgaaaaatttgatgccaactag

SEQ ID NO: 628 - DNA, 939 bp, Staphylococcus epidermidis
gcataccatcccttgaaaaatggtgtagaaaataaatttttaataattagtatgtactttaatttaaaaataaaaaggatgaataaaatgaaatttaaaaaatcactcataacagctttagcaaccataactttggtaccatcattgatgattttagatacacagcatgaggcaaaagcagtaggaaattattattacaatggcatggaagatcataatgcgagtgctgcatatcataaagcgaagaaagttgataatagtcaaatagtcataaaacgttataactatgcgcataaaaataaatataaagcagtaggaagagtatcgaacatggatggttggaaaggtccaggcaaagatagtatgggaacaggatttatggtaggcaatcatacgtttgtaaccaatgcacatgttgtagataagaaaaatggtcaaagaacgagtccgagtaaaataaaatttcaattaaacagagacggtaaaaagataccctatcaatttcatgctaaaaagatatataaaatcccttcatacgatatggttgtcgttgaaactaaagaaaatatggctcaaaaagctaacgtgcaaccacttaaacttgcaaccaatcaaaaaattaagagtttaaaatttaacaagaaattatattctttaggatatccagtgatgaacgggaacaatacatatgcatactggaataagttacgttttttacaagaagcatcgaataaatcagaactcatgacaaaagataaatttagagctggtgattcaggatctcctatggtagatagccagtacgttgtttatggggttcgtacgtatggatataatttaagaggtagttctaatcatccttatgcccaacaagaagttgcaggtgcagaatcattatatggtaatccaagagattttattcttaagcataataagtaa

SEQ ID NO: 629 - DNA, 216 bp, Staphylococcus epidermidis
attaaagtaccgccattcatattaaacaacaacatcccatccttacgtatcattgaaaacagaatacctggtgcaagctgtgtaggtacatctagtagccataataaaggtatgaatgcatttgatataaaagtcaaaataggcgtaagagacaatagacttacaataaggcaaattcctataaaaataggtaaggcttgtacaataaacatttga

SEQ ID NO: 630 - DNA, 624 bp, Staphylococcus epidermidis
ttgaaaaagtttttaaaaggatttattttattttttctcattgtgatgctaggatttgcagggggattgggatacagtcattataaagattcaaaagcaaacactgatgtatcttcaaaagagactcagacttcaaataaaaatactcatgaagatacaatttcacaagatgaaatgcaaaatcaagttgatagccaaacaaacgaagtatcaaatgagacatcaactaaaacacttagcgaaaaagcaaagcggttaagagaagcttttaacgttaatgatgaggaagctcaaatattagcagatgaaatcgatagagcagatgtaaataaagatggcacgattactatggatgaaatgacgcctactttagatcgttttgcaaaagaagggaaattccaaccatctgcaggtggcacaactaacgaagcacatcatcctaaatatacagcagaagatgctagaaatatgtcagatgatgaatttctagacgcgtatacagaaggcatgtcagatgatgaagctgcgacaattcacgaaagtgctcaagaatctaacgagtatatgaaatttttaagaggacaagttgaagcacgtgcaaaaggacagggcggtaattattaa

SEQ ID NO: 631 - DNA, 963 bp, Staphylococcus epidermidis
atgaaaaagttaattcaagataaaaacacaattttaaaagatatgcttgatggaattacagtttcaaacaacgatgttgaagttgtatctgacactattgttgttagaaagcataaaaaacaatcaggtgttgcactcgtttctgggggcggcagtggacatgaacctgcacacgcaggatttgtagcagaaggcatgctcgatgcagctgtatgtggagaaatcttcacttcacctacacctgataaaatattagatgccattaaagctgtggacaatggtgacggcgttctacttgttattaaaaactatgcaggagacgttatgaactttgaaatggctcaagaaatggctcaaatggaagatattaaagttgaaagtgttattgtcagagatgatattgctatttctgacccggaaaaacgccgtggtgtagcgggtacagtatttgtgcataaatatgctggatacctagctgaaaaaggtgttgcacttgatgaaatcaaatctaaagttgaggcacttttaccagatattaaaagtattggtatggcattaacgcctccaatggtgcccacaactggtaaaaacggtttcgatattgaagacaatcaaatggaaattggtatcggtattcacggtgaaaaaggtttacatcgtgaagacgtacaacctattaacgtgattgttgaacgtttactcgatcaattatacaaagaaattgagaaaaaacctttaatcgtaatggttaatggtatgggtggtacgccactatcagaattaaatatagttactaaatatctagatgaacaattcaatcagaatgatattgatgttaaacaatggttcgtaggtgactatatgacagcattagacatgcaaggcttctctataactgtactccccttcagtgaagaattgagtgaagctttagctgcacctacagcaagtaaatatttttaa

SEQ ID NO: 632 - DNA, 843 bp, Staphylococcus epidermidis
tgggaaaagttatttcaacggcgcaccgtggctcttcttcttccctggtgtattgttaggaggtttcgccttattatgtcaaattatcaacaaaaaaataacgcagtaaatacggtagtcaacgtcaatcaattatcgattttagatcaagagaaagtattgttaaaggatgttgatttgacagtaactaaaggtgcatttcattgcattataggtgaaagtggcagtgggaaatcactgttaacaagaacaatacttggaatgaaacaatcacaattatgttatcaaggagatattgacatcgatttaactcaaacagatgcagtgtttcaagatgttcaaagtaatatgtttcaaaatataacattagctaagcatttccaatacatttatgaagccaatcgcacacatctcactaaacagcgtattaaggaagatgtcttacagatgatgcaattacttggtttaagacaaggggaacaattgcttgagcgttatcccttcgaacttagtggaggtatggcacaacgtgtcgcctttataatgtcattaattagacgtccgaactacttatttttagatgaaccaacgagtgcacttgatcaagaaaatattaaaaagtttatgcattaccttcttagggcacaggagcgctaccaaatgaccattgtttttatcacacatgatattaacttagtgaaagattgtgccacacatattagtattatgcagcaaggtaaattgatagaaaatggtgaggccgcgtcgatcttaactaagccgacacataattacacgaaaaaattaattacgattgcacatcggagacaaccttatgcttaa

SEQ ID NO: 633 - DNA, 231 bp, Staphylococcus epidermidis
gctcccattacaattccaattacagtattcgtcgcccccaagtcatgtcctcttagaggtatgaaaacattgagtatggcattcgcactaaaaaacatcaatgttaaaatatataatcttaaaaaaggccaagacatggcacctttcatattgtcactccttagattgatagttgtttatcaatcagttctcttgtataaccattttgttgcctatgcaattcacttatag

SEQ ID NO: 634 - DNA, 984 bp, Staphylococcus epidermidis
aagaaggagttaaagattatgacattaaacctagctcaacgtgtgttaaaccgagaaccattaactaaagaagaagcattaacaatttttgaaagttccgaactagatacatttgatttattaaatgaagcctacacagtgagaaaacattactatggtaaaaaagttaagcttaatatgatattaaatgctaaaagtggtatctgtgcagaagattgtgggtactgtgggcaatctgtaaaaatgaaagaaaagcaacgttatgcacttgttgaacaggaccaaattaaagaaggcgctcaagtggcaactgaaaatcaaatcggtacatactgtattgttatgagtggtagaggtcctagtaacagagaagtcgatcatatttgcgaaacagtagaagatattaaaaagatacacccacaactaaagatttgtgcgtgcttaggattaacgaaagaagaacaggctaaaaaattaaaggctgctggtgtcgatcgttataatcataatttaaatacgagtgagcgttatcacgatgaagtagtaactacacatacatatgaggatagagtgaatacggttgaaatgatgaaagataataatatttctccttgttcaggtgtgatatgtggtatgggagagtcgaatgaggacattattgatatggcatttgctttaagagccatcgatgctgatagcattcctattaattttttacatcctattaaaggaactaaatttggtggattagatttattgtcaccaatgaaatgtttaagaattatagcgatgtttaggttaatcaatccaacaaaagaaattcgaattgcaggtggacgggaggtaaatctacgttcattacaaccactcgcattgaaagcggctaattcaatttttgtaggagattacttaattacaggcggtcaaccgaatgaggaagattatcgcatgattgaagatttagggtttgaaatcgacagttaa

SEQ ID NO: 635 - DNA, 390 bp, Staphylococcus epidermidis
ttccgctggtttacctggttctgctggcgtacctggttccgctggtttacctggttctgctggcgtacctggttccgctggtttacctggttctgctggcgtacctggttccgctggtttacctggttctgctggcgtacctggttctgctggcgtacctggttccgctggtttacctggttccgctggtttacctggttccgctggtttacctggttctgctggcgtacctggttccgctggtttacctggttctgctggcgtacctggttccgctggtttacctggttccgctggtttacctggttccgctggtttacctggttctgcttttgttggaccatactcaacaatttcgtcaacaggttgtttagtgactttttctgttga

SEQ ID NO: 636 - DNA, 429 bp, Staphylococcus epidermidis
atggaaataacaagtgttaatcatatttgtttttcagtgagtgatttaaatacctctatacaattttataaagatattttacatggtgacttattagtatcaggtagaacgacagcatatttaactattggtcatacttggattgcactgaatcaagaaaaaaatataccaaggaatgaaataagtcattcctatacgcacattgctttctccatagatgaagaagattttcaacagtggattcaatggcttaaagagaatcaagtaaatattttaaaagggcgaccaagagacattaaagacaaaaaatcgatatattttacagatccggatgggcataaaattgaattacatactggaacattaaaagatagaatggaatattataaatgtgagaacacgcatatgcaattttacgatgagttttga

SEQ ID NO: 637 - DNA, 822 bp, Staphylococcus epidermidis
aagcacgtgacactgcttaaagtagcacatttaggaattaaggacacatggtcagatgagacgctcgttgataacgtgaatttcacagttcaatgtggagaaacattaggtattattggagaaagtggaagcggaaaatcgattacttgtaaggcattaataggtttaaacgctcaacgtttatctgtaagcggagatatcttttttgaacatcaaaatttaaatacaataactgaaaagcaactacgcaaaattcgtggtaaagatattgcgatgattatgcaacaaggaacacgggcatttgatccttcaactaaagtgggaaagcaaatgattgaaactttgcgtgcacatacgacattatcaaagcaacaaataaaacaagaacttattcattatatgacgtatatgaagttgaaagatcctcagtcattattaaaagcatatccctacatgttgtcaggtgggatgcttcaacgtatgatgattgcactagcattagcattgaaacctaaattgatcattgctgatgagccgaccacagcattagataccatcacacaatatgaagttatcaatgcttttaaagatataaaacatcattttgattgcgccatgatttttatatctcatgacctcacagtgattaataaaattgcagaccgtgttgtagttatgagagaaggtcgtgtgatagaagaaggtcgaacaaatatggtattacaacaacctcgtcatcactatacagcttatttattatcaactaaaaagacaatttatgattattttcagtttgtgctgaggggtgatttcaatgcttaa

SEQ ID NO: 638 - DNA, 930 bp, Staphylococcus epidermidis
tttcattatttaaaggagagaaacgaaatgaaaagacactttttagcaatcggagcaattacaataacaacattacttgcgggatgcgattttggagatttggtaggacagcatcagtctgataagcaatcagaaaatagtaacactcaaaccgagcaagcttcaaataataaaaattcaaattctgataatgatcattcaaataataacgatgagtctagagatagagtggaagatttaactcaatcgcagaaggtagcattagctatcaatgatccctcagtttctcaatatgtcgttaatgcaagtgaattaaggaatcattcattttatgcaaattataacggcggaggccaacgtaaaagtattcatacgtataagttggaatcattacccaaaaaagtagaaggtgcacctaatgatatgacattctatactgcaaaaccatcaaaagggtcatttgttactcttatcggtattggtaatgaaaaggtattaattgcaggcacacaaagttcaggtacatatcaacaatatgctcattcggaagcagcaagagaattagatttacatgaattattagataaatacggtaaaagttcaaattataaaaatctagcaaatcaaattacgtttacacaaggtcaattatcaaatgcaagtgaatatacatcagatgaagggacgtctaataatgatgcatctaatgatgacaaagttactcgtgataatgtaatagataaagttgaagcgtatgaaggtcatcagctagataccgatacgtatacatttaaagaacccgaacagaacgaagacggagattggggattttctattttagataaggaaggcaatcttgaaggttcttatattgtgacatctgatggtgaagttacaaaatacgatgaaaacggggaagaaatagagtaa

SEQ ID NO: 639 - DNA, 198 bp, Staphylococcus epidermidis
ttattatatttcaagattattatagtttttaaatacatcattttagtaataagtatattaattgttagtgagataaaatttaatagtactactacacaaaaaagagagggcgaattcgttctctcttttcttggatttttaaaagtgaataaaaaagtattaagcaacggaatggagctacttaatattttttcataa

SEQ ID NO: 640 - DNA, 984 bp, Staphylococcus epidermidis
gtgttatatttagaaatgacttactgctcattatctataaagatttatacattgaaaatattgattgttttaacaataggaggtcatgttgttattatgagtcagtttaaggacacattatataaactatttgagccaatgatgaaaatagagttctatcaaaatctattggttaatcttttaattatacttgcttatatcttgatgggtatgattgtaattgcgatatcaagaaagttagttactaaatttttcaacgttaatgaaaagaaaaagaaccgtcataaaattaaaagaagtgaaacactatccacattgattcaaaatttaataagttatgtcgtatggtttattgtccttacgtcaatactttcacgtttcggtattagtgtatcagcaattttagcaggagctggagttgttggtgttgccgttggtttcggagcacaaacaattgtaaaagacattattactggtttctttatcatatttgaaggacagtttgatgtaagtgattatgttcaaattaatgcatctggggtaacaattgctgaaggtacggttaaaacaattggtttaagatcaacacgtatacaatcagatactggagaaatttatacattacctaatggtatgattagtgaaatagtcaattattctgctacagatgtttcacctattgtgatgataccgatttctccaaatgagaattataaagtgatagaagagaaattattaacatttttacctacattaaagaataaatatgacatatttgtatctgcaccagatttacttggtttagacagtgttgatggcaatgaaatggtgattaaacttttagcacatgttaagcccggaatgcattttccaggacaacgtttgcttcgtaaagaggtcatacaatacttcagtgaagaaggcattcatattccaaaaccaacacttgtaaaacttgataaagaattgaataaaaaagaatag

SEQ ID NO: 641 - DNA, 627 bp, Staphylococcus epidermidis
atcatgtatttgtatgtgactaagatgacagaaactttagaggaagtagaattgcttttaaatagaagttctcgtcagttgaaaaagccagaacgaatacactatagatttttaaaggatcgacttatgcaccaattaggtgatgcattgattcagtatgctattgaacaatgtgctggattaactcctaaagaatgggagtatcacatcacaactatgggtaaagtagagatacgaagttcttgtcatatatacgtgagtatttcgtatagttatccttatatcatttgtataatagataatcagcctattggtattgatatcgaagaaatgaaagacttggattataaacatttggcgaagaattttacaaaaaatgaatttaaccaagtgactacacttaaagatttttatgaaatttggactaagaaagaaagttatacaaaactcatcggtgagggattgatgaatggtttagactgctatgatgtgacgcaaaatttgagatttttaaaaaaacatgtccaatttacctcagtagattattttaaaagactcattcaaatatgtcatatgagtaaacatagtttgaactttgaagtggtgccgctcacacaattattataa

SEQ ID NO: 642 - DNA, 879 bp, Staphylococcus epidermidis
caatttaatttgaaaatttacattaaaaaggagtgttttatgcaacgtcaagtggtcgaattttcaaaatataatccatctgggaatatgacaattcttgttcattcaaagcatcaaccgagcgaatatgctgcgattgcacatcagttgatggcgacaacacacatgtgttgtgaacaagtagggtttattgaatcagtaaactatgaaaatggggataactatcacttggtaatgagtggaaatgaattttgtggtaatgcgactatgtcttacattcactatttaaaagaacgtttattgatacagcatcaacaatttcaattaagagtttcggggtgttctcatcctgtagagtgtaaagttcattcgcaacattatgaagtgactatgccaaaagtacatcaagttaaggaaagatttgtgaaattaggggaacagcagtttaaagcatttgaaattagctatgatacatacattcactatgtgatgatgtgtgatgatgtagatttggcaataaaacagtgcgtggaagattttgtcagtgcgcaaacatggcatcgacaatttaaaacaattggtgtcatgctttttcaacaagataaacaattcatatatccactgatacatatacctgcaatagatagcttaatctgggaaaatagctgtggttcaggagcggcttctatcggtgtgttggttaattatctaacagatcatgatattcaagattacctagttaaccaacccggaggcagtattattgtctcatccagaaagtctggacaaaatgaatatcaaacaacgattaagggtcaagtttcaactgtcgcaacaggacaagcatatatagaacaggagacaatgacgcaaatatga

SEQ ID NO: 643 - DNA, 1512 bp, Staphylococcus epidermidis
tatataaatttagaaaggaacatgcacatgagtgaagcaaatcataaaaacatcgttgttgtaggtgcaggaattattggtacgtcagtagctacaatgctttcaaaagtaagtcctaactggcatatcgatatgtttgaaagactagaaggcgctggtattgaaagttcaaatgaaaataataatgctgggacaggccatgcggcattatgtgaattaaactatacagttgaacaagatgatggttcaattgatgcatctaaagcgcaagaaattaatgaacaattcgaattatctagacaattctggggtaatttagttaaaaatggtgatatttctaatcctgaagaatttatccaaccattacctcatatcagtttcgttatgggaccaacaaacgttaactttttaagaaaacgttatgaaacactaagaactcttccaatgttcgatacaatcgaatatacagaagacatggaaacaatgagaaaatggatgccattaatgatggaaaatcgtgaaccaggtcatcaaatggcagcaagtaaaattgatgaaggtacagatgtgaactatggtgcgttaacacgtaagttagcacattacttagaacaaaaatctaatgtttcattaaaatacaatcatgatgttgtagatttaacacaaagagaagatggcaaatgggaagttgtcgttgaaaatagagaaactaaagaaaaagtaactaaaatagcagataaagtgtttattggtgctggcggtcactctattccgttattacaaaaatctggcgttaaacaaagagaacacctaggtggtttcccaatcagtggtcaattcttaagatgtacaaacccagatattattaaacaacatgcggctaaagtttacagtaaagagcctcaaggtaagccaccaatgactgtaccacaccttgatacacgttatatcaatggtaaacaaacattattatttggtccatatgcgaatatcggccctaaattcttgaaattcggttcaaatctagacttattcgaatcaatcaaaccatataacattactacaatgttggcttcagcagttaaaaatgtacctttaattaaatattcaattgatcaaatgatcaaaactaaagaaggttgtatgaactatttaagaacatttattcctgatgctaaagatgaagattgggaactttacactgctggtaaacgcgttcaagttattaaagatagtgaacaacacggtaaaggtttcgtagtatttggtactgaagttgtcaattcagacgacaattctatgattgcattattaggtgaatctccaggggcttcaacatcattatcagttgtattagaagttttagagaaaaacttcgctgatgacaaagaagcatgggaacctgttgttaaagaaatggtaccaacatacggtcgttcattaattaatgacgaaaaattaatgagagaaacacgccgtgaaacttctaaaaacttacatttaaatagataa

SEQ ID NO: 644 - DNA, 1248 bp, Staphylococcus epidermidis
aataaatgttatattcagtttgaaagagttgcaaaaaactttagtaaaggagtactttttatgaagaaaaaattaagttatatgattaccattatgcttgcttttacgctaagtttagcacttggcctatttttcaatagtgctcacgccgactcgttaccacaaaagaatggtgcaaaccaaaaaacaactaaagtcactgtcagtaataaagacgttccagatgcagttcgcaaacttgctgaagaacaatatttatctcgtgtagctttattagataaagcttccaaccacaaagcaacatcgtatacacttggtgaaccttttaaaatttataaatttaataaggaaagcgacggcaattattattatccagtgctcaataaaaaaggagatgtcatttatgtagtaacaatttctcctaatccttcaaattctaaagcttcaaaacagcaaaacaattattccattaatgtttctccatttctttctaaaatattaaatcaatataaaaatcaaaagataacaattttgactaatacaaaaggatattttgcacttactgaagatggtaaagtgacacttgtgcttaaaacgccacgtaataatgaaaaaacatatgaaaatgccactgaatccactaaacctaaagatttaaatgattttaaacaaactgcatcagtaacaaaaccaactttagaatatcaaagtacacgaaatgaaatgtacgcagaatatgtaaatcaattaaagaatttcagaatacgagaaacacaagggtataatagttggtgtgccggctataccatgtcagcactactcaatgccacatataatacaaatcgatataatgcagaatcagtaatgagatatttacatcctaatttaagaggtcacgacttccaatttacaggactaacatctaacgagatgcttcgttttggtagatcacaaggcagaaatactcaatatcttaatagaatgacttcatataatgaagtagaccaattaacaactaataatcaaggtatagctgtattaggtaagcgtgttgaatcaagcgatggtattcacgctggacatgccatggctgtggctggtaatgctaaagttaacaacggacaaaaagtcattttaatttggaacccatgggacaatggtctcatgactcaagatgcacatagtaatatcattccagtatcaaatggcgatcactatgaatggtatgcatcaatttatggttattaa

SEQ ID NO: 645 - DNA, 897 bp, Staphylococcus epidermidis
gagaaaagatatagaattggatattttaaaaaagtacaaggcattggaaaggaagtggtaccaacagtagtcatagatttagtggatcaattaaaagtaaaatattcaatcaaattgatactagaagtattaaacatacctaaatcaacatattaccgatggaaaaacaaaacctataaaaatgataccgtaacacaaaaagtcattgaattatgtaaagctaaccactatacctacggttatcgtaagattacagcattgattaatcaatgttatacatcaccaattaatcataagagagtacagagaatgatgcagaagcatcatttgaactgccgagttagacctaaaaagacgacaagaataggtaaaccgtattataaaacggacaatttattacaaagacaatttaaagcgagttgtcccatagaagtattaacaaccgatattacttatttaccatttggtcattctatgttgtatttatcttcgataatggatatttataacggagaaattgtggcgtataaaatagatgataaacaagaccaaagtttagttaatgatacattaaatcaaatcgatatacctgaaggttgtatattacatagtgatcaaggcagcgtttatacatcttatgcttattatcaattgtgcgaagaaaaaggcattatcagaagtatgtcccgaaagggaacacctgccgataacgccccgatagaaagtttccatccctcgctaaagtctgaaactttttacatcaataatgagcttaatcgctctaatcatattgtaatagatattgtcgaaaagtacattaaaaactataataataatcgaattcaacaaaaactaggctacttatccccagtaaaatacagagaattaatagcctag

SEQ ID NO: 646 - DNA, 240 bp, Staphylococcus epidermidis
aatactttgtattgtacgagcaaaagaatatatataacaaacaatggaggacatcatgattttaactattttatttatctttttctgtattcgactcatcagcttaaagatatctatgcaacacgcaaaacagctaaaggtagagggcgcggtggaatatggtgtgaaaaattcaaaatatctagccattacgcatgtattaatttacatgagtgcagctatagaaacattcattcataa

SEQ ID NO: 647 - DNA, 513 bp, Staphylococcus epidermidis
cttgacgattttcacctgtatcaggtaattgatttttattatctgttgaatgcattgatctatttggttgttctggtgcacctgattgtgctggcgtacctggttccactggtttacctggttccactggtttacctgattccgctggtttacctggttctgctggcgtacctggttccgctggtttacctggttctgctggcgtacctggttccgctggtttacctggttctgctggcgtacctggttccgctggtttacctggttctgctggcgtacctggttctgctggcgtacctggttccgctggtttacctggttccgctggtttacctggttccgctggtttacctggttctgctggcgtacctggttccgctggtttacctggttctgctggcgtacctggttccgctggtttacctggttccgctggtttacctggttccgctggtttacctggttctgcttttgttggaccatactcaacaatttcgtcaacaggttgtttag

SEQ ID NO: 648 - DNA, 786 bp, Staphylococcus epidermidis
gaaaagaggtacgatgtgatgaaaaaatatcaaacgtacatcgcaataggttcactattgagtttgatggttgtattaattacgtatggtttaatgcaagacacgcaacatttgaacccacttgagtcacctaatggacaacattggttgggtaccgatcaattaggcagagacttcttagtaagactgattgtcggtagtcttgtcacattgagtttaacaggcatagtgattctattaagcgtttgtatgggacttatctttggcttaattgcaggcatagaaagacgatggttagatcaaatcatcatgtttgttgccgatatgttgctggctattccgtcatttattatcgcattagtcatcttaagtttagtaagtaactccatgataggtttgatacttgctttaacgattggatggataggacgttatttacgttacttcagaaatttaacgcgagatattcaaaaacgtccatttgttcaatatgcacgattgagtgggaactcaacattcaaaacgacagtaacacatgtgattccacatttattaagtagtatattcgctttggtaacggctgactttggcaaaatgatgctcagcatatctggacttgcttttctaggactaggtattaaaccgccgacgcctgagttaggaacaattctttttgatgggaaaagttatttcaacggcgcaccgtggctcttcttcttccctggtgtattgttaggaggtttcgccttattatgtcaaattatcaacaaaaaaataacgcagtaa

SEQ ID NO: 649 - DNA, 1482 bp, Staphylococcus epidermidis
atgatggatttttggtcttcaaaacgaggcaagatgttagaaatcactgtcctcgtgtttattacaatttttggtgtaggctctcaatttttttcaaatttagcctatagtttaaatcaaggtatccttcaaacatcctttggtattggctctcaatatctgattatcccctctgtattagctaatttcacttttgctttaggtataccgttggggcatacactcacacataaatatggattcaagcgtaattacttatgctttgtgtttatatttctcattggttcaatcttaggacttctatcttttaacttaatcattctgtctattgctaaaatgattcaaagtttcagttcaggtgtattattctttaccttgttacctaaacttttcttgaactttccaaaacaatatagaaatgtatttttattgatggttattgtaggtttatttggttcaaatgcgcttggaggattatctggtagtttatcattagaattagatcgttggcattggatttttgtagtaaatatcatctccgcgatattatgcttaattctaggcaacgtcatattaagaaaaaatgaatatcatcaaacatcagatattcatattagtcgatcaatgatgattactttagtattaagtaccatttctttaatgattcctatgtcacttcttactcaaaaaggctaccattcattatgggtgtggccgatactcttaattgcaatattttttattgtaaattttatcattacaaatcggcaagctacacatcccattgttcactttcatacactattcagtaaaaagcctttcgtcggtgcaacaatggcaatttcatcacatttaactttattaacaggcattgctggtatcaatgtctatatcgtaagaatattaaagttgccttttgatatttcattacatttctatttctttttctttgttggagtcattataacgggtatcttaaaaatgttcttttatagctctgtcggtgcaggttttttaggtacattgggatcgtcagccttactatatgtaagcatccattggattattctgggaaatacgattaacattccattactttatattcaaggtcttctgctcggcttcggtgcaagcatgaccttagttagtggctcgatggctacattattggacggagatttaaaagaagcagcacaacgttctcaaaccatgcatacaataagaaatttctctgctgctatgttgataccgattatagcttatacgattaagaatcatatccaaaaaggaacacagtctatatatgctgaaaacattactgataaaatgatttaccttaaaaagttgcaagatgttgcgattgatgctgatcatcaaatattcttattaatgattattttcaatatggtcatgttcgtttcttcaattatacaaatgattttaggtaaaggtagacgtattacaccacctcgggaatcataa

SEQ ID NO: 650 - DNA, 1434 bp, Staphylococcus epidermidis
aaggagtaccattctatgtctaacatttcgatgacgacttctaaacgtaatgctatcgttacggtaatgctcattagtgcttttgtgtctatgctcaatcaaactattttaaacactgcactaccagcaatcatcaaaggactgaacatcacagaaacaacagcacaatggttaattaccggatttatgcttgttaacggtataatgattccactcactgcctttttaatggataaatattcgacacgccatttatatattttctcaatggctatttttcttataggatctattgtagcggcattttcacctacgtttacaattttaatgatatctcgtattatccaagcgattggtgccggcatccttttaccattgatgcagtttacagtatttacactgtttcctgctgaacaacgtgggtttgcgatgggattggcaggggtggttgtacaaagtgcgcctgcaattggaccaacgttaactggattattcgtagatttatttagttggagaatgccattttatcttgtttcagcaattgctgcggtagcttttattttaggtttcttcttcgtagaaaataatacaaaaacaaaagacattgttcttgataaaatttctgtagtttattctactttcggctttggtttaattttattcgcatttagtagcgtgagtacgtttggtatcacctctctacctgtcattgtgacatttgtactcggtatagccattatcataatttttacaacgcgtcagcttaaattaaaacatccattgttaaatatgcgtgtgtttaaaaataaagtgttcacactttcagctgtttcttcaatgcttgtatatattacgatggtaagtcctgcgttactcatacctatttacattcaaacaggtttaggtcaatcagcattactatcaggtgtcgtcgtacttccaggcgcggtcattaatggattaacgatggtttatacaggaaaaatttttgataagcatggtattaaagtgcttgtgatacctggttttatcttactcattagtatgacattcttatattcattccttactacaggaacgccatattggtttgttattcttgtttacactataagaatgattgcgttaggattattagttatgcctcttaatacagttggactgaatgcacttgagtcagatgatgtctcacatggtacagcaattatgaattccttacgcatcattgcaggtgctatgggtacagcggttagtgtgacgattctatcaatagtggcaaaacagtatacagcttcacactcgacaatgtcaaaaatgaaactaacacaagaagcaactgtacatggtatagatgttgcatttatttttactacagtattaatcattattggatttatcttagcgttattcataaaagaagaaaaaaatcattaa

SEQ ID NO: 651 - DNA, 1395 bp, Staphylococcus epidermidis
tgtgaattgcacatgttaaaggtaacctttaatttacgtgatgggacgtttactgacattccagatgatgcacattactttttaattgaagactatgacaaattaactcccagtcagcaaactttattaaaacgttacattatcaaacatcaattagatatttcattacaacatgctattctttcatctccactccatagtttaaatatgattaaaaagttagagacttttgttaaggagagcaaagcataccatcctcaatttcacaatattatttgtggatggtgctttattgtacttatgtttgctttacccatctacttgtcttatcacgtttcagacggattacaatactacgtgtcacactggttaactaaactatcccaaatatcattatttcaagaaaataagctacaacatattttattcggtcattatggtgtcatttctttaggtacatattcattcgtctgggcgttaccagttgttttcatgattagtttatctacagctcttatagatataactcatttaaagcattatatcgtttggtctatcgaacctacgatgatgagacttggtcttcatggatcagatatcatacccttgttagaaggatttggatgtaatgctgctgctattactcaagctacacatcaatgtcatcgttgtacaaaagtacaatgtatgagcttggtaagtttcggaactgcatgtagttatcaaattggtgcgacattatcgatattcaacgcaagccaccgctcttggttgtttttgccatacataggcatggttttcttaggaggaatcatacataacaaactatggtatagtcatcaaacacctaagacaacaccatcagtttttcaacgacaactcgtacgttggcctaaaccaaacctactcttaaaagcagcgtggaaaagtattcaaatgtttattgtacaagccttacctatttttataggaatttgccttattgtaagtctattgtctcttacgcctattttgacttttatatcaaatgcattcatacctttattatggctactagatgtacctacacagcttgcaccaggtattctgttttcaatgatacgtaaggatgggatgttgttgtttaatatgaatggcggtactttaattcaaagactttccgcattccaattattgttgctagtcttttttagttcaacatttacagcatgttcagtaacaatgactatgctcatgcgtcgactcggttcaattctaggaattaaaatgataatgaaacaaatggtatcgtccacaatttgcgtcaccatactagtcatagcaatgttaagcataactaaaatttcagacttaggagtgatgttatggaaatcattattatcggtggttttttag

SEQ ID NO: 652 - DNA, 663 bp, Staphylococcus epidermidis
ttacgattgcacatcggagacaaccttatgcttaaaatagagagattaaccaaatatatagacacgcaactgatatttaaagagatatcatgtacaattaacgaccagcacttactcataagtggggagagtggttgtggtaaatccacattagccaagattatcgctggcttagatacggattatcagggcgaattatatcttaatgggcgcttacgtgaatcttatacgtctaaagagtggatgaagcacatccaatatgtacctcaatatcaacgtgatactttaaatcagcgtaaaacggtattagctacattattagaaccacttaagaattataaggtaaataaacagcgttatacatcaagcattgaagcagtgcttgatcagtgtaatttaccacacgatatacttaatcataaagtttcgacattaagtggtggccaatttcaacgcgtctggatagctaaagctttaatattagaaccagagattctcatattggatgaagctacaaccaacttagatgtcattaatgaagaagctatacttcaaatgttgatttccttaaagatgacacaattaatcattatttcacatgatacatacgtcttaagccaatttgaaggaattcagttacagctaaataaattgaataattaa

SEQ ID NO: 653 - DNA, 384 bp, Staphylococcus epidermidis
acaatgaagcaccacagatgtcttctacattgcaagcagaagaaggaagcaatgcagaagcacctcaatctgagccaacgaaggcagaagaaggaggcaatgcagaagcacctcaatctgagccaacgaaggcagaagaaggaggcaatgcagaagcacctcaatctgagccaacgaaggcagaagaaggaggcaatgcagaagcacctcaatctgagccaacgaaggcagaagaaggaggcaatgcagaagcacctcaatctgagccaacgaagacagaagaaggaagcaatgcagaagcaccgaatgttccaactatcaaagctaattcagataatgatacacaaacacaattttcagaagcccctacaagaaatgacctag

SEQ ID NO: 654 - DNA, 846 bp, Staphylococcus epidermidis
ttatcatttaagaatgatactggaggaatgaagatgacaaatcgtttaatattattcgactttgatgaaacttactataaacatcgtactaatcaagcagatattccttatttaaaagaaatggaaagtttattacagaatataactgctaaaaacaatgtcattacggcgattttaacaggaagtactatagaaagcgtactgaaaaaaatgagtaaagttaatatgtcatataaacctcaacatattttttcagatttaagttctaaaatgttcacatggaataactgcgaatatattgaatctgatgaatataaaaacgaagtgttgatagaaccgttcttattggaagatatattagatatattaaaacacgtttcttctaaacataaagtagagtttataccgcaaagaatttttcgagaaaatgaaacattgtataatttttatctttattcttcgggtgacacgcatttagataaaacaattttagaagacctcagtcaatattctaagacaagggattatacgatgacatttaatcgttgtaatcctttagcaggtgatcctgaaaatgcttatgatattaattttactccaaagaatgcaggtaaattatatgccacaaaatttttgatgaataaatatggcgttccaaaagaattgattattggctttggtgatagtggtaatgatgaagcgtttttaagttatttagatcacgcaatgattatgtctaacagtcaagatgaggaaatgaagagtaaatttaaaaatacaaaatatccttattacaaaggtatttatacacatgtacgtgaatttatagaatatgaaaatgtttaa

SEQ ID NO: 655 - DNA, 915 bp, Staphylococcus epidermidis
tgcaatattaaatccgcgtttaagggaggcaatgaaatgattgtgttacgtcgtctatttcaagatagaggtgccatatttgctatagctattattacaatctacgtagtgcttggagttttagctcctttaattacattctatgaaccgaatcacattgatacagcaaataaatttgctggtataagttggtctcactggttgggaacagaccatttaggtcgagatgtattaacacggataatatacgccataagacctagtttgttatatgtatttgtcgcattgattatttccgttgtgataggagcgatacttgggtttatttcaggttatttcccaggttatatcgatgcaataattatgcgtatatgcgatgtgatgttagcttttccaagctatgtggtcacattggcattgattacgttgtttggcatgggtgtagaaaatattattattgcatttatattgactcgatgggcgtggttttgtcgcgtgattcgaaccagtgtaatgcaatatattgaagctgatcatgtaaaatttgccaaagtaattggtatgaatgatttaacaatcattcgcaaacatattttgccactaacctttactgacatagcgattattgctagtagttcgatgtgttcaatgatattacaaatgtcaggattctcattccttggattaggtgttaaggcacctacagccgaatgggggatgatgcttaatgaagcacgaaaagtaatgttcacacatcctggaatgatgatgacaacaggtgtggctatcgtcataattgtgatggcgtttaactttttatcagatgctttacaaatggcgattgatcctcgtatgtccgctaaagaaaaacgactggctctgaagaaaggtgtgaaagcacgtgacactgcttaa

SEQ ID NO: 656 - DNA, 1425 bp, Staphylococcus epidermidis
aagcattgtttaattatccatctcaagcaactgacgaaacacaatggcgatgtgaagaactacaaacacgaccgaagcagatttttgatattgcactttatcgtaaagtggcatcaaaagttggtgttgaacatgtctaaaatattaatggttggtagtggaccggtcgctattcaacttgctcgactatgtaacttacatggggaacatatggttgatatggtgagtcgcgttcatgcatcaaccaaatctaagagagtctttgatgcgtatcatcgtgacggctttttttcagtaatgactcaaaatgatgcacatcagtgttttttaggtaagtttacggttagacatttttttaaagatgttaaagacattacacaatattatgacgtggtgattttagcatgtactgctgatgcgtatcgaccgatattacagcaattatctaagtccacattaaaacgtattaaacaaattatcttggtctcgccaacattaggatcacatatgcttgttaagcaaatactatcagatgttcattgtgaaggtgaagtgatttcgttttccacttatctaggcgatactcgaatatttgataaagcacaaccgcattgtgtcctaactacacgagttaaatcaaaattattcgtaggttcgactcattctcagtctattacattgtataagcttaagtctttattcgactatttgaatatagaattaacaacgatggacacaccgctacatgcggagatacataatagttcactttatgtacacccaccattgtttatgaatcaattttcattaaaggcggtatttgaaggaacgaaagtgccagtatacgtatataagctatttccagagggtccaattacaatgaccttaatacatgaaatgcgattaatgtggcaagaaatgatgatgatattaaaaaaattaaaggtaccctcggtcaatctcctgaagtttatggtgaaagaaaattaccctatacgtgatgagaccatgcgcgaagttgatattgaaagctttgaaaatttatcagctattcatcaagagtatctactttatgtgcgatatacagcaattttaatcgatccattttctaatccggacgatcaaggtgcatattttgatttttctgccgtaccatacaaacatgttgatactgatgaacaaggagttatacatataccacgcatgccgagtgaagattattatcgtactttgatgattcaagcaattggaagagcattaaacgttgcaacaccgatgattgacacattgttattacgttatgaaactaccgttaaacaatactgtgatacacatttacatcaacaactatcaaagcaattcgaattacatcattttaaacaggatttagcgttagtgacgaactacttaactttttataaataa

SEQ ID NO: 657 - DNA, 1137 bp, Staphylococcus epidermidis
tataaatataaaagatgttttggaggaatacttatgtctaaatttatttatcaatcaccaggaagatatgtacaagggaaaggtattgttagctctatcgctgaagaaacagaacgtcttggtagtcacgcgttgattattgcagatgaagtggtttggaatatcactgaagaaaaaataaaagaaagtttctcagcaaataacaacgttgattttgaatatgaagtatttaaaggagaatcttctgaagaagaaattcaacgtatagttaaacaatataaagaaaaaaacattgacgttgttattggtttaggcggaggtaaagcgttagatacaggtaaagctgtagcatttgaacttaaagcaagcgtcatcgattttgcgtctacagcatcaatggatgcaccaacagcagcagtatctgttatttataacgaagatggatcatttagtggttatgaattctaccctaaaaaccctgatacagttatcgtagattctgaaattgttgcacaagcacctgtacgtttatttgcatcaggtatgagtgatggtttagcaacattaatcgaagttgaatctacacttcgtagacaagggcaaaacatgttccatggcaaacctacattagcaagtttagcaatcgctcaaaaatgtgaagaggttatttttgaatatggttacagtgcttatacttctgtagaaaaacatatcgtgacaccacaagtagatgctgtgattgaagccaatacattactttcaggtttaggatttgaaaacggcggattagcaggtgcacacgcaattcataatggattcacagctttagaaggagatatccaccacttaactcatggtgaaaaagtggcatacggtattttagtacaattagtacttgaaaatgcgccaactgaaaaattcatgaaatacaaaacattcttcgataatatcaatatgccaacaacattagaaggtcttcacattgaaaacacaagttatgaagaattagttcaagtaggtgaacgtgcattaacaccaaatgatacgtttgctaacttaagtgataaaatcactgctgatgaaatcgcagacgcaattttaactgttaatgatttatctaaaagtcagttcaactaa

SEQ ID NO: 658 - DNA, 201 bp, Staphylococcus epidermidis
tttacagataatgccgtatatattgttgtcacaacagcgattccaaatgctgcacctagtgtagaagtcattttgataattcctgatgcagtacctgctttttcagctggaacattagatacagcagtagatagcgcgggagtagcaaaaaatcctaatcctagacctataaagataaagccaatacatgccacaatataa

SEQ ID NO: 659 - DNA, 1218 bp, Staphylococcus epidermidis
acaactatcaatctaaggagtgacaatatgaaaggtgccatgtcttggccttttttaagattatatattttaacattgatgttttttagtgcgaatgccatactcaatgttttcatacctctaagaggacatgacttgggggcgacgaatactgtaattggaattgtaatgggagcttatatgctaacggcaatgctatttcgcccctgggctggtcaaattattgcacgtattggtccgattaaagtattgcgtattatattattgattaatgctatggcactggtattatatgggtttacaggacttgaaggttatttgattgcacgtatcatgcaaggtgtgtgtacggcattcttctcaatgtctttacaattgggtattatagatgctttacctgagaaatatcgttcagaaggtgtatctctctattcattattttcaacgattcccaatttattaggaccattaattgcagttgggatttggcacgtggaaaatatgtccatatttgctattgttatgatttttattgcagtaacaacaaccttatttggttatagaactacttttgcaaatacacaaaaagaggtatcaccaaaagacgaagtcttgccttttaatgcaatgactgtatatgtccaattttttaaaaataaagcactcttctgcagtggtatgattatgatcttgtcatctatcgtgtttggtgcgatgagtacttttataccattatatacggttagggaaggtttcgcgaatgcaggtattttcctcacaattcaagccattacagtagtgatagctagattttatttacgtaagtatgtaccatctgatggtttatggcatcaccgttttatgatgattgtcttaacgttactgatggttgcttcagtcattgtagcttttggaccacatatagtgagtatatttgtatatataagtgcaatctttatcggaataacacaagcgctcgtttatcctacattgacaacgtatttaagttttgtcttaccaaagataggacgtaatatgttattaggattgtttatagcatgtgcagatttagggatttcactaggaggtgtgctaatggggccaatatcagatacggtaggatttaaatggatgtatattttatgcgctttattggttactattgcaatgacactaagtaaaattagacaaagacaaagtgtttcaaaagcctcatag

SEQ ID NO: 660 - DNA, 1026 bp, Staphylococcus epidermidis
ttcattcacaaggagttgttattgatgaaaaatttacgtaacagaagctttttaactttattagacttttcacgacaagaggtagaatttttattaacactctccgaagatttgaagcgtgccaaatatatcggcactgaaaagcctatgctaaaaaataaaaatatcgcgcttctttttgaaaaagattccactagaacacgttgcgcattcgaagttgccgcacatgatcaaggtgcacacgtcacttatcttggacctacaggttctcaaatgggtaaaaaagaaactgctaaagatacagcacgtgtacttggtggtatgtatgatggtattgagtaccgaggtttttctcaacgtactgtagaaacattagcgcaatattcaggtgttccggtatggaatggattaaccgatgaagatcaccctacacaagtgcttgctgactttttaactgctaaagaagtattgaaaaaagagtatgctgatatcaactttacttatgttggcgatggacgtaacaatgttgctaacgcattaatgcaaggtgctgccattatgggtatgaatttccatcttgtttgtcctaaagaactcaatccgacagaagaattattaaatcgttgcgaacgtattgcgacggaaaatggcggtaacattttaataacagatgatattgataaaggcgtgaaagattctgatgttatttatacagatgtttgggtatcaatgggcgaacctgatgaagtatggcaagaacgccttaaacttttaaaaccatatcaagttaaccaagcactattagaaaaaaccggcaatccaaatgttatttttgaacattgtttaccttctttccacaatgcagaaactaaaattggtcaacaaatttatgaaaaatatggcattagtgaaatggaagtcactgatgatgtcttcgaaagcaaagcttctgtagtattccaagaagctgagaatagaatgcatacaattaaagcggtcatggtagcaactttaggagaattctaa

SEQ ID NO: 661 - DNA, 768 bp, Staphylococcus epidermidis
ggtgggagcaaaatgcttaaaggacacttacactccgttgaaagtatgggcactgtcgacgggccaggacttagatatatattatttactcaaggttgtttgttaagatgtttatattgtcataatccagacacttggaagattaacgaaccatcaagagaagtgacggttgatgaaatggtaaatgaaatcttgccgtacaaaccttactttgaagcttcaggcggtggggtaacagtcagtggtggcgaaccattactacaaatgcctttcttggagcaattattcaaagaattaaaagcaaatggtgttcacacatgcattgatacttctgcgggctgtgtaaatgatacaccagcatttaatcgtcattttgatgaattgcaaaagcatacagatttaatcttattagatattaaacatattgataatgataagcacatcaaattaacaggcaaacctaacacacatattttaaagtttgcacgtaaattatctgatatgaaacaacctgtttggattagacatgttttagtacctggtatttcggatgataaagaagatttgataaaactaggagaatttattaattctttagataacgttgaaaagtttgaaatcttaccatatcatcaactcggtgtgcataagtggaaaaatttaggcattccttatcaactcgaaaatgttgaaccgcctgacgatgaagcggttaaagaagcttatcgctatgttaattttaatggcaaaatacctgtaacattatag

SEQ ID NO: 662 - DNA, 213 bp, Staphylococcus epidermidis
tttgtattaaaaaagcaatgctattctatagataacttaattaggaggagggaatacaacgtggaacatgtttctaaattagctgaagctatagctaatactgtatcagcagcacaagcagaagatggtgctgagttagcaaaaagtatcgttaatatcgtagcgaatgctggcggtattattcaagacattgcacatgcattcggttactaa

SEQ ID NO: 663 - DNA, 234 bp, Staphylococcus epidermidis
atacataaaaataccgagacatttgatgatgtctcggatatttatcatatatcactagttgatttatctacatgccttttcaagtcccaacttactagcgtcatcatttacacaacactatttaataacaaaacgcttttcgttaaacttaatcctcacgttgttatttatgatgttcaactttatttatatgatataaaacctgaaaatttctcaacgactgttatgccataa

SEQ ID NO: 664 - DNA, 1365 bp, Staphylococcus epidermidis
ttaatgatgaaaaataaactaacattaaaagagaatctatttatcggctcaatgctgtttggtctattttttggtgctggaaatctcatttttccaattcacttaggtcaaactgcggggtcaaatgtatggaccgccaatttaggatttcttatcacggctatcggactacctttcttaggaattatagcgataggtgtatctaaaacaaacggggtctttgaaatttcctcaaggataagtaaaatatatggttatttgttcacaattggcttatatcttgttataggtccgttttttgcgttgccaagacttgcgacgacgtcatttgaaatagcattttcaccatttatttcatctggtacggcccaagcgttgttgcctatttttagtattttattcttcggagtagcgtggttattttcgcgtaaaccttctaaaatattagactatattggaaaattcctaaatccggtctttctcatcttgcttggaattgttgttgtgcttgcatttatccgtcctatgggtggaattagtcatgcgccagtaagtgctgattatagcaatagcgtgttactcaaagggtttatcgatggatataatacattagacgctttggcatcattagcatttggtattatcattgttactacaattaaaaagttggggattactaatccgaatacaatcgctaaagaaactttaaaatcaggtacgattagtattatagctatgggcgttatttatactttattagctttaatgggtacgatgagtttaggtcgttttaaagtaagtgaaaatggtggtattgcgcttgctcagattgcacaacattatttaggggattatggaattattattttgtcactaatcatcattgtggcatgtctgaaaacagcaataggattgatcacagccttttcggaaacatttacagagttattccctaaatctaactatctttggttagctactggggtgagtatattagcttgtatatttgctaatgtaggtttaacaaaaattattatgtattcaacaccagtattgatgttcatttatcctttagcgattactttaattttattagcgttacttagtccattatttaaacattctaagattgtctatcgatttacaacattatttacaatggtggcggcatttgtagatggtgtgaaagcaagtccagagttctttgttaatacaaaatttgcacaaacaatcattggatttggagaaaattatctcccattctttaacattggtatgggatggattgttccagcatttattggtttcattattggtattattgtatactttatgactgctaaaaaatcgtcccacgtacaataa

SEQ ID NO: 665 - DNA, 453 bp, Staphylococcus epidermidis
aataaagtgaaacaatcttattattcgcatacacctcaatctaaaataaaaagtgtagctatcaataaacatgctcatcaatccatttcaattggcattgtatttgttgtcgtcatctttgtaagtgttatccaaatcctattacatcaacgtcttaaacagaacgcacctctcgaaagattatatttggtaccttatagtcaacttaaactatacttgacttatatcagtgtacatgtggtcatactgatgctcatgctattgatgattagccttttaatgcatcaaccattaagcattcttttctacttaaaaacactgattatagttttattttatgaggcaggtattgctttattactttttaaaattaatgttcttagtcaccgtatattcatggctattatttatacggtagcgataggtattatatatttatggattcaattgtaa

SEQ ID NO: 666 - DNA, 225 bp, Staphylococcus epidermidis
gagagaccgaattatgggatgaacctgggacacaaatcgatgttccaggttttttataatgtaaaaacagtgatgaacttctgggcattaacagagtgtatttcaatagacaaagcaatttggctatcgactatcaaagagtggcacaatgaaggcattatgaatatatgtcttatacttcagctttttagtagaaaatcaaatggactaatggtggttaaataa

SEQ ID NO: 667 - DNA, 528 bp, Staphylococcus epidermidis
gaaatgaggaaatgtgtattaatgacggtagcagcaagtgctacgctcttattggcaggttgtggcaatggtcaaaaagaagataaagatgttacggtatcgctacctactgaagcaaaggcggataaacttgacgcgcaaggctatgatgcagcgatgcccgtttatagtgcagtgtatgatgcattagttaaatatgataaagataagggtattaaagcaggtttagcagataaatggagcgttgatgaatcagggaaagtttatgaattccatttgaaaaagaatgttaaattctcagatggttcagcattagatgctaaggacgtgaaattctcgattgatcgtgcgaaagcgatgaacaaagattcgactgtagaaacgttaaaaaaattagataaggtcgttgttaaaaatgagcacgtggtccaaattagattgaaatctccttcaaatcaagtgttaaatgaattaacacaagtgagaccgttgcgtattatgagtccacattcagtagaaggttgttaa

SEQ ID NO: 668 - DNA, 792 bp, Staphylococcus epidermidis
ataaggaggaagatagatatgagtaaaacagcaattataacaggtgcagcaggtggattaggtaaaggtattgcagaacgtcttgctaacgatgggtttaatatagtactacaagatattaatgaagcacttctattagaaactgagaaagaattcaaagaaaaaggttatcaagctgtcgcattcaagagtgatgtatctaaaaagaaagaacaggaagaattagttcagttcgcagttacagaatttggtcaattagatgtcatggtgaataacgcaggtgttgatgcagtgacgccaattttagaaattggggaagaggaattatctaagttatttaatattaacgtatttggtacattgtttggaattcaagcagctgctaaccaatttattaaacaaaaaagtaaaggtaaaattatcaatgcatgtagtattgcaggacatgaatcttatgaagtactcggcacttactcagctacaaaacactctgtacgttccttcactcaaacagctgctaaagaattagcagacaaaggcattaccgtaaacgcttattgcccaggagttgccaaaactgaaatgtgggatcgtattgatgaagaaatggtgaaacttgatgatagtctagaaataggagacgcgtttgaagcattttcttcagaaatcaaacttggaagatatcaagagccatcagatgttgcgaacttagtatcattcttagcttcaaatgattctgattatattacaggccaatccattttaactgatggtggattagtgtacagataa

SEQ ID NO: 669 - DNA, 360 bp, Staphylococcus epidermidis
attagctttgatagttggaacattcggtgcttctgcattgcttccttcttctgtcttcgttggctcagattgaggtgcttctgcattgcctccttcttctgccttcgttggctcagattgaggtgcttctgcattgcctccttcttctgccttcgttggctcagattgaggtgcttctgcattgcctccttcttctgccttcgttggctcagattgaggtgcttctgcattgcctccttcttctgccttcgttggctcagattgaggtgcttctgcattgcttccttcttctgcttgcaatgtagaagacatctgtggtgcttcattgtttacagtaggttgatttgtgttttcaagtga

SEQ ID NO: 670 - DNA, 1338 bp, Staphylococcus epidermidis
tgcaaaattgaattgcgtttaatttatatgaggttaatcactttctttaaagatttaaaaagtattatatgttttaacagagaaagaaggatgaatgtgaagcaattaagtacaactttaaaagtccgattaatatgcgatttttttcaaaatattatagtcacggcatttttaccatttattgcgttgtatttaacagatatggtcaatcaacatttttcagggctttttttatttgggcttgtaatgataaattttccaatttctttgatttcaggtcatattattgaacgtttacctaaaaagacgttaacacttagttatcaatttatattaagtttaatgctcgtaattatggcgatttcaatatcacaacatacttttaagatcattttattttgtatcgcttacacaatatttagtatcacaataggcatgcagcaacctataatggacacgattattatggatgcgattacgcctgaagttgagcaatatatttataagataagttattggctgacgaatattgctgtcgcctttggtgcgctcataggtggattgatgtatggggcacataaatctatgttgtttttcatcgcttttgtcatttacattatggtttttatagcacttatcgtatggttgcctaaagatttaaatattgttactcagtcgcacacacatcatgctaatgagaaacaattctccatgggtcaaatattaaaaagttataaaccagcatttaaagatacaacatatctacttctaattataggatttagtattttaacaatgggtgagttatctgcatcatcgtacatttcagtgcgtttaaaacaagagtttgatccgatgatattgttttcgttacatatcaatggcgttaaaatgtattcacttctattaatgacgaatacaatcattgttataatttttacctattttatttcaaaaattgttatgagaatgaatgttaaaacagcattattggttggaattattttttatgtcattggatattcgaacctcacttatcttaatgattttacgttacttatcatatttatgattatagcgacgataggtgaaatggtatattctccaattcttgaagaaaatcgttttaaaatggttccttctcataaaagagggacatattcagcagtgcatgctttaggatttaacctagctgaattacttgcaagatttggaattatattaggagtgtttttaacttcaatggagatggggatctatatgtttgttttattattactaggtggcatgtcactttacattgcagtgagtcgttttaataatacaaattcacaataa

SEQ ID NO: 671 - DNA, 243 bp, Staphylococcus epidermidis
aaaaccaccgataataatgatttccataacatcactcctaagtctgaaattttagttatgcttaacattgctatgactagtatggtgacgcaaattgtggacgataccatttgtttcattatcattttaattcctagaattgaaccgagtcgacgcatgagcatagtcattgttactgaacatgctgtaaatgttgaactaaaaaagactagcaacaataattggaatgcggaaagtctttga

SEQ ID NO: 672 - DNA, 528 bp, Staphylococcus epidermidis
ccacagttagacgatacaacaccgtttaaaaaaggtgttggcatagatttagcacgtttatctttggaaaaggcagagacattaaaaggacaacgtccacttacatactatttaacagataaaccgcaagaaacgaagcacgtgtttgatacggcagtaagtacgtctgtcttgtacttaatagaagatattccgcaacatgcaaaagatttaaaagaggtattgaaaccaggcggtgtttattacgcttcattcgcggatttaactaataacccaagtcgtcagtttatggatgacacgattaatcaatatggtgcaacaccttctcagaatcactctctaaaacatatcgttgatagctttgtggatgcaggatttgaagttgcagtaatgaaagagcatgtacctgacgtgattgatttaacacattatagcgatttttatttatcaccgaatgattatttacaaacactatatgaagaatcgtttttaataaaagcaagtgtgaaagaaggtactgagaaatga

SEQ ID NO: 673 - DNA, 1473 bp, Staphylococcus epidermidis
tataaaaaagatagaggtgctttaaacatgaaaaataaaaagaattcatatagcattcgaaagttaagtgtaggtgcgtcttcaatcattgttgcatcgatgttatttattggcggaggctcagtacatgctgctgaatccaatcaccttgaaaatcaagaacaatcagaagtaagtgcatcacattctattgagatgcaacacaaaaatcaagaaactcaacaaactgagaataaagataataaaactaaccattcagaaacaattgataagactccaactatacataacaatggctactcatatcatgagacacctagtactgacgttaaatctaatgaagacaaacaaattgatagtcaattcaatcaacctcagacatctatgccaaataatgatcaacaaaaccctaaaaaagtagcggaacatacaacgaaaagtataaatgcaaaaaaagaagaaactagaaagaatgaaaatgcaaagagcctagtacaaccccaacaagatgataaaacaacatctgaacaaacaaaaatgaaagaatcacgtgaacaggagattacaaacgagcaaaagcagttacaaagtaaagatgtaaaaaatgctcaacaagaaaatcaaaatatagaccaagaaaaatctcaagaaaaaattaaagtccaacaatcgaacatcgaaaaggctcaaaaatcttcaagaatagatggaaaattagataatcaatacaataaagatgcaacgcaatcggatgaggggactgcatctgagaacgtttcagaacagcatataacagcaaaagatggaggtgttacacgaaataatcgtggagataaacatttaaatcaagaaaagccaacaacatcatcagataaagaacttaaagtggatgacatagacaaagatctttccacaaaagaatctcctgaaaatgaaaaagatgattctagaaaagggattaaagcaatcactaaaaattctcaggcaacaacaagaaatactgcgacaacagaagcatccaaagaattgaaggatcaaacaaataaagtagcatcacaaaaagaatataaaaatcatgaccctattattcttgtacacggctttaatggttatgcatcaggaactggtcccgttacaggaaaaggtaactattggggtggtgaccgtctcaaaattattcaagattatagagctaaaggttataacgtgatggaagcaagtgtaagtgcatttggcagtaattatgatagagctgtagaattgtactattacattaaaggtggacgcgtagactatggtgcggcacatgctgcaaaatatggacacgagcgttacggaaaaacatacgccggtgcttataaggattggaagcctggtcaaaaaattcatctcattggccatagtatgggtggtcaaacaattcgttatcttgaagagttattacgacatgtagtcctcaccccgggtagggcc

SEQ ID NO: 674 - DNA, 984 bp, Staphylococcus epidermidis
atcatgaaagaaaatttttggagtacattgccacgtccgttttttattctggcacctatggaagacgtgacagatattgtctttcggcatgttgtcagtgaagctgcgagaccagatgtattttttactgaatttaccaatactgagagttactgtcaccctgaaggtattcatagtgtgcgcggacgcttaacttttagtgacgacgaacaaccaatggtagcgcacatctggggcgataaaccagaacaattccgagaaatgagtatcggcttagcggatatgggctttaaaggtatagatttaaatatgggttgccctgtcgcaaacgttgcgaaaaaaggtaaaggatccggcttaattctacgacctgaaacggcagccgaaatcattcaagcttctaaagcaggtggtctaccggtcagtgtaaaaacacgtttaggttattacgatatcgatgaatggcgagactggttaaaacacgtcttcgaacaagatatcgcaaatttatccattcatctacgtacccgtaaagagatgagtaaagtagatgcacactgggaattaatcgaagcaatcaagacattacgtgatgaaattgcgccaaatacactattaactatcaatggtgatatccccgatagacaaactggtctagaactcgcaaataaatatggtattgatggcattatgattggtagagggatcttccataacccattcgcatttgaaaaggaaccacgcgaacattcaagcaaagaattattaggtttattacgcttacatctctctttatttgaaaaatatgataaagatgaagcccgacacttcaaaagtttacgcagattcttcaaaatctacgtacgcggcattagaggcgctagcgaactccgccatcaattaatgaacacccaatccattgccgaagcaagagaactactcgatacttttgaagcacgtatggatgcacgttcagaagtataa

SEQ ID NO: 675 - DNA, 513 bp, Staphylococcus epidermidis
caaacaatggaggacatcatgattttaactattttatttatctttttctgtattcgactcatcagcttaaagatatctatgcaacacgcaaaacagctaaaggtagagggcgcggtggaatatggtgtgaaaaattcaaaatatctagccattacgcatgtattaatttacatgagtgcagctatagaaacattcattcataaggatacatttaatctacttaacggcattggcttaatcatattaatcgtcgcttatatcatgttatttatagtcataaagacactagggcgtatttggacattgaaattatttatactgccaaatcaccctattatcaaatcaggattatataaagtaacaaaacatccaaactattttttaaatatcattccagaattaattggtgtattactactaacaaatgctacatacacaacactcttattagttccatatgcttattttttaattgtacgtatccgtcaagaagagaaattaatgaatatataa

SEQ ID NO: 676 - DNA, 978 bp, Staphylococcus epidermidis
tcattgaaggaggataatatgaagaattataaaaaatatctgattgttttagtattatgtctaacagtgttatctggatgtaacttacccggtttaaaaaatagtcattcagatgacgatgttagaatcacaagtttaggaacaagtgaatcacaaattatatcgcacatgctgagattacttattgaacatgatacaaaaggtgaaattaaacctaccttaattaataatttaggttcaagtacgattcaacataatgctgtcacaagtggccaagctaatatgtcaggtacgcgttatacaggcactgacttaacaggggcgttgaaagaagatccgattaaagatcctaaaaaggccatgaaagcgacacaagaaggatttaaaaagaaatacaatcaaacattcttcaattcgtatggtttcgaaaacacgtatgcattgatagtgacaaaagaaacagctaaaaaatatcatttagaaactgtttcagacttggaaaaacatgcgaaagatttaagagtaggtatggatagttcatggatggaccgcaaaggtgacggttatccagcatttaaaaaagaatatggttatagctttggtactgtgagacctatgcaaattggcctggtttacgatgcacttagttctggcaaattagacgtagcagtaggttattctacagatgggcgtatttcagcatacgatttaaaagtgttggaagatgatcgtcgattcttcccaccatacgatgccagtccccttgcatcagatcaattgttaaaagagaagccagagctcaaaccgattgttaaaaaattagaaggtaagatatcaacagaacaaatgcaagaattaaattatcaagctgatggtaaaggaaaagagcctgcaacagttgcagaggacttcttgaaaaaacatcattattttgaagacgatgacaataaaaaagataaacagaaaggtggtcaataa

SEQ ID NO: 677 - DNA, 1578 bp, Staphylococcus epidermidis
ctgtcgaaggagatgaaaccgttggaacaagcgatcaatgataataaaaagaaaaaacgttttaactttagaatgccaggtgcatttatgattctctttatcctaacagttgtcgcagttatagcaacttggataatccccgcgggtgcatactcaaaactttcatatgaaccttcatcccaagaattaaaaattgtcaatcctcatcatcaagtaaaaaaagttcctggaacacaaaaggagcttgatcgattaggagttaaaatcaaaatagaacaatttaaatctggtgcaattaataaacccgtttcaattcctaatacttacgaacgtctaaaacaacatccagctggtcttgatcaaattaccagtagcatggttaaaggaaccatcgaagccgtcgatattatggtctttatacttgttctaggtggattgattggcgttgttcaagcgagtgggtcctttgaatcaggattgttagcacttactcaaaaaacgaaaggccacgaatttatgcttatcgcctttgtctccatacttatgattataggcggaacgctatgtggtattgaagaggaagctgtagcgttctatcctgttctcgttccaatatttattgcgctcggatatgattctattgtctcagtcggtgcaattttcttagcaagctctgtgggcagtacattctcaacaatcaacccattctcagtcgtcattgcttctaacgcagcaggaacaacttttactgatggtctttattggagaataggcgcttgtatcatcggtgctatatttgttattagttatttgttctggtattgtaaaaaaattaaaaaagatcctaaatcctcttattcttatgaagacaaagcagcatttgaaaaacaatggtctgtgctccatgatgacggttcttctgagtttacattacgtaaaaagattattcttacgcttttcgtcttaccgttccctattatggtttggggcgtcatgacacaaggatggtggttcccagtcatggcatctgcattcttaatctttaccattgtcatcatgtttattgctggaacaggacaatatggtttaggtgaaaaaggtactgtagatgcattcgttaatggcgcttcaagtttagtaggtgtatctttaatcattggtttagctcgaggaattaacttagtattgaataaaggaatgatttctgacacaatcttgcacttttcatcatctatcgtgcaacatatgagtgggcctttatttatcattgttctgctctttatctttttctgtttaggatttatcgtgccatcatcatcaggattagcagtactatctatgcctatctttgcgccattagctgatacagtaggtataccaagatttgttattgttacaacatatcaattcggtcagtatgcaatgttgttcttagcgcctactggacttgtaatggcaacacttcaaatgttaaacatgcgttactcacactggttacgtttcgtatggcctgttgtcgcgtttgttttaatatttggtggaggcttactaattacacaagttttaatatactcataa

SEQ ID NO: 678 - DNA, 879 bp, Staphylococcus epidermidis
gggtcaagtttcaactgtcgcaacaggacaagcatatatagaacaggagacaatgacgcaaatatgaatgagcatacaaaaatagagaaccaattacaatattatttagaacaatttacgtacttacatcaactcgttttggaagatagtcggcatattgttgatttagaaaatttgattgatgaatacagtcaatggatacttcaacctttggcagagcatcattatttaacatggaatgatttagaaacaaaaataagctttaccaagaagcttcaagaggtatcagcaaagtgtgtgaaacaggtagaagtcattcgagcacaacgtttgttgaatggtagggcctccacgtcaggttatttcgaaaatatagagcattgtattaatgaagaattcggaagatggcaaattggacaaaatgacaagttgttactgattgggtcgggtgcatatcctatgacattaattcaagttgctaaagaaactggcgctgcggtcattggtatagatatagattcggaagcagttgatttagggcaacgtgtcgtcaatgtactagctccaaatgaagatatcgttattagtaatcaaacagttgatcaattagaagacatccaatctgtgactcatattattttcagttcgacgatacctatcaaatatgacattttgaatgaactttacacattgacgaatgatgaagttgttgtagctatgcgatacggtgatgatatgaaagcattgtttaattatccatctcaagcaactgacgaaacacaatggcgatgtgaagaactacaaacacgaccgaagcagatttttgatattgcactttatcgtaaagtggcatcaaaagttggtgttgaacatgtctaa

SEQ ID NO: 679 - DNA, 921 bp, Staphylococcus epidermidis
aaaataaaacttttagaggtgttaatgatgcaaaaagttgttttaacagcagctattactggcgctggagatacaatacaaaaaaatgagaacgtaccagttacaccacaagaacttgcagattcagcaattaaatgtgcacgagcaggagcaactgtcgcacatattcatgtaagagatcctgaaactggaggagtaagtcatgatccagaactgtatgctgaaacagttagattaattagagaagctgatgaagatatcgtcattaatgtgacatctggtggcggtggagacttcattccaagtcttgaacatccagagacaggtggagaaggaacttggatacaaacaccagaagaacgttttaaacctattggtgacttgttaccagaaatgtgtacattagattgtggtagtgtcaacatgggagatgcaatttatttaagtccggcatcatggctacgtaaacaagcacaaatggttaaagatgcaggagtcaaaccagagcttgaatgttttgatacaggccatgtgagttttgccaaacaaatgatagaagaaggattaattgatggagaccctatgttccaattttgtttaggtattccttggggtgcagagaatgatcctgaaacaatagaatatcttaaatcacgtataccagaaaatgcacattggtcagcatttggcattggtaagatgcaactgccaactgtaagaaaagttgcgcaacgtggaggaaatgttcgtgttggattggaagataatatttatttaagaaaaggtgtaaaagcaacgaatgaagcattggtagaagaggcaaaaagaattttagcagaactagatattgagccacttacacctgctgaagcaagagaaaaatttaatcttagaaatcctcatggtaaaggagacaaataa

SEQ ID NO: 680 - DNA, 1959 bp, Staphylococcus epidermidis
gggaaaaaacttatagaggtgatttttttgaaaaataataatgaaacaagaagatttagcattaggaagtacacggtgggagtcgtgtcaatcattactgggattacaatatttgtcagtggtcagcatgctcaagctgctgaaatgacacaatcatcatcagattctaacgaacagtcacaacaaacagaacaagttgaacacaaagaagatacaactcatttatctaacgaattgaatcaagagggtgagacagcgagccaatcaaagactagtcaagagaatcaatctgatggcaatgtacaaaaaaagagtaatcaaatacaacaagattcaacacaaacgtcaccattaaatgaccaaaaacaaacttcaatggaacaacaatcaaaagacaatcatgttaccccaaattcacgtcaggatacatatccaaaaggccaaaatcaagatgataaaggcaaacaacagtttaaagataatcaacactcacaaacaggacatcaacctaatactcaaaaccaaaataatgatcaagattcatcagataaaaagcaacacccatctgatcaaactcaagactcatcttcaaaaggaacacaacctaaacaatcacagtctatagaagatagagataaaacagtaaaacaaccatcttctaaagtacacaaaataggtaacacaaaaactgataaaacagttaaaacaaatcaaaaaaagcaaacatcattaacttcaccacgcgttgtgaaatcaaaacaaactaaacatatcaatcaacttactgcgcaagctcaatataaaaatcaatatccagtcgtgtttgtacatggatttgtaggtttagtcggtgaagatgcattcagcatgtacccaaattattggggtggtactaaatataacgtgaaacaagaacttacaaaattaggttaccgagttcacgaagccaatgtaggggcatttagcagcaattatgaccgtgctgttgaattgtattattatattaaaggtggacgagtagattatggtgctgcacatgctgcaaaatatggtcacaagcgttatggcagaacatatgaaggcatcatgcctgattgggaaccaggtaaaaagatacatcttgttggacatagtatgggtggccaaacgatacgcttgatggaacattttttaagaaatggaaatcaagaagaaatagactaccaacgtcaatatggtggtacggtatctgatttgtttaaaggtggccaagataacatggtgtctacgattactacattaggaacacctcataatggcacgcctgctgcagataaactagggtcgactaaatttatcaaagatacaattaatagaattggaaaaattggtggaactaaagcgctcgatttagaactaggtttttctcaatggggcttcaaacagcaacctaatgaatcatatgctgaatatgcaaaacgtatagcgaatagtaaagtttgggagactgaagatcaggctgtaaatgatttaacaactgctggagcagaaaagttaaaccaaatgacgacattgaaccctaatatcgtctatacatcgtatacaggtgctgcaacacatactggaccattaggcaatgaagtgccgaatattagacaattcccactattcgatttaacaagtcgtgtgataggtggagatgataataaaaatgtcagagtaaatgatggcatagtacctgtgtcttcttcactacatccaagtgatgaagcatttaagaaggtaggtatgatgaacctagcaactgacaagggtatttggcaagtgagacccgtacaatatgattgggatcatctagatttagtcggattagatactactgattataagcgaactggagaagaattaggtcaatgttatatgagtatgataaataatatgttgaaagtcgaagagttagatggtattacacgtaagtag

SEQ ID NO: 681 - DNA, 906 bp, Staphylococcus epidermidis
aatttcagacttaggagtgatgttatggaaatcattattatcggtggttttttaggaagtggcaagacctcagcaataaatcatttaatcgctgatgcacttgaaaacaacttaaatcctgctgttattatgaatgaatttggaaaaagaagtgttgatggccaacttatagaacgtcctgaagtacctatgagtgaaatcactgaaggatgcatttgttgtgcgatgaaatcagacgtatcacaacaactacatgaactatacttaaaatatcaaccagatatcatctttattgaatgcagtggtgtagctgaaccactagctgtcgtcgatgcatgcttcacacccgtacttgcaccttttatcactttaaggagtatggtgggaattattgatgcaagcatgtattcacgaattaaatcttatccacaagacattgcagctctattttatgaacaacttcgtcattgttcgactttatttgttaataaaatagataagatagaggtggaagaaaccgcccgcttgctacgtcaactcgagcgtctcaatagcgatgccaatattcaagttggtcaatttggagaattaaatttaaaatcactgctagagccaacacatataaattcaaatgcatgtggcactttgcatagtaatataaatcatcaattcatcgaaaatcctaggctacaaacaaaagaagaaatgattagtgcgttagataacttgcctcaagatgtttaccgtgtcaaagggtttgttcgtttttcagatcagcaacacgtttatttagtacagtatgcacaaggaaatatagaattatctcccattcaacttaaaaacgatgtaccattgtacctcattgttataggcaaacatttaaaacaaatacaacttgatttataa

SEQ ID NO: 682 - DNA, 720 bp, Staphylococcus epidermidis
actttaaaatgtaataagtttacattaaagataggtgacatgataaacatgaatatatttgtaactggaacgaatactgacatcggtaaaacgtatgtcactaaatatctctataaagcattaagaacgaggggatatcgggtatgtattttcaaaccttttcaaactgaagaaattggtggaggtagatacccagatttagaaatttataaaaacgaatgcgatttagactatgacgttacgtctctttacacattcaaagatccagtttcaccacatttagcattcaaaattgaaaggcatcagcaattgaaccatcaaacaatgatagacaaactcgaatcactaaaagcacaattcgatatgattctcattgaaggtgcgggcggtattgcagtgcctatctatgaatacagtgaccatttttatatgacaacagatttaattaaagacacatcggatttcattgtgagtgtcttaccttcaaagttaggtgcgattaatgatgccatcgttcaccagaaatatattgatcatcaagaacttcccccgaacgtgttaatcatgaataactatactgatagtgctattgaacaggataatttacataccattgaaaaattaatacacaagtctgtttatacgttaggtcatcaagcgactcaagaaagcttttccgaagcatttatacaacgaattataggaggatccaatggctaa

SEQ ID NO: 683 - DNA, 804 bp, Staphylococcus epidermidis
atagaaagatgtgaaaatatgcaacattcaagcaaaataatagtatttgtaagtttcttaattttaacgatttttattggaggatgtggttttataaataaagaagatagcaaagaaacggaaatcaaacaaaactttaataaaatgttagacgtgtatccaactaaaaatctagaagacttttatgataaagagggctatcgtgatgaagagtttgataaagatgacaaaggaacatggattattaggtctgaaatgacaaaacagccaaaaggtaaaattatgacctcaagaggtatggttctctatatcaatcgcaacactagaacagccaaagggtattttttaatagataagataaaagatgatagtaatggtagaccgatagagaatgaaaagaaataccctgtaaaaatgaaccataataagatctttccaacaaagccaatatctgatgataagttaaaaaaagaaattgaaaacttcaaattttttgtgcaatatggaaattttaaaaacttaaaggattataaaaacggggatattttatacaatcctaatgttcctagttattctgcgaaatatcaattgagtaataatgaatataacgtacaacaattaagaaaaagatatgacatcccaactaaaaaagcacctaaactattgttaaaaagggatggcgacttaaaaggatcatccgtaggtcataaagacctagaatttacctttgtagagaataagaaagaaaacatcttttttacggatagtattaattttaaaccgactgagcgtgatgaatcatga

SEQ ID NO: 684 - DNA, 669 bp, Staphylococcus epidermidis
acagaaaggtggtcaataaacatggaagggaatttaatacaacaactcgttcactactaccaaatgaactttggctacctatgggaattgtttgttaatcatttgttaatgtctgtttacggtgttttactagcatgtttagtgggcatacctcttggtatcatcattgcaagatttggtaaattatcaggtgtgattattactatcgcgaatattattcaaactgttccggttattgctatgttagcgatattaatgcttagtatgggactcggtatgaatacagtcatttttactgtgttcttatatgccttgcttcctattattaaaaatacgtatacaggaattaatgaagttgatccaaatattaaagatgctggaaaaggtatgggaatgacgcgtaaccaagtattaactatgattgagttacctctgtcactttcagttattataggtggtattcggattgcccttgttgtagctattggtgtcgtagctgtaggttcatttattggtgcgccaacattaggtgatattgtgattagaggtacaaatgcaactgatggaacactattcattctagcaggtgcaatacctatcgttatcattgtcatacttatagatgttttattacgtttattagagaaaaagctagatccagctacgtaa

SEQ ID NO: 685 - DNA, 963 bp, Staphylococcus epidermidis
atagcaatgctcaaacgtacaattaaattcatactttatttaatcgtaagttcgtttattatcttcattttagttgagaagacatctggtaatccagcgattctgtatctacaacgtcatggttatacgtcgattacgcaagacaatattgaagcggcacaacatcaacttggcttaggacaacatgtgttactaagatatatcgattgggttggacatgcactcacgggcaacttaggatacggctttagtacgaacgaagcagttaccgctatgataatggaagccatcgtgccgacgcttgtgctaatcattgtctctagttgtatcatgttgccatttggctatattgttggttacttcgttgggacgcgtccgcatacacgttacgctaatggaattcgtggattcgcccaagtgatgacctcaatgccagaatactggttagctattttattcatttattatttaggcgtacgttggcaattgttaccatttgtaggtagtgattcatggcaacactttgtgctgccaatcttcacaattgttgttatagaagggtgtcatatcttattgatgacagcacatctgattacacaaacgttagatcaagatgcgtatcaactggcgcagttaagacatttttcgttaaaagcgcgtatcatcgtacaaattaaagagatatttgcaccactaatgacgatttcaattaacagtatcattcatttaattggaaaagccgtaatactagaagtcatcttcagcatgtctggtataggtaaattgttgattaatgctattaaccaacgagattatccactgattcagggcattgtcatctttatcattgtctttattatgctaatgaattatttaggcgatgtgattattttgaagaatgaacctagacttcgacgacgtcatacccagcagtcaggcaatgagaaaagaggtacgatgtga

SEQ ID NO: 686 - DNA, 330 bp, Staphylococcus epidermidis
aaaggtgtgcttatgcataattacaacaacattaacatcgtaagtgatgattcaaaatatcaagaaatttgttggttccatacattagaaggtatttggcaccctgtagaagtagaaacttcaccattaaatattacatttaataaagatataacacctaattacgtttgtacgttaataaatgaagattccagaaaaataattttaagtaatgtagacaatccgaatatcattattgaaatgattcttattaattcaaaaaaattggtttttaatgctataagtaaagaaggcttaggtacctcgcctaaaatcacatttacaaaataa

SEQ ID NO: 687 - DNA, 1035 bp, Staphylococcus epidermidis
atattaaagcgtaacaatttcgatttaggagatgtacacatgtataaaaaaggtttaattttattttttgtagcagtactaacattggcacttgctgcttgcggtaaagatagtcataatcagtcatctgatcataaaggaaaattagatgtgaacacaacagtctatccacttaaatcatttgcacagcaaattggtggtaaatatgtaaatgttgaatcggtttaccctaaaggcgtagatccacatacatatgatccaagtcaaaaacaaatggtagatattgggaaatcagacttattcttatatactggtgataacttagatcccgtagctaagaaaatcgctaaagctataaatgataaagataaaacactatcactagaatcgactttagataaaaataaagatttattaaaaggcgaagaacatgaacatgagcacggagaaggtcacgaacatggtgaatcacatgaagatgaacacgaacatgaacatcatcaccatggaaaatacgacccacacatttggttggatcctgtagtaagtcaaaaatttgctaaagcgattaaagatgaattgattgagaaagatagcaaacataaatcttattatgaaaagaattacaaccaactagttaaagagttaaaagacttagataaagatatgaaacatgctgtgaaaggtaatgaagataaaactgtttatatttcacacgactctataggttatctagctgaacgctatcattttgaacaagaaggcattgaaaatatgaatgcggaagaaccaagccaaaaagatttaacaaatattgttaagcaaattaaagaagataaagtgaaaaatattttaatagaagaaaatgtatctcataaagtagcagatacggtaagaaaagagacaaatgctaaaacaattaaattttacaatatgggatcacacacaaaacaacaagatgatgacaacaatacttaccaatcatttatgaaagaaaatattaaagctattgaaaaagccctacaaaatgaataa

SEQ ID NO: 688 - DNA, 195 bp, Staphylococcus epidermidis
tctaatattttagaaggtttacgcgaaaataaccacgctactccgaagaataaaatactaaaaataggcaacaacgcttgggccgtaccagatgaaataaatggtgaaaatgctatttcaaatgacgtcgtcgcaagtcttggcaacgcaaaaaacggacctataacaagatataagccaattgtgaacaaataa

SEQ ID NO: 689 - DNA, 1401 bp, Staphylococcus epidermidis
cggaagagtaggaggccacttacgatgagcgaacagtttaataaagggaaacaactaattgtagcgattatcttagggattctcacatactggttatttgcacagtcttttttgaatatcgcaccacatgttcaacgtttttatcatgtagatatgagtattgttaatattgcggtcagtctgacatcactcttaacaggtgtatttatagtcgtagcagggggattatctgataaaataggtcgagttaaaatcacaaatgcaggtctaatattaagtatacttggctctattgcattgatcatctcgcatgcaccaattttattattattagggcgtgttttacagggcttatctgccgcatgcttacttccagcaaccatcgcgttaattaattctttcttccaaggtgaagaaagacaaaaggtgcttagttattggtcattcggatcctatggtggaacagggttagcatccctatttgctggaattatagctacatttattggatggcgatggattttcgtgttgtcaatcattttttcaattatcgccttaatattgcttagaggtataccagaatctaaagatgagtctgcatataataaaaaatttgatatcgttggaatcattatttttgttgtcatgatgttaagcattaacgtagtgattacgcaaggagatagaattggatggttaaatcctcttatattgatattaattgctatattcattgtgacattaattgcattttatatatttgaaaaacgtcaagatgaaccttttatagatttaagtttattttcaaataatgtttatattggaacaacattagccaacttgatggtgaacatggatattggttcattagcattatttaatatttatgttcaagacgataagcatttatcagctgcacaagccggtttaattacaattccatatatgctgtgtagtttgttaatgattcgtgttggtgaacgttttatgcaaaaaagaggaccgcaattgccattgatgttaggtccggtatcaattactgttggtattatacttttagcattcacttctttgcctaatatgatttattatattgtggcatgtattggctttatctttataggtctaggattaggattttttgctactcccgcgctatctactgctgtatctaatgttccagctgaaaaagcaggtactgcatcaggaattatcaaaatgacttctacactaggtgcagcatttggaatcgctgttgtgacaacaatatatacggcattatctgtaaatcacccggcatatttagcagctactatcgcatttatcgtgggtgcaggtttagtgtttatcgcatttattgcggcgtattgtttaattcctaaaaagaatgtagatatttaa

SEQ ID NO: 690 - DNA, 948 bp, Staphylococcus epidermidis
aaggaagtgagtgaaatggctaaaattgtagtagctttaggtggaaacgctttaggaaaatcaccacaagaacaacttgaattagtaaaaaatacagctaaatccctagtaggattaattactaaaggtcacgaaattgtgattagtcacggtaatggaccacaagtaggaagtattaaccttggtctgaattatgcagctgaacacgatcaaggtcctgcttttccatttgctgaatgtggcgctatgagtcaagcctacatcggctatcaacttcaagaaagtttacaaaatgaacttcattcaatgggcatagataagcaagttgtcacactagttacccaagtagaagttgatgaaggcgatccagcttttaatagtccaagtaaacccatcggtctgttctacactaaagaagaagcaaatcgtattcaacaggaaaaaggttatcaatttgtagaagatgctggtcgaggttaccgtcgcgttgtaccatcaccacaaccaatatctattatcgaactggaaagtattaaaactctagtagaaaatgacacactcgtcatcgctgcaggtggaggtggtataccagtcattcgcgaacagcatgatagctttaaaggtatagatgccgtcatcgataaagacaaaacaagtgcattattaggtgctgatattcactgtgatcaactcattattttaacagcgattgattatgtttatatcaactatcatactgaccaacaacaagcacttaaaacaacaaatatagatacgcttaaaacatatattgaagaaaaacaatttgccaaaggcagcatgctacctaaaatcgaatctgccatctcctttattgaaaataatcctaacggtagcgtgctcatcacatcattaaatcaattagatgcagcactagaaggtaaaattggcacactcattacaaagtaa

SEQ ID NO: 691 - DNA, 336 bp, Staphylococcus epidermidis
atcatacggaggtttttttctatgaaaagagcttcttattcagtagaaacaaagtataaagcagttgaaatgaaagcagcaggattttcaacaaaagaaattatgaaagaattaaatattagaaataggacgcaagtgaaaacttggtggcgatggtatcgaaatggggaaagttatagattttcacaacaagttggtaaacaatatacctacggtaaaggattagaagagctgtcagaagtagaacaattaaaattagaaaataagagaaaagatatagaattggatattttaaaaaagtacaaggcattggaaaggaagtggtaccaacagtag

SEQ ID NO: 692 - DNA, 246 bp, Staphylococcus epidermidis
tataataggaggaacagtaagatgaaagtgtataagttgaattatcaacaccataaagatattgttgatgataatgtattaacgatgttcgtaacagctgacaatcaagatgaagttgaagcgtttgcgaaaaaattacattacaagattgaacatttatctccattaactaaaaaggaatttgaagatgagaaagcgaaagattcacactatagacttgaacacgtggatcactatttaaattaa

SEQ ID NO: 693 - DNA, 3552 bp, Staphylococcus epidermidis
atacatgggaggtataatatgggcaaacgtagacaaggtcctattaataaaaaagtggattttttacctaacaaattaaacaagtattctataagaaaattcactgttggtacggcctcaatattacttggttcgacacttatttttggaagtagtagccatgaagcgaaagctgcagaagaaaaacaagttgatccaattacacaagctaatcaaaatgatagtagtgaaagatcacttgaaaacacaaatcaacctactgtaaacaatgaagcaccacagatgtcttctacattgcaagcagaagaaggaagcaatgcagaagcacctcaatctgagccaacgaaggcagaagaaggaggcaatgcagaagcacctcaatctgagccaacgaaggcagaagaaggaggcaatgcagaagcacctcaatctgagccaacgaaggcagaagaaggaggcaatgcagaagcacctcaatctgagccaacgaaggcagaagaaggaggcaatgcagaagcacctcaatctgagccaacgaagacagaagaaggaagcaatgcagaagcaccgaatgttccaactatcaaagctaattcagataatgatacacaaacacaattttcagaagcccctacaagaaatgacctagctagaaaagaagatatccctgctgtttctaaaaacgaggaattacaatcatcacaaccaaacactgacagtaaaatagaacctacaacttcagaacctgtgaatttaaattatagttctccgtttatgtccttattaagcatgcctgctgatagttcatccaataacactaaaaatacaatagatataccgccaactacggttaaaggtagagataattacgatttttacggtagagtagatatcgaaagtaatcctacagatttaaatgcgacaaatttaacgagatataattatggacagccacctggtacaacaacagctggtgcagttcaatttaaaaatcaagttagttttgataaagatttcgactttaacattagagtagcaaacaatcgtcaaagtaatacaactggtgcagatggttggggctttatgttcagcaagaaagatggggatgatttcctaaaaaacggtggtatcttacgtgaaaaaggtacacctagtgcagctggtttcagaattgatacaggatattataataacgatccattagataaaatacagaaacaagctggtcaaggctatagagggtatgggacatttgttaaaaatgactcccaaggtaatacttctaaagtaggatcaggtactccatcaacagattttcttaactacgcagataatactactaatgatttagatggtaaattccatggtcaaaaattaaataatgttaatttgaaatataatgcttcaaatcaaacttttacagctacttatgctggtaaaacttggacggctacgttatctgaattaggattgagtccaactgatagttacaattttttagttacatcaagtcaatatggaaatggtaatagtggtacatacgcaagtggcgttatgagagctgatttagatggtgcaacattgacatacactcctaaagcagtcgatggagatccaattatatcaactaaggaaataccatttaataagaaacgtgaatttgatccaaacttagccccaggtacagaaaaagtagtccaaaaaggtgaaccaggaattgaaacaacaacaacaccaacttatgtcaatcctaatacaggagaaaaagttggcgaaggtgaaccaacagaaaaaataacaaaacaaccagtggatgaaatcgttcattatggtggcgaagaaatcaagccaggccataaggatgaatttgatccaaatgcaccgaaaggtagtcaaacaacgcaaccaggtaagccgggggttaaaaatcctgatacaggcgaagtagttactccacctgtggatgatgtgacaaaatatggtccagttgatggagatccgatcacgtcaacggaagaaattccattcgacaagaaacgtgaattcaatcctgatttaaaaccaggtgaagagcgtgttaaacaaaaaggtgaaccaggaacaaaaacaattacaacaccaacaactaagaacccattaacaggggaaaaagttggcgaaggtgaaccaacagaaaaagtaacaaaacaaccagtagatgaaatcacagaatatggtggcgaagaaatcaagccaggccataaggatgaatttgatccaaatgcaccgaaaggtagccaagaggacgttccaggtaaaccaggagttaaaaatcctgatacaggcgaagtagtcacaccaccagtggatgatgtgacaaaatatggtccagttgatggagattcgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggagaaaaagttggcgaaggtgaaccaacagaaaaaataacaaaacaaccagtggatgagattgttcattatggtggtgaacaaataccacaaggtcataaagatgaatttgatccaaatgcacctgtagatagtaaaactgaagttccaggtaaaccaggagttaaaaatcctgatacaggtgaagttgttaccccaccagtggatgatgtgacaaaatatggtccgaaagttggtaatccaatcacatcaacggaagagattccatttgataagaaacgtgtatttaatcctgatttaaaaccaggtgaagagcgcgttaaacaaaaaggtgaaccaggaacaaaaacaattacaacaccaatattagttaatcctattacaggagaaaaagttggcgaaggtaaatcaacagaaaaagtcactaaacaacctgttgacgaaattgttgagtatggtccaacaaaagcagaaccaggtaaaccagcggaaccaggtaaaccagcggaaccaggtaaaccagcggaaccaggtacgccagcagaaccaggtaaaccagcggaaccaggtacgccagcagaaccaggtaaaccagcggaaccaggtaaaccagcggaaccaggtaaaccagcggaaccaggtacgccagcagaaccaggtacgccagcagaaccaggtaaaccagcggaaccaggtacgccagcagaaccaggtaaaccagcggaaccaggtacgccagcagaaccaggtaaaccagcggaaccaggtacgccagcagaaccaggtaaaccagcggaatcaggtaaaccagtggaaccaggtaaaccagtggaaccaggtacgccagcacaatcaggtgcaccagaacaaccaaatagatcaatgcattcaacagataataaaaatcaattacctgatacaggtgaaaatcgtcaagctaatgagggaactttagtcggatctctattagcaattgtcggatcattgttcatatttggtcgtcgtaaaaaaggtaatgaaaaataa

SEQ ID NO: 694 - DNA, 195 bp, Staphylococcus epidermidis
cgtatttatggttattggtcattgattccaaagtttagttattatatttttaatgaaataccatgccattttcatatctttaacagtataaataattacattatctttttaaaaataaaatatattaagattttctttttcatttttaatatcatcatatcagtttatttacccaccttaccattagcgttataa

SEQ ID NO: 695 - DNA, 318 bp, Staphylococcus epidermidis
tcctcccatggaaccatttgctttaagccttctcttataatcctttcatcatcacaaataactactttaaacatctttattcctcctagacaagtggtatttggtaacacattaatgtcccttgctggcttcttgagaaaatgtgcagacgtgcatatgttccatattgaatcatggctctattatgtaaatgatttaaacctaggtgtgtcgtatcaaaaacatcgtgatgaagggattggcgcacgtgttctaaatgtgatggagacataccgatgccattatcatgaaccagaatatgtaatttgcgcttcgtaa

SEQ ID NO: 696 - DNA, 1128 bp, Staphylococcus epidermidis
attcagaaaggatgtactatcatgtctcatcatcgcatcatcatcatcggcgcaggagccgctggtgtgggtatggcaatcactttacaagaattcaatattaaagatgttctaattgttgaaaagggaaccatcggtcattcatttaaacattggcctctatcaacaaagaccatcacaccatcatttacaactaatggttttggcatgccaaatatgaatgcaatagctaaagatacatcacctgccttcactttcaatgaagaacatttatctggaaaacgttatgctgaatacctctcactagtagctacgcattacaatctaaatgtcaaaacaaataccaatgtttcacgtgtaacatacatagatggtatatatcatgtatcaacggactatggcgtgtatacagcagattatatatttatagcaactggagactattcattcccatatcatcctttttcatatggacttcattacagtgaaattcaaacattcactcaattaaaaggtgatgcttttacaatcattggtggtaatgagagtgcttttgatgcagccataaaccttagtcaaacaggtgcaaaaatatcaatatatacatctaaaactggacttaaaaaggaagatgcagacccaagtataagattatcaccgcatactcaacagcgattacagaatgctatacaagagggtgcattaatcgaaatgcatgttggctaccaggcacgcaaaataacatatcaaaatcattcctataagatacactttgataatggacatattgttcactctcatactgaaccgattattgcaactggatttgatgttacccaaaaccctttaatagaacaactatttcaagtacgacaatcagaagttcaattaacagaattagacgaatctacaaagtttcctaatgtatttttaattggggcgactgtacgtcatcaaaatgccattctttgttatatatataaattcagagcacgttttgcagtattagcacgcatagtaagcctacgcgaaggcttacctgaagatacgtctttaattcagtcatatcgtcaaaaaaatatgtttctagacgattatagttgttgtgatgtgaattgcacatgttaa

SEQ ID NO: 697 - DNA, 939 bp, Staphylococcus epidermidis
gtggaaagggggagtcaaaaggtgaaaacgctaatgattaaagcaatggggacggtgatacgtttatcgattgaacatcaacatccggatacattacttcaagaagctgaaataaaaattcgtgcttgggaatcacaatttagtgctaatgatccgaaatcagatttgatgaatgtgaatcaacatgcaggtatcgcaccagtcaaggttagttctgaaatctttaacatgatacgttatggttatgaaactacattatcttctaattttaagatgaacattttgatagggccactagtcaaattatggaaaattggttttaaagatgcattgaaacctaaagaagtggatatacaacgtgctttattgtgtatgaatcctgaaaatcttgttctaaattcaaaaacacatgaagtatttcttacacaatcaggaatggagattgatttaggagccatagttaaaggttattttgctgatcaattacagcaatactttttagctcatggtgtatcttctggcattatcgatttaggtggtaatgttttaacaattggtagacaacccgaaacattagaaaaatggcatgtaggtgtacgtaatccatttcataaggatacactaccactcgttacattaagcgtagagcatcaatcagttgtcacatcaggtatctacgaacgctacttcatacaggaaaatcaattatttcatcatatattggattcaacaacaggttatcctgtagataatgatatcgctagcgtgacaatcatatctgatcatgggattgatggcgaggtatggagtacaatttgtagttttggtcagtcacaaaaaaatattgaattattaaatctcattgacggtattgaaggcattattgtgacaagagatggaagcgttttaatgacttcgaaaatgcaaaagtatttataa

SEQ ID NO: 698 - DNA, 984 bp, Staphylococcus epidermidis
tgggatattatgaaagttaaactttatacgttgttattattactcatttttctgatagcatgcgctccaacatcgacttcacaatcacctcatcctttacgtacgttgattgtttattctccttatccatcacatttaattcgtccgattttaaatgattttgaaaagcgagaacatgtgaaagttgaaatcaaacatggctcaactcaagtattactatctaatattcacaaagaagcactttctaaacgtggggatgtctttgtgggtggcgtgttatcagagatgatagatcatcaagaagattttgttccttaccataatcgttctacactgaaacaaatagaggattatcgctctaacaacccattagtcacgagctttctattgatgccaacagtaattgtagtgaatacagatttacaaggtgatatgactattcatggatataaagacttacttcagtcttcactaaaggggcgtgtcgtttattctaatcctcattctacgacgacaggataccaacatatgcgtgcgatgtatcatatgcgtcaccaagtaagcgatgttcatcaatttcaacaccatgctgtacagttatctaaaagttctcaagtgattgaaaaggtggctaaaggtgcttattacgctggattgagttatgaacaagatgctagaacgtggaaacaaaaaggataccctatctcaatcatttaccctactgaggggacgatgttaaatgtagatggtattgctttagttaacaatgcacaacctcatcccaaacgtaaaaagttagtacaatatttaacaagccgttctgtacaacaacgtttggcagaagaatttgatgctaaatcaatacgtaaagacgtgactgaaacaaatcactcatctattgaaaacttggatcatattccactaatcccacaatcacgtgtatccaatattccacatcatcaatttttggagatgattcaatga

SEQ ID NO: 699 - DNA, 777 bp, Staphylococcus epidermidis
gccaagattatggctcatattacattaaattatttatctaaaactttaggaatgcatcaaacgattaatgtcattcttccagaagataaaagttactttgatacaaatgaaaatgcgaaaccattaaaaactatgttattgctacatggtttatcaagtgatacttcctcttatatgagatatacgagtatagaacgctacgcgaatacccaccaactagcagtggtgatgcctaatgccgatcatagtttctattcaaatatggcttatggacatagttattatgactatatactagaagtttatgattatgttcatcaaatattgccattgtctaaaaagagagaagataattttatagcaggtcactctatgggaggttatggtgcaatcaaatttgcattaacgcaaagttatcgtttctcaaaagccgccatgctttcagcgccatatgatgtttctatgattggtcaatatcaatggtatgattttacgccagaagcgattgtaggtaatacgcaacatgtcgcggggacatcttttgatccatactatttagttgaacaagcaatagacaatggacaagcgttaccacaactatatattacttgtggaactgaagatgaactgtatcaaggtaatattgattttgtgaactatttagatgaaaaaggtattccatatcaatttaaaaaagcgccaggtaatcacgattatgcattttgggataaagcaatagaagatgtcattgaccgttttacatcatcacatatttaa

SEQ ID NO: 700 - DNA, 195 bp, Staphylococcus epidermidis
acttatgttatgtatacaaaatgttacacatgtactttatattcaacttcactttttttcttatcaaaatacggtacaacaaatattacaaataaagcacatccaatagctaacaaaaaacctaaattttccaatttattcactccttattttgtgtacaatatcaacactattattcttcagaaatactcttaa

SEQ ID NO: 701 - DNA, 393 bp, Staphylococcus epidermidis
ttagtttatattataaatatattaatatttaagattttaggagatgcacaaatgcttaaaattaatttttttaataaggaatatggagttttaaaatcacaaaattacgaaagaatttcactagaattattgaacaaacattaccatataactgaaaatgattttaaaaacaaagattattgtttggataaatttaatagtaaagatacatttattggcgatatagcacatacagagaaagagttaatttctttaattgaagataatattaaaaatcctaaaaatatggagcatcaaaatctatcaagcatattcgattatacagatcatcataataaccaacgtgtctatcacagtattttagatcttatacaagacaatacgtcttcttaa

SEQ ID NO: 702 - DNA, 774 bp, Staphylococcus epidermidis
tcaccgtatattcatggctattatttatacggtagcgataggtattatatatttatggattcaattgtaaaggagtcatattcaatgatagatattcaaaatgtttccaaaagctataaaaagaagcatattttcgattccctagatatgcaatttcaaaatcataaaattactattttattaggtgaaaatggtgctggaaaatctacattattgcgtttaattgcaggtattgagaatgcagacgaaggacgtattcaatacttcaatcaatatttgtcaagacgtcgaatacgtcatattgtaggctatgtccctcaagacatcgcactattcgagcatatgactgtcatggagaacattgagtttttcaagtcactttgtgaaaatcctatttcagatgaaacacttcattcttatttatcacaattaaactttactgatacaaaagtgaaagtatctaacctttctgggggaaataaacgtaaagtcaatattatgataggtctacttagtcggcctaaaatacttattctagatgagccaacagaagacattgatttagaatcaagatatgatattcacaacttattacaacaaatgaccgatcaatgtttaatcatcatgacgacacatcatttagacgaagttgaagcactagcagatgatattaaagttataggtcaaaatcctttttatcatgatattttagaaaataaaggttggtcttttaaaaaatatgcaaatgccttagctgataatacgaaatcttaa

SEQ ID NO: 703 - DNA, 219 bp, Staphylococcus epidermidis
ataattaatattgaagctacccaatatgagggtagagctgttagtagaaaagctattgaacgtatagcacgatctggaaatctaccactagtcaaagcactcactatgcctagtacaacagacgttatcatcaccacaacactggaaatcaaagtgagttttaatgtattcataaacgctggccccatacgctcagatactggatcccctgtgatataa

SEQ ID NO: 704 - DNA, 396 bp, Staphylococcus epidermidis
gaagcaaatatttcattaaaaataaggtgcatatcaatgaaaagattgatttttatagttgttattctctttatccaagcctgtagttatgttgttattaactttttcttcttcgacatgtgggtgattcactctagtgaacaacaattaaatcaatccatacaacatcatgacacaaagcaacttcataagattgctaaagataagcagacatatcagtttttaaaaactataaaaaaagccgatttcgaaaatgcgacagataaccaaggtggtgggcctattggttattatcgtttagatattaataaaaaacccgtcggacttacaatcaatattaaatataacttccttccagaaaagacaactattaaatcaataaagttatatcaataa

SEQ ID NO: 705 - DNA, 3054 bp, Staphylococcus epidermidis
tgtgaaaatattcacaaaaaactaggaggatttgctatgagtaaggaaatattcgatacttttaaatttaaatgtggtgccgaattaaaaaatagagtattaatggcacccatgactatccaagctgggtattttgatggaagtgttacatcagaaatgattgattattatcaatttagagctggtgatgcttcagcaatcattgttgaaagttgttttgttgaaaatcacggacgaggatttccgggagctataggtattgataatgatgacaaaatacctggactcaaacgtttagcagaagcgattcaagctaagggatcaaaagcgattttgcaactttatcatgccggaagaatggcaaatcctaaatttaatgaaggagagcagccgatatctgcgagccccattgcagcattaagacctgatgctgtaccacctagagaaatgacacatgctcaaatcaatcagatgattgatgactttggagaggctacacgtcgcgctatagaagcggggtttgatggtgtcgaaattcatggcgccaacacatacttattacaacaatttttctctccacattctaatcggagacaagattcatggggaggcagtcgtgaaaaacgtacacgatttccaatcgaagttttaacaaaggttcaacacgtcgttgctgaaaaagaggcttctcattttattataggatatcgattctcacctgaagaaattgaagaaccaggcatacgttttgaagataccatgtttttactaaatacattagcagaatatgaacctgattacttccatatatcagcaaacagttatcaacgtacatctattgtgaatcaagaagatacagaacctttaattaataagtacatcaaaatgcaaagtgcacagttggcaaaaattccattaattggtgtaggtagtattgcccaacgacaagatgcagaacatgcccttgaactaggatatgatcttttaagtgttgggaaagcctatttagtggaaccacaatggacagataaaatttcacaaaacgaagaagtagaacaatttgtcgatatacatgatcagaaagtacttcacataccatcccctttatggaaagtaatggactttatgattttagataaagaagaagagcatcgtaaatatgaaaaattaaaagcacttcaaaataaaaaagttaaatttaacaaaggtacgtatcatgtctatgcaaaaggtcataatggcaacttacctatgaaagtccaattatcagaagataagattgtaagtatcgaggtagatgatagcggagagtctgaaggcatagcgaacccagtgtttgaacgtttacctcaagatattatcaatgggcaaacactgaatgtagatgtcatttcaggtgcgacagtaacaagtgaaggcatcgtgcaaggtattgcagatgcaattgaacaagcaggagaagacccagatattttacgggcgcgtcctaaaccagtcgttcagtggtctgatgaggtcgttgaagagacgactgacgtcgttgtgatcggtacaggaggtgccggactcagtgcagctgctacggtattagatgaaggaaaagaagtcatcatgcttgagaaatttgcggctataggtggcaatactatccgtacaggtggtcaagtcaacgctgctgagcctaaatggcaaaatgcattcccggcacttgctggtgaaaaagagacactcatacagttattaaatcatgatgaaaatgatatagatgaagcttacattgaagatttcaatactttaaaacgtcaaattaaagactaccttgaaaatagcagtaatgaagatgaatatctttttgattctgtcgaattacatcgtattcaaacatatttaggtggtaaacgtaaagatcgtaataatgtcgaaatatcaggtgattatgatttagttaaaacactcacagataacgttttggaatcagtatattggttgaaagacaaaggtgtacattttgatcgttcgtttgtagatatgcctgtaggtgctttatggcgtcgtggtcataaaccaatgaaagcacaaggtttagagtacattgaaaatttaggagactacgttaaacataatcatggtcgtatttttacagaaactactgcagaaaagttaatcaaagaaggtaatcaagttgttggtattgaagcacgtaaagcaaatggtgctaaagtgaagattcatacacgtcatggtgtagtgttggctactggtggctttggagcgaatacaaaaatgctacaacaatataatacgtattgggataatattcctgatgacattaagacaacgaattctcctgcaattacaggtgatggtatacgtttaggtgtgcaggcaggcgctgacatcgtaggtatgggattctctcaaatgatgccgatttctgatccgaagacaggtgcattgtttactggattaattgtaacaccttcaaactttgtcttcgttaataaggaaggacagcgttttgttaacgaatttgaaagtagagatgtattatctaaggcagcattagaacaaaaagacggtatcttctatattattgcagatgcaaatattaaagcactagctatgaatacaactgaggataaaattaatcaagaattagaagacggcactttagtaaaagcagataccttagaagcattagcccaaaaattaaacattgatacaactacttttgtgaacacgattgaaagatataataccttcgtagaacaaggacaagatgaggatttcaataaaaatgcatttgatttaaaaattgaaaaagcaccattctacgcgacaccacgtaaacctgcaatacatcatactatgggtggtttaaaaataaacacgcatgcacaagttatagatgttgaaggtcatatcattgaaggtttatatgcggctggtgaagttgccggtggtattcatgctggtaaccgtttaggcggaaatgcactggcagatatttttacttttggtcgcattgcaggtcaaagtgctgtaacgaaataa

SEQ ID NO: 706 - DNA, 192 bp, Staphylococcus epidermidis
tacgaaatcttaagctgtactttcactccatcacttcatcaatatttaacatcaaaaaggcttgccctttcgtcgtatatttctcgattgaaaaggcaagccttaataaattttatacacatttatttatcgtgtctaacttatctgtacactaatccaccatcagttaaaatggattggcctgtaatataa

SEQ ID NO: 707 - DNA, 1221 bp, Staphylococcus epidermidis
gtatgtctaataaagaaattaaaaaaatggttaaaattttcaacaaagccttacatcaaacattgggtaagaagtaagaggggatttatggacattaaagcacagttaaaacagattcaagataaaggtttatatagagagcttcagccgattcagtccgtagaaaaacaatatatttatatcaatgaccaatcttatattaattttacttcgaacgattatctcggtataggacaacttgaatatcaacctcaaaatttcttagattttataaagacatatagtatccatctatcaagttctagattagtgagtggcaactcagtcgtttatcagcaattagaacaggcaattagcgagcattttaattttgaagacgccttaatttttaatagtggttacgatgcgaatttggcggtatttaatatttttaaaaataataatgtagttatcttttcggatcaacagaatcacgccagtataatagacggtattaaattaagtggtttatcaaaagtgatttatcaacatttaaactatgatgacctggaaagtcatttagcacggcacaccaatccagatgttcaaaaagtaattgtctctgatagtgtgttttctactaatggcactaaagcagatattaataggctagtacatctcaagcaacgttacaatgcgattttaattattgacgcatctcatagtttaggattaaatctctttgagtatcatgcagacattgacatagttacttcaagtttatctaaagcgtggggagcccatggtggcttaatactaagttcaaaagatataaaagatttaattattaataaaggtcgttcgcttatctactcgagtagtttacctagctatcatttgtattttattcaagtgagcttacaacatgtgattgaagatacatacagacgagagaagttgaatgcacttagtgaatattttaaccaccaatttatggaattatttcccaatcaaccattatctaatacacctatcaaaaatatcgtttgtgatagtttggcttcagcacaagcacaatacgacatgttatttgaacatggtatatttgtcagttatttaaggtatccaacagtgtcacagccaacattaagaatttcattatcctattttcatgacacagatgatattaatcgacttttcaatgtaatgaaacaatacgatgaaggtgatagctatgtatag

SEQ ID NO: 708 - DNA, 321 bp, Staphylococcus epidermidis
tgtgactttttcaaaaaaatgtgtcgtaaaattcttgtatataagcatactatcacagtaattaagggtttctttctccacacttcacacaatttttttaatacccctttactatcaatagttatcgagtttaactacataccttttgatattggtaagcttaataaaacttttcaaacatacaaacaattgaatataccattattattcaaaagaatcctttctaacgaactatatactataattaaagttttacaaaaatttgaaagtctaaattttacatattttatatatatagcgcacttcattattatgctataa

SEQ ID NO: 709 - DNA, 885 bp, Staphylococcus epidermidis
ggtgaatcaatgaataaattatcaaagtacattgcaatagctacattagcatcgacagttacaatttcagcaccaattcatacatatgcatgtgaatctcatactaaagataaccataatcaaacgacacaacatcaaaatgaccccaaccttggtgaacaaaatgtaatggctgtctcatggtatcaaaattctgccgaagcgaaggcactttatctacagggatacaatactgcaaaatatcagttagatgaacatattaaaaagaataaaggtaagaaaaaacttgctatagctttagacttagatgaaacagttcttgataattcaccatatcaaggatatgcttctatgcacgatacgtcttttccagaaggatggcatgaatgggttgctgcagcgaaggcaaaacctgtttatggcgccaaatcattcttaaaatatgctgacaaaaaaggtatcgatatttactatatttctgaccgtgataaagaaaaagattttaaagctacaaaggaaaatttaaaaaatattggactaccgcaagcgaaagataatcatattttactaaaagggaaaaacgataaaagtaaagcatcacgacgtcaacaagtcgaaaaaaatcataagttagtgatgttatttggtgacaatttgttagattttacagatcctaaaaaatctactgctaaagaacgtgagaaactcgtgaagaaacatgcaaaagattttggcaaaaagtatattattttcccaaatccaatgtatggaagttgggaatcgacactttatcataatcaatacgaaataagtaagaatgagaaggatgaactacgaaaggcatcaattaaacaatttaatcctaaaacgggtgaagtaaaataa

SEQ ID NO: 710 - DNA, 1365 bp, Staphylococcus epidermidis
gaggatccaatggctaatacacgagagttaaatcataaagatgcacagtatgtatggcacccattcacacagatgggagtctatgctaaaaatgacaatattattattgaaaaaggtcgcggaagttatttatacgatactgaaggtaataaatatttagatggttatgcgtcattatgggtcaatgtgcatggacatcagcataaaaagttaaataaagctattcataaacaacttgataagattgcccattctacgctattaggttcgtctaatattccatcgattgagctagccgaacagttagtcaaattaacaccagatagattacaaaaagtgttttactccgatacagggagtgcgtcggtagagattgctattaagatggcttatcaatattggaagaatatcgatgctaaacgatatgcgaagaagaataaatttcttacattacatcatggatatcatggagatacaataggttctgttagcgttggtggtatcgatagtttccacaaaatttttaaagaccttatttttgaaaatatacagatagaaacaccgtgtttatataaaagtaagtaccgcaatgaagcggaaatgcttaattcaatactgaatcaaattgaaaatatattatctgagagaaatgatgaaatagtaggatttattctagagccacttatacaaggtgcaacaggtttattcgttcatccgcatggttttttgaaagctgtagaacagttatgtagaaaatatgatgtattactaatttgtgatgaagtagctgttggtttcggacgtacgggagaaatgtttgcttgtaaccatgaagatgtacaaccagatattatgtgtctgggtaaggcgattacaggtggttatttaccgttagcggcaactttaacatctcaaaagatatatgatgcttttttaagtcagagtcacggtaagaatacgtttttccacggtcatacatatacaggtaatcagttagtttgttccgtagcacttgagaatattaatctttttaaaaagaagcatctgattgggcacattcaaaagacatctcaaacattaaagcaacgcttagaggcacttcaacctcataaaaatattggagatattaaagggcggggattaatgtatggtgtggaattagttgaaaacaaatcaacgcagacaccactcgatattccaactgtagaactgattatacgtcgatgtaaagagaatggattgatgattcgtaatttggaaaatgtcatcactttcgtacctattttaagtatgtctaataaagaaattaaaaaaatggttaaaattttcaacaaagccttacatcaaacattgggtaagaagtaa

SEQ ID NO: 711 - DNA, 588 bp, Staphylococcus epidermidis
ataattacaattatatattatttagaattcgataaagaaggtgacgaaatgcctagaatttccaaaagacaattaatattagaatcggccgcagctattattaatgaaaaaggtgctgattatctcacgttggatgctgtagctcaaagggctggaataagtaaaggtggtttattttatcattttaaaagtaaagatgaactcatcaaagagctggttaactatgccaataatttgtacagagagaacgtgaaccaacatatcggtaatgaaaagaacaaaaaagggcaatggctcaacgcatttatagaagcgacaagagcacatcgtacggataatgcgcctattacttctggaatgttagcggcgcaagggactaatagaagtttattatcaccattaaagacctcatatcaagaatggcaatatcaaattacccacgacgggttagatgaggtagatgcaaccattattcgtttagctgtcgatggtttatggttgtcggaaatattcggaattagtgctatagatgaagaaatgagagagaaagttattgaacgtttaaagatgcaaatagaaaaaaagtaa

SEQ ID NO: 712 - DNA, 816 bp, Staphylococcus epidermidis
atgtatacaataatagagagatgtgaaaagatgaaatattatgggaagtgcatttcttacataagcattttaatattaacgttttttattggcggatgtggatttatgaataaagaaaataataaagaagcagagattaaagaaaattttaataaaacattaagtatgtatccaattaaaaatttagaagatttatacgataaagaaggctatcgtgatgaagaatttgaaaaagaggacaaagggacatggattattaattcagaaatgaatattcagaaaaaaggtcaagcgatgaaatctagaggtatggttttgtatatgaatagaaatactagaaagacgactggtcatttttatacaaatataattacagaagataaaaaagggagagtgcacagtaaagataaagaatatccggttcgccttaaaaacaataaaattgaaccgactaaatctatcgccgatgaaaaattaaaaaatgaaattaaaaactttcagtttttctctcaatatgggaattttaaaaatttaaaagactacaagaatggaaatgtgtcttataacccaaacgtaccaagctattcggcagagtaccaattaagtaatgaagatgacaatgtgaagcaactcagaaagaggtatgatattccgattaagagagctcctaaactaatattaaaaggggacggtgaccttaaaggttcatctataggttataaagatatcgagttttcttttgtcgacaataaagaagaaagcgtctactttgtggatagtttggaatttaatccaagtgatgtaaataatgagtag

SEQ ID NO: 713 - DNA, 195 bp, Staphylococcus epidermidis
gttattcaaatgaatcattttggtaagcttcatcgtatatcattaatattaaatattatgtttttaatactcatgcctaaaatctatagttttgataatatttatttatcaataatttggactttgttaggaatagcaaatgctgtctacttattgattaagcaaaaacaagaaaacaccattaaacgtaaataa

SEQ ID NO: 714 - DNA, 978 bp, Staphylococcus epidermidis
aggagacaaataatgaaattcgcagttgttggaacaggtgtaattggtagtggatggattactagaatgcttgcgcatggtcatgaagtgattgctactgatccaagtgaaggtgcatatgaacgcatgttgacacaagttaaacaaaattggccttacgcagagcaaatgggccttgctgaaaatgcatcaattcaaaacctaacatttacaccacatttagaagaagcggtcaaagatgcggatcatattcaagaaaatgtaccagaagtagaagaaattaaagatgctgtattaaaagagattgatttttatgcgaaacctgaagcaacaattggttcaagtacatcaggaattatgccttcagaattacaagctaacttatcacatcctgaacgattagttgttgcccatccatttcacccggtatatattttgccattagtcgaaattgtgccaggtaagcaaacatctgaagaaacaacagttaaagccgaacagatttatgaaagtattggtatggatgttttacatgtgcgtcatgaaatagaaggacatattgcagatcgtcttatggaagcattatggcgtgaatcattgcacatagttaatgatggtattgcaacaacagaggaagttgataaggcgtttacccatgcagcaggtttacgttatgcacaatatggtccatttatgacgttccacttggcaggtggtgaaggtggtatgcgtcatatgttaaaacaatttgggccagctttaaaaaaaccttggacaaaactcatcgcgcctgaactgacagatgacctatatcataaagtagtaagtggtagtgaagcatcttctcaaggatatacaatgtctgaacttgatcaaaaaagaaacgaatttctaattaaagtgaaagaattagcagaacaatattggccaagtgatagtaaagcgatgaaaaagtctaacggagcggaattacaatga

SEQ ID NO: 715 - DNA, 1257 bp, Staphylococcus epidermidis
aaagtgaaaatcattactaaaaatgaggaggactgtgaaatgactgtattgagtgagcaagacaaaataagattattagctgatatcgtcaagattcaaactgagaatgatcatgaaattgaagtatgtgagtacttaaaagacctgttaagtcaatatgatattgattctaagattgttaaagttaatgattcacgcgctaatttagttgctgaaattggtagtggcgctccagtcttagcaatcagtggacacatggatgttgtagatgctggtgaccatgatgattggacttttcctccatttgaactcacagataaggatggcaagttattcggcagaggtaccactgacatgaaaggtggtcttatggcgatggtcatcgcgatgattgaattgaaacaatcaaacgcattaaagcaaggtacgatacgtttattagctactacaggagaagagacggaacaatatggtgcacaattacttgctgatgaaggttacttagatgatgtgagtggtttaattattggcgaaccaactagtaatatcgcttactatgctcataaaggttctatgagctgtgtagtcacagcgaaaggtaaggctgcacacagttctatgccacacctaggtacaaatgctgttgatattttagttgattttgtaaatgaaatgaaacaagaatataaaaatattaaagagcatgataaagtacatgagctagacgctgttccaatgattgagaagcatctccatagaaaaattggtgaagaagaatcacatatctactctggatttgtaatgttaaactctgttttcaatggtggtaaacaagttaattctgttcctcataaagcgacagctaaatataatgtaagaactgttccagagtatgacagtactttcgtgaaggatttatttgaaaaagtcattcgtcatgtgggtgaagattatttaactgtagatatacctagcagtcatgatccagtggcaagtgatcgtgataatcctcttattcaaaatattacacgtattgcaccgaattatgtacatgaagacattgttgtgagtgcattgattggtacaactgatgcatctagtttcctaggaacaaatgaaaataacgtagattttgctgtctttggacctggtgaatctattatggcgcatcaagttgatgaatttattagaaaagatatgtatttaagttacattgatgtttataaagatgtatttaaagcatatctagaaaaataa

SEQ ID NO: 716 - DNA, 2271 bp, Staphylococcus epidermidis
caatacgaaatggaggcggagagtatgttagaaacaaataatcatactaatgcttggcaaggatttaaaacaggtcgttggaataaaaatatagacgtgagagaattcatacaattgaactattcattatatgaaggtgacgatgaatttttagaaggtcctacaaaagcaactgaaactttatgggatcaagtaatgcaattatcaaaagaagaacgtgagcgcggtggcatgtgggatatggatactaaagtggcatcgacaatcacttctcatgacgctggttacttagacaaagatttagaaaaagttgttggtgttcaaactgaaaaaccattcaaacgttctatgcaaccattcggtggtattcgtatggcaaaagcagcatgtgaagcgtatggttacgaattagacccagaaacagaaaaaatcttcactgaatatcgtaaaacacataaccaaggtgtattcgatgcatattcaagagaaatgttaaattgtcgtaaagctggtattattactggtttaccagatgcttacggacgtggacgtattatcggagactatcgtcgtgttgctttatacggtgtagacttcttaatggaacaaaaacttaaagactttaacacaatgtccactgaaatgtctgaagatgtgattcgtttacgtgaagaattatcagaacaatatcgctcacttcaagatttaaaagaattaggacaaaaatatggatttgatattagccgtcctgctactaacttcaaagaagctgtgcaatggttatacttagcatatttagctgctatcaaagaacaaaatggtgcagcaatgagtttaggacgtacttcaacattcttagatatttatgctgaacgtgatttacaaaatggtgacatcactgaacaagaagttcaagaaatcattgaccacttcattatgaaattacgtatcgttaaattcgcacgtacgcctgaatataatgaattattctctggagatccaacttgggtaactgaatctatcggtggtgtaggtattgacggccgtccgatggtaactaaaaactcattccgtttcttacactcattagataatttaggtccagcaccagaaccaaacttaacagtattatggtctacacgcttacctgaaaacttcaaaatctattgtgctaaaatgagtattaaaacgagctcaatccaatatgaaaatgatgatttaatgcgtgaaagctatggcgatgattatggtatcgcttgctgtgtatctgccatgaagattggtaaacaaatgcaattcttcggtgcacgtgctaacttagctaaagcattactttacgctatcaatggtggtaaagatgaaaaatctggcaaacaagttggaccaagttatgaaggtattaaatcagacgtactagattatgatgaagtcttcgaaagatatgaaaaaatgatggactggttagctggcgtatacatcaactcattaaatatcattcactatatgcatgataaatacagctatgaacgtcttgaaatggctttacatgatacagaaattattcgcacaatggcaactggtatcgctggattgtctgtggcagctgactctttatcagcgattaaatatgcacaagttaaacctatccgtaatgaagaaggtcttgtaactgactttgaaatcgaaggcgacttccctaaatatggtaataatgacagtcgtgttgatgaaattgcagtagatttagttgaacgtttcatgactaaattacgtagccataaaacataccgtaattctgaacacacaatgagtgtattaacaattacttcaaacgttgtttatggtaagaaaactggtaacacaccagatggacgtaaagctggcgaaccatttgcgcctggtgcaaacccaatgcatggtcgtgaccaaaaaggtgcattatcttcactaagttctgtagctaaaataccttatgattgctgtaaagatggtatctcaaatacatttagtatcgtaccgaaatcactaggtaaagaagaagcagatcaaaataaaaacttaactagtatgttagatggttatgcaatgcaacatggtcatcacctcaatattaacgtgtttaatagagaaacattaattgatgcaatggaacacccagaagagtatccacaattaacgattcgtgtatctggatacgctgtaaacttcattaaattaacacgtgaacaacaattagatgttatttcacgtacattccacgaatctatgtaa

SEQ ID NO: 717 - DNA, 504 bp, Staphylococcus epidermidis
cggagcggaattacaatgatgaatcaacagtatgtgtttcacacaaaagtacatcgtgattgggtagatcataacgggcacctaaatgatgcaatgtataaccgaattttcagtgatacaacagatgattggttaggtcatttaggcttaactattaatgccattcaatcttatcaatataccgtattcaccttagaaaatcatgtcatgtttcttaatgaaatgaaagaaaatgaagatgtcattgttaaagtacatcttcacgattatgatagcaaacgattacatgtcctaatggaaatgtttaatgcagatgatgatttatgtgcaacatatgaagtgatgctgatgggcattgatacgacttcaggaagaccttcagcctttccgaacgacattttgaataacattgaacactattataatattgagaatgtggagatgacatctcaatatataggtcatcgtattggcatcaagaaaaagccaaaaagcaaagagtaa

SEQ ID NO: 718 - DNA, 255 bp, Staphylococcus epidermidis
tacgttatgatggattttttacattacatactgccagtcattatatacgctgttttgcttgctattcattactttttatcgcgtacgggaaataaaatattaggccttattgtgcctgttggtgtgattgcaagtcttgtatatatgtatcaagccgatattatacatatgaaaatgattggcgttattattataggtattgtggctctattattcttggcagaggagtggcagagagcacaaaaggataaataa

SEQ ID NO: 719 - DNA, 642 bp, Staphylococcus epidermidis
gacaccatgataaagtttatttcggaacatagtggtatgttatttgcaaagactttcgaacatttgtacatatcgatagtggcattggttattgcaatgatcgtagcggttcctttaggcattttattatctaaaaaagaaaagctttcgaaagtgtcattgacgatagctggcgttttacaaacgatacctacattagcggtattagctttaatgattccattatttggcgtaggaaaaacacctgcaattatagcgttatttttatatgtattattaccaattttaaataatacgattataggcattcaaaatatagattccaaccttagagaagcaggacgtagtatgggaatgactaactttcaattgatgaaagatgttgagttgccactcgcattaccattaatacttagtggaattagactgtcttcggtctatgtcattagttgggcaacattggcaagttatgttggtgctggtggtttaggtgattttatctttaacggattagcgctatttgaaccgagtatgattattactgcaactattcttgtcactgctattgcacttattgtagattatgttttatcactgattgaaaaatgggttgtacctaaaggattaaaagtttccagataa

SEQ ID NO: 720 - DNA, 192 bp, Staphylococcus epidermidis
ttaaactcgataactattgatagtaaaggggtattaaaaaaattgtgtgaagtgtggagaaagaaacccttaattactgtgatagtatgcttatatacaagaattttacgacacatttttttgaaaaagtcacactatcaaaaattaaaaaatattattataataaatgttgtgaaaaacgtattagattaa

SEQ ID NO: 721 - DNA, 711 bp, Staphylococcus epidermidis
aacaatacgatgaaggtgatagctatgtatagtataaaaatgcgtgcaagccacgaagatgttcatattagtggtgctgaaacaatgtgtgaatttgaggatttagaaaattatttaaaaaaatattttaataaagcctttaatcatgaaaatggaaatatagatttcttaaatttgaaaattgaaaaggttaaggcaccgattcaaacgttagtagcattaccagtggttgaaaatctaaacgatactttaacacaattagcaaaacaaacaggtgtttctgaatatgcgctaaacaaagggttagaatttataaaaaatgatattacttatactggagccattattctatctgcacaaaccggacaacgacttgatagcactgaacaacgaggtatcagggtaacacaattagcatttaaaacatgcaaatgtaatggagaaatatcagaaagagtaaaagatgcacgtgcacttgcaacttgtatcaatgcatttgaaggtgtaaaagcagaactatgtgtatcagacgatttgcattacacgactggatattttgcgtcgcctaagttaggatatcgtagaatctttaatattaaagaaaaaggtacgcgtcacggaggaagaattatcttcgtagacgaaggaataaatttaaatgaatatgtttcctttttagaaacagtacctaaagaaattatagaaaaataa

SEQ ID NO: 722 - DNA, 579 bp, Staphylococcus epidermidis
agaatgaatgtagcagatatcaaagcacgcttattagatttagaaaatacttttaaagaaaaagaaagtgaactgactgatttagacagagctatcggtgatggagatcatggtgtaaatatggtcagaggtttcgaacacttaaaagaaaaaatagatgatcaaagtatgcaagcgctatttaaatcaacaggtatgacattaatgtctaacgtaggtggtgcttctggaccattatacggatttggttttatcaaaatggcgagtgcagtgaatgatgaaattgatcatgataatcttaaagaggtacttaaagcgtttgctgatggcattcaacaacgtggtaaagtcgaattaaatgaaaaaacgatgtatgatgttatcgaacgtgcgagagaagctgttgaaaaaaatgaaacagtagatctagataaactacaatcatttgctaatgaaaccaaagatatggtagctactaaaggccgtgcatcatattttaacgaagcttcaaaaggttatattgatcctggtgcacaaagtagtgtttatattcttaatgcaattataggaggagagtaa

SEQ ID NO: 723 - DNA, 228 bp, Staphylococcus epidermidis
aatatttgcttcttatatttaatttatcataatattgttcagtttaacttaaaattcacgatgttcaatatatattcatcattctatattttgtataaaaagcatggactatatttaacagtttgctcatttacttttcggcccactatatgtttaagtaatcagtctaaaacttatttttatgtcacttttgtaaattgctcgagatttactactactaaatattaa

SEQ ID NO: 724 - DNA, 948 bp, Staphylococcus epidermidis
aggagcgtcgtcatggttaaatttattatgaaacgtcttacgctcatgattccattattgattgtagtgacttttatgactttcatgatgacctatctcacgaacgaagatccagccgtaacaattttacatgcccaaggaacgcctaatataacgcaagatttaatagctgaaactaaagaaaaatatggattaaatcaaccgatattcacgcaatataaaaattggcttgttgatgccttgcagtttaaatttggaacgagttatatcacaggggatccagtatctgagcgtatggggccagcgtttatgaatacattaaaactcactttgatttccagtgttgtggtgatgataacgtctgttgtactaggcatagtgagtgctttgactagtggtagatttccagatcgtgctatacgttcaatagcttttctactaacagctctaccctcatattgggtagcttcaatattaattatttatgtatctgtaaaactcaatttattaccaacctcaggactcactggtccagaaagttatattcttccagtctttgttattacgattacctatgcaggaatttattttagaaatgtccgacgatctatgcttgaacaattaaatgaagattatgttttgtatttaaaagctagtggtgtacctcgtctgacaatgttgctgcatgtattacgtaatgcattacaggtagccatatctattttttgtatgtcgataccaatgattatgggaggtctagtcgttattgaaaatgtatttgcgtggccgggtttaggaccattaagtattaaagcgattactgaacatgattttccagtaattcaagcatacgtgctcattgtcgcggtgttgtttattctttttaatacacttgcagacatcattaatgcaatattaaatccgcgtttaagggaggcaatgaaatga

SEQ ID NO: 725 - DNA, 774 bp, Staphylococcus epidermidis
ttgacgatggtaaacattatggaaaaatttaaattaactggtaaggtggcaatggtcattggaggtgcaactggcattggtaaagctatggcagaggcattagcacaagcaggggcaaatatcgttatcgctgatttgcaatccaatattggtcaagaaacagccacaactatatctacacaatcaggtgttaaaaccacatcattaaaattagatataactcatctagatgaagtaaatcaaattgttgattatgtagtaagggaatatggaaaaatagatattcttgtcaataacgctagtatctcaattcaagatgatactgaaaatatttcgtatgaagaatggttaaaagaaatcaatttaagcttaaatggagcattctctgtagcgcaaacagtaggacgtcaaatgattgagaagggcagtggttcgatgattaatgtctcttcagtattaggattgattgctaataaaacgcaagaccagagctcttatgaaacgtctaaagccggtgtgacgatgctgactaaaagcttagctagagaatggtctagatatggaattaaagtaaatgcaattgcccctggttacatgagaacaatcgaaacggaaaagatactaaatgataatactgaaacaaatacaacgcctatggaacgagtaggtgagcctgaagaattagctggaataacagtttatcttgcttctgatgcatcatcgtttactcaaggtagtgtatttaatattgatggcggttattcagcattataa

SEQ ID NO: 726 - DNA, 585 bp, Staphylococcus epidermidis
ttaatcctattacaggagaaaaagttggcgaaggtaaatcaacagaaaaagtcactaaacaacctgttgacgaaattgttgagtatggtccaacaaaagcagaaccaggtaaaccagcggaaccaggtaaaccagcggaaccaggtaaaccagcggaaccaggtacgccagcagaaccaggtaaaccagcggaaccaggtacgccagcagaaccaggtaaaccagcggaaccaggtaaaccagcggaaccaggtaaaccagcggaaccaggtacgccagcagaaccaggtacgccagcagaaccaggtaaaccagcggaaccaggtacgccagcagaaccaggtaaaccagcggaaccaggtacgccagcagaaccaggtaaaccagcggaaccaggtacgccagcagaaccaggtaaaccagcggaatcaggtaaaccagtggaaccaggtaaaccagtggaaccaggtacgccagcacaatcaggtgcaccagaacaaccaaatagatcaatgcattcaacagataataaaaatcaattacctgatacaggtgaaaatcgtcaagctaatgagggaactttag

SEQ ID NO: 727 - DNA, 1422 bp, Staphylococcus epidermidis
tgtgatatattttttttaacgaagatgataggggtgttagggatgaacttttttgatattcataaaatgccaaacaaagggataccattatctgtacaacgcaaattatggctcagaaactttatgcaagcgttttttgtcgtattctttgtttacatggcgatgtatttaattcgaaacaattttaaagcggcacaaccgttattaaaagaagaaatcggattaacaacattagaactaggttatataggattagcgtttagtattacttacggtttaggaaaaacaatactcggttatttcgttgatgggcgtaatacgaaacgtattatttccttcttattaatattatctgcgattacagtacttattatgggatttgtattaagttatttcggttctgtgatggggctattaattgtattgtgggggcttaacggtatatttcaatctgtgggtgggcctgcaagttactcaacgatttcaaggtgggcgcctcgaacaaagcgcggtcgttatttaggcttttggaatacatcacataacattggtggtgctattgctggtggtgtcgcactttggggcgcgaatacatttttccacggtaatgtggttggaatgtttatttttccttccgtcatagctttaatcattgggattgtgacattatttattggtaaagatgatccagaggaattaggttggaatcgtgccgaagaaatttgggaagagcctatcgaccaagaaaacattgattctcaaggtatgactaaatgggatatctttaaaaaatatatccttggaaatcctgtgatttggattttgtgtatctctaatgtttttgtatatatcgtgcgtattggtattgataactgggcaccgctatacgtatcagagcatttacattttaataaaggtgatgcggtgaatactattttttactttgaaataggtgcattagtagctagtttattgtggggctatatctcagatttattaaaaggtcgtcgtgcgattgtagcgattggatgtatgtttatgatcacctttgttgtactcttttataccaatgcaacaagcgtgacaatggtcaatatttctctatttgcattaggcgctttaatcttcggtccacagttactcattggtgtatctctgactggctttgttcctaaaaatgcaattagtgtcgctaacggtatgacaggttcatttgcatatctattcggggattcaatggctaaagtgggtctggctgcaatcgctgatccaacacgtaatggtttaaatatttttgggtatacgttgagtggttggacagatgtctttattgtattctatgtagctttattcttaggaatgatattattagccattgttgcttattacgaagaaaagaaaattagaaaattaaaaatttaa

SEQ ID NO: 728 - DNA, 1632 bp, Staphylococcus epidermidis
gtttacatattttcgaaaagaaagaggaaaacaatgaataaactcacaaaactaagtacagtcatttttgtatctgggattattttagccggttgtggaagtaacaaagaactaacagagaaaaaagagaataaagtattatcatatacaactgtcaaagatattggagatatgaatccccatgtttatggaggttcaatgtccgcagagagtatgatttatgagccgttagttcgcaataccaaggatggtattaagccattattagcgaaaaaatgggacatttcacctgatggtaaaacatatacgttttatttaagggacgatgtatcttttcatgatggtacgaaatttgatgcagacgcagtgaagaaaaacatcgatgcagtacaacaaaataagaaactacattcatggttaaaactttcaacactgattgatgatgtcaaagttaaggataagtatacggtacaactacatttgaaggaagcttatcaacctgcgttagcagaactagctatgccacgaccatacgtttttgtatcgcctaaagattttaaacacggtacaaccaaagatggtgtgaaatcatttgacggtacaggaccatttaaaatgggtgaacacaaaaaagatatatctgcagaatttaataaaaataatcaatattggggagaaaaggcaaagttaaataaagtagaagcaaaagttaaacctgctggagaaacagcatttttatcaatgaaaaaaggagaaaccaactttgcttatacagatgatagaggtacagacagcttagataaagatagtttaaaacaattaaaagaaaccggaagctatcaagtaaaacgtagccaagccatgaatacaaaaatgcttgttgttaattctggtaagaaagatagtgcagtcagtgataaagcagtcagacaagcattaggtcacatggtaaatagagataaaatagctcaagatattttaaacaagcaagaaaagccagccacacaactatttgctaaaaatgtgacagatataaactttaatttaccaacaagaacatatgataagaaaaaagcacaagcgttattagataaggccggatgggtgctttcaaaagatcgacaagttcgtcaaaaagagggcaaagatttgaatcttaagttgtattatgacaaaggctcttccagtcaaaaagaacaagctgaattcttagaggcagaatttaagaagttaggtgtacaactagatataaacggagaaacgtcagataaagtagctgaacgtcgtagttctggtgattacgatctaatgtttaatcaaacatgggggctattatatgatcctcagagtacattagcagcatttaagacgaaaacgggatatgaaagtgcaacattaggtattaagaataagtcacaactgtacaaagatattgatgaggcgttcaaaattcaagatgcaaaggcacgttcaaaagcgtatcagcaaattttgaaacaagttgacgatgaaggtgtctttattccaattactcacgggagaatgactgttgttgcacctaaagatttacaaaaattatcctttacacaatcacaatatgagcttccatttaatgaaatgcaatataaataa

SEQ ID NO: 729 - DNA, 516 bp, Staphylococcus epidermidis
ttcatgatattatgcttcttctgcaagtattccatatgtcaaatctttattatgtatgaatcctacactcattcatcacaaataagaggtagctactctatgtcaaaaaagaaaatcttgatctttattagtgtcatattaatcatttttggaggtgtctacctcaaaatgaaatatgacgaaaaagcaaaacaaaaagaaatctactacaaagagcaacaagaacgtatcacgctttatcttaaatacaacacaaaaaaacctaatactatcaaatctgtccatttcacaagtttaaaacagggaccaatgggtgatgctattattgaaggctatatcaataacaataaagaaaatgaatttgttgcatttgcatcatctgaagataattttcaattccaaggtgatatgatagaaagcaaaaaagtatcaaatctaataaaatatcaaacaaaaacacctgatgaaatcaaaaaagatttagacaaaaagaaaaacgctaaagatttttactga

SEQ ID NO: 730 - DNA, 210 bp, Staphylococcus epidermidis
tgtcctccattgtttgttatatatattcttttgctcgtacaatacaaagtattttatatagaaaatgtttcaaatgccattaactatttattaactttagcaccaactcataactcttctaacacctcacatattaagttcagtttttcggataatttaatacttttaaggatattaagcgcttacattgatgtgatatattttttttaa

SEQ ID NO: 731 - DNA, 1026 bp, Staphylococcus epidermidis
accgttaaatttgaaaaagcgattggaacaggtgcatttgttgttgataaaactgttaaggaaaaaacgacattgaagcccaataaatattttgaccacggtcacccaatcaattatcatcttgcattccaaacgattgaagatggggactccagaaattctccagtacaaagtggttttgtagatatttctggtggtgctttaggtatgctctcagacgaacaaatcaaacaagataagaaaaataagaacttaacgattgaagatagacctagcacagtaagtcactttatggcatttaaccctaaaaatgatgtattaaatcaacgcacaattcgtgaagcgataagtaagagcatcgatgcgaaagacattgcgggcaaatctgtaaatggtctgttccagaagaacgtacaatttgtgactaaaaataatcaacagccacacgattatgatatgaaagcggctgaaaggttacttaaatcagaaggatatcataaaaacgatgacggcatctttgaaaagaatggcaaacctttatcatttaacttagtcattcaaactgcagagttcccaaattggaaagataaagctgaaaaagtgcaacgtcagcttaaacaagccggtattaagttaaatgtgaaaacgttagattcacaatcatactatgatacattatggacgaaaaaagactatgatttgattttctatagaacgtattcagatgcattaatgccttacaactttataagttcagtgtttaaaaataatgatggtcaaccaggggtgttagctgatgatgaaacattaacgaaacagctagacgatttcccatcaaccgtatcaaaagaagaccaacagtgttcatttgatgacatatttaaacactttaatcaacaatactatggtgtgccaattgcttatccaaatgagacgtttgtagtgagtgataaagtaaaacaattcaaattctctggacttacggatgcaccaattgattataaagcgttgaaagttaatgaatag

SEQ ID NO: 732 - DNA, 762 bp, Staphylococcus epidermidis
ggggtgatttcaatgcttaaggttcaaaatgttattaaattttatggaaaaaaatcaatgtttcgtgataaacgtattcctgtagttaaaggcgtgtcatttgattgtcccactggtgcatcagtagcaattattggtgaaagtggaagtggaaagtctacgttgagtcgtatgattttaggactagaaaaaccagatcaaggacaagtgactttggacggtcagcctgttcatttaaaaaaagtgagacgtcatcgaattgctgcggtttttcaagactatacttcttctttgcatccttttcatactgtcaaagatattttgtttgaagtaatgaatcaatgtcgatgtacatcgaaggagaatatggaagagtatgtaacagtgttactacgtgaagtagggttaaaatctgattgtttgtattgttatccacatatgctttcaggtggagaagcacagcgtgtagctattgcacgtgcgatatgtatgcaaccagattatatattatttgatgaggcgattagttcattagatatgtctatgcaaacacaaatattagatttattgaaaaggttacgtcactcacaccagctgagttatatctttattactcatgatatacaagctgcgacatatatatgtgatgacttgcttatttttaaaaatggttgtatcgaagctaggacatctataagtgaattgcataggcaacaaaatggttatacaagagaactgattgataaacaactatcaatctaa

SEQ ID NO: 733 - DNA, 1221 bp, Staphylococcus epidermidis
caaattgaattacctatagaaaggaatggacatatgttaagtattaaaaacttatcaaaggtctatgcaggtggtaaaaaagctgtagataatatgaccatagacattgaatcaggagactttattgcatttattgggacaagtggtagcggtaaaacaactgcccttagaatgattaatcgtatgattgaatctacagagggagaaattaccattgacggtaaaaatatcaaagagcttaatccggttgagcttcgtcgcagtatcggttatgtcatacaacaaatcggcttaatgccacatatgacagtgaaagagaatattgttctcgtaccaaagttattaaaatggtcacaagagaaaaaggatgagaaagcgaaagaacttatacgcttagtagatttaccagaagaatatttagatcgatatccttcagaattatcaggtggtcaacaacaacgtattggtgttgtaagagcactcgcagctgaacaagatattattttaatggatgaaccgtttggtgcactcgatccaataacaagagatacattacaagacttagtcaaaaaattacaacaacaattaggaaagacattcatttttgttacacatgatatggatgaagcaatcaaacttgcagataaaatatgtattatgacaaatggacaggtggttcaatatgacacgccagataatattttacgtagtccagcgaatgatttcgttagagactttattggtcagaatcgcttaattcaagatagacctaatatccgtacagttaaagatgcgatgattaaacccgtgacagtacatgttgaccgttctcttaatgatgcggtgaatattatgagagagaaaagagtcgatacgatatttgttgtcggcaatgatgagcatttattgggttatttagatattgaagatattaacgaaggattaagacatcataaagaacttatagatacgatgcaacgagatatttatagagtacgtattgatagtaagttacaagattctgttcgtacaattcttaaacgtaatgtacgtaatgtacccgttgttgacagtgataataaaacattattaggccttgtcactcgagctaaccttgtagacattgtttatgacagtatttggggagagttagaatcggataacaatgataatcattctgggattgttgaacccgaatccacaggagttgagacaccatga

SEQ ID NO: 734 - DNA, 861 bp, Staphylococcus epidermidis
agccatgattcaatatggaacatatgcacgtctgcacattttctcaagaagccagcaagggacattaatgtgttaccaaataccacttgtctaggaggaataaagatgtttaaagtagttatttgtgatgatgaaaggattataagagaaggcttaaagcaaatggttccatgggaggactatcatttcaccactgtttatactgccaaagacggcgtggaagcattgtctttaattcgccaacatcaacctgaactcgtcattactgatatacgaatgcctcgaaaaaatggtgttgacctactagatgacatcaaagaccttgattgccagattatcattttatcgagttatgacgacttcgaatatatgaaagccggtatacaacatcatgttcttgattatttactaaagccagtagaccacactcagttagagcatattctagacatattagttcaaaggttattagaacgcccacattctaccaatgatgacgcggcatatcatactgcctttcaaccattattaaaaattgattacgatgactattatgtcaatcaaattttgtctcaaatcaagcaacattatcacaagaaagtgactgttcttgacttaattaatcctattgatgtaagtgagtcatacgccatgaggacgtttaaagaacatgtaggcattacgatagttgattatctaaatcgttatcgtattttaaaatcattacatcttttagaccagcactacaagcattatgaaattgctgaaaaagtaggtttttctgagtataaaatgttttgctatcattttaaaaaatatttacatatgtcaccaagtgattataataagcaatcaaaatag

SEQ ID NO: 735 - DNA, 255 bp, Staphylococcus epidermidis
agtgcttttttatcaattttatctcctttatttaaaggatctacttggaagaggacttcaaaaccaccttgcaaatctagaactaaattaacatttttaactacattcttatacgtcatacccattcctgtgaatagtagagctatgaggagtatgaatgcaattattctactcgttttcttcacatgcacacctcattatttacttatgtatctagaatactcgatgaataaattatcgtgcaagttaaaatga

SEQ ID NO: 736 - DNA, 330 bp, Staphylococcus epidermidis
ggagtgacatcaatgaaaacattgaaattattgaaaaaaacacgagcatttaccttgatagaaatgcttttagtattactaataataagtttattgttaatacttataattccaaatattgcaaaacaaacatctcatattcagtcaactggatgtgatgctcaagttaaaatggtaaacagtcaaatagaagcctacgctttaaaacataatcgcaacccttctaatattgatgatttggtttcagatggttttataaaagaaggacaaaaaacatgtaaatccggtcagacaattagtattgcaaatggagaagcagttgccaattaa

SEQ ID NO: 737 - DNA, 1596 bp, Staphylococcus epidermidis
ttaattatgtcaaagatatattgcattaaagtaataaaaacgttactatatcaaagatacatagaagtgacaggttataaagatgaaagcgagaaggataaaatggataagcaagaacgatacaatagaagagaaaatattagaaatttctccattattgctcatatagaccatggtaaatcgacattagctgatcgaattttagagaatacaaaatcagttgaaactcgagaaatgcaagatcaattacttgactctatggatttggaaagagaacgaggcatcactattaaactaaatgctgttcgattaaaatacgaagctaaagatggagaaacttacacatttcatttgatagatacaccaggacatgtcgactttacatatgaggtttctcgctcattagctgcatgtgaaggtgcaattcttgtagttgatgctgcccaaggtatagaagcacaaaccttagcaaacgtttatttagcattagataacgatttggaacttttgccagttgttaataaaatagacttgcctgcagctgagcccgatagagttaagcaagaattagaagatgttataggtatagatcaagaagatgtagtacttgcaagtgctaagtcaaatataggtattgaagaaattttagagaaaatagttgatgttgtaccagcaccggacggtgatccagaagccccacttaaagcacttatctttgattcagaatatgatccatacagaggagtaatatcttcaattcgaattattgatggtgttgttaaagctggagataggattaaaatgatggctaccggtaaagaatttgaagttacagaagtcggaatcaatacacctaagcaactaccggtagaagaattaacagttggtgatgtgggttatattatcgcaagtatcaaaaatgttgatgattctagagtaggtgacacaattactttagctgaaagacctgctgacaaaccgttacaaggatataaaaagatgaatccaatggtattttgtggtctattccctattgacaataaagactataatgacctaagagaagctttagaaaaattacaacttaatgacgcatccttagagtttgaaccagagtcttcacaagcacttggttttggatacagaactggatttttaggaatgttacatatggagattattcaagaaagaattgaaagagaatttggtattgaactcattgcaacagcgccttctgttatctatcaatgtatcttaaaagatggttctgaagtttcagttgataatccagcacaaatgcccgaaagagataaaatagaacatatttatgaaccatttgtcaaagctacgatgatggtgccgaatgattatgtaggtgcagtgatggaattatgtcaacgtaaaagaggtcaatttataaacatggattatcttgatgatataagagttaatattgttcatgaaattccattatcagaagtaagtttttcgatttctttgatcaacttaaatctaacacaaaagggtatgcttcttttgattatgaatttattgagaataaagaaagtaatcttgttaaaatggacatattactga

SEQ ID NO: 738 - DNA, 1011 bp, Staphylococcus epidermidis
gctaatatgtcaggacaagttatcttactattagatgaaattcatcgtttagacaaagctaaacaagattttttattaccacatcttgaaaatggcaaaattgtattaataggtgcaacaacttcaaatccttatcatgcgataaatccagcgatacgatctagagcacaaatatttgagctttacccattagatcaagatgatataagattggcattagatagagctataaatgataaggaaagaggtttaagtacttatcatcctattgtagatgaagatgctatcgaatatttttcaacgcaaagccaaggcgacgttaggagtgcattaaacgctttggaattagctgtactaagtgctcatattggtgaagaaaacgaaagacatattacattagatgacgcaaaagattgcttacaaaaaggtgcttttgtaagtgataaagatggagacatgcattatgacgtcatgagcgcttttcaaaaatcaattagaggtagtgatgtcaatgcagcactccactacttagcacgtctaattgaagctggtgacttacctacaatcgtacgtcgattacttgtaattagttatgaagatgttgggttagcatcacctaatgctggtcagaggactttagcagcaatacaatcagctgaacgtctaggttttccagaagcacgaattccccttagtcaagctgtaatagaattatgcttatcacctaaatcaaattctggtatcacagcaatagataaagctcttggcgatataagaaatggacatataggtcaaataccggattatctgaaagacggtcattattcaggtgctaaaaagttaggacgggctataggttacaaatatcctcataactatgaaaatggtcatgttgtacaacagtacttaccagaaaaattaaaaaacagagtgtattatgaaccaaaaaccacatcaaaaagtgaacaacaatttaaaacaatttacgataacttacgaaataaaacataa

SEQ ID NO: 739 - DNA, 747 bp, Staphylococcus epidermidis
agaatacggtcaggcagtattttagtcatgaatcaatatgaagatatgagtttagtatatgacaaacttactcaagatcaaccgtatcattcgtggtttaatattgttgagcatttcttaccttctgatagtcatgatttgttagatattggttgcggtactggcaacttaacacaattactaacgtcactaggtgaagtcactggtatggatattagtgtagatatgttatcaatagctagacaaaaaacaaatcaagtgaagtggatcgaaggtaatatgactcactttaatttgaacaaaaaatttaatatgattacaatattttgtgattcactgaattatttagaaacattaaatgacgtaaaaatgacattcgaaagagtgtatcaacatttaaataaaaatggtgtttttatttttgatgtacatactgttcataaaatgaaaacattatttaataataaaagttatattgatgaatctgataatgtttttgtaggttgggatgcaatatgtggggatgaaccattaagtgtttatcatgaaatgactttctttgtatcacagcaaaatggattgtatcaacgctttgacgaatcacattatcaaagaacatatgaggaacaaatttatcgaaatttactaaaagatgttgggtatcatagtgttaagacttttacagactttaacattcacagtcatgaagaagatgcccatcgcttgttttttgttgctaaaaaataa

SEQ ID NO: 740 - DNA, 525 bp, Staphylococcus epidermidis
tggtattttccttctggacatgttgaaaatatacattttgtatcacatgctcaactaaataatattaatttaaataaaatagcaaactttttgaccgaacatttcagttttaatcgtaaagtactaactcaaaacattgagtcttactttagtcaaaaagaagagctattacttgcaaatgaagtagttgagatgataaatttacaaattggtaatcaaagtaatagcatttatatgggtggaaaggttaaacttattgatgcgttaaatgagtccaacgtttcatctattcaaccgattcttcaatatatagaatcaaataaaataactgaattattagaagatatatcaacatctcaaatcaatgtccgaattggtaaagagattgatgatagtttaagcgatatatcaattgtgactagtcagtatcattttgatgagtcactaaaaggtcaaattgcagtaatcggaccaactgcaatgcattatcaaaatgtaattcaattattaaaccgtatatggtag

SEQ ID NO: 741 - DNA, 681 bp, Staphylococcus epidermidis
ttttttgtgtttaatattaacagacgatatatcgatttttttatgaaatggaagttgtacatcttgattatattaataatgttaacaacattctttttttacttactcaatgataacaataatgatttgatacagaatagtcaggaaagacaatctaaaatatctgaccagcaaataaaaaatagcaaaaagttaaataaaaaagaagtgtctattcaaaaagataatacaaaagaaactaaaatatttatcgatattaaaggtgctgttaaacatccgaatgtatatgaaatgtcttcttcgaatagagtcattgatgctttaaataaagcagaggtattaaaggatgcagacttatcacaattaaatctttctgaaaaattagttgatcaaaaacttatctatgttcctaaaaagggtgagaatagtatgaaaatcaattcacagcaatcaacattgaattcgagtgacgtaaaaatcaacacgaatcaacctttaaatttaaactctgctactgaagaacaattgaaaaacataccaggaataggtccaagtaaagctaaagaaattttaaattacagagaacaaaatcatggatttaatagtatcgatgacttaatgaaaataaaaggattcggaaagaaaacatttgaaaaactgaaagaacattttactatttaa

SEQ ID NO: 742 - DNA, 1404 bp, Staphylococcus epidermidis
ggagaggcttttatggttaaaaatatggatacaattgtacaacttgcgaagcatagaggatttgtattccctggtagtgatatttatggtggattatcgaatacatgggattatggtccgttaggtgttgaattaaaaaataatattaaaaaagcttggtggcaaaaatttattacgcaatcaccttacaatgtgggtattgatgctgcgattcttatgaatccaaaaacatgggaagcatcaggacatttaggaaattttaatgatcctatgattgataataaggacagtaaaattcgttatcgtgcagataaattaatcgaagattatatgcaaaatgaaaaaggtgacgaaaactttatagcagatggcttaagttttgatgagatgaaaaaaattatagatgatgaaggaattgtttgtccggtcagtaagactgcaaactggaccgatatccgtcaatttaatcttatgttcaagactttccaaggtgttactgaagattctactaatgaattatttttacgacctgaaacagctcaaggtatttttgtgaactataaaaatgttcaacgttctatgcgtaaaaaattaccttttggtattggtcaaattggtaaatcattccgtaatgaaatcacaccaggaaactttattttcagaacaagagaattcgaacaaatggaacttgaattcttctgtaaacctggcgaagaaattgagtggcaaaattattggaaaacttttgcaagtgaatggttaacagatttaaacatctcagaagacaatatgcgccttagagatcatgatgaagatgaattatcacactattccaatgctactactgatattgaatataaattcccatttggttggggtgaattatggggtattgcgagtcgtacagactatgatttaagacaacatagtgaacattcaggtgaagattttaaatatcacgatcctgaaacaaacgaaaaatacattccttattgtattgaaccatctcttggtgcagatcgtgtgactttagcatttttatgtgacgcgtatgctgaagaaggtgttgaaggtagtaaagatgcacgtacagttatgcacttccaccctgctttagcaccatataaagcggcagtattaccattaagtaaaaaattatcaagtgaagctattaaaatttttgaacaactaagctctagctttgcaatagactttgatgaatcacaatctattggtaaacgttatcgtcgtcaagatgaaataggtacaccatattgtattacttttgattttgattcattagaggacaaccaagtaacagtgcgtgacagagatagtatggaacaagtacgtatgccaatatcagaacttgaaacatttttagctgagaaagttaaattttag

SEQ ID NO: 743 - DNA, 1068 bp, Staphylococcus epidermidis
cctatgaacactttaatactactaacgaaaagagggaataatttgaatatcgaagatttcgattatcatttgccagagtctctcattgcacaaacaccactaaaaaacagagaccaaagtagattgttagttcttagcaaagatactggtgagctgacacacttacattttagagatgtcatccattattttgagcctggtgatacattggttcttaatgatacacgtgttatgcctgctagattatttggcctaaaagaagaaactggtgctaaagttgaaatgctaatgctcacccaaattgaaggtaatgattgggaagttttacttaaacctgcaaagagaattaaaaaaggtcatcgtctaaattttggagatggtaaaatcgttgctgagtgtattgaggaacttgaacagggcgggcgtattatgcgtctacattatgagggtatactccaagaacgcttagatgaattaggcgagatgccattacctccatatattaaagaaagattagatgatcctgataggtatcaaacggtttatgctaaagagagtggatcagcagctgcaccaacagcgggtttacattttactgatgatttgctaaataaaattaaacaaaaaggggtacatatcgcttttattacattgcatgttggattaggaacctttagacccgtaagtgttgaaaatatcgatgatcacgaaatgcatagtgagtattatcaaatgacacaagaaacggctgatttattaaataaaacaaaagaaagtgggaagcgtgtgatatcagttggaacaacatcaacgcgtacattagaaacgatacgtcgtgatcatcctcaatttgttgccacaagtggatggactgatatctttatttatcctggctttgagtttaaagcgatagatgggttaattactaatttccacttacctaaatcaacgttagtcatgctagtatcagcatttagcaataaaaaatatattttaaacgcttatcataaagctgttgaaatggagtatcgattctttagttttggagatgcaatgttaattatataa

SEQ ID NO: 744 - DNA, 276 bp, Staphylococcus epidermidis
agaggagtaactaaaatggaattaacttcattgattataccaattttattattggtcgtaatgtatttcttattaataagaccacaacaaaaacgtgcaaaagaacatcgtgcaatgattaaccgtgttgaagcgggtcaaaagattactacaatcggtggtattaaaggaactataaaagctgtagatgaaacttctgtaatcattacagtaaatagtaatggaacagaaatgacttttgaaaaaccagctataaaacaagtagatccttcataa

SEQ ID NO: 745 - DNA, 993 bp, Staphylococcus epidermidis
aaagtaatgacagatattattttagctgctgatataggcggaacaacttgtaaattggggatatttgacaaggatttagaacaattgcataaatggtctattgatactgatacaagtgaccacactggtgagttacttttaaaaaacatttataattcttttactgaaaagattgcagaatataaatatgattttaacaatgtagttggagtcggtattggtgttcctgggcctgttgattttgatactggagttgtatacggagctgttaatttacattggcccgatagtgtcaatgtaagagaaattttcaaacaatatgttaattgtccagtttatgttgataatgatgctaatgttgctgctttgggagaaaaacataaaggtgccggcgaaggtgctgatgatgtagtagccattactttaggtaccggcctaggtggaggtataatttctaatggagaaattgtacatggacacaatgggtctggcgctgagattggacatttaagagctgattttgatcaacgttttcaatgcaattgtggtaaatcaggttgtatagaaacagttgcttctgctactggtgtagtaaatttagttaatttctattatcctaaattaacgtttaaatcatcaattttacaacttattaaagataaccaagtaactgcaaaagctgtatttgatgcggctaaagctggcgatcaattctgtatatttataactgaaaaagtggcaaattatatcggttatttatgcagtatcattagcgttactagtaatccaaaatatattgttctaggagggggcatgtctacagcgggacttatccttatagaaaatattaaaactgaataccgtaatttaacttttactccagctcaaaataatactgagatagtacaagctaagttagggaatgacgctggtattactggtgcagctgggcttatcaaaacatatatcatagataaagagggtgctaaataa

SEQ ID NO: 746 - DNA, 1143 bp, Staphylococcus epidermidis
catatgcctgcagtgacatatgagcatataaaaacatgtaaacaatccggtgccagattaggaattgtacatacaccgcatggatcttttgaaacaccaatgtttatgccggttgggacaaaagcaacagttaaaacaatgagcccggaagaattaagaaacatagaagcaaagattatattaggaaacacatatcatttgtggttacaacctggaaatgatattatcaagcacgctgggggattacacaaattcatgaattgggacggtccaattttaacagattctggtggtttccaagtatttagtttaagtaatttgcgtaaaatttctgaagaaggtgtagaatttagacatcataccaatggctcaaaactatttttgagtcccgagaagtctatgcaaatacaaaatgatttaggttctgatattatgatggcatttgatgaatgtccaccaatgccagctgaatatgattacgtcaaagattcaatcgaacgtacaactcgatgggcagccagatgtttaaaagcacatcaacgccctggagatcaagcactgttcggtattattcaaggtggagaatacaaagacttaagagaacaaagtgctaaagagctagtcagtcttgattttccagggtatgcaataggagggctgtctgtaggtgagccaaaacctgttatgtatgacatggttgaacatacagaacaatttatgccgaaagataaacctagatatttaatgggagtaggttctcctgatgctttgattgaatgtagcattaggggcatggatatgtttgattgtgtattacctactagaattgctagaaatggtacttgtatgacatcaaatggtcgattagttgttaaaaatgctaaatatgcagatgatttaagaccacttgatgaacaatgtgactgttatacatgtcaacattacacaagagcttatattagacatctagttaaagcggaagagacttttggtatccgtcttactactattcataatttacattttctgctaaaattaatggaagatattagacaagccattcgagaagaccgtcttttagattttaaagatgaattctttgaacaatatggattaaatgtagaaaaccctaaaaacttttaa

SEQ ID NO: 747 - DNA, 606 bp, Staphylococcus epidermidis
ttatttatggcttttgaattaccaaatttaccttatgcatatgatgcattagaaccacacatcgacaaacaaactatggaaattcatcatgacaaacatcataacacatatgttacaaaattaaattcagcagttgaagggacagatttagaagctaaatcaatcgaagaaattgttgctaatttagatagtgtgccatctaatattcaaacagctgttcgtaataatggcggtggtcaccttaaccattcattgttctgggaactattatcaccaaattctgaagaaaaaggtgaagtagtagataaaattaaagaacaatggggttctttagatgaatttaaaaaagaatttgcagataaagctgcagcacgctttggttcaggatgggcttggttagttgtaaacaatggacaattagaaattgttacaacaccaaatcaagataatccaattactgaaggaaaaacaccaattttaggtttagatgtttgggagcatgcttattatcttaaatatcaaaataaacgcccagattatatcaatgcattctggaatgttgttaactgggaaaaagttaatgaattatataatgcaactaaataa

SEQ ID NO: 748 - DNA, 762 bp, Staphylococcus epidermidis
gtggataatttgcaaagatattttatgaatcaaagcgctgatgaaaatcagtgcttttttattgaaaacaaagaagactatcatcatatcgtgaatgttatgcgctataaagaaggacaaaatattattgtcactttttcagatgaaaatgtattcaaatgtaaaattatttcaataaacgatcaatcgattgaaattaaattagtagaaaagcaacaaattaacactgaactacctcagaacattacaatatgtagtggtttaatcaaagcagacaaatatgaatggatgatacaaaaagcaactgaaatgggggcaaatgagtttatagctgtagccatggaacgttctgtggtcaagctcactgattctaaagtagaaaagaaattatcgagatggcaaaaaattataaaggaagctgcagaacaaagttatcgtttaacaataccaaatataaaatttaagtcgaatttaaaagaaatttatggtatgataagtcaatatgactatgttcttatagcatatgaagaacaagcaaagcacggtgaattaagtcaatttaagcaaacaattaaacaatttaagacacaggatcgtgttttaatcatatttggacctgaaggtgggctatcagatagtgaaatttcattattcggtgatgtaagtactatagttggattaggtccacgtatcttgcgtgctgaaactgcacctctttacgctttaagtgcagtaagttatgaaaaagaattattggggtga

SEQ ID NO: 749 - DNA, 2220 bp, Staphylococcus epidermidis
ccaatgttttacattgctcttgcttttttggtaggggtactttggataaaattcaaagtaatctctatctccttaatattaactcttttgttactaattatgataaaaaggcttaatattataatactattattaatgtttatttcagctataagtttcttttttttaataagttcctataaccaaaccgaaattaaaaacataaatagtttatataatgaaccgtttattgatgattttgttactttcaaatcttttacgcctaaatcaacatactatactggcatattaaattataaaaataaagactatagatacttttacaaaatattaaagtcaaatttcaagcaagatttaactcataaaagttgtcgagttaaaggagaatttaaattcgaaaaagagttgtccttgttgaatatttcaacagttcaatttaagtcttgccaagaaaacaatattttcactcctatatatcatcatcaaaattatatcaccaaaataattcatatatctggggtcacgcatcctgaaagaatattagcgttgataacaggtgatacctctctaattgatgaatattacaaatctaacatcaaagatataggtatttaccatttactagctataagtggtacacatgttggtacaattattgtcctcgtttatcaactgttagtacgtttaaatatacctctagttctcattaaaggtgtaactattttactattattaatctacgctgtttatactggatttgtacctagtgccatgcgtgccatttcaattgcaatcattatacttatgttgccaatccattttaggaaaagttctatacatgtgctttcatttatatttgtgttaatgattctcttaaatcctcaatttataaatcacattggttttcagttctcttttttgataagtttatttattatattggcaaaaccatatataagtgctttaaaaccacttaaatgtttgtttattattagttttttggctcaattaggttcaattgtaattaatacctatcattttaatcaatttcaatggataggtttgctatctaattttatatttgttccattctattcttttatattatttccttcggtcattatctactttattttaattcacttttttcaacatagcttcctattaaatacttatataaatatgctttttaaaattcatgactggctagttcaattatttttaaatttaaatcatttaaagtggtacattcctaaattaaaccaatatagtttacttattttgattatactaacgttaatttttctttacatacttgtctatagagggtttgttacatccgtactaagttttttaattgttttaatcatttttacacatttaattagaccacattatgccgagttaacactttttgatgtgggtcaaggagatagcattttattcaaaacaaagtcaaataaaagtgttttgattgatacaggaggtaaaaaaaatgaaaatgtaagttttaaacataataatattgccaaatataaaattttaccaattattaaaaaaaagggtattaccactataaattatttagtaattacacatcctcatgccgatcatatgggtgaattaatatattttttaaataatattaatgtgaataatctcgttttaaatattgaaagtttcccattaaaattacttaaagaggttacgacaaaatgcaaggaaaaaaaaataaatatcttggatgtaaatcaagtgaaaaaaatagatattgataatagtaaaataagctttttaaatagttttataccattaattgatgataaaaatgaacattccattgttacattaattgaatataacggcattaatattctactgatgggagatgcaactgttaataatgaagacattctaatgaagagatataatttaccaaaaatagatattctaaaagttggtcatcatggaagtaggacaagtagttcgaaattatttattaaagatatagaacctaaaatcagtcttatatctagtggtaaaaataataagtatcatttacctaatttggatgttattcaaagattaaaatattatggtagtaaagtttttgatactcaagacaacggggaattaactataaatttagatgaagaagtttacatagtctaccgtgataatttaaatcaaaagagtttagctagagaaagtgtatcgtaa

SEQ ID NO: 750 - DNA, 732 bp, Staphylococcus epidermidis
attctatcctactcttttttaatacatataaggagtttaaaaatgattaaccttaaccaaagattatcaattgtatgctcatttattaaaagaggaacattggctgatattggttcagaccacgcatatctacctatatatgcaattcaaaacgacttatgcacaaaagcaatagcgggagaagtgattcaaggaccttataaggctgctaaaagaaatattgcaaattatgaattaaatcaacaggttgatgtacgtctaggcgatggtctaagcgttataaactcagaagaccaaattgataatataactgtttgtggtatgggagggccattaattgcaaaaatattaaacgatggaaaagataaattagttaaccatccaagactcatactacaaagcaacatacaaactcaagcattaagacaaactcttaataaactttcatatgaaatcgttgatgaaagaatcattgaggaaaagggtcacatatatgaaatcgtggtagctgagtttaataataacttagttaaattaaatatattacaagaaaaattcggaccatttttacttagagaatgtaataacatttttcaaaaaaaatggcaaagagagttagaagcactgcgtgatataaaatcccaattgaattcaacatcacatcatgagagactaaaagaaatagaagatgaaattaacttaatacaagaggtgttaattaatgaaaattag

SEQ ID NO: 751 - DNA, 273 bp, Staphylococcus epidermidis
ggagtgtcgtatatggaaaattttgataaaacaatgaaatttagttatgaagaaattccaaaggaagatgtcaaatcagttcttcagaatgtccatcgtacattagaagaacgtggatataatgcagttaatcaaatagtgggttacttattatctggagatcctgcatatattccacgtcaaaatgaagcaagaaaccaaatacgtcatatagaccgtgatgtaattatggaagaactcgtttcaaactatttaaaagagtctaagaattaa

SEQ ID NO: 752 - DNA, 888 bp, Staphylococcus epidermidis
ctacggcatcaacggactctatcggtacgcaagacttttgtcttgcgtatttttatgtatataattataaagaagcatagatataatgaattggaatcaaaggagctaaagatgaaacatcaattttcaaggaatgaattagcaataggacaagaagggctgaacttactaaaaaataagactgttgcagttttaggtgttggtggcgtcgggtcatttgcagctgaggcattggctcggactaatatagggcacatcatacttatagataaagatgatgtcgatattacaaatgtgaacaggcaaattcatgcactgacttcaactattggtcaaagtaaagtcacgctaatggaagaaagaatcaaattaataaatcccgattgtaaagtaacttctttgcatatgttttataccgaggaaacatacaaagatatcttcaataattatgatattgattattttattgatgcaagcgatacaatcatttataaagttcatctcatgaaagagtgtttagaaagaggaattgagttaatttcaagtatgggtgcagcaaataagactgacccgacacgttttgaaattgcagatatttcaaaaacacatactgatcctatggctaaagtaattagaaatcgtttaaaacgccttggtattcgtaaaggtgttaaagtagtattttctgatgaaagtcctattgttattcgcgaggacgtaaaagaaacagtaggagataaaaatgcaatcaatagaaaagggcaaatgcctccatcttctaatgcatttgttccaagtgtagtaggccttatttgtgcaagctacgttgtcaacgatattttaaaagatatacctgtaaggcgaattaaagataaaggacaaaattaa

SEQ ID NO: 753 - DNA, 1350 bp, Staphylococcus epidermidis
atattgagtcatcgttatataccattaacagaacaagataaaaatgaaatgctaaatagtattggggcaaaatctatttccgaattatttgatgatatacctacagatattttattaaaaagaaatttaaatattgccgaaagcgaagcggagacgatattacttagaaggttaaatcgtctcgcagctaaaaatacaactaaagaaacacatgcaacatttctaggtgcgggcgtttatgatcattatactccagctgttgtcgatgcaatgatttcaagatctgaattctacaccgcatatacaccttatcaacctgaaatttctcaaggtgagttacaagcaatttttgaatttcaaacactcatttgtgaattaacagatatggatgtagcaaattcttctatgtatgatggtatgactagttttgctgaagcatgtatattggcactaagtcatacaaaaaaaaataaaattgtagtttcaagtggactacattatcaagctttacaaattctacacacatacgccaaaactcgtgatgaatttgaaataattgaagttgaccttaaaggtactattactgatttagagaaattagaacaacttatcgatgacaacacagcagctgtcgctgtccaatatcccaatttttatggttctattgaagatttagaacaaattaataactatataaaggataaaaaagctttatttatcgtatatgccaatccactttctttaggattactaacacccccaggtacattcggggcagacatagtagtgggagatacacagccttttggtattcctacacaatttgggggtccgcattgtggatactttgctacaacaaagaaattaatgagaaaagtacctggtcgattagttgggcaaactcaagatgacgaaggtaatcgtggatttgttctcacgttacaagctagagaacaacatatccgccgtgataaagcaacttctaatatttgttcaaatcaagctttaaatgcacttgcatcttcaatagcaatgtcagctttaggtaaacaaggtatttatgaaattgcagttcaaaatcttaaaaatgccaattatgccaaaaataagtttgaagaacatggttttgaggtactaaaagcacaatcttttaatgaatttgtagtcaaatttaatcaaccaataaaaaatattaatcttaaattagcagaatatggatatattggtggttttgacttaggtgaagtatctgatgattttaaaaaccatatgttagtagcagttacagagttaagatctaaagatgaaatcgatgatttcgttacgaaagcaggtgagttaaatgattag

SEQ ID NO: 754 - DNA, 1095 bp, Staphylococcus epidermidis
acaaaatgtctaaagaaggtgttatatgtgaagaagttgtcgataaatacatttaaatataagaggaataaatatcttactgaaatacaatcaatagacttactacagagattacaacagcttttaagtcacggattcactttatatcaaagttttaaatttttaaactcctattttaaatataaagagcgaacaataaataaaaagattatccaacatctacaaaacggtgctacatgttatgatattttaaaaataatagggtatccagaattagttcttcttcaaataaaatttgctgaaaactacggcaacattgaggaggctctcgttgatactgttcaatatatgaaaagaaatctgaaagctaaaaaacgactcatcaaaaccttacaatatcctgttgcattaatttctatcttcttattcatattaaccattttaaatataactgtcatacctcaatttcaacaactttatgagactatgaatgttaaattatcaacatttcaaaatctactaactcttattattacccgtcttcccaaactaactttcatttttatctttattagtggtatagcattttttatcacttataaattctactattatctaccaattgagaaaaagttaaaatctattttaaaaatcccaatgattaatacgtattataaaatatatagaacttatcaactttccaatcaactttctttattttacagaaatggtacaagtcttcaacaaattgtccgtatatatcgtaatgagcaagataacgattttcttaaatttctgggtgattatctttttaaagaagctaataaagggctcccgttacctgttatattaatgaatttaaaatgttttcaaaatgatttgattaaattcatagaacaaggagagaaaaatgggaaattagatatagaattaaagttatacagtcaaatgctattacagcaatttgaagaaaaagtgttaaaacaaacaaaatttatacaacctatcatcttctttatcttgggaatttttattgtatctttatacttagtcattatgcttcctatgtttgaacttatgcaaacaataaaataa

SEQ ID NO: 755 - DNA, 1782 bp, Staphylococcus epidermidis
aaaggaagtctaaaaatgaataaaagaacaacgtattgtggtttagtcacagaagaatttttaaacgaaaaagtaacattaaaaggttgggttcataacagacgagatttaggtggattaatttttgttgatttaagagatcgtgaaggtattgtccaaatagtttttaatcctgacttttccgaagaagcattgcaagttgctgaaacagtacgctcagaatatgtagtcgaagttgaaggtgtagtaacaaaacgtgatgctgaaactattaacccaaaaatcaaaacaggtcaagttgaggttcaagtttcaaatattgagattattaacaaatcagaaacacctccattttcaattaatgaagaaaatgtaaacgttgatgaaaatattcgattaaaatatagatatttagatttacgtagacaagaattagcgcaaacttttaaaatgagacatcaaactacgcgttctatccgtcaatacttagataataatggcttcttcgatattgaaacaccagtattaacaaaatcaacacctgagggtgcgcgagattatctagtaccttcccgtgtacacgagggtgaattttacgcgttgccacaatcaccacaattatttaaacaactattaatgataagtggttttgataaatattatcaaattgttaaatgtttccgtgatgaagacttacgtgcagatcgtcaaccagaattcactcaagttgatattgaaatgagttttgtcgatcaagaagatatcatagccatgggtgaagatatgttacgtaaggttgtaaaagatgtaaaaggaatagacgttagtggcccattcccacgtatgacatatgcagaggctatggaccgttttggttcagataaacctgacactcgtttcggtatggaacttatcaatgtgtcacagcttggtaaagaaatgaattttaaagtttttaaagatacggtagataacaacggcgaaattaaagcaattgtcgcaaaagacgctgcaaataaatatacacgtaaagacatggatgcattaacagagtttgtaaatatatatggtgcaaaaggattagcttgggttaaagttgttgatgatggtttaagtggcccaattgctagatttttcgaagatgttaatgttgaaacacttaaacagttaacagaagctaaacctggagatttagtaatgtttgtagctgataaacctaatgttgttgctcaaagtttaggggctttaagaattaaattagcaaaagaattaggtttaattgatgaatcaaaattaaatttcttatgggtaactgattggccgttattagagtatgatgaagatgcaaaacgttatgtagcagcacatcatccatttacttcacctaaaagagaagatatcgaaaagctagacactgaacctgaaaatgtacaagccaacgcttatgatattgttctaaatggttatgaacttggtggtggttctataagaatacacgatggtgaattgcaacaaaaaatgtttgaagtattaggatttactaatgaacaagctcaagaacaatttggtttcttattagatgcttttaaatacggtgctccacctcatggtggcatcgcgttaggtttagatagacttgtgatgttattaacaaatagaacaaacttgagagatacaattgcattccctaaaacagcatcagctacatgtcttttaactgacgctccaggagaagtatctgataaacaactccaagaactctcactaagaatcagacactag

SEQ ID NO: 756 - DNA, 1461 bp, Staphylococcus epidermidis
atgaatattaataaactttattggaaggctttatactactggattaggtatcttaattataatgtaatttatcgtgataaagaggacgatgaaatatggttgtctcataagagaaaacattcaattgttgtatttagaaaagatgtcacatctacccaagagattaggtttgataaatcaaaaattatggaacgacctgaagaaatacaacaattcatcggttatatacctgaatcttatgaattttattattttacggataaagagctttcaaaagaaaatttaaatgaagaaaaaccaattaaactgaaatttaaaattataagcaatgagcaaagcttaaattcactccctataaactttttacttttaaaaatgctaattaataatgaagataaaaggacttaccttcattacaaaagaaaagttttaacacaaaatcttgttgataaacatatgcaacgttttacccctattacatatacacttatcttaattaatattgtgatatggttatgtatgattttatacttaaatcgattttctgatgttaaactattagaagtaggtggacttgttcattttaatgttgttcacggagaatggtatagacttatttcgtcaatgtctttacattttaatttcgaacacattttaatgaatatgctctctctatttatttttggtaaaattgtcgaatcaatcattggatcatggcgaatgctaataatttatataatatccggattatatggaaattttgtttctctatcatttaatacgactacaatttcagtcggtgctagtggagcaatatttggtctaattggttctatttttgtgattatgtatttaagcaagaattttaataaaaaaatgattggccagttattaattgctttggttgttttaatcgttttttcactttttatgtctaatattaatataatggcacatttaggtggatttatcagtggtgtattaattacattaataggctattatttcaaaacacaacgctctttattttggtcatttttgattgtatttttacttatattcatcattttacaaattagaatatttactataagtgaggataatatctatgataaattaattcgggatgaaatgattaaaggtaattatagcgaagcaaaaaatgttgtaaaacaaacacttaataataattacgccgatgatgaaacatattaccttagtggtttgattactgcaactaagagttcgcaagcagaggccgtatcagaatgggaaagaggtttaagaaaatttccaaattcaggtgtacttaattatgaattagctatagctaatcgttctttaagtgatgataaaaaggctttaaaatatataaaaaaagctgtagcaattaatcctaataataaaaaatatgttaatttaaaaaaagagttgagtaaatctaatgacacgaaaaattaa

SEQ ID NO: 757 - DNA, 441 bp, Staphylococcus epidermidis
atggatattaaaaaaattgaggaagtcattaaattggtaaaagctaatgatgtaaaaaaatttaagtataaggactctcataatgaaatagaacttgattttactaatggagcatctcaacaacattcgcaacaatcatctcaagatattcaacaagagaatattaaatccttagatgaaaagcaagagtccatatcaaatgaccagcaagagattaaatctcctatggttggaacatttttcttacaagatagtaaagaactaacagaacctaagattaaagttggcgatactgtaactgaaggagatattatcggttacattgaagctatgaaagttatgaatgaagtaactacggatgttactggtgaggtcactgaaatattagtagaacatggagacaatgttgaatatgatcagctactagtcagagttaaatag

SEQ ID NO: 758 - DNA, 369 bp, Staphylococcus epidermidis
ctagaaattaatatgaaacgttttaaatatgcatatgagggtttttgcgcaattttaaaaaaagaccaaaatttcttattacacattttagcggccataattattatcatattaggatttgtgttaaatattgatcgtatagattggatattaatcatcgtagctataggacttgttttaagttttgaagctattaatacctcaattgaatttgttgttgacctaattacaactgactatcatgaatatgcaaaatacgctaaagatatagctgcgtttagtgttgtcatcgtttcaatcgtttcaatatgtattgggttaatcgtttttttaccatatatattagaaatatttaagggaggaatgtaa

SEQ ID NO: 759 - DNA, 558 bp, Staphylococcus epidermidis
aatcattataaaggtaaaggtgaaaagatagtgggaatcataaaaaaattatttatgccaaatgcatatgtgaaatcaatatttgaaattgatatagaaaaacttgccgatagtggtgttaaaggtatcataactgatttagataatacacttgttggttgggatgttaaagaacctactaagggtgttaaatcatggtttgctaaggctaaagatttaggaataactgtcacaattgtgtcaaataataataaaagtcgagtatcaagtttctcaagtaatttaggtgtagattatatattcaaagcacgtaaaccgatggggaaagcctttaagatggctattaaaaaaatgaaaattcaaccgagagaaaccgttgttgtaggagatcaaatgcttactgatgtgtttggtggcaattgtaatggtttatatacaattatggtagtacctgttaaacggactgatggattaattacaaagtttaatcgattaattgaaagacgattattaaatcattttagaaaaaaaggttatattaaatgggaggaaaattga

SEQ ID NO: 760 - DNA, 696 bp, Staphylococcus epidermidis
agaggtgataagatgaatattggcattatcattttcatcatatctgtgataattacaggtgttagcgcattacgagataaaagtcacgaggacagacaaaatcaaagacccaatcaaaaaacctcaaacgagcaacatcaagaaggtggtttctttgaaaaattagaaaaaacttttcaagaaattagtgacgaattaaatgatgaacctgaaaaaaaacagagtaaaccttttgaaacttcattaccaccactgaacgaagattggaatgaaaatgaaaagaaaaaaacatcacatcataaagaaaaacaaaatacttcacaatccaaacgtcaaacaacgtctactcatgaacatcaaaatatccctcagccagataaaacaacatcaagagatgataattatgaaaaacttaagcaagaacttgaacaagatgtaactaaaaatttaattgacgtacgtaaagaaattgataaagaaaaagaaaagcaacttgttatgattgagaggaaagctcaagacattatcaacgataaatatctttcagaaagaacaaaacgatatagaataaaacaactactaaattctaggaatgttgagaaaaacatgtcgcgctctgcttttcaatatgatagtgatgaagttattaatggtattatttggtcagaaattttaaataaaccaaaacagctttaa

SEQ ID NO: 761 - DNA, 1509 bp, Staphylococcus epidermidis
atgattagtaaatcaagtcctttaatatttgaaagatccaaaaaagatagatatgcgtattcattaccacaaaatgacattgagaatatcagtattgcttcactcttagatgataagtatattcgtaaacataaggctgaatttcccgaggtttcagaattagatttagttagacattataccgaactatcaaataaaaatttcggggtagatactggattttacccattaggttcttgtacgatgaaatataatcctaaaatcaatgaaaaggtagcgcgtatttctggttttagtgaatctcatcctttacaagaagaagaacacgttcaaggttctcttgaaattatatatagtttacaagaagaattgaaggaaattactggtatggatgaagttaccctacaacctgctgcaggtgcacatggtgagtggactgctttaatgattttcaaagcttatcatgaaaaaaatggacaaagccatcgtgatgaagtaatagtgcctgattcagcacatggtactaatcctgcttctgcctcatttgctggatttaaatcagtaactgtaaaatctaatcaacgtggggaagttgacatagaagatttaaaaagagtagtaaacgataatacagctgcaatcatgttaactaatccaaatacattaggtatatttgaacagaatattattgaaatagggaaaatcgttcatgaagcaggaggtttattatattacgatggagcaaatttaaatgctattttagataaagtacgtcctggtgatatgggctttgatgcggtacatcttaatttgcacaaaacattcactggtcctcatggcggtggtggaccaggatcaggaccagttggagtagtagagaaattagccagttatctacctaagcctatggttataaaagataacgataggtataaatatgataatgatattccaaattcaattggacgagtaaaaccgttttatggaaatttcggcatttatttaagagcatatacttatatcagatcaatgggagccaatggtttaaaagaagtatctgaagctgccgttcttaatgcgaattatataaaatctcgccttaaaaatcactttgaaattccgttcaatcaatattgtaaacatgaatttgtattaagtggaactttacaaaaacaatatggtgtcagaacattagatatggctaagcgactgttagattttggtgtgcatccacctacaatatattttcctctcaatgtcgaagaaggaatgatgattgagccaacagaaactgaatctaaagaaacacttgattactttattgatgcgatgattcaaatcgctgacgaaacaaaaaatgatccagataaagttttagaagcaccacatacgactataattgatcgattagatgagaccactgcagcacgaaaaccaattcttaaatttgaagaacttaaggacgaaaagtataaagaacacacaaatattgattctgaagataattaa

SEQ ID NO: 762 - DNA, 1272 bp, Staphylococcus epidermidis
tattcaatccttatagggggtcaaaagatgggggaaaatacaaaacaagatttcaatcaaaaaggacaaaattttaaattcacaaaaaaacatagacgattattatatggttcagtttttttaatggctacatcagctattggtccagcatttctgactcaaactgcagtgtttactgcacaattttatgctagttttgcatttgcaatattaatttctattattatagatataggcgctcaaataaatatttggagaatattagtggtaactggattacgtggacaagaaatatctaataaagtattacctggacttggtactattatctccatactaattgcatttggtggtctcgcatttaacataggtaatattgctggtgcaggtttaggtttaaatgcaatgtttggtcttgatgtaaaatggggtgctgcaataacagctatttttgcgatacttatctttgttagtagaagtggtcagaaaataatggatgttattagtatgattctaggtatcgtaatgattttagtagtcgcttatgtcatggttgtttcaaatcccccttatggagatgcattagtacatacatttgcacctgaacatcctttcaaacttatattacctataattacattagttggtggtacagtagggggttatattacttttgcaggtgcacatagaattctagattctggtataaaaggtaagtcataccttcctttcgtaaatcgatctgctgtagcaggtattttaacaactggtgtcatgcgcaccttattgtttttagctgtactaggtgttgttgtaactggcgttacgcttagttcagaaaatccaccagcatcagttttccaacatgcattaggtcctataggtaaaaatatttttggcgtagtaatatttgcagcagcaatgtcctcagtaattggttctgcatatacaagcgcaacatttttaaaaacactacacaaatcgttactcaataaaaataatcttatcgttattacatttattgtaatttcaacttttgttttcttatttattggtaaaccggtgagtttacttataatagctggtgcgattaatggttggattctaccaatcacattaggtgcaattctcattgcaagtaggaaaaaatctatcgttggtaattaccaacacccaacatggatgcttgtttttggtattatagccgtaattgtcacaataatgactggtatcttttcattacaagatttagcaagtctttggaaaggttaa

SEQ ID NO: 763 - DNA, 2694 bp, Staphylococcus epidermidis
ataatactcaactatgactatctaactgcgataacaaaaacgtatgaaggagagtttttatttatgaaaaaaatgaaagctagtgaaattaggcaaaaatatttgaatttctttgtagaaaaaggacatatgattgaaccgtctgcaccacttgtacctatcgatgatgattcattattgtggatcaattctggtgtagctaccttgaaaaaatactttgacggacgcgaaactcctaaaaaaccaagaattgtcaattctcaaaaagctatacgaacaaacgatatagaaaacgtcggttttactgctcgccatcatactttttttgagatgctaggtaatttttcaatcggtgactactttaaacatgaagcgattgaatttgcttgggaatttctaacaagtgataaatggatgggcatggaacctgagaagctatatgtgactattcatcctgaagatactgaagcttttagaatttggcatgaagacattggtttagaggaaagtcgcatcattcgaatagaaggcaatttttgggatatcggggaaggaccatctggaccaaatacagaaattttctatgatcgtggatcggcttatggaaaagatgatcctgctgaagaaatgtatcctggtggtgaaaatgaaagatatttagaagtttggaatctagtgtttagtgagtttaatcacaataaagacaatacttacacaccactaccaaataaaaatattgatactggcatgggattagaacgtatgacgtctatctcacaaaatgtaagaacaaattatgaaacagacttatttatgcctataattaaggaagtagaacatgtttcaggaaaaaaatatttaattgatgatgcacaagatgttgcatttaaagttatcgcagaccacattagaacgatttctttcgcaattgctgatggcgcattaccagctaatgagggtagaggatatgtattaagaagattattacgcagagcagttcgctttagccaatcattaggaattaatgaaccatttatgtataaacttgttgatatagtcgctgatatcatggaaccatattatccaaatgtcaaagacaaatccaactttattaaacgtgtcattaaatcagaggaagaacgcttccatgaaacgcttgaggaaggtcttacgattttaaatgaactgataaaagaagcgaagaatagtgatcaggttattaaaggtcatgatgcttttaagttatatgatacttatggattcccaatagaattaactgaagaattagcaactcaagaaaatttgtctgttgatatgcctacttttgaacaggaaatgcaacaacagagagatcgagctagacaagctcgacagaattctcaatcaatgcaagttcaaagtgaagtactaaaaaatattcaagatgaaagtcaatttgttggctatgaaactacggactatcaatcattaataactcatatcatatacaatggtgaagaagttaaacatgttgaagcaggagaaacaatttactttattttaagagaaacgcctttctatgcagtaagtggtggacaggtcgcagataagggaacagttggtaatgagagctttgaaataaatgtaactgacgtaactaaagcgcctaatggccaaaacttacacaaaggtattgtgcaatttggtgaagcaacacagaacgcgaaagtagaagcacgtgttaacaaagaggatagacgacttattcaaaaaaatcatagtgctacacatttattacatgctgcattaaaagaagtattaggagatcatgttaatcaggctggttcgttagtagaacctgaaagactacgttttgatttctcacattttggtcctatgacacaagaagaaattaatttagtagaacgtagagtaaatgaagaaatttggagagctatcgacgtccgtattcaagaaatgagtattgaagaagccaaatcaataggcgctatggctttatttggtgaaaaatatggagatattgttcgcgttgtcaatatggcaccattttcaatagaattgtgcggtggaatacatgtgaataatactgcggaaattggtctctttaagattgtgagtgaatctggaacaggtgccggtgttagaagaattgaagctttaacaggtaaaggtgcattcttacatcttgaagaaattgaaacacagtttaataatattaaaaatcatttaaaagttaaatccgataaccaagtagttgaaaaagttaaacaacttcaagaagaagaaaaaggactgcttaaacaattagaacaacgcaacaaagaaataacatcactaaagatggggaacattgaagaacaggttgagttgattaataatttgaaagttttagcaacagaagtagaaattccaaatccaaaagcgatacgttcaactatggatgactttaaatctaaacttcaagatactattatagtgttagtcggacaagttgatggaaaggtttctgtaattgctacagtaccaaaatcacttacaaatcaagtaaaagctggagatcttatcaaaaacatgacaccaattattggtggaaaaggtggaggtcgtcctgatatggctcaaggtggcggaactcaacctgaaaaaataacagaagcattacgctttattaaagattacattaaaaatctataa

SEQ ID NO: 764 - DNA, 498 bp, Staphylococcus epidermidis
aagaaggacaaaaaacatgtaaatccggtcagacaattagtattgcaaatggagaagcagttgccaattaaaaacattaaagcatttagtttagtcgagatgatttttactttatttattatcagttgcttgttgataacaactttatggtcacgaagcctgttcgacattcagctaattgatgaagaatatgaaattaaacaattaataacaaaatttaattactataaatctaaagctattagcaacaacgaatcaataactttattattttttaataattcaaatagagtacaagtaattgaagaaaatggagataaatatagttttaaacttaataaaggcaaagtgattaatatagctaaaattcaaacattaaattttgataaaaatggaaatataaatcattttggatcgctcattttacaatataattcacatgcttatagattaatcttccatattgaaaaggggcgtttgagatttgtcaaaatataa

SEQ ID NO: 765 - DNA, 399 bp, Staphylococcus epidermidis
ggaggatgcaagatgagtatctctttgtacattgcaattggtattattgttattatcattgcatatatgattatccaacaaattcttaataagcgagctgtaaatgaattagaccaaaatgaattccataaaggtttaagaaaagctcaagttattgatgtgagggaaaaagtggattatgattatggacatattaatggtgcacgtaatattcctatcacagtatttaagcaacgatatcaaggactaagaaatgaccaacctatttatttatgtgatgctaatggtatagcaagttatcgtgctgcacgtatattaagaaaaaatggatataaaaatatttacatgcttaaaggcggttacaaaaaatggacaggtaaaataaaatctaaaaagtaa

SEQ ID NO: 766 - DNA, 957 bp, Staphylococcus epidermidis
tggattagcaatatctataaaaggagaatgactatggttgaattattagttactcctaagtcaataactcatatggaaacactaatagataaaggtgcagacgcatttgttattggtgaacaaaaatttggtttaagactgccgggagaatttaatcgtgatgctatgcaagaagctgtagcattagcccataaaaataacaaaaaagtatacgctgctgtgaatggtattttccataattaccacttagatgccttggaagactatattaactttttacatgatattcaagtagatcgcattatatttggtgatccagctgtcgttatgtatgttaaacaacacgagcatccaattccattaaattgggatgctgaaactcttgtaacgaattattttcagtgtaattactgggggaaaaaaggtgcaaatagagcagttttagctcgagaacttagtttagatgaaataattcatattaaagagcatgctgatgtagagatagaagttcaagttcatggtatgacttgtatgtttcaatccaaaagaatgctattaggaaattattatactttccaagagcgacaaatgaagatagaacgccaacatgatcatggagacttattattatatgatgaagaaagagataataaatatccagtttttgaagattataatggtactcacatcatgtctccaaatgatatctgtttaatagaagaattagagcctttttttgaggcaggaatagatgcgtttaagatagatggtattttacaaagtgaagaatatataaatgtagtcacagagcaatatcgagaagctatagatttatttaatgaagatccggatgcatatgaagatgaaaaattcatgctcgttgatcctatagaagaaatacaacctgaacatcgtccattcgacgaaggtttcttgtataaacaaacagtatattaa

SEQ ID NO: 767 - DNA, 1386 bp, Staphylococcus epidermidis
tcagagttaaataggaggaattcaatgatgtatcgatgtttgattgcaaatagaggcgaaatagcagtaagaattataagagcttgtagagagcttaacatagagacagttgccatttatgcaaaaggtgatgaaaatagcttacatgtaagtttagccgatcaagcaatatgcataggtgaagcaaatccattagacagttatttaaatattgatcgtattatatctgctgcaaaagttacagaatcaaacgtaattcaccctggctatggtttcttatcggaatctacgaattttgcgaaagccgttgaagacaatcatatacattttattggacctagtaagacaactatggaaatgatgggggataaaattactgccagacaaactgttaaacaagcaggagtacctgttataccaggttctaatgatgctgttcaaagtgtagatgaaattaaattattatccaaagaaataggatttccagttgtactaaaagcagctagtggtggtggtgggaaaggcatcagaattgttaaagaagcatctcatttggatcaggctttgaaagaagctaaaagtgaaggacaaaaatattttaatgatgatcgagtgtatgtagaggcgttcataccagtagcaaaacatgtagaagtgcagattatcggagacggtaaaaataactatgttcacttaggtgaacgcgattgttctgttcaacgaaagaatcaaaaattaatagaagaagcgccttgtgctgcattaactgaagaaagaagaacaagaatatgtggcgacgcagttaaagtagctcaagcttcaagatatcgtagtgctggaacaatagaatttttagttacagaagatgcacattattttattgaaatgaatgctcgtattcaagttgaacatacagttacagaaatgcgtgctgatagagacctattacaagctcagttatatttattaacacacggtgaattaccattcactcagaaagatattttatttaatggtcatgtaattgaggcgcgtataaatgctgaaaatcctgaaaaaaactttttacccactccaggaaaagttaataaattacacttaccacaaggatttaatatacgtgtagattctttactttacacaggttatcaggtttctccttattatgattcacttgtagctaaagtgattgtaaaggattctaatagacaaactgctattaataaattaaaagttgcgttagatgaaatggtcatcgaaggttttactactacagctgactttttatatgcggttttaaattatccaatatatgcaaaaggcgatgccagtaaagtagatataaaatttcttgaaaaacatcaaatcattaaagaggtgaaatga

SEQ ID NO: 768 - DNA, 348 bp, Staphylococcus epidermidis
caatcgataaaatcaacgcataatcgtatgattactgttgatattacggttaatgacgaaggtaaggtcacagatgtagtcatggatggtcatgctaatcatggtgaatatggtcatgatattgtctgtgcaggagcatcagcagtcttatttggaagtgttaatgctataatgggattaacatcagagaagccagatatcaactacgaagatgacggcggatattttcatataagaagtgttgatacgaataacaaagaagctcaattaattcttcaagcaatgttagtttctttacaaactatagaagaagaatataatgaaaatatcaaattaaattataagtga

SEQ ID NO: 769 - DNA, 189 bp, Staphylococcus epidermidis
ataacggtaaaaccttttctgaaccatacgcatagcgcatggttttctttatacaataaagaagccagtaatgaatttataaaaaattcatttactggctattttgctaggaattatatcccagactcattgaactcaaaatttatatatattactatccggaaccgagtttggaaagtacttcaatga

SEQ ID NO: 770 - DNA, 297 bp, Staphylococcus epidermidis
gatttgtcaaaatataaatttaaagggtctttaattattgatgcattgctagccttttttatagttagtacaataacaatgattttaatacctatgttttcaaacttaaacaatcagtatcttatcaatttaaataatataaaaatcaagcaaatcatgataactagccttcaacactataaaaagaaagaactttatcaaggggttgtaatagaaaattatgaaatacaattattcaataataaaatatgtggggaggataaagcatttaatacgcgaacatgtatttcaatttaa

SEQ ID NO: 771 - DNA, 1020 bp, Staphylococcus epidermidis
agaaatcgaaaaataaaaaggagcgatttaatgtttagtattggttttataatcattgcagtcattatagtagttgcactactcattctgttttcatttgttccggtcggattatggatttcagcactagctgctggagtacatgttggaataggcacacttgtggggatgcgtttaagacgggtttcaccaagaaaagttatcgcacctctgatcaaagcgcataaagctggtttaaacttaactacaaatcaacttgagtctcattacctagcaggcggtaatgttgatcgtgttgtagatgcaaacattgcagcacaacgagcagatatcgacttaccatttgagcgaggcgctgccattgatttagcaggtagagatgtattagaagcagtacaaatgtcagttaatccaaaagttattgaaacgccatttattgcaggtgtagcgatgaatggtatcgaagttaaggcgaaagctcgtattaccgtacgcgctaacatagcaagacttgttggtggtgctggtgaagaaacaatcattgctagggtcggagaaggtatagtatctacaattggttctagtgagcatcatacagaagtgctcgagaatccagataatatctcaaaaacagtactaagtaaaggtttggactctggaactgcattcgaaattctatctatcgatattgccgatgttgatattagcaaaaacatcggtgctgatttacaaacagaacaagcacttgctgataagaacattgcacaagctaaagcagaagaacgtcgcgcaatggctgttgcttctgaacaagaaatgaaagcgcgtgttcaagaaatgagagctaaagttgttgaagctgaatccgaagtgcctttagctatggcggaagcattaagatcaggcaatattggagttaaagattattataaccttaaaaatattgaagcggatacaggtatgagaaatgcaataaataagcgcactgatcaaaacgatgatgaatcaccacaacaataa

SEQ ID NO: 772 - DNA, 693 bp, Staphylococcus epidermidis
tcgtgtagaaatgagggagaaaagatgcacgaacaaagtaagatataccaaaatattaaagatggtaaattagataccgctttgaaagacttgtttgaaaatatagaagaaaatccggccattgttgaaaattatattaacgcaggtattgtattatcagatgttggagaaattgaaaaagcagaacgttttttccaaaaggcattaactattgaacctgaaaatggtgctgtttattataacttggcaaatatttattataatgaagaacgttataacgaagcgataaagctatatcaaactgcactacaatatgaagtagcgaaaaaagattgtaattatatgattggtatgtcgtttaatcaactaggtgcttttaaagaagctttaccatttttaatgactgcagctgaaatggacgatgatagagatttagaagtacagtttcaatatgggttagtactatgccaactcgaaatgtttgatgaagctattaaacaattaaataaggttctttctatcgattcacagcacgtagatggtatatataatcttggtttagcaacatatatgaaaaatgaaaatttagatgaagcaattgcatattttgaacaagcaatatcaattgatgaaaaacatttacttagtcaacatgcattaaagacattcaaaacaatgaaagaggaggaataa

SEQ ID NO: 773 - DNA, 519 bp, Staphylococcus epidermidis
attaatttgaagagtattcaagtgcctattattttagttggtttcatgggaactggtaaaactactgttggaaaatatctttcagatttatataatttaagttatgtggatttagataattttattgaagtaaatgaatgtaaatctatacctaatatatttaatgatatcggagaaaaaggatttagatcattggagactagatacctaaaatcttgtctcaatactttcgatattatttcaactggaggaggtattatagaagatacgaattcattaaagctcttaaaaaatcaaaagcatgtagtttggctagactgtgacattgaaatcattttcaaacgagttaaaaatgattcacatagacccaatgctaaaagtaaaaatcttaaccaacttgatgccttgtattcttcaagactttcaagatataatgaaatcgcattcatgaaagttgatagtgcacagagtgtttctgaaatttgcactttaattaaaacaaaattattaagcgattga

SEQ ID NO: 774 - DNA, 498 bp, Staphylococcus epidermidis
aaaattatgaaatacaattattcaataataaaatatgtggggaggataaagcatttaatacgcgaacatgtatttcaatttaatataaaagcatttacttacatcgaagcattatttgctttatttgtgactactttaattctcgctttattacctactatacttaaattgacttcgttttatcttaatactgctcaaaataacgaagatattcaatttgaattttttagaagagatttacttaaagagaaaatgacgactcaaaacaattatgagatagaaaatgcatatacaattaaacttaagaaagataaagatgttattagatatatttataaaaaccgtaaaatttacaaaaacattaatcaaaaaggtaatattacattgttaaatcacgtcttgtctactcgtatattaaaaacgaacgataatatagtaaaattattaataacaacaggagaaacgaacgatgaacacaaagaaatcctgtttatatag

SEQ ID NO: 775 - DNA, 276 bp, Staphylococcus epidermidis
aaaggtgtgaaaaatgtgagtacagaaccattagcctctcgaatgagaccgaaaaatatagatgaaattatatctcaacaacacctgtttggtccgaaaggtataataagaaggatggtagatactatacgtctttcttctatgatttcttatggtccacctggaattggtataacaagtattgcaaaagcaatttcaggcagtacacaatctaaattcagacaattaaatgccggtccaaataccaagaaagatatgcacctaattgtcgactaa

SEQ ID NO: 776 - DNA, 210 bp, Staphylococcus epidermidis
caacaggagaaacgaacgatgaacacaaagaaatcctgtttatatagccgaaaagcgttcattagtttatatttaatagtaattttttcaatttatttatcaattatatctttttatatctctcaatatagtttaaaattaaagacaatacataacttagatgtttactacaataaagttatcgttaataagttaaaagaggtagattaa

SEQ ID NO: 777 - DNA, 2448 bp, Staphylococcus epidermidis
aagaggaggaataatatgtctgaccctacactttttgattattcaatgatcaaaggtacagttgatgctattttatttcaaaatacggataatttttatactgttctaaaagtagatactatagaatcaaatgaaaaatttgatagtatgccaactgtggtagggtttcttcccaatgtagttgaaggcgatgtttatacttttaaagggcaagtcgtacaacatccacgttatggtaagcaattaaaggctgaaacatttgaaaaagaattacctcaaactaaagaagccattattagttacttatcaagtgatttatttaaaggcatcggtaaaaaaacggctcaaaacattgtaaatacactaggtgaaaatgctataaatgatattttaactcgtccagaaatcttagaaagtgtacctagtttaccaaagaagaaacaaaagcaaattgctgatcagattaatgcaaaccaagaatctgagaaaattatgatacgtttacacgacctagggtttggtccgaaattatcaatggctatatatcagttctatatgggtgatactttaaatgtcttagataaaaatccttaccaattagtatatgacattaaaggtattggttttaataaggctgaccaacttgctcgaaatgtcggtattgagccacattcacctgaaagattaaaagcagcattattatttacgttagaagaagaatgtatcaaacaaggacatacatatctacctcgtacaattgttatagaaacaacacaaaatttactcaatgaagatattgagaaaccaattgaaacagagcaattactagaaatcattgacgttttatcagaagagaaaaaattaatatctgaagctgatcaggtatcaattccaagtttatactattcagaattgaaaagtgtgcaaaacttataccgaattaaaacaaacacatctaaattaaaagaaatagaacagtctgatttacaaatacatattggtgatattgagtcacaaaatgaggttaattactctgcctctcaaaaagaagcgcttgaaacagcaataaattctaaaattatgcttttaactggtggtccgggtaccggtaaaaccacagtcattaaaggtatagttgaattatatgcagaaatacatgggctctcgctcgattatgatgattacaatgaagatgattatccagtagtgttagctgcacccactggtcgtgcttctaagcgccttcacgaatcgacaggtttagaagcaatgacaattcatcgtttaatcggttggaaccaagatacacaaccacaggatattttagaaaatgagatcaatgcaagactcattatcatcgatgaaatgtcaatggtagatacttggttgttccatcaatttttaagcgctgtgcctttagaagcacaaattgtatttgtcggagatgaagatcagttaccatcagtaggtccaggacaggtatttaaagaccttattgattctgaaataataccgcgtgttaatcttaccgaagtatatcgtcagcaagatggttccagtattattgacttagctcaccgtatgaaattaaatgaacctatcgatattactaaacgttatcatgatcgtagttttattcgttgtggtacgaatcaaattccagacgttgttgataaagtagttaaaagcgctgtagctaaaggctatgatatgagtgatatacaagttttggctcctatgtataaaggtaacgctggtattaagagacttaaccaagttctacaatctattcttaatccgaagcaacaagatgatcgtgaaatagaatttggtgaagctgtgtttagaaaaggggataaagtacttcagttagttaatcgacctaatgataatatatttaatggggatataggtataatagtaggtatattttgggccaaagaaaatgctctaaataaggatgtgttagttgtagattttgaaggtaatgaaattacatttactaaacaagatttaatggaactaacacatgcatattgtacatctatccataaatcacaaggttcagaatttcctattgtaattatgcctattgttagacaatattataggatgttacaacgtcccattctttatacaggattaactagagctaaacaatcacttgttttgcttggtgaacaagaagcatttgatataggtttaaaaacaaatggacaaatacgattaacgcaattaaatgatttgttaaaatcgtattttggacaaaacaaagataatttaactacaaataaacaaacgattaacgaacaaaaagaaaataacaatcatctggatttgaaaaatgaaaaagaaaatgatatccaattaaacgagtcgacaattttccaaatcgatccaatgattaatatgggggaaatgacgccatatgacttcgttgaacgttga

SEQ ID NO: 778 - DNA, 189 bp, Staphylococcus epidermidis
ctttcacttgagggatcgattaatattacattttcttcattctcaatgaaatacgtattagtatcaactattcctaatgttaaatttgaaattcgcattataattcaccactatggtctagatgtttttgtactgattttaatttatcattcatttttcttgatttatctcgacgatcatcaattctaa

SEQ ID NO: 779 - DNA, 270 bp, Staphylococcus epidermidis
gaaaagaacctagtgacaataactgaggttctttttattaattataggccattggtcgtatttattaaaatttatgcatttttatgtttaatcttcacaaatttgagatatatttatagtatatcaattagtaggtttagaaaaatattaacaagattcacattaacaattttgtttaattgtcgtgtgagtcgggaaaataatttaataattaaaacttttttgaaagcatattctttgttgcttataaatctacttgttatgatatag

SEQ ID NO: 780 - DNA, 615 bp, Staphylococcus epidermidis
aggagtactgacatgtatgcatatattaaaggaacattatctcagttgttccctacacatgtagtggttgagacatgtggcataggttatgagatacaaacgcctaattcctatcgttttcaaaaatatcttgaaaaagaagtccaaatttatacttcactaattgtacgagaagatgctcaactactatatggctttattaatgaagaggaaaaagaaatgtttcttagcttaataaaagtgactgggataggacctaaatcagctttagcgatacttgcttcaagtacaccacatgaagttaaattggctatcgaaaatgaaaatgatgcttatttaacacaatttcctgggataggaaagaaaactgcaagacaaattgtgttagatttaaaagggaaggttacaattactgaagaaaatagtgacgatttattacaaactcaagttaatggtaatgaacaaaaccaaataatatctgaagcactattagctttacaagcactgggctattctaaacgagaattaaccaaagtagaaaaatccttaaacaaacataatgtgaatagtgtggatgaagccgttaaaataggactacaaacactagtttcttaa

SEQ ID NO: 781 - DNA, 651 bp, Staphylococcus epidermidis
caacatgatgagaaaggaaattggctaatgaatcagacaacgattattggcattgcagggggttcaggctctgggaaaaccacagttactaatgcaatcatgaagaatttagaaggtcatagtgtcgcactcttagcacaagattattactataaagatcaatcacatttaacttttgaagaacggcttgaaacaaattatgaccacccatttgcatttgataatgatttacttattcataatttaaaagatttaagaaatggaaaaccagtagaggtacctacgtacgattattctcaacatacacgtagtaaagaaacaattgcatttgatccaaaagatgttattatcgtagaaggtatctttgctttagaaaacaacacattacgagacatgatggatgtgaaaatttatgtcgatactgatgctgatttacgaattttacgtaggcttacaagagatactaaagagcgtggtcgtacaatggaatcagtaattaatcaatatcttaatgtagtaagacctatgcatgagcaatttattgaacctacaaaaaagcatgctgacatcataattcctgaaggaggcagcaataaagttgccatagatattatgactactaaaatccagtcactcgtaagcaaaaaatag

SEQ ID NO: 782 - DNA, 780 bp, Staphylococcus epidermidis
  unsure (118): Identity of nucleotide at the above locations are unknown.
aaggttggtgatcaactgatgctaatgacacaaaagggcatcattatcaaatctgttgattatggtgaatcagacaaaattattacaattttaaatgaatacggagctaaaataccantaatggccagacgagcaaaaaaagttaagtctggacttcaagcaaatacacagcttttcgtatatggcttatttatatataataaatggcgaggcatgggaacactaaattctgttgatgtgattaatcaacattatgaactccaactcgacttatttgaaagtagctatgcatctttatgtgctgaaacaattgaccgatcaatggaagagaatgaggtttcaaaatataattatgacttacttcaatttgttctttccaaaattaacgaaggaacccctgcacaattaatgtctgtaatcgtcttattaaaaaatatgtctaaatttggattcacagcttcatttgatcactgtgcaattaccggcattcaagatcaatcaaaacttatagcgtatagttttaaatttgacggtgctatttcagaatctgcattatatcaggatcaacatgcttttcatctctctaatcgcaccttatatcttcttaatatcctgcagcaattacctataagtaagatgaatcatttaaatattcagcaagacatattaaatgaaatgtctgaactacttatcatgctttatcgtgagtatgctggtatgttttttaaaagtcaaaaattaataaatcaattaaatagattagaaaaagattcattgtaa

SEQ ID NO: 783 - DNA, 726 bp, Staphylococcus epidermidis
gggcgaggtgaaaaaatggataacttacatctaatacatatgctatttatggcaaaacctttaaatggaatgaattgggttgaaaaccttgcacagtttatcactcaaccttttgtttctcttattttcacttgtattatatttattggctttttataccaactatattcaaagcgcataaacttaatgggaataatagcattacttgctttactacttttatttttagcattcctaattaatggcgatgtcaatgtgatgtcagtattactgtttacaattggcctcatactactgattgttgaattatttgttataggcgctgtaataggtattattggtattattctaataacactaagtattattatacttggtgacaatattttattaatgcttggaaatgttatagttgcattaatattatcaattgtagaatgggtgattttagtgaaaatattcaatagaaaaattccatttttagataaagttattttaaaggattcaacaaattctgaagcaggttatcgttcacatgacgaccgctctcatcttgtaggaaaaactgcacatactgttaccgatttaagaccagcaggaattataacttgtgacaatgatcgaatagacgcagtatctgatggatcatttattttacgtaatcgacaagttaagattcttgaagttgaaggtacacgtgttgttgttagagaaatcgaaaaataa

SEQ ID NO: 784 - DNA, 630 bp, Staphylococcus epidermidis
agacctatagaattaagtcaaagacaagaacaaataatagagattgttaaatcggaaggacctatcacgggcgagcatatagctgaaaaaatcaatttaactcgtgctacattacgtcctgacttggctatactcacgatgtctggttttatagaggcacgtcctcgagtaggttatttctattctggtaaatctaaaaataaaatcataaacgaaaaattacgaaaatatgttgtaaaagattatatgtcgcatcctgttgtcataaaagaaaacatgactgtttatgatgctatatgtaccatctttttagaagatgtcagtacattatttattacaaatgagaataacgattttgtaggagtatgttctaggaaagacttacttcgtgcctcaatgattggtgaggacatacatacaatgcctatcagtgtaaatatgactagaatgcctcatgtttcatatttaaaagaacaggaactcgttatttatgctgcaaatcaaatgattgataaagagatagattcattaccaattgttagacctaaagaaaacgacaaatttgaagtaataggtcgcatctctaaaacaacaatcactaaattattcgtttcattatttaaagaatag

SEQ ID NO: 785 - DNA, 1068 bp, Staphylococcus epidermidis
ttattaatagattatcagtatttactaaaatcgggaggccttttcatgtctgacaaccaagttaaaattaaaaagcaaacaattgatccgactttaacactagaagatgttaaaaaacaattaattgataaaggaaaaaaagaaggtcatttaagtcacgaagaaatcgctgaaaaactgcaaaattttgaaatggactcagatcaaatggatgatttcttcgaccaattgaatgacaatgacattacacttgttaatgaaaaagatagttctgacacggatgataaaatcaatcctaatgatttgagtgcccctcctggtgtcaaaatcaatgacccagtgcgtatgtatttaaaggaaattggtagagttaatcttttaagtgctcaagaagaaattgagcttgcaaaaagaattgaacaaggtgatgaaattgctaaatcacgattagctgaagcaaacttgcgtttagttgttagtattgctaaacgatatgttggtcgtggaatgttattcttagatttgattcaagaaggtaatatgggcttaattaaagctgtggaaaagtttgattttagcaaaggatttaaattttcaacatatgccacttggtggattagacaagctattacacgagcaattgctgaccaagcacgtacaattcgaataccagtacacatggtagaaacgattaataaattgattcgtgttcaacgtcaattattgcaagatttaggaagagatccagctcctgaagaaattggagaagaaatggatttaccaccagaaaaagtcagagagattttaaaaattgcacaagaacccgtttcattagagacgccaattggtgaagaagatgatagtcatttaggagatttcattgaggaccaagaagctcaaagtccatctgaccatgcagcatacgaattgttaaaagaacaattagaagatgttttagatacacttactgacagagaagaaaatgttttacgtttacgttttggtttagatgatggacgaacaagaacactagaagaagttggaaaagtattcggtgtaaccacgtga

SEQ ID NO: 786 - DNA, 852 bp, Staphylococcus epidermidis
cttttgatagatgcgttattaaattttgattttattagatattctttgattagcggtctgcttattggctttatcgcaccattaataggtgcatttattgtagttcggagactatctttaattgctgacgctttaagccacgtgacattaggtggtatttcctttggtatgtttttgcttaccattattcccgttttctcagtaataaaccctatgtggtttggtattctttttgctgttattggagcgttattaattgaaaaattaaggacttcgttttctaattatcaagaaattgcaattcctattataatgagcgctggtattgctctaagtgctatttttatttctctagcagatggttttaatcaagaaatcgtaggcctactatttggatcaattagtgcagtaaatattagtgatttaactacaattattatcattacaataattgttctcatatttattgttttattttataaagaattgtttattttatcatttgacgaagaatatagtaaggtcataggtataccaaagtggattcaatttttatttatagtaattgttgctatggtaatatctgcatcaatgagagttgtaggtatattattagtaagcgcgttaataactcttcctatagcaatttcaatgagaataactaaaggatttaaacaattaatagcattaagtgttatattaggagaattatctgtaattctaggattaattatagctttttatatgaatatatcacctggtggcgtcattgttgtactattggtattaatgctcatactaacgatgattattcagaagttaaaaattaagtttaaaaagggagtcgtttaa

SEQ ID NO: 787 - DNA, 354 bp, Staphylococcus epidermidis
atgaattcagaagaattattaaatattgctgtcgaagcggcagagaataagaaagcagaagatattatttctctcaatatgaatgaaattagtgatatgacagattattttgtagtctgtcacgggaacaatgaacgtcaagttcaatccattgctagatctgttaaagaagtggcacataaacatgatattgacgttaaacgtatggaaggctatcaagaagctcgatggatacttattgatttagcaaatgtagttgttcatgtttttcataaggatgaaagaagctattacaatttagagaaattatatcaagatgcacctattaaagaatacggtcaggcagtattttag

SEQ ID NO: 788 - DNA, 1164 bp, Staphylococcus epidermidis
tttgacaaggagtgtccaaacatggaagtatacgcagattatgctgcgactacgccagtaaaaccagaagtaatagatgctatgatggaaatatatcaatctcattttggtaatccatcgtcaatacattctattggtagagatgcacgcaaatatcttgatcagtcacgtcgtacagttgcacaattgttgggagcgaatccgaatgaagtaatatttacaagtggtgcaacagaatcgaataacactgctattaaaggattagtgaaagcgaatgaacaattaggtaatcatattattactaccaaaattgaacaccattcagtattacacgtatatgagcaacttgaaaaagaaggttatgatgttacgtatctagatgtagatgatactggtgcagttgatttagaccaattaaaagaaacaattaatgatagaacaattttagtatcaattatgtttgtaaataatgagattggaacagtacaaaatatttatgatattgaagatattattggagacactcatgcgttattccatgttgatgctgttcaagcaattggacatttagatttagattttcataattttaaaattgatacaatgagtatttcagcacacaaatttggtggtcctaaaggtgttggtctactattagtaaaagagcatacaccaatagcatataatcaacttggtggtgaacaagaaaccaaacgtcgagcaggtacagaaaatttacctcaaattgttggattaacaaaggcacttgaattagctataaccaatcaagatgtaaataatgttcatttaatgaatttaaaagaattatttttagttcagttacaggaaagggcaattccatttgaattaaacggttcaatgacagattcaacgggtcatattttaaatatttattttccatttatagatgttgaaacaatgttaacattattggatttagcccatgtatatgtatcttcaggttctgcttgtacagcaggttcaacgactccatctcatgtacttgcagctatgtttgaagatgaagaacgagcaaaacattcagtacgttttagctttaatgaacaaacaacaacgcaagaaattaaatatattgtagctgaaattcataaaatctatcataaatttaaggaggaatcatag

SEQ ID NO: 789 - DNA, 996 bp, Staphylococcus epidermidis
tatatagaggaaggtgtacgtatgagcaacaatatcttcactgtctacggtgaagtaccagaattagtcgaaaagaaaacaaaagaaattgtaaatgattatctaggacaagagatagatgactttaattatgtaaaatacaacttgtatgagagtgacctaactccgattattgaagagacacttactatgccttttttctcaaataaaaaagcaattgttgtaaagaactcgtatgtttttacaggggaaaaattttctaaagatttaaatcacaattctgacgagcttataaaatttttagaaaaatatgatggtgaaaatctcattatctttgaagtgtatcagcctaaactagatgagcgcaaaaaactcacgaaaacgttgaagaaaaatgcacaacttaagaaaattgaacaaatgtctgaaaaggaattaaagcattggattaaaaatacactaaacaataattataaagatattaagcaagatgctcttgaattatttattgaattaactggtgttaactataatattgtttctcaagaattagaaaaattaattttattcataggtgagagacctataattaataaagaagatatcgatttaattattaatagaagtttagaacaaaatgtatttctactaactgaatacattcaaaaaggtaataagaataaagctatacaattagtcaatgatttaatcattatgaaagaagaacctataaaattactggcattaattactagtaattatagattatattatcaatgtaaaattcttagtcaaaaaggctatagtgggcaacaaattgcaaagactgtaaatgcacacccttatagagtaaaactagcactcaatcaatcccgacattataaactagaaagtttgtttaacatcataaacgcttgtgcagagactgactacaaactaaaatcatcttatatggataaacaactcattttagaattattcatactatctctataa

SEQ ID NO: 790 - DNA, 1173 bp, Staphylococcus epidermidis
ctttttcattgtcttctccctaaaccaaaaactattattattattactagttatgctatcattttaatgtataaaataaaaatgtacaaatgtaaacgtaggagggaaaaaatgaataaattaagaaaagttctagatatcattgaacataagcacttagatgcaatcatagtattatcagattataatagacgttatctttcagatttgactggtacaagtggtgcactaatcataacacctaaaaaacaatatcttattactgattttagatatatagaccaagctacagaacaggcacaggattttgaaattataaatcgaaaatcaagtttgatttctgaaattaaatccatattagaaagagaaaatttatcaaatattggttttgaaggtcatttaatcagttatgatacttatgttgaacttaataaaggattaattactttaataagcatatctaatgaaattgataagattagagaaattaaaaataaggaagaaattcagctcattcaaaaagcggctaagatagtagatcaaacatatgaatatatcctcactcaagtaagtatcggaatgacagaacgagaaattaaagctaaattagaaagtaagatgttagaattaggcgcagatggcccttcattcgacacaatagtggcttcaggttaccgaggtgcgttaccgcatggtgttgcaagtgataagcgtattgaaaagggtgatatgattacattagattttggtgcatactatagaggatattgttcagatattacgcgcacgtttgcaataggagaaccggatccaaaactcaaagaaatatttaatatagttctaacttctcaaaagaaagctattgaacaaatcaaaccaggtatgactgcaaaagaagcagatgctatatctagagagtatatttcatctcacaactatggtgagcagtttggccattcacttggtcatggtatcggccttgatattcatgaaggtccactattatctcaaaatagttcagatgaattaaaaataaataactgtgttactatagaaccaggcatatacattgagggattgggtggcgttagaatagaagatgacattcttattacagaaaatggatgtcatgtctttactaaatgctcaaaagaccttattattttagagtaa

SEQ ID NO: 791 - DNA, 942 bp, Staphylococcus epidermidis
tcaatgaattggatggaactctcaattgtagttaatcacgaagtagaatacgatgttacagaaattcttgaaagttatggctctaatggagttgtaattgaagattcaaatattttagaagaacaacctgttgataagtttggagaaatttatgacttaaaccctgaagactatcctgaaaaaggagttcgattaaaagcttactttaatgagttcacttataatgaaaacttaaaatctaacatcaattatgaaatattaagtcttcagcaaattgataaaacaatttatgattaccaggaaaaacttattgccgaagtagattgggaaaatgaatggaagaattattttcatccatttagagcttcaaaacaatttacgatagtaccaagttgggaatcatatgttaaagaaaatgataacgaattgtgcattgaattagatccaggtatggcttttggaacaggtgatcatccaacgacaagtatgtgtttaaaagcaattgaaacttttgtaaaaccaactgattcagttatcgacgttggaacagggtcaggcattttaagtattgctagtcatttacttggagttcaaagaataaaggcattagatatagatgaaatggctgtaaatgtggcaaaagaaaactttaagaaaaatcattgtgatgatgcaattgaagcagttccaggtaatttattaaaaaatgaaaatgagaaatttaatatcgttattgcaaatattcttgctcatattattgaagaaatgattgaagatacttataatactttaattgaagatggttattttatcacatcaggtattattgaagaaaagtatcaagatatagaatcacaaatgaagcgtattggtttcaaaattatttcagtagaacatgacaatggctgggtttgtatagttggtcagaaagtgagtggataa

SEQ ID NO: 792 - DNA, 636 bp, Staphylococcus epidermidis
attcattactggcttctttattgtataaagaaaaccatgcgctatgcgtatggttcagaaaaggttttaccgttatctaaaaaaacatctcatcatgctagaatatatattggtcagccaaccaaaatattcaacacgaggagatgcttttttatgtcatctgacacaaacagtttagcacatacaaaatggaattgtaagtatcacatagtctttgtaccaaaatatagaagacaagtgatatacggaaaaatcaaaagagatattggagttattttacgtcaactatgtgaaagaaaaggcgtagaaataatagaagcagaagcatctaaagatcatattcatatgttagttagtattccacctaaattaggagtatcctcatttgttggatatttaaaaggtaaaagcagtttaatgatttttgatagacatgctaatttaaaatatagatatggaaatagaaagttttggtgtaaaggattttatgtagatacagtaggtagaaataaaaaggtaattgaaaattacattcgtaatcaattacaagaagatatcgttgcagatcaaatttcaatggaagaatacctagatccctttacaggagaagaaattaaaaaaagacgaaaaaaatag

SEQ ID NO: 793 - DNA, 372 bp, Staphylococcus epidermidis
aatggcagctgtatttattttacaaggctatttagattctattcaataaaggagaaattaaaaatgacagaacataatcacgatgctgagttaacaataaataatgaagaggaattacttacgttatatgatgaaaacggaaatgaagttttataccgtaaaatgttagaattttatcatccagaattcaaaaaagaatatgtcgttcttgcagaagaaggtgcacaatcagatgacgaagatatgattgaacttgtaccaatgataaatgaacctgatgagtctggtgatggtgggaaattagtccctattgaaacagatgaagaatgggatatgattgaagaagttgtaaatactgagattaacgaataa

SEQ ID NO: 794 - DNA, 897 bp, Staphylococcus epidermidis
atcgcaggatgggaaaataatatgaagaaaatagattcatggctaactaaacatggtctaaaaaatcgacttacgctcgtagtaattgtaatttttattatatttttaattttactttttatgtttgttaatttaagtgatgaagatacaggtcaaattactataactgagaatgctgagttaagaacaggacctaatgccgcctatcctgttatttataaaatagaaaaaggcaaaagttttaagaaaatagatcgaaaagggaaatggattgaagttcaaaatcacgctggcactgagaaaggctgggttgctggttggcacacaaatttgaacattccagctgatcaatcactttcgtcaaaccctctaaaaggaaaaacaattgtacttgaccctggtcatggtggaagtgatcagggcgcctcaagtagtacaccatctaaaagtctcgaaaaaaattacacacttaaaactgctaaagaattaaaaaagttattaaataaggaaggtgctcatgtaaaaatgactcgttccaatgataaatatgtgtccctagatgatagaaatataaagggtgacgcatttattagtatacataatgatgcgcttgattcttcaaatgccaatggagtgactgtttattggtttaaagacaagcaagaatcacttgcacaaactttaaattctgcaattcaaaagaaggcattattgacaaatcgaggttctagacaacaaaattatcaagtgttgagacagacagatataccagcagtactgttagagttaggctatataagtaatcctactgatgaatcaatgattaatgatcaattacatagacaagtggttgaacaagctattgttgatggtttaaaacaatatttctcgtcctag

SEQ ID NO: 795 - DNA, 2097 bp, Staphylococcus epidermidis
gttgttttgctaaaaagattaaaagaaaaatcaaatgatgaaaaaatgagaaacaccatgaataaaagaatcaatttcatatttggatttatagtatttatctttgctatagtcgtattgagattaggttatttacaaatagcacaaggatctcattacaaacaattaatcaaaaacgatgaaaacataactgttaatgaatcagtaccaagaggccgaatactagatagaaatggcaaagtactagttgataatgcttcaaagatgtctattacatacactagaaaccgtaaaacatcacaaaaggaaatgttaaatactgctaagaaactgacagatttaattaaaatggatacagataaaattactgagagagataaaaaggatttttggattcaaatgtatccgtcatttgctaaaaagttaatgagaaaagaacaattaatgttagaggatggcagtatttcacaagaccaatttgatacccaacttagagataaaataggaaaaaaacaattaaaacagttaactaaaaaagatttgcaagttttagcaatttatcgggaaatgaacgctgggtcaactctagatcctcaaacaattaaaaatgaagacgtaagcgagaaagaatatgcagccgtatcacaacagctttctaaattacctggtgtaaatactacaatggattgggatagaaaatacccatacggtgatactttaagaggcatatttggagatgtgtcgacttcgactgaaggtatacctaaagaattaactgaacaatatttatcaaaaggttattcacgaaatgatcgggtcggtaaatcttatcttgaatatcaatacgaagatgttcttaaaggcacgaagaaacaaatgaaatatacaactgataaatctggaagagtaataagttcagaagtacttaatcctggctcaagaggtcatgatttacaattaactatagatattgatttacagaaaaaagtagaatctttattagaaaaacaaatttctaaattacgtagtcaaggtgctaaggatatggacaatgcgttaatggttgtccaaaatcctaaaaatggagacattctcgctattgcaggaaagcaaattgataagcaaggtaaactcaaagattatgatatcggcaactttacagctcaatacacagtaggttcttcagtaaaaggaggaacattattagctggataccaaaataaagctattaatgttggagaaactatggtagatgagccattaaaattccaaggtggtttaactaagcgttcttattttaataaaaatggtcatgtatctatcgatgataaacaagcacttatgcattcatcaaacgtatacatgtttaaaaccgcacttaaattagcaggtgacccctatacttcaggtatgtcattacctaataatatagcagatgctggtcgtaaattgcgtaaagggttaaatcaagtaggtcttggcttaaaaacaggtattgacttaccgaacgaaacgccaggccaaatagaacccttaactaataatcctggtaactatttagacttagctattggacaatacgacacatatacaccacttcagttgtcccaatacgtatcaactattgctaatgatggctatagaattcaaccacatattggattgtctatttatgaatctactaataaagatgaaactggtccattaaaacgtaaaattaagggtaatgttttaaataaggtaaataactcaaatgacgaaattaaagaagttcaagaaggcttcaaaatggctttcaatgaaaagcaaggtacaggttatgctagttttagaaatactgtagtaccttcagctggtaaaacaggaactgctgaagtttttcaagacggagaacctagagttaactcaacatatatcggttatgcacccgtcgatgatcctaaattatctttttcaattgtctatacaaatcaacctgttccaccaccttggttaaatggtggagatttaggtagagacgtaatcaactactattttaaagataaggataataaaaaagatgactctcaatctaataacgaagagaaagaagattaa

SEQ ID NO: 796 - DNA, 438 bp, Staphylococcus epidermidis
aaagggagtcgtttaagaatgaatacaaatgatgcaattaaagttttaaaggaaaacggacttaaatatactgataaacgtaaagatatgctagatatctttgttaaagaggataaatatttaaatgctaaacatattcaacaacaaatggataaagactatcctggaatatcatttgatactgtatacagaaatcttcatttatttaaagatttaggcattatagagagtaccgaattagatggagaaatgaaattcagaatcgcatgcacaaatcatcaccatcatcattttatttgcgaaaattgcggagaaactaaagtgattgatttttgtccaatagaaaagattaaaagtcaattacccaatgtaaatattcatactcataaattagaagtgtatggtatttgtgaagaatgtcaacgtaaagcaaactaa

SEQ ID NO: 797 - DNA, 1317 bp, Staphylococcus epidermidis
aagactattttaatcttttttaataataaaggagagagttttatgattaagatgccaagaggtacccaagatatcttgccgcaagattctgctaaatggcgttacattgaaaatcgattacacacattaatggaattgtataattataaagaaataagaacgccaatttttgaaagtactgaactttttgcaagaggcgtgggggattctactgacgttgttcaaaaggaaatgtatacatttaaagataaaggggatcgtagtttaacattacgtcctgaaggaactgcagccgttgtacgttcatatattgaacacaaaatgcaaggtgaacccaatcaacctatcaaactttactacaatggtcctatgtttagatacgaacgtaaacaaaaaggaagatatcgccaatttaaccaatttggtgtcgaagcaataggagcggaaaatcctagtattgatgctgaaatactcgctatggttatgcatatatatgagtctttcggattaaagcatttaaagttagttatcaatagtattggtgatagtgaatcacgtaaagaatataacgaagcattagtaaaacattttgaacctgtgattgatacattttgttcagattgtcaatcaagattacacactaatcctatgagaattttagattgtaaaatcgatagagataaagaagcagtaaaaaatgcaccccgtatcacagattatctcaataatgattctaaatcttattatgaacaagttaaattacatcttgataatttgaacatatcttatgttgaagatcctaacttagttcgtgggttagattattatactcatactgcctttgaattaatgattgataatccagagtatgatggagctatcactacattatgtggtggtggtcgatataatgggttgttacaattattagatggtccagatgaaacaggtattgggtttgcactaagtattgaaagattattgatggcacttgatgaagaaggtatttcattagatgtaagtgaagattttgatttatttgttgtgacaatgggagaagatgccgatcgttatgctgttaagttaatcaatgatttaagaagaaatggaataaaagtagataaggattatctaaacagaaaaattaaaggacaaatgaaacaagctgaccgtcttaatgctaaatatacagtagtaattggagatcaagagcttgaaaataatgaaattggtgtgaaaaacatgatttcaggcgaatcagaaaatgtacaattagacgaattggttaattattttaaaagtagaaaggaagtctaa

SEQ ID NO: 798 - DNA, 465 bp, Staphylococcus epidermidis
ttaatggaacgaattaaatgggaagaatacttcatggctcagagtcatttactggcattaagatcaacgtgtaaaagattatcagttggtgctacaatcgtaaaggataatagaataatagcgggtggatataacggctcagtagctggagaagtgcactgtattgatgaggggtgcttaattgaagatggacattgtatacgtactatacatgcagaaatgaacgcactactacaatgtgcaaaacagggtgtatcaacagaaggagcaacgatttacgttactcatttcccttgtttaaactgtacgaaatcaataatacaagcaggtatcaaaacgatttactatgcacaagattatcataataatgactatgccattaaattattgaagcaatcaggaattgaatataaaaaaattccgttttcacctgaatatgttgctcaatatctgactcaagaataa

SEQ ID NO: 799 - DNA, 1803 bp, Staphylococcus epidermidis
tgtcttttgcgtatagatcaatccgtcattgatgaaataaaaaataaaactgatatattagatttagttagtgaatatgtaaaacttgaaaaaagaggacgcaattatatcggtttgtgtccttttcatgatgaaaaaacaccctcatttacagtttcagaagataaacaaatttgtcattgttttggatgtaaaaaaggtggtaatgtttttcaatttacgcaagaaattaaagacgtatcatttgttgaagctgtaaaggacttgggtgaacgagttaatattcaagttgatatcgggcagaaccaaacaaattcctcgacaaaaattgcgtctgatgagttgaaaatgattgagatgcatgaactcattaaagattattatcattatgctttaatgaaaacagttgaaggtgaggaagccctaaattatttacatgaacgcggctttacggatgaccttattaaagaaagagaaattggatatgcacctgataactcacatttttgtcatgattttcttgaaaaaaaaggatatgatatagaactagcatttgaagcgggtttgttatctcgtaatgaagagaatttcacatattttgatagatttagaaatagaattatgtttccattaaagaatggacaaggacgaattgttgggtattcaggacggacatatactgatcaagaaccaaaatatttaaatagtccagaaacacctattttccagaagcgtagaattttatataatttaaataaagcacgtaaatttattcgaaagcaagatgaaattattttattagaaggtttcatggatgtaattaaatcagattatgctggtttaaaacaagttgtcgctagtatgggtacacagttatcacaagaacatattacttttttacaaaaactaacgcaaaatgtaacattaatgtttgatggtgattatgctggtaaagaagctactctaaaaactggacaagcactgttgaatcaaggcttaaatgtgtatgtggttcaactaccttcaggtatggatcctgatgactatattagaaaatatgataacgaacaattcttaaaatttgttcaacaagacaaacaatcatttgtgctatttaaagttaaaatgtatcaaaatgagattaatcataatgatcttgcatacgaaaaacattttaaagaaactgtgcgagacctttctttagtcaattcaggtatcattcgtaataaacttattcaaaacatagctgatatatttaaagttaatccagaaaccattcaatatgagttagatgcaacttatcaacatcagatgtcgtcgaacacttatcccacttttcaagatgagccaagcaaacaacaattaatactcggtcgtctgactaaaaatgagaaagcagaaagagctttaattaagcatttaacgaaagataaagatacttttttgaattattatcaaaaaattgtgccagaagactttacaaatagctatttaaagcgtatatttagttatttatacgactattattcaaaaaatgattattatacaattagcgatatgatgcaatatattgaatctaatgaattgagagaagttcttattgaattagatcaatatcatctaaatgatgaaccttatgaaaacgaaatagaggactatattcaaattattaaaaataataataacgaagattccttagaaagtttgaattataaattaagggaagcatcgcgtattggagattcagaattacaaaaatattatttgcaacttatcgttaacaaaaataaaaatcgaatgtaa

SEQ ID NO: 800 - DNA, 630 bp, Staphylococcus epidermidis
attataatgcgaatttcaaatttaacattaggaatagttgatactaatacgtatttcattgagaatgaagaaaatgtaatattaatcgatccctcaagtgaaagtcaaaaaataataaaaaaattaaatcaaatcaataaacctttaaaagcaattttattaacacatgcacactatgatcatatcggagcattagataatattattgaaaaatatcaggttccagtttatatgagtaaagatgagtttgattttttaactgatccagataaaaatggctcatctaaatttacacaatatggtttatctaaaatagaaagtcacgcaaatcccttaagtttatcagaaggtcctgcagagattgaaggatttaaatttaaagtattacatacgccaggtcattcgccaggtagtcttagttttgtttttaatgactttgctgttgttggcgatactctgttcaaaaatggtatcggtcgtacagacctttataagggagattatgaaacattaattgattcaataaaagataaattatttgaattagagggtgatatgccacttttccctggacatgggccttacactacagttgacgatgagcaactcaatccgtttataaatggttaa

SEQ ID NO: 801 - DNA, 852 bp, Staphylococcus epidermidis
tatttcgataggggtatgattatgactgaaatatggaattttataaatactggaagcaaaaatccttattataatatggcaatggacgaagcgttactaaattttgtatcgcgtggagaaatcgatccagttataagattttatacttggaatcctgcaacactctcaataggctactttcagcgtctccaaaaagaaattgatattgataaagtaaaagaaaagggctatggcttagtaagacgtcaaacgggtggtagaggcgtgttacacgataaagaattaacatatagcgttattgttcctgagtctcatccaaatatgccttcaactgtaactgaagcttataaaattatttcacaaggattattagaaggttttaaaaatttaggttttgaaacttatttcgctatcccccgttctaaagaagaacgagacaaattaaagcaaccacgaagttcagtatgttttgatgcacctagttggtatgagcttgtagtagaaggcagaaaaattgcaggtagcgctcaaaccagacaaaaaggtgtcattcttcaacatggttcaattttacaagatatagatatcgatgatttatttgatatgtttaaatttaaaaatgaacgactaaaagcaaaaatgaaagaaaattttgttcaaaaagctgtagctattaatgacatttcaaatcaacatattacattaaatgaaatggagaacgcctttgaggcaggttttaaaaaaggactgaatatagattttaaacctctagaattaacggaaaaacaattagaggaagtacaagaactcgaagataaataccgctctgaagcatggatgtaccgtaaataa

SEQ ID NO: 802 - DNA, 357 bp, Staphylococcus epidermidis
tctagaaccagatataaaagcaatgaaaaacatagtaattcaaaaattgaaaggagcattatgatgttaactggtaagcaaaaaagatatttacgtagtttagctcataacattgatccaactttccaaataggtaaaggtggtattaatgaaaatatgattcaacaaatttctgaaacattagaaaagagagaattaattaagattcatatattacaaaataattttgatgataaaaaagatttagcagcaatagtatctcaacaaacgcaaagtgaattggtacaaataatcgggtcaatgattgtgttatataaagagtctgaagaaaataaagaaatcaaattgccacaatga

SEQ ID NO: 803 - DNA, 447 bp, Staphylococcus epidermidis
aagagtctaagaattaatatgctaaagcataaaattttaggactagatgttggaagtaaaactgttggcattgctataagtgaccttatgggttggactgctcaagggttagacacactccgtatcaacgaagaacaagatgatttaggaattgatcaactcgtgaagattattaaagataatcaagttggaactgttgttattggcttgcccaagaatatgaacaattcaataggttttcggggagaggcttcaataaaatataaagaaaagttacaagagtctatcccttctattgatattgttatgtgggacgaacgtttaagtacaatggctgctgaaagatctttacttgaagcagatgtttcaagacaaaaaagaaaaaaggtaatagataaaatggcagctgtatttattttacaaggctatttagattctattcaataa

SEQ ID NO: 804 - DNA, 822 bp, Staphylococcus epidermidis
aaattaataagttgtatagttatatgcgaggtgaaaaccatgacaacaccagtttttgaattacgaaatttagattattatttcgataataagcatgtattagagaacataaatatcaaaattaatcagggagaatttttagcaattgttggtccgaacggggcaggcaaatctactttactaaaagttatactagggctattgcctatacaaaagggcgagataattgttgatggaaaaccatttaaaggtaataaatcttcattgaaaattagctatgtttctcaaaaagcttctgccttcaatgcaggtttcccagctagtgtaaaggaagttgttttaagtggtctgactaaaacaaaaaaattatttcaaagatttaataaaaatgactatcaaaaagtcacaaaggtattagagagattaaatatatctcatttaataaataaaaatatagctgaactatctggtggtcaacaacaacgtgtacttattgctagagcacttatttcagacccaagtgtgctagtgttagatgaacctacaaacggaattgatgcaaaacatgtaagcaaattttacgatacacttgataaattaaaaaaacaggggattacaataattttagtcactcacgatattggcgttgtagcagataccgctactgaagtagcatgtttaaataaacatcttcatttccacggttccacagaagcatttaagtctttagatgaagttgaaatttcaaaaatttatggtcatcctattcaatttgttgatcatcaacacaaccgaacatgttgtaatgagggaaatgaataa

SEQ ID NO: 805 - DNA, 321 bp, Staphylococcus epidermidis
gaggtgcaaagtatgtttgctataattgaaacaggtggaaaacaaatcaaagtagaagaaggtcaagaaatctacgttgaaaaattaaatgctaacgaaggtgactcattcacttttgataaagttttatttgtaggtggcgactcagttaaagttggtgctccaacagttgaaggtgcatcagtaactgcgacagttaataaacaaggacgcggtaaaaaaattactgtcttcacttacaaacgtcgcaaagactctaaacgtaaaaaaggccatcgtcaaccatatactaaattaacaatcgataaaatcaacgcataa

SEQ ID NO: 806 - DNA, 702 bp, Staphylococcus epidermidis
ggtgtgaaaagatatatgataggaattattggagcaatggaagaagaagtgacgattttaaagcgtaaattgaatgatatgaatgaaataaatattgcgcatgttaaattttatgttggcaagctaaaccacaaagaggtggttttaacacaaagtggtataggtaaagttaatgcttctatctcaacgactttgttaatagaaaaatttaatccagaagtcgtcattaatactggatcagcaggtgcactagatcaaacactatctattggagatatattagtgagtaatcatgtattatatcatgatgctaatgctacagcgtttggttatgaatatggacaaatacctcaaatgcctaaaacttatactactgatcctactttgttgaaaaaaacaatgcatgtattagaacaacaacaactgaatggtaaagtaggtatgattgttagtggtgatagttttataggtagctcagaacagcgacaaaaaattaagcaacaatttccagaagctatggctgtcgaaatggaggcaactgcaattgcgcaaacatgttatcaatttaaagtaccatttatcgtaactagagctgtttctgatttagcaaacggtaaagccgatatttcttttgaagaatttttagataaagcagctttatcatctagtgagacagtttcattattagtagaatcattataa

SEQ ID NO: 807 - DNA, 1080 bp, Staphylococcus epidermidis
aataatttgagcaattcaatattgaaaatcaaaaatgattgttatacttcaattattattaattatggaaaggaagcatcatgtatgaaaaatataaaattatctgcgttaaacttagtacctatacgtgaaggtcaagaagataaagatgcaattaacgatatggttacactcgctcaagcattagatgatttagattatgagcgctactggattgcagagcatcataatgctccaaatttagttagttcagctacttctctattaattcaacatacattagaacatactcattctatcaaagtaggttctggaggcataatgttaccgaatcatgcaccactagtcgtagcagaacaatttgggacattggaaacattattccctcaacgtgtggacttaggattaggacgtgctcctggtacagatatgatgacagcgagcgcattaagaagagatcagcataatggtgtttatcaattccctgaagaagttgaacaactgcaacaatattttggaccgagtcatcaacaagcatatgtacgtgcttatcctgcggtagataaaaatgtcccaatgtatattctaggttcatctacagattctgcacatttagctgcacgtaaagggttaccatatgtttttgcaggacattttgctccacaacaaatgaaggaagcactacaaatttatagagaattatttgaaccttcagaagtacttgataaaccttatgtaattgtttgtttaaatacaattgtgtcagattctgatgaacaagcagaatatttagcaactacgatgtctcaaataatggtaagtataacacgaggaaaaatgcaacctgtccaaccaccaacagatgatttaaaggccctattaacaccacgcgaatatgaattagcacaacaacgtttaaaagggtcacttataggatctgaagatacagttaaacaaaaacttgaatcgttcataaaagagtacggggatatcgatgaacttatggcaattagttatatctatgatcaagacaaacaaatagaatcatatcgaagattagaacgtgcaattaaatcatag

SEQ ID NO: 808 - DNA, 492 bp, Staphylococcus epidermidis
aggaagatgagatttatggaaaaccaaaaacaatatcctatgactcaagaaggttatgagaaacttgaacaagaattagaagaattaaaaacggttaaaagacctgaggtagttgaaaaaataaaagtagctcgttcatttggagacctatctgagaactctgaatatgatgctgctaaagatgaacaaggctttattgaacaagatatacaacgtattgaacatatgattagaaatgcgttaatcattgaagataacggtgataacaatgtagttcaaattggtaaaacagttacttttattgaattacctggagatgaagaagaaagttatcaaatcgttggttctgctgaagctgacgcatttaaaggaaaaatttctaacgaatctccaatggcaaaagcactaatcggtaaaggattaaatgatcaagtacgtgttccacttcctaacggtggcgaaatgaatgttaaaatcgttgaaattaaataa

SEQ ID NO: 809 - DNA, 1851 bp, Staphylococcus epidermidis
ttaaattggaggaattatattatgggtaaagtaattggaattgatttaggtacaactaactcttgtgtttctatcttagaaggagatgaaccaaaagtaattcaaaacccagaaggtgcacgtactacaccatcagtggttgcatttaaaaatggtgaaactcaagtgggtgaagtagcaaaacgacaagctatcacaaaccctaacactgtacaatctattaaacgtcatatgggtacagattataaagtagatattgaaggtaaatcatatacaccacaagaactttcagcaatgattttacaaaatttaaaaagcactgcagaaaactatttaggggatacagtagacaaagctgttatcactgtccctgcttatttcaatgatggtgaacgtcaagcaactaaagatgctggtaaaattgcaggcttagaagttgaacgtattatcaacgaacctacagctgctgcacttgcttatggtttagataaaactgaaacagatcaaaaggttctcgtatttgacttaggtgggggaacatttgacgtatctattctagagttaggcgacggcgtatttgaagtattatcaactgccggagataataaacttggtggcgatgacttcgaccaagtgattattgattatcttgtttcagaattcaagaaagagaatggtgtagatttatcacaagataaaatggcattacaaagattaaaagatgctgccgaaaaagctaaaaaagatttatcaggtgtttctcaaactcaaatttcattaccattcatttctgctggagaaaatggcccattacacttagaaattagtttaactcgttctaaatttgaggaattagctgattcattaatcaaaaaaactatggaaccgactcgtcaagcattaaaagatgctggtttatctacttcagaaatagatgaagttattttagttggtggttcaacacgtattccggccgttcaagaagctgttaaaaaagaaattgggaaagaaccacataaaggtgttaacccagatgaagttgtagcaatgggtgctgctattcaagctggtgtaatcacaggtgatgttaaagatgtagtattacttgatgttacgccattatctttaggtatcgaaattatgggtggacgtatgaacacattaattgaacgtaatactactattccaacttccaaatcacaagtttattctacagcagctgacaatcaaccagcagtagatattcatgtattacaaggtgaacgtccaatggcatctgacaacaaaactttaggaagattccaattaactgacattccacctgcaccacgtggtgtacctcaaatcgaagtaacatttgatatcgataaaaacggtattgttaacgttacagctaaagatttaggtactaataaagaacaaaacattacaatacaatcaagctcatctctatctgatgaagaaatcgatcgcatggtgaaagatgctgaagaaaatgctgaagcagataaaaaacgtcgtgaagaagtagacttgcgaaacgaagcagatagtctagtattccaagttgaaaaaacagttaaagacttaggcgaaaatattagcgatgaagataagaaaaatgctgaagagaaaaaagatgcacttaaaacagcattagaaggtgaagacatcgacgatattaaagctaaaaaagaagaacttgaaaaagtaattcaggaattatctgcaaaagtttatgaacaagctcaacaagcacaacaacaaggccaagaagaacaaggttctcaagatagcactgttgaagatgcagactttaaagaagttaaagatgacgaagataaaaaataa

SEQ ID NO: 810 - DNA, 237 bp, Staphylococcus epidermidis
attaataggagttttgagatgcgcaaattcatcttttatttaatattagcgatagctgcatttggtttaatgatgaatcttgatgagtttttattttcgattatgaaagccattattagttttgcaattatagctttaattatttatattatatactatttcttctttttaacagaagatcaaagaaagtataaaaaagcacttcgtaaatataaaagacaaaaaagaaagcaataa

SEQ ID NO: 811 - DNA, 675 bp, Staphylococcus epidermidis
accgtatatggtagtaattggaattgtattggaggtcagactatgtcagaaaaagatcagtcagtgaataatactgaggaagatttcaatgtagaaactgaagacaatcagaatgatacaaatattgaaaactcagtatctaacacagataatagtgaagctaatgctagcgattcagaaaataattcagaagaaagtatcaaggatgaagagtcagagtctcaagatactaaaattaaagaattagaaaagcttgcaaatgacaatgaagaaaaatatttaagattatatgctgaattcgaaaattataaacgtcgaattcaaaaagaaaatcaaattaatgctacttataaagctcaaggtgttttaactgacattttaccgtctatagataatattgagcgtgcactacaaattgaaggtgatgatgaatcgttcaaatcacttcaaaaaggagtgcagatggttcatgaaagtttactaagagctttaaaagacaatggtcttgaagaaattttagctgaaggtaaggaattcgatcctaatttacatcaagctgtcgttcaagatgacaatcctgattttaaatcaggagaagttactcaagaattacaaaaaggatacaaacttaaggatcgtgttttaagaccatcaatggtaaaagtaaatcaataa

SEQ ID NO: 812 - DNA, 699 bp, Staphylococcus epidermidis
tcaatacatgggctgatttattttgtttttgtaattgttaatgataaaggaagttttaatgatatggattcaaatcaaaaatatttagcacaattacatcaatcaattgatactgaaatcgaagaacttagagtttatgctgaagaaaatcaagttcctattgtagataaattaacacttgatttgataagacaactcattcgaatgaatagaactaaaaatattttagaaattggtacagctattggttatagttcaatgcaattcgctaatatttcgaaagatataaatgtaacaacaattgaacgaaatgaagacatgattcatcttgcaaaaaagttcataaaaaagtatcgataccagaatcaaatccgtttaattgaatacgatgctttgaatgcatttgaacaagtcaatgacaaacaatatgatatgatatttatcgacgcagctaaagcacaatcaatgaaatttttccaactatatacaccgttattaaaaaaaggtggaattgtggttactgataatgttttatatcatggatttgtttcaaatatagacgttgttcgttcgagaaatgtgaaacaaatggttaagaaagtgcaacagtacaatgaatggttgatggagcaatctcaatttacaacaaactttataaatatggatgatggattagcaatatctataaaaggagaatga

SEQ ID NO: 813 - DNA, 1026 bp, Staphylococcus epidermidis
tttcttaatggaggaagtcaaatggataaaagaatggtcgatcaagaatttcataatgaagatactgacttggaattatcactaagaccaacacatttaaagcagtatataggtcaatcctctataaaaagtaatttagaagtctttatcaaggctgccaaacttagacaagagccactcgatcatgtcttgttatttggtcctccaggactaggtaaaacgacgctatcaaatatcattgctaatgagatggaggtaaatattcgtaccatctcaggaccatctttagaaagaccaggtgacttagcagcgatattatctgggttacagccaggtgatgtgttatttatcgatgaaattcatagattaagtagtgttgttgaagaagttctgtatcctgctatggaagattttttcttagacatcatcatcggtaaaggcgatgaagcaagaagtattcgaatagatttgccgccatttacattagttggagcaacgacaagagccggtagtttaacggggccattaagagatcgttttggtgtgcatcttagattagagtattataatgaaaatgatttaaaggaaataatcacgcgaactgcagaggtcttaggaacggacatcgataaggaaagcgccttagaattagctcgtcgttctagaggtacacctaggatagcgaataggttactaaaacgtgtaagagacttccaacaagtaaatgaagacgatcagatatatattgaaacgactaaacgagcattacaattactgcaggtcgaccaacacggtttagattacattgaccataaaatgatgaattgtattattaatcagtacaatggtggtcctgttggattagatacaattgcagtttcaataggtgaagaacgagtgactatagaagatgtatatgaacctttcttaatccaaagaggtttcttggaaaggactccacgtgggagaaaagcaactgctttagcctatgaacactttaatactactaacgaaaagagggaataa

SEQ ID NO: 814 - DNA, 837 bp, Staphylococcus epidermidis
agaataggtggtaagtacatggataatataaagataattgttgcctctgattcaattggtgaaactgcggaactcgttgcaagagcaggcgtttcacaattcaaccctaaacaatgtaagcatgaattccttcgatatccatatatcgaatcatttgaaaatgttgatgaagtgattcaggttgctaaagatacgaatgcaatcattgtttatacattaataaaacccgaaattaaaaagtatatgatatcaaaagtcaatgaacatgcattgaaatctgttgacatcatgggtccactaatggaattgttatcgaattctattgaagaaacaccttattatgaaccaggaatggttcaccgattggacgatgcttattttaaaaagattgatgcaatcgaatttgctgttaaatacgatgacggaaaagatcctaaaggattgccgaaagcagatattgtgttacttggcatttcaagaacatcaaaaacacctttatctcaatatttagcacataaaagctataaagtaatgaatattccaatagtacctgaagtgactccaccagacggtttatttattgttgatccatcaaaatgtattgcgttaaaaattagtgaagaaaaattaaatcgtatacgtaaagagagattaaaacaattaggattaggtgacaaagctagatatgcaactgaagcaagaattcaggaagaattagattactttgaaaagttagtcgataagattggttgtcctgttattgacgtttcagataaagccattgaagaaacagcaaatgatattattcattttatcgaacaaaataaatcgaaatga

SEQ ID NO: 815 - DNA, 891 bp, Staphylococcus epidermidis
atgttaataggatcacatgtttcaatgagtggcaaaaaaatgctgcaagggtcagcagaagaagcacataaatatggtgaatctacatttatgatttatacaggtgcgcctcaaaatacaagacgtaaaaatattgaagatttaaatatcgaaaaaggccagcaggcaatgaaaacatatggcttatcaaatatcgttgtacatgcaccatatatcattaacattgcaaatacaaccaaacctgaagtatttaatttaggagtcgactttctacaaaaagaaatcgaaagaactcaagcgctcggagcgaaagatattgtactgcatcctggagcgcatgtcggagcaggtgtagataaaggaattcaaaaaattattgaaggacttaatgaagtactcacacatgataataatgtaagaatagcacttgaaactatggcgggtaaaggaacagaagtagggagatcttttgaagaaattgctcaaataattgatggtgttacacataatgatcgcttatcagtatgttttgatacgtgccacactcatgatgccggttataacgtcaaagaagatttcgatggtgtactagaaaaattcgacagcataattggagtagatcgaattaaagtagtacatgttaatgacagtaaaaacctaagaggtgcacagaaggatcgtcacgaaaatatcggctttggtcatattggctttgatgcacttaattacgtagtacatcatgatacttttaaaaatattcccaaaatattagaaactccatatgttggtgaagataaaaaaaataaaaaaccaccgtataaattagaaatagacatgttaaaatcacaaaaatttgatccagaactcaaaaacaaaattttaactcaataa

SEQ ID NO: 816 - DNA, 1368 bp, Staphylococcus epidermidis
acatttaaaggagaacaaattatgtcaaaacatccatttgaacactttaatttagatgagaatttaattgaagctgttaaaaatctcaattttgaaaaaccgactgaaatccaaaatagaatcataccgagaattcttaaaggaacaaatttaataggacaatctcaaactggaactggaaagtcacacgcttttcttttaccattaattcaacttatagaaagtgacattcaagagccacaagccatcgtagtagctccaacacgtgaacttgctcagcaactatatcaagttgctatgcatttagtaaaattcaaaaaaggtataaatgtaaaacttttcattggtggtaccgatttagaaaaagataaacaacgatgtagccatcaaccacaactcattattggtacaccaacaagaattaatgatttagcacattcaggttatcttcatgcacatttagcgtcatatttaattatagatgaagctgatttaatgattgacctcggtctcattgaagatgttgaccatattgcagcgagattagatgatgaaaatgctcatctagcggtatttagtgcaacaatacctaaatcattacaaccatttttaaataaatatttaagtcaaccagaatttgtagaagttgatggcaaagctcataataaagaaaatatcgaattttatctaattcctacaaaaggttctgctaaggtagataaaacattggaattgatagatatattgaatccttatctatgtattattttctgtaacagtcgtgaaaatgccgatgaattggcagacactttaaataaagaaggaattaaaataggtatgattcatggtggtttaacaccaagagaacgtaaacaacaaatgaaaagaataagaaatttagattttcaatttgtcattgcaagcgatcttgcttctagaggaatagatattgaaggcgtaagtcatgttattaatttcgatgtacccaatgatatcgatttcttcacacatcgcgtaggtcgaacaggaagaggtaattataaaggtgtagccattacattatatagtcctgatgaagaaagtaatattactcttattgaagacagaggttataaatttgaaaatgtagatattaagaatggtgaattaaaaccgataaaggcatacaatatgcgtaaatcaagacagcgcaaagatgaccatttaacaaatgaagttaaacacaaagtaagaagtaaatcaaaacgtaaagttaaaccaggctataaaaagaagtttaaacaagaagttgaaaaaatgaaacgtcaagaaagaaagcagtatagtaaaaagcaaaatagacaaaaacgaaaaaataataaaggatag

SEQ ID NO: 817 - DNA, 537 bp, Staphylococcus epidermidis
ctttcaggaggaaaaacaatggatttaaaacaatatgtttcagaagtaaaagattggccttcagcaggtgtaagctttaaggatataacaactataatggataatggtgaagcttatggatatgctacggatcaaattgttgaatacgcaaaggaaaaaaatatagatatagtagttggtcctgaagccagaggattcataatagggtgtccagttgcttactcaatgggtattggatttgctccagtacgtaaagaaggaaaactacctcgagaagttattcgttatgaatataatttagaatatggaactaacgtattaactatgcataaagacgcgattaaaccaggacaacgagttttaatcactgatgatttactagctacaggtggaactattgaagctgcaataaagcttgttgaacaattaggtggtatagttgtaggtattgcttttattattgaacttaaatatttgaatggaattgataaaataaaagattatgatgtgatgagtttgatttcatatgatgaataa

SEQ ID NO: 818 - DNA, 2211 bp, Staphylococcus epidermidis
attgagtggggtgtcattaaagtgaataacgagtatccatatagcgcggatgaggtgctttataaagctaaatcatatttatcaacaagtgaatatgaatatgttctcaaaagttatcatatagcttatgaggcacataagggtcaatttagaaaaaatggcttaccttatattatgcatcctattcaagttgcagggattttaacagagatgcgtttagatggacccactattgtcgctggatttctacatgatgtgattgaagatacttcttatacatttgaagatgttaaagatatgtttaatgaagaaattgcacgaatagtagacggagtaactaaacttaaaaaggttaagtatcgctctaaggaagaacaacaagcagaaaatcatcgtaaactatttattgctattgctaaagatgtacgcgtaattttagtgaagttagcagatcggcttcataatatgagaactttaaaggcaatgccaagagagaagcaggtaagaatctctaaggaaaccttagaaatctatgctcctttagcacatcgtctcggaatcaacacgataaagtgggaacttgaagatacagcgctgagatatattgacagtgtgcaatatttccgcatcgttaatcttatgaagaaaaaacgtagtgaacgcgaagcttacattacaaatgcaatcaataaaattaaaaacgaaatgactaaaatgaatctttcgggcgaaattaacggtagaccaaaacatatttacagtatataccgcaaaatgataaaacaaaaaaagcaattcgatcaaatatttgatttgcttgctatacgtattatagttaattcgataaatgattgttatgcgacacttggtttagttcatacattatggaaaccgatgcctggacgttttaaagattatatagctatgcctaagcaaaatatgtatcaatcactacataccactgtagttggacccaatggcgatcctttagaaatacaaattagaacgcacgaaatgcatgaaatcgctgaacatggtgttgctgcacattgggcttataaagaaggtaagacagttaatcaaaaaacacaggattttcaaaataagcttaattggttaaaagaacttgctgaaaccgaccatacttctgcagatgcgcaagaatttatggaatccttaaaatatgatttacagagcgataaggtatatgcatttactccagctagtgatgttatagagttaccttatggtgcagtaccaattgattttgcttatgcaatacacagtgaagtaggaaataaaatgattggtgctaaggttaatggtaaaatcgtacctatagattatgttctacaaactggtgatattatagagattcgtacaagtaaacattcttacggtccaagtagagactggttgaaaattgtaaaatcttctagtgccaaaagtaaaatcaaaagtttctttaaaaaacaagatcgtttttctaatattgaaaaaggtaaatttatggtagaagcggagattaaagaacaaggattccgtgttgaagatattctaactgagaaaaatttagaagtcgttaatgaaaaatatcattttgctaatgatgaagatttgtacgcagctgttggattcggtggtgttacatcaatacaaatcgtcaataaattaactgaacgacaaagaatattagataaacaaaaggcattaaatgaggcgcaggaagttacaaaatctgtacctataaaaaaagatattaccacagacagtggtgtatatgttgagggattagaaaacgtcttaatcaagttatcaaaatgttgtaatcctataccaggtgatgatattgttggttatatcactaaaggacacgggattaaagttcatcgtacagattgtccaaatataaaaaatgagacagatcgattgatttcggtagagtgggtaaaatctaaagattcaacacaacaatatcaagttgatttagaagttactgcatatgatagaaatggcttgcttaatgaagtattacaagctgtaaattctactgctggaagcttgattaaagtatctgggcgttcagacattgataaaaatgcagtaattaatattagtgtgatggtaaaaaatgtcaatgatgtgtaccgtgtcgttgaaaaaattaaacaactaggtgacgtttatacagtatctagagtttggaactag

SEQ ID NO: 819 - DNA, 207 bp, Staphylococcus epidermidis
catgtgtttatttacttttcaacccgcggttccacccaaattagtgtaaacactcgcttttataaaaatttaatcatatgccaaaatatatttgttaagctcacaccatccttaactcgcttattaataattctaattgaaataatttttaatagcaagtgtttatatgtatttgtagcaattgaaaataaaagttataatgagtaa

SEQ ID NO: 820 - DNA, 501 bp, Staphylococcus epidermidis
gtgacgtttatacagtatctagagtttggaactagaggtgcaaaagatatgaagataattgtacaaagagttaaaaatgctagagttacgaatgatacaattgataaccaaattaataaaggctattgtttacttgtaggagtaggtcaaaattctactgaagaggatgtaaaagtcatcgcaagaaagattgctcatgcacgtctctttgaagatgaaaatgacaaattgaatttaaatattcaacaagttgaaggagaaattctttcagtttcccaatttactatatacgctgatgttaaaaaggggaatagacctggattctcaaattctaaagctccagaacaagctaaagacttatatcaaaaatttaataaagaattagaaggttatggcttaattgtcaaaacaggtgagtttggaacacatatgaatgttgaaattaataacgatggacctgtcacattgatttatgaatcgcaggatgggaaaataatatga

SEQ ID NO: 821 - DNA, 465 bp, Staphylococcus epidermidis
aattccattatcagaagtaagtttttcgatttctttgatcaacttaaatctaacacaaaagggtatgcttcttttgattatgaatttattgagaataaagaaagtaatcttgttaaaatggacatattactgaatggagataaagttgatgctctaagttttattgtccatagagattttgcatatgaaagagggaaagcgcttgtcgaaaaattaaaaacattaattccacgacaacaatttgaagtgccagttcaggcggctattggtcaaaaaattgttgcacgaacaaacattaaatctatgggcaaaaatgttttatctaaatgttatggtggagatatcagtcgtaaacgaaaacttttagaaaaacaaaaagcaggtaaagctaaaatgaaagcagtaggcaatgtagaaattccgcaagatgcatttttagcagtattaaaaatggacgatgaataa

SEQ ID NO: 822 - DNA, 1371 bp, Staphylococcus epidermidis
aaaagaattattggggtgaagattatgtcaacagttgcgtttcacacattaggttgtaaagtaaaccattacgaaactgaagcaatttggcaattatttaaagatgcaaattatgaaagagtagaatttgaaacaaatgctgatgtatttgttattaatacatgtacggtgacaaatacaggggataaaaaaagtcgtcagataataagaagagctattagacaaaatcctgatgcagtcgtttgtgtaactgggtgttacgcacaaacatcatctgccgaaattatggaaatccctggtgttgacatcgttgtaggtactcaagaccgacataaattgttagactatatacaacaatttcaggacgagagacaacctattaatggtgtaggcaatatcatgaaaaatagaacttatgaagaattagaagttccttactttactgatagaacacgtgcttcattaaaaatacaggaaggctgcaataatttttgcacgttctgtattatcccgtgggcacgtggattgatgcgttctagagatccagaaaaagtagtagaacaagctactcaacttgttaactctggttataaggagattgtattaacaggtattcacactggtggttatgggcaagaccttaaaaattataatctagcacaattgctaagagatttagatactattgaagggcttgaacgtatacgtatttcttctattgaagcaagtcaacttactgatgaagttattgatgtcattggaaactcaaataaggtggtacgtcatttacatataccgctacaatctgggtctgatgatgtgttaaaacgtatgagacgtaaatataccatggcacatttttcagaaagattgacaaaattacatcaagcattacctgatttagcagttactagtgatgtaatcgttggtttccctggagaatctgaagatgaattccaagaaacttacgatttcatcgtaaatcatcatttttcagagttacacgtattcccttattctcctagaataggaacgcctgctgcaagaatggacaatcaaattgatgaagaaacaaaaaatgttcgtgtacacaaacttattagtctaagtaatcaattagccaaagaatatgcttctaaatttgaagatgaagttttagaagttatacctgaagaaatgggtgaagaaccacatacacttgttggctatgctgacaattatatgaaggtaagatttgaaggagatgactcattaataggtcaaatagtaaaggtcaagatagttaaagccaattatccaattaatgaaggcaaagcaatacgtgttgttaaacatgcaacgaatcaatctgaaaaagaagtacttgtttaa

SEQ ID NO: 823 - DNA, 468 bp, Staphylococcus epidermidis
atgtttactatagattttagtgaccatacaggtctagtagaaacgtcttggtttgaccaaatagatcaattattaacattcgctaagaagaaagaaaatattcataatgatgccgaattgtcagtaacttttgtagataaagatgaaattcaaaatataaataaagtatatcgcgacaaagataaagttactgatgtcatctcatttgctctagaagaagatgaaccagaaatagatttcaatgactttgatataccacgtgttctaggtgatattattatatgtacagatgttgccaaagaacaatcagaaagctacggacactcatttgagcgtgaattaggatttttagcattacatggctttttacatttgctaggatatgatcatatgaatgataatgatgaaaaagaaatgtttggtcgacaagatgctatactaaacgaatttggtctaactagaaattaa

SEQ ID NO: 824 - DNA, 240 bp, Staphylococcus epidermidis
tgcaaaactatacaagggacgattcaccgtgttgccaccctatttgattatactgataaaagcataatccactcaaaacgcttaacgtgcgctatccgacttttaattaaaagtacctcttcttgcgttcaaatttttaaattactaagtacaatcttacagccaaggattgtatttctacgcattaaatgctacctacttcatttaaaatttcaagaatcatatcggttttatttataa

SEQ ID NO: 825 - DNA, 987 bp, Staphylococcus epidermidis
gaggtgatttttttgaaaattttatttgaacagattatcaatcatgcaattaagcaagaagcaagtgacatacactttataccatgtgaggaacacactataattaagctaagaattaaagatgagctcacaatatatgatagactttcatttccaatttataaaaaattacttatatacatgaagtttcaatctggcttagatgtatcaacacagcatagagcacaaagtggtagatatagttataagatgaagcatttatattatttaagaatctctacattacctttatcattaggcaatgaaagttgtgtaattcgtatagtacctcaatacttccaaactacacgagaatcatatgaatttaaagattttaaacactttatgaaaaagaaacaaggtctacttttgtttagtggaccaactggctctggcaaaagtactttaatgtaccaaatggtcctttatgcacatcaaaaattgaatttaaatgtaatatcagttgaagatccagttgagcaaatacttaatggaatcacacaaatatcagtcaatgaaaaggcaggtataaattatgaaagctctttcaaagccattttaaggtgtgatccagatgtaattttaattggtgaaatcagagattctaccgtagctaaatacgtgattcaagccagtttaagcgggcatttagttttgtcgacaatgcacgcgaatgattgcaagggagcactattacgattattagaaatgggtatttctgtccaagagttgtgccaggcaatcaatttaatttctaatcaaagattaatcactactactacaaattatcgtcaactagtatcggaattaatgtttcaaagccaaataaattatttttttgaacataatcattctttacctaaaaatttcacaaaattagctacacatttaaacaaaatgtctaaagaaggtgttatatgtgaagaagttgtcgataaatacatttaa

SEQ ID NO: 826 - DNA, 300 bp, Staphylococcus epidermidis
gtgaggtgtatcccgatgttaaaattaaacttacaattcttcgcatctaaaaaaggggtaagttctacaaaaaacggacgtgactctgagtctaaacgtttaggtgcaaaacgtgctgatggtcaatatgtatcaggtggttctatcctttatcgccaacgtggtactaaaatctaccctggtgaaaatgtaggtcgtggtggcgatgatacattattcgctaaaatcgacggcgttgttaagtttgaacgcaaaggtcgcgacaaaaagcaagtttctgtatacgcagttgctgaataa

SEQ ID NO: 827 - DNA, 744 bp, Staphylococcus epidermidis
ttccttagtatttttaaaaggagggattttgttttgaggacacaatttattaatgaacaaacaatgatgatttactttgaaaatgaaattagtgaatcaactttcaaaaaggtacaacaaacaattcaatatataaaatcgaaaaatttatctgaaataacaaacatgataccttcatatcgtgctattctaatttactttgataattcggggataaacggaactgaattattagaaaatttagaactcgatgaaaattcgaacagtagaaaacaatcacattttaaacagcgtatcattcatatacctgtattatatggtggagattttggtccagatttatcagaagtagctaacgttaataaattaagtcaggaagaagttattcaaatacatacacaacaaccttatctaatctatatgcttgggtttatgccgggtttcccatacttaggtggattggatgctaagttgcacacacctagacggtctgaacctagaatcaaaattaacgctggttctgttggaatagcaaataatcaaacaggtttatatcctatggactcacctggtggttggcagataattggtcgcacaccaataaaagtctttgatttaaataggacaccaatgacgttatatgaagctggtgattacatacaattttatagtataaattatcaagagtttgaaaaaatatcaaacgatattaataaaggaaaatttgatatagataagtggtga

SEQ ID NO: 828 - DNA, 1302 bp, Staphylococcus epidermidis
acaaacagtatattaaggaggcttatcattaaaatgaaaactttagaagaagttaaatccaaaacccaaaagataatgaaaaagcctgaactacttgcaccagctggtaacttagagaaacttaagattgctgttcattatggtgcagatgcagtgtttttaggtggccaagaatatggattacgttctaatgctgataattttactatggaagaaattgctgaaggtgtagactttgctaatcgttatggcgctaaaatttatgttacaacgaatattattgcacatgatgaaaatatggagggactagaagagtacttacaaaaccttgaatctacaggtgctactggtatcatagtagcggatcctcttatcatagaaacttgtaaaaaagttgcgcccagattagaaattcatttatcaacacaacaatcactttcaaattataaagctgttgaattttggaaacaagaaggattagaccgtgttgtacttgcacgtgaaactggtgcaatggaaatgagtgaaatgaaagaaaaagttgatattgaaatagaagcgtttatacatggcgcaatgtgtatcgcatattctggtcgttgtactttaagtaatcatatgacagctcgagattctaatcgaggtggttgttgtcagagttgtcgttgggactatgatttacttgaagttgatagtgatggagaattagatttatattacgacaatagtgatgttactccttttgcaatgagtcctaaagatttaaaattaatagaatctatacctcaaatgatggaattaggcatcgattcgttaaaaattgagggacgaatgaaatctatacattatattgccacagttgtttctgtatatcgtaaagtcattgatgcatatgccgaggaccccgaaaactttaaaataaaaacggaatggttaatggaattaaataaatgtgccaatcgtgacacagcaccagctttctttcaaggtacacctggttatgaagagcaaatgtttggtgaagaacagtctaaaaaatcatcttatgatttttgtggcctcgtgctagattatgaccatgaaacacaattagcaacaatacagcagagaaatcattttaaaccaggacaagaaattgagttctttggtccagaaattgatagttttaaacaagttgttgaagcgatttacgacgaagaaggtaattctttagatgcagcacgtcatccattacaaattgtacaaattaaagtagataagcctatttattctaacaacatgatgagaaaggaaattggctaa

SEQ ID NO: 829 - DNA, 288 bp, Staphylococcus epidermidis
actaagattttttcatcgttagatttcttctctttgtgtactactaatttattattttttgtctttttaaactgtcgtttcttaagcatgccccataatggtacagcaatgaaaattgacgagaatacaccagataataatccaattagtaatgctaaagagaaattaaatattgttggtgcacctaatattaatattgcaactacaactacaactacagtcaacactgtattaatagaacgtgtcatagtttgtctaatagagcggttgactatatcatcaatttga

SEQ ID NO: 830 - DNA, 1131 bp, Staphylococcus epidermidis
ggaggaatcatagtgtctaacaaagatatacgcgtagttgtgggcatgtctggtggagtggatagctctgttactgcatacttgttaaaagaacaaggttatgatgtaataggtatatttatgaaaaattgggacgatactgatgaaaatggggtgtgtacagccactgaggattataatgacgtgattgcagtatgtaatcaaattggcatcccatactacgctgttaattttgaagaacagtattgggataaagtatttacttattttcttgatgaatataaaaaaggtcgtacacctaaccctgatgtgatgtgtaataaagaaattaaatttaaagcatttttagaacatgctttaaaattaggcgctgattatgtcgctacaggtcattatgctcgtatacgtcgtcatgatgatgggcatgttgaaatgctaagaggtgttgacaataataaagaccaaacctactttttaaatcaattatcccaagaacaactatccaaagtcatgttcccaattggagatattgaaaaaagtgaagtaagacgtattgcagaagagcaaaatttagctactgccaagaaaaaagactcaacaggtatttgttttattggtgaaagaaactttaaagaatttttatcacattacctaccagctcaatctggtgaaatgttgacattaaatggaaaaaaaatgggacagcatagtggattgatgtattatacaattggtcaacgtcacggcttaggcatcggtggagatggagatccatggtttgttgtaggtaaaaatttaaatgataacgtattatatgttgaacagggatttcaccatgatgcactttatagtgattatctcatagcttctgattattcatttgttaatccaagtgaaattgatttggaaaaaggttttgaatgtacagctaaattccgttatcgccaaaaagatactaaagtttatgttcaacgcgaaaacgagaattctattagagtaacttttgctgaaccagttagagcgattacacctggtcaagcagttgtcttctataatcaagaagtatgtttaggtggcgctacaattgatgatgtttataaaaacgaaggtcaattaagttacgttgtataa

SEQ ID NO: 831 - DNA, 939 bp, Staphylococcus epidermidis
attattaccattaggattttctggaaaggatttaaattaatgacagaacataaatcaggatttgtttcaattatcggtagacctaatgtaggtaaatctacctttgtaaacagagtaataggacataaaattgctattatgtcagataaagctcagacgactagaaataaaatacaaggtgtgatgacaagagatgatgctcaaatcatctttatcgatacacctggtatccataagcctaaacataaattgggagattacatgatgagagtagctaaaaacacactttctgaaattgatgctattatgtttatggttaatgtaaatgaagatataggtagaggagacgagtatataatggaaatgctaaaaaacgtcaaaacacctatatttttagttttaaataaaattgatttggttcatccagatacaatgatgccaaaaattgaacaatatcagtcatatatggattttacagacataattccaatttctgctttagaagggttgaatgttgatcattttattgatgtattaaaatcttttttaccagaagggcctaaatattatcctgacaatcaaatttcagaccatcctgagcaatttgtggtgagtgaaatcattagagaaaaaattctacatttgactagtgaagaaattccacatgcaattggtgtcaatgtcgatcgtatgattaaagaggatgaagatagagtacgtattgaggcgacaatttatgttgaaagagattcacaaaaaggtatagtaataggtaaaggtggtaaaaagcttaaagaaatgggtaaacgtgcacgtagagatatcgagatgttacttggctcgaaagtttatcttgaattatgggtgaaagtacaacgtgattggagaaataaggttaattttataagacaaattggatatgttgaagatcaagattaa

SEQ ID NO: 832 - DNA, 207 bp, Staphylococcus epidermidis
tctttatacataaggcacctcgttaattttgtttattggtatttattaaattatgtgaaaggtccttatttttcaaagtattttaatgtaaaattacatataaactcaaagtattttggcgagactcttgagggaacaggacaagctgaagactacaggctgaagctgtcccctaagaaagcgagccaacaaaacgaagtattgtaa

SEQ ID NO: 833 - DNA, 489 bp, Staphylococcus epidermidis
ggtgaaaacatgattacaaaaagacaattaagcatccttaatgctattgttgaagattatgttgattttggacaaccgattggatctaaaactctaattcatcgtcatcacttggatgtgagtccagctaccattagaaatgaaatgaagcaacttgaagaaatgcatttcattgagaagacacacacatcttctggaagggtgccatctgaatcagggattagatattatgtcaatcgccttttagaacaaacatctcatcaaagtcaaaacaaaattcaacgtttaaatcaattattaattgagaatcattatgatagttcgactgcactcacaaactttgcacacgaattatgtatgaaatctcaatatgcaacgttggtagtccgccctaatcataaacaagatgttataaatgatatacatcttattcgtgctaacaaccatttgattattttagtaatggtattttccttctggacatgttga

SEQ ID NO: 834 - DNA, 633 bp, Staphylococcus epidermidis
aatgatagcataactagtaataataataatagtttttggtttagggagaagacaatgaaaaagttaatattaatagttggtgcgagcagtttgcttatgggttgtggaagtcagaacttagctcctttagaagataaaacgactgagttacgtgatgataatcatcaattaaaacttgatattcaagaacttaatcaagaaattggcgaacataaatctaaaatagccgcccttaaacaagataaagaaaatactaaagaggcttcatctaataagttaaaaataaaaaatttaaaagcatcatctgattattacgactctattgcaaaaaccattaaagattatagagatattgaatcaaaagttaataaaaataataataaagtagcgattcaaagaaaattagatgacattttaaatgatattgacggtactttcattaaatataaagaatctgtagactctgaatcacaatctgaagaagataagaaaaaagaaaaagaaatacgtcaacttaataaagacttatcttcagcattcaatacaataaaaaaaggatatgaaacgaaagataataaaaaaatagaaaaaggtcaaaaaaaacttgcaacaataaatacaaatttaaattaa

SEQ ID NO: 835 - DNA, 1116 bp, Staphylococcus epidermidis
aaattattaattgggggtacacgtatgacaacagatttgaaaaaaacacctttatatcaaaattacgttgatagtggtgctaaaattgttgagttcggaggatgggcaatgcctgttcaattctcaagtatcaaagaagaacataatgcagttagatttaatgttgttctttttgaagtaagtcatatgggagagatagaaattagtggtaaagatgcagaacaattcatacaatacatcctttctaatgatacaaatcttctaacaaatgataaagcaatgtatagtgcgttatgtaatgatgaggggggcatcattgatgatttagttacatataaacttaatgaaaaccactacttgcttattgtaaatgcagccaataccaataaagattatcaatggattaagaaacatagctctaattttactgtagatgtgagcaatacttcagacaaatacggccaattagctattcaaggtcctcattcaagagcattaataaatgaattagtggatatagatgtaagccatatggcaatgtttgaattcaaacagaacgtacaaatctttggtaaatctattattctttcgcagtctggttatactggagaagatggctttgaaatttactgtaagcaagaagatactaaggatatatgggagcaattattagaatacgatgttacaccatgcggtttaggtgctcgtgatacgctaagacttgaagcaggattacctttacatggtcaagatttatctgaatcaattactccttatgaaggagggatagccttcgctgctaaaccgttaattgaaaatcattttattggcaaatccgtactcaaagctcaaaaagaaaatggttccgagcgtagaacagtaggtcttgaactattaggtaaaggcattgctagaacaggttatgacgtactagatgaaaatagtaatgaaattggtttcgttacatcaggaacacaatccccatcttctggtaaatctatagcacttgcaataatagatagagatgcatttgaaatgggcaaaaaagtaattgtgcaaatacgtaagcgtcaagttgaggcaaaaatagttaaaaaaaatcaaattgagaaataa

SEQ ID NO: 836 - DNA, 210 bp, Staphylococcus epidermidis
gtaaatctaatgacacgaaaaattaaaagtttttatgacgtgttacaattacttaaaacatatggtttcattatatattttaaaaatccagatgatatgtatgaaatgatgatacaagagattaaatccttatatagttatcaattgttaacgaaggatgaatatctaaattgtatactgataattaatcaaagaaggaatgaaaagtaa

SEQ ID NO: 837 - DNA, 432 bp, Staphylococcus epidermidis
ggttatacaatgaaaatatcaacaaaagggagatacggattaacattgatgatatctcttgctaaaagagagggtcaaggttgtgtatcactaaaaacaattgctgaagaaaataaactaagtgatttatatcttgaacaattagtaggccctttaagaaatgctggattaattcgaagcgttcgaggtgctaaaggtggttatcaacttagagttccatcagaagaaattactgcaggagatattatccgattactagaaggaccgattacgtttgtagaaagtattgattcagaaccgcctgcacaaaagcaactatggattagaatgagagatgctgtaagagatgttttagatcatactacattaaaatatcttgcagattacaaagatacgaatgaagacttagagggttatatgttctatatttaa

SEQ ID NO: 838 - DNA, 330 bp, Staphylococcus epidermidis
ataatggcaattgttgatgtagtagttattccagtaggaacagagggacctagtgtaagtaaatatatagctgaaatccaaacaaagttaaatgaatttaaacaacaagggaaaattgattatcaattgacaccaatgaatacattaatcgaaggtgatttgaaagacctttttgaggtgattcaagcgattcatgaattaccttttgataaagggttagatagggtttgtacaaatattagaattgatgatcgtcgagataaatcaagaaaaatgaatgataaattaaaatcagtacaaaaacatctagaccatagtggtgaattataa

SEQ ID NO: 839 - DNA, 939 bp, Staphylococcus epidermidis
ataattcaaattgacgatattaatcaatctcaagctttaataggaaataacgatgaaaacctaaaagcgattgaagcacattttaatgtcgtaatacatgctagaggtcaagaaattgctgttaaaggtgaaaaaatagagcatgttgaaaaagcagaattagttctaaagaatttacttaaagtaattgaattaggtaatacaattacgcttaaagatgtagaagctgctataaaaatggccgacaataatacaattcatcatttattagatttatacgatgaagaaattacaaaagatgcttatggtaaaacaattcgtgctaagactatgggacaacgtatatatattaatgctatgaaacgtaatgatttagtatttggcattggtccagctggaactggtaaaacctttttagcagtcgtatatgcggctaaacaactacgtaaaggatctgttaagcgtattgttctaacgagacctgctgttgaagcaggtgaatctctaggatttctaccaggcgatttaaaagaaaaagtagatccatatttaagacctctttacgatgggttaaatactgttttaggtagagagcaaactcaaagactcatcgaacgaggtgtaatagaaattgcgccattagcatatatgagaggtagaaccctagatgatgcatttgttatattagatgaagctcaaaatacgacacatgcacaaatgaaaatgtttcttacccgcttaggatttggatcaaaaatggttgtcactggtgatcaaactcaaatcgatttaccaaaaggtgtaaaaagtggtttgaaagaagcggtaaaaaaactaagtggtgtcagcggcataagtatcatgaaaatggatcaaagtgatgtagttagacatccacttgtaagtaaaattattaatcgttatgaaggagttgaataa

SEQ ID NO: 840 - DNA, 594 bp, Staphylococcus epidermidis
  unsure (298): Identity of nucleotide at the above locations are unknown.
agaaatcaaattgccacaatgaataaaaaaatcgttctctttggcggtcaatttaacccgattcacactgctcacttagcagtagcaagtgaggtttatcatgctattaaaccagatatatttttctttttgcctagttatatggctcctttaaagcatcataatacacaattatattctgaacatcgagtgaaaatgatacagctcgttattaaggagattggatttggtgaaatttgcagtactgatttagatagaaaaggtccaagctatatgtatgaaaccattttgcatctcnaagaaatatatcataatgcacagttatactttattattggaacagatcagtataatcaattggataagtggtataaaattaatgaattaaaaaaacttgtaacctttattgtagtgaatagagaaactgataaccaaaatgtaagtaaagagatgatttctataaagatacctcgaatagatataagctcaacaatgattagaaatagagtgagaatgaaccaatctataaaagttttagtacctaaaagggtagagaattatattaaagaggaggggttttatggagataagtag

SEQ ID NO: 841 - DNA, 1104 bp, Staphylococcus epidermidis
ttaatgaaaattagtgaactgatggaagttttaaataatcacgttccatttcatcaagctgaatcatgggataatgtaggattattaattggtaatgataagttagatattacaggtattctgacaacactcgactgcaccgatgatgttgttaaccaagcaattgaacttaataccaataccatcattgctcatcatccacttattttcaaaggagtaaaacgtatcgttgaagatggatatggtagtataattcgtaaacttatccaaaataatatcaatcttatagcattacacactaatcttgatgtaaatcctaaaggtgtcaatcgaatgttagcggatcaaataggtttagagaacatatcaatgattaatacaaatagctcatattattacaaagttcaaacttttatacctaaaaattatattgaagatttcaaagacagtttaaacgaacttggattagctaaagaaggtaattacgaatattgtttctttgaaagtgaaggtaaagggcaatttggaccagtaggtgatgcaagtccttatatagggaagttagatagtatcgaatatgttgatgagataaaacttgagtttatgataaaagacaatgaattagaaataactaaacgtgctattttagataatcacccatacgaaacaccagtttttgattttattaaaatgaacaaagaaagtgagtatggattagggattattggacaattaaaccaaactatgactttagatgaattttctgaatatgccaaaaaacagctcaatataccgagcgtacgatatacaggtcaacatgatagtccaattaagaaagtagctatcataggtggttcaggtataggatttgagtataaagctagccaacttggagcagatgtttttgttactggtgatattaaacaccatgatgctttagatgctaaaatccaaaatgtaaatttattagacatcaatcattatagtgagtatgttatgaaagaaggattaaaagaattattagaaaaatggttatttaaatatgaaaatcaatttccaatatatgcttctgaaatcaacacagatccatttaaatataaataa

SEQ ID NO: 842 - DNA, 1101 bp, Staphylococcus epidermidis
ttgaatgaaatactaaaatgtattggatgtggtgcacccctacagtcagaaaataaagacgcacccggctatgttccagaacataatatgtttcgagaagatgtcatctgtagaagatgttttagattgaaaaattataatgaagttcaagatgtgggtatggaaagtgaagattttttaaatctacttactggactatctgaaaaaaaaggaattattgtcaatgtagtagatgtgtttgattttgaagggtcattcatcaatgcaatacaacggattgttggtaataaaaaaattatattagtggcaaataaaatagatttattacctaaacaaattaatcatcgacgtgtaaaagaatggttgagaaaatctgctcgtaaatatggattagaagcagaagatgtcgttcttatttctgcaaataaaggttgggggattgatgaattattgcaatctataaaccatgtaagaaataaagatgacgtatacattgtaggtacaacgaatgttggaaaatctacattaattaataaattaattgaacagagtgtgggagaaaaagatgtagtaactacatcacgctttccaggaacaactttagatatgatagatattccattagacgaaaaatcatttatgtttgatacaccaggtatcattcaatcacatcaaatgacaaattatgtatctgaaaatgagttgaaaatcattatacctaaaaatgaaataaagcaacgtgtgtatcaacttaatgaaaaacagacattatttttcggaggattggcacgcattgattatgtatctggtggtaaaagaccacttgtttgtttcttttcaaatgatttaaatattcatagaactaaaaccgagaaagctaatgatttatggaaatcccaattaggcgcattgctttcaccgcctcaagatgcacaacaatttaatcttaatgatgtaaaagcagtaagactggaaactggtaaaactaaacgtgacatcatgatatctggtttaggattcataactattgatgctggtgcaaaagtgatagttcgtgttccaaaacatgtagatgttattttaagaaattcaattctttaa

SEQ ID NO: 843 - DNA, 768 bp, Staphylococcus epidermidis
agaggtgaaatgaagttgaaaattgatttaaattgtgatttaggagaagcttttggtaactatacattcggtggagatcagcacattttaccattaataacttctgctaatattgcttgtggttatcatgcaggtgatgaagatgttatgaatgaaactgttcaattagcgaaaaaaaataatataagtattggagcacatccgggtcttcctgatttgaaaggctttggtcgtcgtaaaatggatcttactccaaatgaaatttataacttagttatatatcaattaggtgcgttaagtggcttttgtaaaatcaatcatgtaaaaatgatgcatgttaaacctcatggtgccctttatcaaatgggggctagaaataaagaaattgcacatgcaattgctcaagcagtttttgatttcgactcaaatctaattttcgtcggcttagcgaatacattacttatttcggaagctgaattagtggggcttaaggtagcttcggaagtatttgctgaccgtcgttatgaagatgacggacaattggtaagtagaaaaaaaaccgatgccactatcactaatactgacgaagcaatccaacaagcattaaaaatggttttggaaaataaagttgtaagtaaaaatggaaaaatcatcgatttgaaagctgatacaatttgtgttcacggagatggaaaacacgcattagaatttgttacgcaaattagaaatgaattaatgaaagaaggcattgatattcaatccttatag

SEQ ID NO: 844 - DNA, 2298 bp, Staphylococcus epidermidis
cctgtggaaatgaggacgattataatgattaaatcaaaatataattgggatataactcaaccgaatacctttataagtgagagtagcagtgatcaatttaaactttcacctatagtaaaaaaggtattagagagtaaaaatattgtggataatcaggagattcaaaatctatttgaaggcactaacattagtcatgattatatgttattaagtgatatgcaaaaagccattgatcgtattaaattagctatcgatcaaaatgaacgaatactagtatatggtgactatgatgcagatggtgttacatctactacaattctagtgtctactttacgtctacttggcgctcaggtggggtggtatattcccaatagatttacagaaggatatggacctaatgaattagcatttaaaaatgcttatgacgaagggatttccttaataataactgtagataatggtatacagggacatcatgaaataagtaccatacaagaattaggtgtagatgttatagtgacagatcatcatgaaataggagaaactttacctgatgcttttgcaattgtacatccgatgcatcctaattttgaatatccttttaaatatttatgtggtgcgggtgttgcttataaattggcccaaggattgatagagcatccacctcaacatttcatagcattagctgccataggtacaattgcagatttagtatcattgacagatgagaatagatatattgtaaagcaaggattaaagatattaaacaatcatacaccatcgtccataaaggctatcttaaatcaagcgggttttaatgatgaaataacagaagaaacaattggttttattattggacctcgattaaatgcggttggtagactagaagatgcatcattagctgctgaacttttattgtccgatgaatttgaagaggcggaatttttagctgaacaagttgaacattttaatcatgaacgtaaagatatagtatctaaaattactgatgaagcattgttattagcagaggaacaaatcaagcaaggccatttgtttcttttacttgccaaagaggggtggcatgagggtgtattaggtattgttgcatctaaaattgtagaaacatatgcactacctacattaattttaaatattgatgaaaatcaaaatcatgccaagggttctgcgaggtcaattgaacaagtttccatgtttgatattttaaatgaccatcaacagttaattgataagtttggtggtcatcacatggctgcaggaatgacaatgtctatcgataatattgaacatttacgtaaagagctagatatgtggatgaaagaactaactgttaccacttcattagagccttcaataaaggtggatgcacaacttgaagaaaaagaaattaacattaaaaatattaaagatatatttcaattaaggccttttggtacggactttaatagtcctctttttatggttagagatctaattgtcaagtcaacaaagggaattggacaggataataagcatcttaagttaacgcttggtcattcaggtttaactgctttattttggaatcatggacatttggcaagtgaacttgaaccaggtcaaccgattcatataataggaacattgcaaattaatgaatggaatggtaatcaaacacctcaatttatcatcaaagacattgctatagaccaattacaaattttagattatcgtagtaaacgtaaaaatatacaatttaaagaatctgaatcaaatgttgcctatgtcattcatccgaaacttaaaaaaagcaattcacattactatcattatggtgaggctattgatagaccttatgataaaatagtgtttagagatttacctaatactatggttgaaattgaacaaaccttagaacattcacaaatttctcaactatatttagttctgcagcatgaaaagtcaatatattttgaaggtatccctagcaagtcgctttttaaaaagtgttacaaagctttaataaacaaaaaagaaactgacttaattaaagaaggtatgctgctttgtgagtacttaaatattaagccagaaatattaacattcatgcttaaagtctttaaagaattggagtttatttacgacgaaaagggattgattaagataaatccagcgccaaataaacaagatatagaaaatagtcgtatttaccaaatgagacgagcacgtatggaagtagaagaacgtcttctctatgatgattttttaaatataaaagaatggataatatcaaagttaacatag

SEQ ID NO: 845 - DNA, 480 bp, Staphylococcus epidermidis
atttgtcgaataggggtgtctaaattggtcaataaagacaatcgaaaattttatttaattagagaagatgtactaccagaatctgtcatcaaaactttaaaagttaaggatgctttaaaaaataattcgaatttgtccatttatgatgctgtaaaacaattcaatctctctagaagtgcattttacaaatatagagagacaatatttccagtagatgaaaaaatattagatcaaagagaatttactttgattttatatgtaaatgatattgttggaatgttagcccaagttcttaatgcaatctctcaacttcaattatcagtgttgacaattcatcaaagtgttccaattgaagataaagcgacaatcacactatctttaaatgcgagaaattctaatttatccattgatgaggtcattgaatcattaagagagataaatcatgtaactaaagtagacttaataagtatgactatgtaa

SEQ ID NO: 846 - DNA, 189 bp, Staphylococcus epidermidis
cactctttgatcagggagcccaataggttttctcgcagcgcacacgcctctataggaggacttgcaaaacgagaaacagggcacccacctgtatatagcaggccgaatgatcaagctatttataactacggcatcaacggactctatcggtacgcaagacttttgtcttgcgtatttttatgtatataa

SEQ ID NO: 847 - DNA, 285 bp, Staphylococcus epidermidis
attttactgattgaccgtcatttagagttatattatactaataactgcatagttttactatgcaatgactataaagttccgttgatatttggagggagggaaatacagatgtctaaaacagtagtacgtaaaaatgaatcactagaagatgctttacgtagatttaaacgttcagtatcaaaaagtggaactattcaagaagtacgtaaacgtgaattttacgaaaaaccaagcgtaaaacgtaaaaagaaatctgaagctgcacgtaaacgtaagttcaaataa

SEQ ID NO: 848 - DNA, 270 bp, Staphylococcus epidermidis
cttataatgattcaagttttgatctctattctctctaatactgatcaatcgcttaataattttgttttaattaaagtgcaaatttcagaaacactctgtgcactatcaactttcatgaatgcgatttcattatatcttgaaagtcttgaagaatacaaggcatcaagttggttaagatttttacttttagcattgggtctatgtgaatcatttttaactcgtttgaaaatgatttcaatgtcacagtctagccaaactacatgcttttga

SEQ ID NO: 849 - DNA, 825 bp, Staphylococcus epidermidis
aaagaggtgataaaagtgaaatttgcagtaattggaaaccccatttctcattcattatcgccattgatgcatcatgctaattttcaatctttaaatttggaaaacacgtatgaagcgataaatgtaccagttaatcaatttcaagacattaaaaaaataatttcagaaaagagcattgatggattcaatgttactattccacataaagaacgtattattccgtacctagatgatattaatgaacaagcgaaatctgttggggcggtaaatacagttttagttaaagatggtaagtggattggttataatactgatggaattggttatgttaatggtttaaaacaaatatatgaaggtatagaagacgcttatatattaattttaggtgcaggtggagcaagtaaaggtatagcaaatgaattatataaaatcgttcgtccgactttaacagttgcaaatagaacgatgtctcgttttaataattggtcgttaaatattaacaaaataaatttaagccatgcagaaagccatttagatgaatttgatattataataaacactacacctgctggtatgaacggcaatacagattctgtaatttctttaaatcgtttagcttcacatactttagtaagtgatattgtttataatccatataaaacaccaatactaatagaagctgaacaaagaggtaatccaatctataatggtcttgatatgttcgttcatcaaggtgctgaaagttttaaaatttggactaatctagaaccagatataaaagcaatgaaaaacatagtaattcaaaaattgaaaggagcattatga

SEQ ID NO: 850 - DNA, 1014 bp, Staphylococcus epidermidis
  unsure (32): Identity of nucleotide at the above locations are unknown.
catatcaagatgagtattaaaattttaaagcntggcctgttttcaacaattcaagatataggtagattagggtatcaggatttaggattttctgaagcaggtgcattagattactatagtttatctattgcccaaaaacttatcggaaatcatggaccagcaattgaatatactttagtaggtcctaatatagaatttttaacagacaatacttttgccattgtcggtggtgattcagaaccgaaacttaatggtaacaaaattgacttattaactgtttatcatgtaagaaatggagaccaattagacattggtcaaatcactgaaggagcaagaggatatattgtttttggacacccacttaaaattaataaagtggctcaaagctattctacacatgttagaagtggaatgggcggatttaaaggtcgtgcattaaagaaatacgatgttattgcaactcaagtaaatcataactataaaactaatttaggaaaaacaattgatttctcatctatacctgataataattacatacacgtcattgaaggacctcagatcaatgaatttgatgaagaaacgatagctaaattcgtaaatagcgatttcaaaatttctgatcaatcagatcgaatgggatacagattaaaaggtaatacagtagcacctaaaaatagtgctgatatcatttctgaacctgtcgctttgggaagtattcaagtacctaacgatggtaatcccattattcttttaaatgataagcaaacaattggtggttatacaaaaattgcaacggtaacacaattagatttaagaaaattagcacagatgaagcctggagacattatacagtttaaatggataactgttgaagaagcttcaaaaaagcttaaagaatttaatactaaatttgaacaattattaaagcgttttgatgagcaaccattgtttaacctaaatcaacttagacatacttctaataaaatcgcagaaataattaaggaggatagataa

SEQ ID NO: 851 - DNA, 1158 bp, Staphylococcus epidermidis
actattcttgttaaacgtataaaaggagaggtaattatggccaaaagagactattatgaagtcttaggcgtaaacaaaagcgcttctaaagacgaaattaaaaaagcttatcgtaaattatcaaaaaaataccatccagatataaataaagaagaaggcgcagacgaaaaattcaaagaaatctccgaagcatatgaagttttaagtgatgaaaacaaacgtgcaaattatgatcaatttggtcatgacggaccacaaggcggatttggaagtcaaggctttggtggcagtgactttggtggatttgaagatattttcagctcattctttggtggcggttcacgtcaaagagatcctaatgcacctcgcaaaggtgatgaccttcaatacacaatgacaataacatttgaagaggctgtattcgggacaaaaaaagaaatatcaataaaaaaagatgtaacatgtcatacatgtaacggtgatggggctaaacctggtacaagtaaaaaaacttgtagctattgtaatggcgctggtcgtgtttctgttgaacaaaatactattttgggtagagtgagaactgaacaagtttgtcctaaatgtgaaggtagtggacaagaatttgaagaaccatgtccaacatgtaaaggaaaaggtactgaaaataaaacagttaaactagaagtaactgttcctgaaggtgtagataacgaacaacaagttcgtttagctggagaaggttcacctggtgttaacggaggaccacatggtgacctatatgtggtgttcagagttaaaccatccaatacatttgaacgtgatggagacgatatctactataatctagatattagcttttcacaggctgcactaggtgatgaaattaagatacctacattaaaaagtaatgttgttttaaccattccggcaggtacacaaacgggtaaacaattccgacttaaagataaaggtgtaaagaatgttcatggttatggctacggggacttatttgtcaacataaaagtggttacaccaacaaaattaaatgaccgtcaaaaagaattattaaaagaatttgctgaaattaatggtgaaaatataaatgaacagtcatctaatttcaaagatagagcgaaaagattctttaaaggagaatag

SEQ ID NO: 852 - DNA, 2301 bp, Staphylococcus epidermidis
ggtgtgcatgtgaagaaaacgagtagaataattgcattcatactcctcatagctctactattcacaggaatgggtatgacgtataagaatgtagttaaaaatgttaatttagttctagatttgcaaggtggttttgaagtcctcttccaagtagatcctttaaataaaggagataaaattgataaaaaagcacttcaagctacatctcaaacattagaaaatcgtgtaaatgttctaggtgtatcagaaccgaaaatacaaatcgaagatccaaatcgaattcgtgtacaattagcaggtatcaaggatcaagcacaagcgcgtaaattattatcgacacaagctaatttaacaattagagatgctgaagatcatgttttaatgtctggttcagacattaaacaaggctctgctaaacaagaatttaaacaagaaactaatcaaccaacagttacatttaaagtaaaaagtaaagataaatttaagaaagtaactgaaaagatttctaaaaaacgtgacaatgtcatggtagtttggttagatttcgaaaaaggcgatagttacaagaaagaagctaaaaagcaacaagaaggtaaaaagcctaaatttatatctgcagcgagtgtagaccaacctattaattctagtagtgttgaaatttcaggtggcttcaatgggaaaaaaggtgttgaagaagcgaaacaaatagctgagttattaaatgccggctcattaccagttgatttaaaagaaatttactctaactctgttggtgcacaatttggtcaagatgctcttgataagaccatgtttgcatcaattgtaggtatagcattaatttatttatttatgcttggtttctatcgtttgcctggtttagttgcaatcattgccttaaccacttatatttatttaactttagtcgcattcaatttcatatcaggtgtattaactctacctggattggcggcattagttttaggtgtaggtatggctgtcgatgccaatatcataatgtatgaacgtattaaagatgaactaagaattggacgcacgcttaaacaagcgtattcaaaagcaaataaaagttcattcttaactatatttgattccaacttaacaactgtcatcgctgcagctgtgcttttcttctttggagaaagttcagtcaaaggcttcgcaaccatgttactcttaggtattttaatgatatttgtaaccgcagtattcttatcaagagggttgttatcattactggtatcttcaaacttctttaaaaaacaatactggttatttggtgttaagaagatggatagacatgatattaatgaaggtaaagatgtacatgatttaaaaacatcatatgaaaggttaaactttgttaaattagctaagccacttatttcacttagtattttaattgtaattattggtttgattatcatttcaatatttaaattaaacttaggtattgatttctcatccggaacaagagcagatattcaatctaaaaatgctataacacaagcacaggttgagaaaactgtaaaatcagttggattggaaccagatcaaatacagattaatggtagtggaaataaaaatgccacagttcagtttaaaaaagatttatcacgtgaggaagacaataaattaagtgctaaggtgaaatctgaatttggagataatccacaaattaataccgtttcacctctcataggccaagagctagctaaaaatgctgtaactgcattaatacttgcttctataggcattattatctatgtttcactaagatttgaatggcgtatgggtctatcttctgtacttgcattattacatgacgtatttatcatcattgcaatctttagtttgtttagattagaagtagatttaacatttattgcagcagtattaactatcgttggttattcaatcaatgatacaatcgtaactttcgaccgtgttcgagaaaatctgcataaagttaaagtaattacgcatactgatcaaattgatgatatagtcaaccgctctattagacaaactatgacacgttctattaatacagtgttgactgtagttgtagttgtagttgcaatattaatattaggtgcaccaacaatatttaatttctctttagcattactaattggattattatctggtgtattctcgtcaattttcattgctgtaccattatggggcatgcttaagaaacgacagtttaaaaagacaaaaaataataaattagtagtacacaaagagaagaaatctaacgatgaaaaaatcttagtttaa

SEQ ID NO: 853 - DNA, 1176 bp, Staphylococcus epidermidis
atatataatgtaaaaactatactaaatgatttaaagattggtggttataaagtgaatgtaaaaagtgcatatattcatattccattttgctatagaatttgtacttattgtgatttcaacaaatactttatcgataaacagccagttgatgaatacttagacgcacttattagcgagatgcaagttaaaaataatagagaccttgaaacaatgtatgtcggaggtggtacaccgacagccttgaatatgagacaacttgagaagctacttagagcaattaatcaaacatttacaattagcggagaattttcttttgaagctaatcctgatgagttaacttatgaaaaagttgcacttttaaaacaatatggcgtaaatagaatatcgatgggtgtacaaacatttaaacctgaattattaaaaattttaggcagaacccataaaactgaagatatatatgatgctgttagtcatgcccgaaaggcaggtattgaatcaataagtttggatttaatgtatcatttaccacaacaaactatcgacgattttaaagacagcctggagcgtgccattgcattggatattgatcatatttcaagttatggattaattcttgaacctaaaacccagttttataatttgtatagaaagggacatttaaaattaccaaatgaagatttaggggcagaaatgtatcggtttttaatggagcgtatgaaaaactcaccatttcatcaatatgagatttctaattttggtaaacttaatcatgaatcaaaccataataaagtatattggttaaatgaagaatactatggctttggtgctggtgcaagtggttatgtaaacggtgtacgttacacaaatcttaatccagtaaatcattatattaaagcgataaatgaagggaaaaaaccaatactatctgaaacgtctcctacttataacgaaagaatggaagaagaaatgtttcttggtttaagaatgaatcaaggtgtgagtaaaagccgttttaagaaaaagtttaataaattaatcgatgaggtgtttggtgaaactattaaagatttgaggtgtaggggactcataaaagaagaaggagaatttatatctttaaccgaacgcggaaaagttataggtaacgaagtttttgaagcatttttactaaactcataa

SEQ ID NO: 854 - DNA, 417 bp, Staphylococcus epidermidis
gggaggaatgtaatgagttatcaatcacactactttaaagaagtccgagaggcacaaaaaaatgcttacgcaccatacagtaactttaaagttggtgcttatttaaagacgaaagatggtcgatgtttttatggagcaaatgttgagaacgctgcatatccgatgggaatatgtgcagaaagatcaagtttagtaagcgctatatcagaaggttatcaaccaggtgattttgaatccattacagttactgtcgatgctgataaaccatcatccccatgtggcgcatgtcgccaggtgatgatggaactttgtgataaagatatgcctgtatatatgaccaatcaaaacggagatatgatagaagctacagttgatgaattattaccattaggattttctggaaaggatttaaattaa

SEQ ID NO: 855 - DNA, 558 bp, Staphylococcus epidermidis
atgatttcagtaaatgattttaaaacaggtttaacgatttctgttgataacggaatctggaaagttattgatttccaacatgtcaaaccaggaaaaggttcagcttttgttcgttctaaattacgtaatttaagaacaggtgctattcaagaaaaaactttcagagctggcgaaaaagttgagcaagcaatgatcgagaatcgtcgtatgcaatatttatatgctgatggcgataaccatgtattcatggataacgagacatttgatcaaatcgaattacctggtgactacttaaaagatgaattaaattacttaaaagcgaatatggaagttcaagttcaatcttatgaaagtgaagttattggtgttgaattaccaaaaactgtagaacttgaagttactgaaactgaacctggaatcaaaggtgatactgccactggcgcaacaaaatctgcgactgttgaaacaggttatactctaaatgtacctttatttgtaaatgaaggtgacacactagtgataaatactagtgatggaagtcacatttctagaggataa

SEQ ID NO: 856 - DNA, 264 bp, Staphylococcus epidermidis
gaggtgacagtaatgccaaatattaaatctgcaatcaaacgtgtaagaacaactgaaacagctgaagaaagaaatatttctaagaaaaacgctatgcgtacagctgtgaaacgagctaaaacagctatctctactgatgctgaaaacaaagatgaattattaagatttgctatcaaacaagttgacaaagcatctcaaagtaatttaatccattctaataaagctgaccgtattaaatctaaacttatgtcagctaataaataa

SEQ ID NO: 857 - DNA, 1320 bp, Staphylococcus epidermidis
aatttcggagtaaaagaggtgagatatatgttcgtcgatcaagtgaaaatatctctaaaagctggtgatggaggtaatggcatcactgcttacagaagagaaaaatatgtaccttttggtggtccagctggtggcgacggtggtaaaggtgcttctgtggtatttgaagtggatgaaggattgagaactttattagatttcagatatcaaagacattttaaagctaaaaaaggcgaaaatggtcaaagtagcaacatgcatggtagaaatgcggaagacttagtgttaaaagtaccaccaggtacaattattaaaagtgttgaaagtgaagaagtgcttgcagatttggttgaagatggccaacgtgctattgtagctagaggaggacgcggcgggcgtggtaactcaagatttgctacccctagaaatcctgcgccagattttagtgaaaatggtgagccaggcgaagaattagaagtgactttagagttgaaattgttagcagatgttggattagttggttttcctagtgtgggtaaatctacattgctttcaatagtttctaaagcgaaacctaagataggtgcttatcactttacgacaataaagcctaatctaggtgttgtttcaactcctgatcatagaagttttgttatggcagatttaccaggattaattgagggcgcttctgatggtgtcggccttggacatcaattcttaagacatgttgaacgaactaaagtgattgttcatatgattgatatgagtgggtcagaaggtcgaaacccattagacgattataaaattattaatcaagaattaatcaattataaacaacgcttagaagatcgtccacaaattatagtcgcaaataaaatggatttacctgattcacaagggaatttatcgcattttaaggaacaattagataacgatgtgacagttgttcctgtttcaactattacgagagacaatattgatcaattattatatcaaattgccgataagctcgaggaagttaaagatgttgacttctcagttgaagaagatgagaatttaggtgttaatcgtgtattatataaacacacaccatcagcagataaatttactatttctagagatgatgacggcgcatatgtagtgagtggcaatgctattgaaagaatgtttaaaatgactgattttaatagtgatccagctgtaagaagattcgcaagacaaatgcggtcaatgggtattgatgatgctttaagagagagaggttgtagcaatggtgatattgttagaatcttaggcggagaatttgaatttgtcgaatag

SEQ ID NO: 858 - DNA, 570 bp, Staphylococcus epidermidis
acgaaatgggtgaataaaatggataaaaaaggactacgtagaaatataattaaaaagatgaaatcttacgacaaagaacaaaaatatttggctgatgaatggttggctaagaaattatatcaaagtgaagcttatcgcaaagctaacacaattggttttgttttatcgatgcctcatgaagttaatacatatccaattattactcattcgctaaacaataataagaaaatttttgttcctgaaacaaattatcaacagcaagacatgacttttaagcaactattatcaattgaggatatcgagaaagatagcaaaggtatttatcattctatttccccagtcggtacaacgaataaaatggacttagttgtagtaccgggggttgcatttgacaaattgggctatcgaataggatatggtggtggttattatgaccgattcctgagccaacataaatgtaatacagttagtttactatacgattttcagttagcccaattcaatatagaaccacacgatcaacctgtagagcaattaattatttatcacaataaagtggtggaggaataa

SEQ ID NO: 859 - DNA, 612 bp, Staphylococcus epidermidis
agaattatattaaagaggaggggttttatggagataagtagagctaaagaactggtaaaagaaaaactgcctgataaacgttatcaacattcattacgagtggcggatacagcagttaagttagcagaaatatacgatggtgatatcaaaaaagctgagttggcaggtatattacatgattactgtaaatacgaagacttaagtacaatgtatcaaattgttagacaatacgaacttgaaagtgatttgcttagctatggtggagagattcttcatggaccagtatgtgcggcacttatgaagcatgaatttgatgtaaatgatgaagaagttttacttgctataaaatatcatacgactgggcgtcaacaaatgactaaaacagagaaacttgtttttattgcagactatatagagcctggtagaaaaacgcctggagttgaagaaattagagatatggcatacaatcaaggtagcttagataagacaatttatgagatttctaagcgtactgtattatttttaatagaaaaggatattactgtatatggcgccacaattgcgtgtttaaattattataattatagcgatgaaagaataaaggatgattaa

SEQ ID NO: 860 - DNA, 270 bp, Staphylococcus epidermidis
atggaaatattttataaaacccaaattaataaaactttcagaacaaaaagcaaaaaccatctacagtcaaagaaaatttggtctggaagcttttttggatttgtgaagtctattttgagtttcacacgaatgtccgttcgagagataaataaagccaaaagagaactagaatttgtactaatggcacttaatataagaaaagtaacagttcaacgagctaaaaataatcaaaaaaattataaaaagacaatttctatattttttcaatag

SEQ ID NO: 861 - DNA, 231 bp, Staphylococcus epidermidis
ccgttcaaaccaactaggggagaaatgaggcctcctaaaataaattggaataggccaagtaaacttgaagcattgccacttccacctgtgcgttcagccattgccatagaaaaacaaagtggtgctatagaagtgactggacatatattaataaaaaagccaataagtaaaacatacaatggaagatgtaatgttaaagtaaatattaaaattacaacacctaacatttga

SEQ ID NO: 862 - DNA, 192 bp, Staphylococcus epidermidis
tggagcccaactggcatttttaataagatgcctaagatgactattaaggtaatgattgttaaaaatataaaaatcattttccaacttgcaatagataaagcgaggccacctaacagtggagcaatgatggtgattataccgtttatgaccataagagaagttaaaaattttgctaatttgtttccgtcatag

SEQ ID NO: 863 - DNA, 461 bp, Staphylococcus epidermidis
  unsure (326),(404),(405),(428): Identity of nucleotide at the above locations are unknown.
gtgaaggtgactcaaaatgaaaatttgaagttagcgcaacgaggtgcatttcttagtttagtcatctatattatactttctattgcgaaatatatgactggatatgtttatgattcggcggcagttagagcggatgctttaaataacatgacagacattttagtttcagtagcagttatcgtcggacttaaaatctctattaaacctgctgatcaaaaccacccatatgggcacttaaaatctgaaaatatttccacattgctagtatcattcattatcatgtttgtgggaatacaagttattatagaaaactttccgagattatntacacatgattcacatattcctaactttattactattattataagtatgatcagtggacttgtgaagttatgtgtctnngctattaattatcgattatctanaagaacgaaaagtagctccataaaatcagcagc

SEQ ID NO: 864 - DNA, 1152 bp, Staphylococcus epidermidis
atgtcaccatataaagttatcattgcacctgattcttttaaagaaagtatgtcggcaaaggaagctgctttagctattaaagatggattccaagaggtgttcgattccagtactatatatgacattattcctatggctgatggtggcgagggaacaaccgaagtattgaaagaagccttaaatgctacctcttattgcgtagaagtaaaagatccacttaatagaaatatcatggctagttatgcgagaagcgacgaacaccaaacagctatcattgaaatggcagctgcttcaggactagcattattgagtaaagatgaaagagatccatctattacaacttcgtacggtaccggccaactcattaatgatgcacttaatcacgatgttaataaaattattttaggaataggtggaagtgccacgaatgatggtggtgtaggaatgttaaaggctttaggtgtctcttttaaagataaaaacaatcaagagattcgcgatggaggtttagccctatctcaaatagaatacattgatattactcgtataaacccacgattgaaagatgtgaatattaaagtagcctgtgatgtaactaatccattattaggagacaatggagcaacaatagtttatggtccacaaaaaggcgctcaacaaaagatgataccaaagttggattccgcattacgtcactatcatgataaaattgaaagagaattaaatatgaatgtaaaagatatcccgggcgctggtgctgcaggaggcatgggaacagcgttaattgcgtttctaaacgctgaattacgtcctggaattgatgtagttcttgaagagactcaatttaaacaaagaataaaagatgcgaatttagttgttactggcgaaggtaaaatggataaacaaacaatctatggcaaaacacccattggcgtagctaaagttgcaaaatcatatgatatacccgtcattgctatttgtggtagtttaggaaaagattacgaagtaatttatcaccacggtatcgatagcgtgtttagtatcatggaacgtccatgccaccttgacgaagctttgaaagaaggcgcacttcatgttaaacatacaacaacaaatttcgcacgacttttacaattaaaaattgaaaactga

SEQ ID NO: 865 - DNA, 1242 bp, Staphylococcus epidermidis
aacgtatataatagatgctataacttttctaggagaataatgatgatgactacaagttccaaacacttatctaaaatattaatcgttatacttggcgttatgactgcatttggtcctttgactattgatatgtacggaccatctttacctaaagttcagcatgcgtttggttcatcaatttcagaaatacaacttacattatcctttgctatgataggtttagctattggtcaatttgtattcgggccactatcagatgtattaggtcgtaaaaaaatggcactcattttattgattggatatttaatagcctcattactatcagtgtttacagttcatttaacaatatttttaattatccgtttaattcaaggtttagcaggagggggtgcaatcgtcatagccaaagcttctattggagataactatgacggaaacaaattagcaaaatttttaacttctcttatggtcataaacggtataatcaccatcattgctccactgttaggtggcctcgctttatctattgcaagttggaaaatgatttttatatttttaacaatcattaccttaatagtcatcttaggcatcttattaaaaatgccagttgggctccatcaaaaacaatctcagttaaattttaaagcaatatttaaagattttggtttgttattaacaaaacccaccttcgttattccgatgttattgcaaggattaacttatgtcatgttattcagttatttgtcagccgcaccttttatttctcaaaagatgtatcatatgacaccacttcaatatagtgcaatgtttgctattaatggagtgggtttgatagtcgtcagtcagataaccgctattatagtagaaaagataagccgatatgcgatgctcatatatttaacaatcattcaaatgttaggtgttgtaattttaatatttactttaacattacatcttccattgtatgttttacttattggcttttttattaatatatgtccagtcacttctatagcaccactttgtttttctatggcaatggctgaacgcacaggtggaagtggcaatgcttcaagtttacttggcctattccaatttattttaggaggcctcatttctcccctagttggtttgaacggtcagcatgatatgtccccgtatctaattattattagtgctacagctgttttacttattgcactacaaattatttatttcaaattatttatgaaaaacacatag

SEQ ID NO: 866 - DNA, 1491 bp, Staphylococcus epidermidis
agaacagagaggtcaacaatgaattacttaaaacaatatgaatcatttttttggttaataggaatttttatcttttatcttataatggcaattctaacaccattatcaactacggattggcatgcatataaagttaatctaagtcaatatttgactcaagaaaatggtcgttatttaggacatttatttgaatgggttgccgtacataatatcataataagagctttaatatatgcgataacttcgtttttagttatctatttagttgcttatatggttcaattacatacgaatcgtttttattttattttgagttttgtgttaatggttactgtacctaatacaatttatagcgaaacttacgggtggtttactggattttttagttatatacctgctacagtcctatcactttttattctttttactgtagttaaaatgattgagtcgcacgatacagtttctgaaatgcaattatgggtatttttattagtaagtttgtttggacaattcttcttggagaatctttccatcgctaatagcttaattattttaataggaatggtagtctatttctttgttaaaaaaagactcagttatttcttaattgtaggatttatgcttagttgtataggtaacattataatgtttttaaacttcaattattttttaattaaggatggattaaatacgcattattcaatttccgatagtcatggaatgatacataaagcaggtgtgacgttatttaagcttgtaccagaatatatgtttattaatcaaatgattattcttaccgtgatatcaatagtaagtatagttttacttaagcaaaataaaagcctgaagcatatgagagtttatattaaaataccactactcttaggtttaattactttacctatttataagatcttcgtttacaatcaatttcattttgaattatataaagcttcattttctatagccgttttgaatacaacgatttgcttcatttacatgataagtgtgatatacgttgtgtttaaaatgatacagcaaagatacataagaatgattgtgatggggagttttatagctatggcttcatctgttttgccacttttatttgtgacgcctataagttatagaaatttttattttatttatactttatggatcgtgatattactttgtttaattcagcaatgtgatgtgctatttaaacaacttgaacatataattaaaatatttgcgattatcatcagcatcattatgatgattggatttacttttatacatattagtagtgtgcacagaatagacttcattaaagaacaaataacacaacatcatcgctatcagaaaataacattggaaagattaccatttgagcgatatactcatatgactacaccaaagtcgaaggaacaacttcaagatttcaaacactattatgatttgcccaaagacatcacatttaaagtagtcccatatggtacaaaacaataa

SEQ ID NO: 867 - DNA, 711 bp, Staphylococcus epidermidis
ggtgacaatatgaaaagaacagataaatatagagattcatacaaatatgatgaccaatatcaaaatcatcgtaaacgttcagaagaagatatgtatcgacaacatcaagagtcccaacagagagcaaattcaaatcgtgcaacacaaagtgaaaatgatagagagtatgaaaatcatcctgaacgttattacaatggaagagactatcgacgtgagcagcaattggaagaagaaaatgaaaaatcaagcaaaactaaaaaatggctgattgcaatcatagttattttactcattattgtagctatctttatcacgcgtgcaattatcaatcataataatgataaagtaagtaatgaccctaacgtttcacaaaactataaaaaagaagttgaaaatcaaaacgacgacattaatcgacaagttgattcagccaaaagcgatataaaaaataaaaaggacacccaatcccaaattgataaactacaaaatcaaattgatcaattaaaacaaaatgaagaaactaatgcggattctaaattcacaaaattttatcaaaaccaaatcgacaaactgaaaaatgcaaataacgctcaacttaataacgaaaatcaaagtaaagttaacaacatgcttgaagacatcaatacaaaatttgatagtattaaagctaaactagaaaatatcttgaatggatcaaattcaggaaactaa

SEQ ID NO: 868 - DNA, 435 bp, Staphylococcus epidermidis
agtagtcccatatggtacaaaacaataactgttcaaaggagaaatattatgaagttaacccgaatacattatgagattataaagtttatcatagttggtggaattaatacctttaactactatataacatacttatttttgttaaaggtgttacatgtgaattatatggttagtcacattgttggatttattgtaagttttattatttcatattatttaaattgttattttgtatataaagtaaaacctacaatagaaaagtttttaagatttcctatcactcagatagttaatatggtaatgcaaacgttattattatatatattcgtaaagtggttgaatatcgcttcagaaattgcaccttttgcgggtctaatcattacaatcccagtgacattcatactttctaagtggttacttagagataaagtttaa

SEQ ID NO: 869 - DNA, 816 bp, Staphylococcus epidermidis
gtgagattgttaatgttacattataatttttatgaatctaagaaccaaagtaagcaattattggtgatgttgcatggttttataagtgatgctactacttatcattcacatatagaacgcctcgtagaacatacaaacgtgctcacaattgacttgcctggccatggcttagatacttcatctatggacgaagtgtgggatttcccgtttattacacgtcaacttgatgaagttttaatacaatatcaaacatatgatgtgtttcttctaggttactctatgggtggccgggtagcactttattatgctatacatggtaatgaaacgctatcagggttgctcttagtgagtacttcagcaggtattcaaaatgagacggataaagtagaacgtgcccaagtggatgctgcacgtgcaaaagtacttgaaattgctggtttagatatttttgtgaatgattgggaaaagttaccactttttcgttcgcagtataatctagcacctgagatacgccaaagtattcgcaataatcgcttgaatcaagatgctaataaattggccaaagcacttcgtgattatggtactggtcatatgcctaatttatggccacatctatcattgatacgcattcctactttaattttagtaggggaaaaagataaaaagtttgttcagataggacaacaattagagaatcacttacaagatagtcataaagttcaaatttctaatgtcggacatacaattcatgtggaagatagtacggaatttgatacaataatattaggttttttaaaggaggagcaaaatgactag

SEQ ID NO: 870 - DNA, 225 bp, Staphylococcus epidermidis
aatagtgatcccgcaggtttaaaaaaggctgtaatgatgacaatgatgtatgcgatggcatacattattgccataaaaataactgaagcacgtttacctaaaagtataggcaaagtttttctaccgctagccttgtctttaacacggtcacgaatattgttacccatattgattaaaccaattgtgatgactattggaatacttaaccatacggcatatccttga

SEQ ID NO: 871 - DNA, 240 bp, Staphylococcus epidermidis
aataaccatacggaggtagacataatgaaagttaacaaaacaatttatattatagttgcattgattttaggtggtctgggcgtgcataaattttatgccgaccaagttggacaaggtattctacatctcgtctttttctggactggcattccaagtgttgtcgcaatcattcatgctatcattgttatttttactaaaaaagcagatgaatacggctacataacttttgataaaaaataa

SEQ ID NO: 872 - DNA, 1023 bp, Staphylococcus epidermidis
aaaaggagagcgtttatgacagccatcaaagatagggattattttttcgataatgctcgagcaatattgatatttctagtcgtattaggacatttattacagccttatacatctgaagataaatttttacaagctttatatttattaatatatagctttcatatgcctacctttctgtttatctcaggctattttgctaagaatttagataaacctaactatttagaaaaaattgcaaaaaaattacttcttccttatgtaatattttttgcgtttttctcactttattactatttcactggtaaagaagatgcaattcaattagacccatttaatccggtttttgcattgtggtttttactcaccctttttttctttcacgttgttttagttatagtgagaaggtataatccgtatattgtattattcatatccatacttgtttctgtattagctggtttctctggcaatatcgatagttatatgagtatatcaagaaccattgtgttcttccctatcttctttataggacatttggttacacaatcacatacggaaaaacttagaaataaaaaatggatccccatttcaataatcattctgattaccttctttataggatacacaatccatcctattaatggagattggttattaggaagtacaccttatacttctttagaaagtaacggggaggatgtttatagtcctctaaaacgcttattactctatatcattatacttttaactatgtgtgcatttctaaatctaatgccacaaactaagcgtatttatacatatataggacagcgcacaatgtttgtttatttattacacggtatcgttataggagtcattcgcgggtttgatttatatccatttaaggatcagatttctatctttacctatctttatttatttatcagtgcgagtgtgattgtattaatattatcttcaaaatgggtttgcaaatggacgaatccgttcattaatttaaaaaggccctctcaatttaaaaattaa

SEQ ID NO: 873 - DNA, 426 bp, Staphylococcus epidermidis
aacaacatgtataaacaacttgaaaaacttatcacactgacaaataatgatttgaatttagttaatagacgctttggtcaacgaactgacattacttctgaacaattagagttactacgtattttatataattatgatcgtttatctcaatacgatttaactatgaagattagtagggaacaatcaattgtatcaagatggattaaaaagttagtccaaaaaggttatatcatgagtcaacaatctcatgaagatttacgatgtaaagaactgatattaactgaagaagcaagggctttaattcagcaaatcaacacggcgagatgcgagttaattgaagcgagatgtcaatgtctatcttcagacgaaattgcaagtttaaatcaattattaaacaaacttaatagtagacacattttcatctga

SEQ ID NO: 874 - DNA, 540 bp, Staphylococcus epidermidis
cgaggaattcattgttccgaattattaaaaggactaggatttaaaagatatgcctatcgtcatgataaatatggttttaaacgagactttaaattatatgaatgtgatgattgttcagaatgccctctgaaacaacaatgtatgaacttcaattcaaaaacaaataaaaaaataatgaaaaattataattgggaatattttaaagcccaaattaataaaaagctttcagaaccaaaaacaaaaaccatctacagtcaaagaaaaattgatgtggagcctgtttttggatttatgaaggctattttgggtttcactagaatgtccgttcgagggatagataaagccaaaagagaattaggatttgtgctaatggcacttaatataagaaaagtaacagctcaacgagctgaaaataatcaaaaaaataataaaaaagacaatttctatattatttcaatagaaattgtctttttttacttatcctgggactttatgtcccacactcattatgagcaaaaggaaatctgttttaataaataa

SEQ ID NO: 875 - DNA, 954 bp, Staphylococcus epidermidis
gaggttgtgcatatcatgtcagatcaatatcaacaatattccactgttaagaagtactggcaattgatgagacctcatactttaacagccgctgttgtccctgtactcgttggtactgcagcagctaaaatatatttactcggtagcgaagaccatctgaaattcagtcttttcttagctatgttgcttgcatgtttgttaattcaagctgcaacaaacatgtttaatgaatactatgactttaaaaaaggtcttgatgatcatacctctgtgggtattggtggcgctattgtacgtaatggtatgagtcctaaacaagtaatgaatttagcaattgctttttacatcattgcagcacttttaggtatctttttagcaatacaaagctcattctggattattccagtaggcatagtttgtatggcaattggctatctatataccggtggccctattccaatttcatggacaccttttggtgaactattttcaggattatttatgggtatgattatcatactactttcatttttcatacaaaccggtaatgttcaaggatatgccgtatggttaagtattccaatagtcatcacaattggtttaatcaatatgggtaacaatattcgtgaccgtgttaaagacaaggctagcggtagaaaaactttgcctatacttttaggtaaacgtgcttcagttatttttatggcaataatgtatgccatcgcatacatcattgtcatcattacagccttttttaaacctgcgggatcactattttacttgttagttttattatcattcccaatgcctattaaagcagtgagacgttttaataaaaatgatacacctgaaacaatgatgcctgcgatggctgcgacaggtaaaacgaatacattctttggtttattgtatgcattaggaatctatattagtgcacttttaggtgcaatctaa

SEQ ID NO: 876 - DNA, 183 bp, Staphylococcus epidermidis
aattctaataactctcttaataatattctgcatgttaactccccttatattttgtttgatattttatacccagtttttgtaggagctaaaagtaaaatttgttattttggaaaatatgaagaaatatttttagatgttattttttatcaaaagttatgtagccgtattcatctgcttttttag

SEQ ID NO: 877 - DNA, 780 bp, Staphylococcus epidermidis
ttaatgtgcaaagcctttgttgaagcagttgatgaattaggtggtatatattatgacgtaccatataacttaaatgaacctaacagtgatgatactggtagaattaaaataaaaaaaggataccaaaagctaaacggcgaccaagcattagctgtagctcgaactagacaccatgattcagaccttaaacgtggtcaaagacaaatggaacttattaaaatattgttccaaaaagctcaaaatttaaaatctatagataaacttgacaatgttattagtattgtagggaaaaatgctaaacataatttaactcaaaaagaaattaagtctctagccaaaatgtatcttggtggtagtactgaaattaaaacatcacaacttaaaggtaaggatgactacttaaatgatatatactattaccacccaagcgtaaaaagtattatggaatattcaaatcttttacgtaatgatttagatttatctaaaataacaaacaaaaacgatttcttagatcaaagagtcattaaacgatatggttcactcgtacccttaacagaattagatgaagacttattgcgtaagaaccaaaaggaatcgactgatagtcagaaagagtctgattcttcatcacaaaataatgatgaagaagatcaaactaacgaacaaacagaccaaaatagcttaaacggaaacgaacagtacccaaatcaacaagacaacaatcaaaccaatggtgaaaatggtatgataaataatgacaattatccttacgcacaataa

SEQ ID NO: 878 - DNA, 831 bp, Staphylococcus epidermidis
aggaggagcaaaatgactagacagtgggaaacacttagagaatatgatgaaattaaatatgaatttttcgaagggattgccaaagtaacgattaatcgtccagaagtaagaaatgcatttactcctaaaacagttgctgaaatgattgatgcattttcacgtgcgcgtgatgatcaaaatgtatcagtaattgtattaactggtgaaggggacaaagcgttttgttcaggtggagatcaaaaaaaacgtggacacggtggttatgtaggtgaagatgatattcctcgtttaaatgtattagatttacaacgtttaattcgtgtgattcctaaaccagtaatagcaatggttagaggctatgcaattggtggaggaaatgtacttaatgttgtttgtgatttaactatcgctgcagacaatgctatttttggacaaactggaccaaaagtaggctcatttgatgctgggtacggttctggctacctagctcgtatagttggccataaaaaagcaagagaaatctggtacttatgccgtcaatataatgcacaggaagctttggatatgggcttagtgaatactgtagttccattagaacaagttgaagacgaaacagttaaatggtgtaaagacatcatgcaacactcaccaactgctttacgtttcttaaaagcagcaatgaatgctgatactgatggtttagctggtttacaacaaatggctggagatgcgactttactttactatactactgatgaagcgaaagaaggacgtgacgcgtttaaagaaaaacgtaatcctgattttgaccaattccctaaattcccataa

SEQ ID NO: 879 - DNA, 4008 bp, Staphylococcus epidermidis
atggcgaaaaaattcaattacaaattaccgtctatggttgctttaacgttatttggcacagcttttactgcacatcaagcaaatgctgctgaacaaccacagaatcagtctaatcataaaaatgtattagatgatcaaactgccctcaaacaagcagaaaaagctaaaagcgaagttacacaatcaactacaaatgtatctggtacacaaacatatcaagaccctacccaagttcaacctaaacaagacacacaaagtactacatatgatgcatcattagatgaaatgagtacttataatgaaatttcatcaaatcaaaagcaacaatctttatcaacagatgatgcgaatcaaaatcaaacgaattctgttacaaaaaatcaacaagaagaaacaaatgatttgacacaagaagataaaacatccactgatacaaatcaattacaggagacacaatctgtagcaaaagaaaatgagaaagatttaggagctaacgcaaataatgaacaacaagacaagaagatgactgcaagtcaaccttccgaaaatcaagcaattgaaactcaaactgcttctaatgataatgaaagccaacaaaaaagtcagcaagtaacttctgaacaaaatgaaactgctacacctaaagtatcaaatacaaacgcatctggttataattttgattacgatgatgaagacgatgatagctcaacagaccatttagagcctatctcattaaacaatgtgaatgctacatctaaacaaactacttcatataaatataaagaaccagctcaacgtgtaacaactaatactgtaaaaaaagaaacggcatctaatcaagcgactatagatacaaagcaattcaccccatttagtgcaactgctcaaccgagaacagtttattctgtatctagtcaaaaaacatcatcattaccgaaatatacaccaaaggttaattcttcaataaataactatattcgtaaaaagaatatgaaagcaccaagaattgaagaagattatacgtcatatttccctaaatatggctatagaaacggtgtgggacgtcctgaaggtatcgttgttcatgatactgcaaatgataactcaacaatcgatggcgagattgctttcatgaaacgtaattacacaaatgcattcgtacacgcatttgttgatggcaatagaattatagaaacagctccgacagattacttatcttggggtgcaggtccatatggaaatcaacgttttatcaatgttgaaatcgtccatacacatgattatgattcatttgcacgttcaatgaacaactacgctgattatgctgcaacgcaattgcaatattataatttaaaacctgatagcgctgaaaacgatggaagaggaacagtttggacacatgctgctatctctaacttcttaggaggtactgatcacgctgaccctcaccaatatttaagaagtcacaattatagctatgcagaattatatgacttaatttatgaaaaatatttaattaaaacgaagcaagtagcaccttggggcacaacatctacaaaaccgtcacaaccttctaaaccatcaggaggaactaataataagttaactgtgtctgctaatcgtggtgttgctcaaattaaaccaacaaataatggcttatatacaactgtttatgacagtaaaggtcataagactgatcaagtacaaaaaactctatccgttactaaaactgcaacattaggaaataacaaattctatttagttgaagactacaatagcggtaaaaaatacggttgggttaaacaaggtgatgttgtttataacactgctaaggcaccagtaaaagtgaatcaaacatataatgttaaagcagggtcaacactttacacagttccttggggtacaccaaaacaagttgctagcaaagtatctggtactggaaatcaaacatttaaagcaactaaacagcaacaaattgataaagcaacgtatctttatggtacagtgaatggtaaatctggttggattagtaaatattacttaactacagcatctaaacctagcaatccaactaaaccttcaacaaacaaccaattaacagtgactaacaatagtggtgttgctcaaatcaatgcaaaaaatagtggcttatatactacagtttatgacactaaaggaaagacaacaaatcaaatccaacgtacattgtcagtgacgaaagctgccacacttggtgataaaaaattctatcttgttggtgattataatactggtacaaattatggttgggtaaaacaagatgaggtcatttacaacacagctaaatcacctgtaaaaatcaatcaaacatacaacgtcaaacctggtgttaaattacacacagtaccttggggcacatataatcaagtggctggaacagtttcaggtaaaggcgatcaaacttttaaagcaactaaacaacaacaaattgataaagcaacatatctttatggtacagtgaacggtaaatctggttggattagtaaatactatttaactgcaccatcaaaagttcaagctttgtctactcaatcaacaccagcacctaaacaagtaaaaccatctacacaaactgtaaatcaaattgctcaagtgaaagctaataattctggaataagagcatctgtatatgataaaacagccaaaagtggtacgaaatacgctaaccgtacattccttatcaataaacaacgtactcaaggtaataacacgtatgtactacttcaagatggaacaagtaatactccattaggatgggtaaacattaatgatgtgacaactcaaaatatcggaaaacaaactcagtctataggtaaatattcagtaaaacctacaaataatggtctatattctattgcttggggtactaaaaaccaacaattactagcacctaatacgctagctaatcaagcatttaatgcttccaaagctgtttacgttggtaaagatttatatctatacggtacagtcaataacagaacaggatggattgctgctaaggatttaatccaaaacagtactgacgctcaatcaacaccatataactatacttttgttatcaataatagtaaaagttatttctatatggatccaacaaaagcaaaccgatattctttaaaaccatattatgaacaaactttcacagtcattaagcaaaaaaatattaatggcgttaaatggtactatggtcaacttttagacggtaaatatgtttggataaaatcaactgacttagttaaggaaaaaattaaatatgcatatactggaatgactttaaataacgcgataaatatccaatctcgtcttaaatataaaccacaagtacaaaatgagcctttgaaatggtcaaatgctaattatagtcaaattaaaaatgctatggatacaaagcgtttagctaatgattcatccttaaaatatcaattcttacgtttagatcaaccacaatacttgtcagcacaagctctcaataaattattaaaaggcaaaggtgtacttgaaaaccaaggcgctgcatttagccaagctgcacgtaagtatggtctaaatgaaatttatcttatctcacatgctttagtagaaacaggtaatggaacttcacaacttgctaaaggtggagatgtttcaaaaggtaaattcacaactaaaacaggtcacaaataccataatgtctttggaattggtgcatttgacaataatgcacttgtagatggtatcaaatacgctaaaaatgctggatggacttctgtctctaaagcaattattggtggcgctaaattcattggaaattcatacgtgaaagcaggacaaaatacgctatataaaatgcgttggaatcctgcaaaccctggtacgcatcaatatgcaactgatattaattgggcaaatgtcaacgcacaagtattaaaacaattttatgataaaattggtgaagtcggtaagtacttcgaaattccaacatacaaataa

SEQ ID NO: 880 - DNA, 1389 bp, Staphylococcus epidermidis
aattcggaggagaaagaagtgaaaaaaatggatgtgaatgtagacgaacaggcaatcgtcgataagttatatgaaagtacaaaagattgggtttcagttgaagttgaattaaataaaactatgaaacctagtgtgttgtttcatttaactgaaaaagatgctggggaccgtttttacatgcgcttaaatgataattattcttcgtattttggatatcatgctattcataggtttaaaaacgactttgagaataagcaatccatttttaaggactgggaaaaattaaaaaataatattgaacttattcatccacataataaatatcatcatcttagattgtgtggcggttttcaattttcgagtcacaaatcagatgatgaatggagagaatatggtttaaaccattttgttttacctaaagtattaatttctaatgaaggtacgcgtacttatctaacttatacaacaaagcgacaagattttgatttacaagcatttaaaactttagtggcacattttgaacaaacaaccatggataaccctgaggaagcacttggagatgtgacgcgtatggaagatatttataaggatgattggcgtgatctcgtaaaagaagcgattgatacgattgacgacaataaaaaaatcgttctcgcacgtcgtcgtttagtcaaatttgataaaaaaatcaatattccatatgttttaaaccgggctcttgaaaatgaaaaaaatagttatatatttttattagaagctaatcagtcaatattcttttctcaaacgcctgagcaattaatcaaagttgaagatggtgttttatctacaaaagctgtagcaggtaccattaaacgtacacataatgagcaaatagataataagaatatagaggcatttcttaaagataagaaaaatttaggagaacatcgttttgttgttgagagcatcttaaatgatattgagccttttgtacaggatgtagagtacaatgaaacgcctaatattttaaaaaatgatcatatgtatcatttatatacggaaatcaaagctaatttaaatgacaaatcatacattggtttaatcgatcgtttacatcctacacctgcgttaggtggctaccctaaagaagaagcgcttgattttattgagaataaagagtttggtactcgaggtttatatggcgcgccggtaggctatattgatgtttatgatgattgtgaattcattgttgctatacgttctatgctaattaaagagcaacaagcgactttatacgctggatgcggcattgttaaaaattcggatcctgatagtgaagttgctgaaactgcagttaaattctcaccaatgatgaacgccttaggagtagataataatgatgaatcatag

SEQ ID NO: 881 - DNA, 453 bp, Staphylococcus epidermidis
gggaaaaccagtgaaaatggaggtgatactgtgtttcaaatagcaaaaaaccaaacgatgctagatgattgctttgaaataagaaagtgtgttttcgtcgaagaacaaggcgtaccactcgaaaatgaatttgatcaatatgaagattactcattccatatagtgggatatataaatggtgttcctatggcaactgctagaattagacctttaaatactcatatttgtaaaattgaacgtgtagcaatcatcaagtggtatcgtggtcttgggtacggtaaaaatttaatacatgctattgaaacaattgcaaaaaaacaccaatacaatgaactcactatgaatgctcaattacaagctcgagacttttacttaaaactaggttactcaccttttggtaaagtattcttagaagaaaatataaatcatattagtatgaataagtttttataa

SEQ ID NO: 882 - DNA, 312 bp, Staphylococcus epidermidis
tgccccaggcttttttattgcaaacacagacaacaatttaatttaaaaacccgcttaatatcgagttatttcaacatttgtctaaacccagaatttcaaacagaaattctacagacaaggcaagttggggttcggggccccaacatagagaatttcaaacagaaattctacagacaaggcaagttggggttcggagtatgtttagacaacgcgcttataacttatgccccactgaaaccatttataaaaattcaatctgtaaacaaaattaatgtttattcatttatatacatcacacacctttcattatga

SEQ ID NO: 883 - DNA, 606 bp, Staphylococcus epidermidis
aaattgagtataaactttagctatcaatatctaaaaggggagtcaaatgtgattagaaaagcgaaaacgagtgataatcgacagattgcagagttatgttaccttatttggagagatatggaattagatattaccaaggaaataactaaagatcgtattattgaagcgatagaattaagtattgtgaatgtgagatatcggtcgttttatgagcatatttgggtatatgagaaagacggggttgttgctggatgtgtaattgcgtatcctgggaaagaggaaatggattttgaacaacaatggcttaagttaccacttgaagaagatatccttcagttaggtacaccattacctgaaaaagaatcatacgatgatgaaatatatatagaagcagtagtaacgactccaaaatatcgaggacaaggtattgcaacacaacttttaaagtatgtaatttccactcatgcacatgaaaaatggggattgaattgtgattatgataataataaagcacgccacctatatcacaaattagggtttaaagaggatgcgacaattcgtttatatggccatcaatattttcatatgacattgaataataagtaa

SEQ ID NO: 884 - DNA, 1680 bp, Staphylococcus epidermidis
ataataatgatgaatcatagtgaagctttaactgaacaagtattttcatttgcttcagagctttatgcttatggtgtaagagaagtagtaattagtccaggttcacgttcaacaccattagcacttgttttcgaagcacatccaaatattaaaacatggattcaccctgatgagcgaagtgctgcattttttgctttaggtcttattaaaggtagcgaaaaacctgtagcaattctttgtacatctggaacagccgctgcgaactacacacccgctatagctgaaagtcaaattagtcgtttgcctctcgttgttttaacgagcgacagaccgcatgaactgcgcagtgtgggtgcacctcaagcaatcaatcaggtaaatatgtttagtaattatgtgaactttcaatttgatttgccgattgctgatggaagtgaacatacaattgatacaattaattatcaaatgcaaattgcaagtcaatatttatatggaccacaccgaggaccgattcattttaatttaccatttagagaaccactaacaccagatttagatcgtgtcgatttattaacatctgtaactaaaacgttacctcattatcagaaatcgatttcggtagatgatataaaagacatattacaagaaaaaaatggtctcatcattgtcggagatatgcaacaccaagctgttgatcaaatattaacgtattcaactatatatgatctgccaatcttagcagatccccttagtcagcttcgtaaagagaaacatcctaatgttataaccacttatgatttattgtatcgagcaggattaaatttagaagtagactatgtcatacgtgtaggtaagccagttatttctaaaaaattaaatcaatggttgaagaaaaccgatgcgtatcaaattattgtgcagaataatgatcaaattgatgtatttccgacaccacctcatatatcttatgagatttcagcaaatgattttttccgttcattaatggaagaaccacttgttgaacgaaaaaaatggttacagcaatggcaatcacttgaacaacaagcacgcattgaaataagtgattacttaaagcatgcgacagatgaagcggcatatgtagggagtttaattcaaaaacttacaaaagaagatacattatttgttggaaatagtatgccaattagagatgtcgataatttactgtttgatagtgaggcatctgtatacgctaatcggggtgccaatggaatagacggagtagtttcaactgcgctaggtatggcggcacataagaatgtgacattgcttattggtgatttatctttttatcatgacatgaacggtttattaatggccaaattaaatgaacttcatattaacattgtattagttaataacaacggaggaggtatcttttcatatttacctcaaaaacgatcggctacaaaatattttgagcgattatttggaacaccaacaggcttaaactttgaatatactgcactgttatatgattttacatttaagcgctttgataatttgactgactttaaatatgctgaattatctaaaatgggttctcacatgtatgaagttataaccaatagagacgaaaatttgcatcaacaccaaaatttatatcagaaattgagtgagattgttaatgttacattataa

SEQ ID NO: 885 - DNA, 507 bp, Staphylococcus epidermidis
acttatgtagtaaatatacttaaaaggagcgcaaatatgagtcgtaaaacatatgaaaaaattgctaatattaatggtatgttcaacgtacttgaacaacaaatcattcatagtaaagatatggcattatttaggaatgaatttttttatgtaaaccatgaacacagagaaaattatgaagcgcttttgatctactacaaggatagtttagataatcccgttgtagatggcgcatgttacattcttgcattacctgaaatatttaataaggttgatgtgtttgagtctgatttaccttttacctgggtttatgatgaaaatggactttctgatacaatgaaaagtatcagtgtgccccttcaatatcttattgcagccgctttggaagtgactgatgtaaatatatttaagccttcaggttttactatgggcatgaacaattggaatattgcccaattacgtattttttggcaatactgcgctatcgtcagaaaagaggctttataa

SEQ ID NO: 886 - DNA, 1188 bp, Staphylococcus epidermidis
caaatgaaattatcattaaattcaagttcaaaatttttaagagcccctagtattcgtcaattttctaatagaattaaagcgattgacgattgtgttaatttaacaattggacaacccgattttcctatgccagatgtggtcaaaaatgcttatatcaaagcaatcaaaaacgataaaacaagttattctcataacaaaggtttatttgaaacacgcgaagctattagccaatattttaaacgaaaatataatttcctttatagtgaggaagaaatcatcgttactaatggtgcgagtgaagcattagatacatcgttaagaagcattattgagcctggcgatgatatacttattccaggaccgatatacgctggttatatcccattagttgaaactctaggtggaaatccagtatatatagataccacacaatcagattttaaagtaacacctgaactgattgagtcgcatctaacgcataaaactaaagctatacttctaaattaccctaccaacccaacaggtgtaatactcgaacgctctgaagtcaaaaatatagtagacacacttgtaaacaaacacatttttataatcagtgatgagatttatgctgaaaatacgtttaaaggacaacatacatcttttgctgaatttccagaaattcgagatcaattattacttataggtggtttgagtaagtcccattctgcaacaggtattcgaatcggctttttacttggtcctgaatatttaattgaaaaattaacctttatgcacgcttacaattgtatttgtgcaaatgtaccagctcaaattgcttgtactaccgctttaaatgaagggataaatgcccctctatacatgaatcgtgattatatcgaacgtcgtaattacctgaaagaaaaattagaatcattaggcttcgaattaactgctcaacctgaaggcgcattttacatcttccctagtattaaaagatttacggaaaacgattttgaattttgtgttgatgtgttggagaaagcacacttagctatggttcctggttcttccttcaccgatattggcaaagggtatattcgaatttcatatgcttatgatatggaaacattaaaaaaaggaatgcatcgattagaaaattatttacagcaacattatccagagcaaatgaccactccaactaaataa

SEQ ID NO: 887 - DNA, 300 bp, Staphylococcus epidermidis; identical to SEQ ID NO: 233

SEQ ID NO: 888 - DNA, 351 bp, Staphylococcus epidermidis
gcaattataccacatatgactccattaattgtcaatggtatggctataattaaatgctttaagtacacaggaatcatcattttagcagcacctatgagtaataccacgttaactccaagagaattaactcttaaagatccaaataaaaaggttacacaagctgcaactattcccatatttgcagcaccacttcctaaaccagtaaggttaattgctgttgctatagcaactaacgagattggagttaccattaataaagaaaatgttacacaaattaatatagacattaataatggatttaattctgtaaacctgtttactaattttcctagtgactgcgtaataacttga

SEQ ID NO: 889 - DNA, 294 bp, Staphylococcus epidermidis; identical to SEQ ID NO: 235

SEQ ID NO: 890 - DNA, 240 bp, Staphylococcus epidermidis
ctacggatcaagaggttatgggttcgactcctatcgggcgcgcttattttacgggaagtagctcagcttggtagagcacttggtttgggaccaaggggtcgtaggttcgaatcctgtcttcccgatagtaaaataaattttgggggcttagctcagctgggagagcgcctgctttgcacgcaggaggtcagcggttcgatcccgctagtctccaccaatattaatttacaaactacataa

SEQ ID NO: 891 - DNA, 1080 bp, Staphylococcus epidermidis
tgttttaaatggaggtttaacatgagtcattcgcaaataaatggaaagcgattttttaacaacattttgaatgcagtaggagcaggggtagttattgcactgttacctaatgccttattaggtgaattattaaaattcttcaaagaaggtaatcatgtactagaaacgatttttcagctagtaacaatcatacaatcttttatggcttttattataggggttcttgctgcgcaccaatttaaatttaaaggtacaggtgctgcaattattggtatttcagcaatgctaggttctggagctgtacactataatggacaaacaattgaattaaaaggaattggagatattataaatgtaattttagtagttatattagcgtgtttcatttatatgtttttagaggggaaattaggttccttagaaatgattattttacccgttttagttcctgtaattagtggattaatagggttattaacattaccttacgttcaagttattacgcagtcactaggaaaattagtaaacaggtttacagaattaaatccattattaatgtctatattaatttgtgtaacattttctttattaatggtaactccaatctcgttagttgctatagcaacagcaattaaccttactggtttaggaagtggtgctgcaaatatgggaatagttgcagcttgtgtaacctttttatttggatctttaagagttaattctcttggagttaacgtggtattactcataggtgctgctaaaatgatgattcctgtgtacttaaagcatttaattatagccataccattgacaattaatggagtcatatgtggtataattgcttatattttaaaaattaaagggactgcactatctgctggctttggttatactggattggttggtcccatcaatgcattaaaccgtatgtcgggaaatccatctatgaatattattttattaattattggatatttcgtgataccatttgcaggtgcctttattgtacacaaaatttgtaaaaaagtattaagtacatacagtgatgaaatatataaatttgaaatctcaaaagattaa

SEQ ID NO: 892 - DNA, 936 bp, Staphylococcus epidermidis
tcacatattttatcagtttatatatataatttaattgtaacaactgttattaaaaaaataaattttataatttttggaggttatcatatgaaaaagagatttttatctatatgtacaatgacaattgcagcgttagcaactactacaatggtaaatacttcttatgcaaaaaccgatacagaaagccataatcattcctcacttggcacagaaaacaaaaatgttttagatattaatagttcgagtcataatatcaaaccaagtcaaaataaaagttacccaagtgtaatattacctaataataatagacatcaaatttttaatactacacaaggtcattatgatgctgttagttttatttatataccaatagatggtggatatatgagtggttcaggtgttgttgtaggtgaaaatgaaatattaactaataaacacgttgttaatggagctaagggtaatccaagaaatattagtgtccatccttcagctaaaaatgaaaatgattatcctaatggcaaatttgtgggtcaagaaatcataccgtatcctggtaatagtgatttagcaatcttaagagtgtcaccaaacgaacataatcaacatattggtcaagtagttaaacctgcaactataagtagcaatacagacactagaattaatgaaaacatcactgttactggttaccctggtgacaaaccattagccacaatgtgggaaagtgtaggtaaagttgtctatattggtggcgaggaattaagatatgacctaagtactgtaggtggaaactctggatctccagtatttaatggtaaaaatcaagttattggaatacattatggtggcgtagataataaatacaatagcagtgtttatattaatgatttcgttcaacaattcctaagaaacaatatacctgatataaatattcagtaa

SEQ ID NO: 893 - DNA, 207 bp, Staphylococcus epidermidis
ctgtgttggctttctaacccgcaccacttatcgtggtgggagacagtgtcaggcgggcagtttgactggggcggtcgcctcctaaaatgtaacggaggcgctcaaaggttccctcaaaatggttggaaatcattcatagagtgtaaaggcataagggagcttgactgcgagacctacaagtcgagcagggtcgaaagacggacttag

SEQ ID NO: 894 - DNA, 747 bp, Staphylococcus epidermidis
aagagggtatcgctcatgattgaattgtctcatatccataagtcttttaatgaaactgaagtgattaaaggtattgatttgaaaattaatcaaggtgaagttgtgacactaattggacgttcaggttcaggtaaaacaactttacttagaatgattaatgctttagagatacctactgaaggtacagtgtatgttaatggcatgacatataacactaaagataagaaatctcaaattaaagtaagacaacaatcaggaatggtttttcaaaattataatttatttccacataaatctgcattagaaaacgttatggaaggtcttataacagttaaaaagatgaataaagcaacggctaatgaagaagcaatgaatttattggctaaggttggattggtacatgttaaagatcaacggccgcatgctttatcaggagggcaacaacaacgtgtcgcaattgctcgtgcattagccatgaatcctaaagtgatgttatttgatgagccaacatctgcacttgatcctgaattggtcaatgatgtattaaaagtcattaaagaattggctgacgaaggtatgacaatggtcattgtgactcacgagatgcgttttgccaaagaagtttccaatcaaattgcttttattcatgagggcgtcattgcagaacaaggtacgcctgaagatatatttaatcaccccaaaacagaagagcttcagcgatttttaaatgtgattaatgaaaaatag

SEQ ID NO: 895 - DNA, 828 bp, Staphylococcus epidermidis
gaagacatgttcaagaacaacaaaagtattgaagatacttatgcaacaaaacctattattcagaatatcgttggtcaggcacaaatcaaacaagtgatggcgaaacaaacacccatgagatatacgttgaaagctatcatggctggttttctattatcaatagttacagtttttatgttagcaattaaaacacaattcgcttcaacgcataatgacgggttaatcaatttgatgggagctattgcgtttagtttaggtctcgtattagttgtgttaaccaattctgaattattaactagtaattttatgtatctgactgttggttggtattataaagcaattagtgtaagtaaaatgatatggatttttattttctgttttataggtaatatcttaggtggatttattttatttttcctcatgaaatatgcacatgttatgacgccagaaatgacagatagtttaacagcattagtacataaaaaaacagtagaatcgacttggttaaatattttgattaaaggtatattttgtaatttctttattaatatcggtatttttatttcaatgcagtttaaagagggactagccaaagcattctttatagcttgtggagtgattgtctttgtatttatgggttacgaacacgttgtttttaacgctggattatatgcaggtatgatgttctttaatatggatggattatcttggttgggtgtgctaaaaaatattgtttttgcattccttggaaactatatcggtggaggtatctttattggattagtgtatgcatatttgaacggtaaacgtgacagcctccaaccatag

SEQ ID NO: 896 - DNA, 216 bp, Staphylococcus epidermidis
taccttcatacttttctaaagaaaccaggttcagcgaatggtattgtatccatgatgggaggaataggcggtttcttcccaccactggtgattacttttgtaacgagtatcactggttcaagtcatctcgctttcttcttcttggctatatttggtgtaattgctcttattacaatgattcatttaaataaaaaagagaaagctattcgtatataa

SEQ ID NO: 897 - DNA, 471 bp, Staphylococcus epidermidis
gcgactttaacaagggatcattacatgtatgtagagaatagttatttgagcaaacaattatgttttttattttatgtttcctctaaagaaatcatcaaaaaatatacagattacctaaaagagtatggtcttacatacacaggttatattgtattaatggcgatagaagatgatgagaaacttaacattaaaaaactaggcgaaagagtcttcttggattctggcacgctgacaccattattaaaaaaattagagaaaaagaattatgtcattcgaactcgtgaagaacaagatgaacggaaccttcaaatttctttaacagaacgtggcaaggatattcaaaatgttctatctgatatttcacaaagtgtttttaatgaatttaatattactcaagaagaaacccaaaatttagttgaagacttgcaaaattttgtaacgaaaaattttgataaaacagtggaaaagtga

SEQ ID NO: 898 - DNA, 201 bp, Staphylococcus epidermidis
acgcgatctgcgtcatataataaaacacctaaatatctcatacgtcctgtacaagtttcggaacaaacagttggcataccagcttcgattcgtgggaaacaaaatgtacatttttcagctttattcgttttccagttaaaatatacttttttatacggacatccagtcatacagtatctccaacctcgacaggcttcttga

SEQ ID NO: 899 - DNA, 951 bp, Staphylococcus epidermidis
tggagatatttacttatgtctataacttatcctggcacagtttatctaatcggtgcaggaccaggcaatccaaacttattaactaaaaaagctgaacggttaattagatcagctgacgtgattttatttgatcgtctcgtaaatcctttcatcttacagtatgcttcttctcaaacaaaagtgatcaatgtgggaaagaaaccttattgtaaacacattcaacaagaggagattaatcaaaaaattgttgaagcagccaatcaatatcaatgtgtggtgagactgaagggtggagatcctgcgatttttggtagaattacagaagaagtacaaacattagaagatcatcatattcattacgagattgtccctggtgtgacatcagcaagtgctgccgtagcaactatgaatatgggattaacaatgcgttctatcgcaccgagtgtgactttctcaactggtcattttaaagattcggttaatcacgatatggatattaggaacttgattaatggaggcactttagctatttatatgggtgtgaaaagattaggtcaaattattaaacaaattgaatcgtatacgaatgaagactaccccattgcaatagtgtttaatgcttcctgctacaatgaaaagattgttataggtcatttaagtacgattgaagaacaattggtttctcaacaactagaaggtcatccaggcatatgcattttaggtaatatacttgatgacattaatcgtacgttattgaataataataagaatgacaaggggaatctatatttaattaagggagataaagaacgtgcaattgcaaaggctgaaactttatatgatgaaggaatccaatgtctgattgattttgaccatagctaccacatttctcaacaaaacgtgtataacgaaatgattaaacataagagtattaaaacaatatatgtataa

SEQ ID NO: 900 - DNA, 639 bp, Staphylococcus epidermidis
agaagagaatatgtattaatcgttttaggaaaaggagaaacgatgaaaaaattaatcggattattgatgattttatgtatggttttgctatacagttgctcaggtccaatggactctccaaagcattctaataatagcaaacctgtagtggtaatatacggtgattataagtgtccttattgtaaaaaaacagaagatcgcgtgatgccaaagcttaagaagaagtatattgatacaaacaaaattaaatatcaatatgtgaatttggcattcttaggaaaagattcaattgtaggttcaagagcgcagcatgcggtaaatcattatgctcccaagaagtcacttgaatttcagaaattaatgtttaatcaacaaaaagatgaacataagcaatggattacaacacgtcttgttgataagcaaattgataaattaagtatcagtgatgacaaaaagaaaaaaataaagactgattataaaactaaaggttccatctcgtggaaaaaagccaaggaagatcaacaaattgcgaagaaaaatcacatcaagcaaacacctacagcgtttgttaatgataacaaggttgaagatccatatgacttttctagctacgagatgttgctagaaaacgaaaagtga

SEQ ID NO: 901 - DNA, 312 bp, Staphylococcus epidermidis
tcgggtatacaggttttggaatttttaaagagtcgattttcaccattaagtgatggtttcaatgaacaagatttagaagaatacagactagacatattagaagttgaagatgtaatcgatgttaataatattaaaggtagatatcatggaagtagtatctttatagatgtgaccatggtagtagatcgttatctttcactttatgaagcacatcagatttgtgataaagttgaaattcatttgcataataaaggaatttcgtctgtatatgaacatccagaaccctatagtacaaaagacgaagtaaaataa

SEQ ID NO: 902 - DNA, 189 bp, Staphylococcus epidermidis
tgtaattcacatttaaaattaaaatcggggatttccctaatggcatggatatggttttctaggatgaaattgaggccaaaattaaaatatattattaactattttataatatatgttgcaattgaaattacactttacgctgtcattttaaaccacaaactattttataatgagctgcattcattatag

SEQ ID NO: 903 - DNA, 714 bp, Staphylococcus epidermidis
atacttataaagcgcaaggaagtcaaggttacggtggagagtactttggctctaattgtgaaggttgtggtgttgcagttcaatcaggtaaaactggacaagaaatttataatgaaaatttctatggagggatcttccgtgattaaccttgaacaattaagtctataccaagatagcttaggctatcttggtcaacaaatgaattttccagaaaaaatgacatttcatccaaaaatatttgaagaaactatttctaagtctcaccccggctacgaagatttgcttgcatatagagaagtcatgatgaattatactttgtcagaaattaaagctatctatacagatacatttgattttagtaaaaaacacccactctatatgacatttaataaatttgacacgcaaaaggaacggggtcaaatgctagctaaattaaaggttttatacgaaatgtttggactaaaaatggttgataatgaattatctgattttctcccattgatgctacagtttttgcaagttgctgattttaaaaatgatagtcgagcacaggaaaaccttcaacttgtcattatgattattgaagatggtacgtatgaaatggcaaataccctagctgaaaacaataatccctatgcatatgttgtcagtgcattaagaaaaacgttaaaagcgtgtatcgtgcctttgaaagaggtggaaaatcatgcttaa

SEQ ID NO: 904 - DNA, 2409 bp, Staphylococcus epidermidis
agtatggcaaaacaaaaacttgtaatgattggtaacggcatggcagggttaagaacgatagaagagattttagaacgttcacaatcacaatttgatattactattattgggaaagaaccttatccgaactataacagaattatgctatccaatattttacagaagaaaatgactgtcgaagatacaattatgaatccttatgattggtatcaagagaataatattgaacttataaataatgatccagtggaaaaagttgataaagaaaacaaaatagttactacttctaaaggtattgaagtagagtatgacatttgtattttcgctactggatcaaaagcttttgtgttacctataccaggttcaaaccttcctagtgtcattggatggcgaacaattgatgatacaaataaaatgattgaaattgcccaaacgaaaaaacgagcagttgtcattggtggaggtcttctaggcttagagtgtgccagaggacttctagatcaaggaatggaagtgacagttcttcatttagctgattggctcatggaaatgcaattggatcgtaaagctggagaaatgcttaaagcagatttagaaaagcaaggtatgaagattgaacttcaagcaaattctaaagaaatcattggtgataaagatgttgaagccattaaattagctgacggtcgggtgattgaaacagatttagtagttatggctgttggtatcagaccttatactgaagttgctaaagatagtggattagatgtcaatagaggtattgttgtaaatgattatatgcaaacatctgattctcatatttatgcagtcggtgaatgtgccgaacatgatggtaaagtttatggattggtggcgccactttatgaacaaggcaaagtgctagcagattatttaactggtaaagaaacaaaaggttataaaggatctactactttcacttcacttaaagtatctggttgtgatttatatagcgcagggcaaattgttgaagatgaagatattcatggtgtagaaatttttaatagtgtagacaatatctacaaaaaagtgtatttaagtcatgggcaagtcgttggtgctgtcttgtatggtgatactgatgatggatcacgattttataatatgatgaaaaaacatgaaacgcttgaagattatacacttgtttctttattgcataaaggtgatgaagatgcggggacatctatcgctgatatgtctgatgatgaaacgatttgtggatgtaatggtgttgataaaggaacaatcgtcaatgctataacaactaaaggtttaacgtctgtagatgaagtgactaaagcaacaaaagcaggtaattcatgtggtaagtgtaaaggtcaaataggtgagttattacaatatacattaggtgacgactttattgctgcaaaaccaacaggtatttgtccatgtactgatttaacaagagaccaaattgtaactcaaataagagctaaaaatctcaaatcatcaaaagaagtacgacacgttcttgatttcaaagataaagatggttgtcctaaatgtcgacctgcaattaattattatttaaatatggtttatccttttgaacatagagacgaaaaagattctcgcttcgctaatgaaagatatcatgcaaatatacaaaatgatggtactttctcagtgattcctcaaatgcgcggtggtgttacagatgctgaccaacttattcgattaggagaagttgctaaaaagtataacgtaccacttgttaaagtaacaggttcgcaacgtgtaggtttatatggattgaagaaagaagaattaccacaagtttggaaagatttaggaatgcgttctgcttctgcttatggtaaaaagacgcgttctgttaaaagttgcgttggtaaagagttttgtcgttttggtacacaatacacaactcgactaggaataagacttgaaaaaacatttgaatatattgatacacctcataaatttaaaatgggagtatcaggttgtccgagaagttgtgtagagtctggtgttaaagattttggcgtcatatctgttgaaaacggctaccaaatatttatcggaggtaatggtggtactgatgttactgtaggtaaattgttaacgacagttgaaaccgaagatgaagtgattcaattatgtggtgccctcatgcagtattacagagaaacaggtgtttacgctgaaagaacagcaccatggttagaacgtatgggctttgaaaatgtcaagaatgtcttattaaatcaagaaaagcaaaaagaactgtattcaagaattatggaagccaaaaaagctgttgagaatgaaccatgggaaactattgttgaaaataaagaagcacaaaaaatctttgaagttgagaaggtgtaa

SEQ ID NO: 905 - DNA, 549 bp, Staphylococcus epidermidis
ggagtgaaaaatatgtcgaatattaatattagagtggcacatgaacaagatgctgaagaattacatagcatcatgcaaattgcttttacacctttaagagaactaggtattgattggccatcagttcacgctgatcttgaaatggtaaaggataatttaagacaaaatactacatttgtacttgaaaatgaaaaagaaattatttcaacgattacggtttgctatgcatggagtagtgtaaaacccatttcaggttatccgttcgtttggtggtttgcaacacgaccaacttatgatggacaagggtatgggagtcaacttttaaaatatgtagaggagacatttttacgcgatactttaaaagctgctgcggtaaccttaggaacatcagcacgtttgcacccttggttattaaacatttacgaaaagcggggttatgaaatatacgctaaacatgaaaatgatgatggtgatttaggagtcataatgcgtaaaattttaataccagaacaatttaatgatgacattttgggccgaccgccattttag

SEQ ID NO: 906 - DNA, 1146 bp, Staphylococcus epidermidis
attaaaatgaacatgaaaaagggtgtttctcagcttacgttacagacattgagtttggtcgcaggctttatggcatggagtatcatttctccattaatgccatttatttcacaagatgttgatatttctccaggacaaatatctgtcattttagctattcctgttattttaggttctgtactacgtgtaccatttgggtacttaactaacattgtaggagcgaaatgggtgtttttctggagttttattgtactattacttccaatttttcttttaggtcaagctcaatcacccggtatgctaatgttatcaggattctttttaggaattggtggcgcatttttttcagtaggtgttacttcagtacctaaatacttttcaaaagacaaagttggtttagcaaatggtatatatggtgtaggtaatattggtactgcagtttcatcattttgtgccccagtgttagcaggtgcaattggctggcaaaatacagttcgtagttatttaattattctaagtatatttgcaattttaatgttttttttaggagataaaaatgagccgaaagtgaagattcctttgatggctcaagtcaaagacctatctaagaattataagttgtattatttaagtttgtggtattttattacttttggagcttttgtggcttttgggatttttttaccgaactttctagttgatcattttagtattgataaagtggatgcaggtattcgttcaggtatatttatagcactagcgacgttcttaagaccggttggtggtgttataggtgataaatttaatgcagtacaagcgcttatcatcgacttcgtgataatgattattggtgcgcttatattaagcttatctagtcatattgttctgtttacgataggctgtttagcaattagtatctgtgcaggtataggtaatggtttaatatttaaattagtaccttcatacttttctaaagaaaccaggttcagcgaatggtattgtatccatgatgggaggaataggcggtttcttcccaccactggtgattacttttgtaacgagtatcactggttcaagtcatctcgctttcttcttcttggctatatttggtgtaattgctcttattacaatgattcatttaaataa

SEQ ID NO: 907 - DNA, 693 bp, Staphylococcus epidermidis
aagaggtggaaaatcatgcttaatcaatttgtatgggttatttatccatatttatgtttagcaatatttgttattggacatatcgcaagatataaatatgatcaattttcatggacagcaaagtcgagtgaaatgattgaaaagaaacgattaaaatggggaagtttactttttcatttaggtattattccggtattctttggtcatgttgtgggattattgattcccgctaattggttagaggcgataggagtaaataatcatatctatcatataggtgcagtttatataggtagtgtttttggtataataacattaataggaatgttgttgctaactttaagacgactatccatcaaaaacgttagacgattaagttcattttcagatatatttgtgaatatcgttttgttgattattttaataatgggttgttattctacgcttgtaaccaatgcgattcaacctgaatttgattatcgtcaaaccattgcgatatggtttagacatttattcatgttttctccaaatgctgacttaatgttaaacgtgccttggtcgtttaaactgcacatattattagggtttacagtgtttgcgtgttggccatttactcgtttagtacatgtttggagtgtaccactgtcttatatgaacagaagatatattgtttatcgcaaaaacaaaatttaa

SEQ ID NO: 908 - DNA, 243 bp, Staphylococcus epidermidis
atgaattgttgccacaggctgctaaaacaaaaacaagtgcaacaatgcaaagtaaaagtcttttcatttaatcaaaccccttattcttattattctaatcggaataaaaatattttatcccgttattacataatagtcaataaagagttacttgctaacaagtgttcagaaagttcaaactctattaactattattttaaactatttacaaatcgtaataattactatttacaaataacttaa

SEQ ID NO: 909 - DNA, 789 bp, Staphylococcus epidermidis
atgaaaagacttttactttgcattgttgcacttgtttttgttttagcagcctgtggcaacaattcatctaacaataaagataatcaatcaagcagtaaagacaaggatacgttaagagttggtacggaaggtacatatgcgccctttacttaccataataaaaaagatcaattaacaggttatgatattgatgtgattaaagcagttgcaaaagaagaaaatcttaaacttaagtttaatgaaacgtcatgggattcaatgtttgcaggattagatgctggtcgttttgatgttattgcaaatcaagtgggtgtgaataaagatagagagaaaaaatataaattctctgaaccttacacatattcaagtgctgtacttgttgttcgtgaaaatgaaaaagatattacatcattcaatgatgtaaaaggtaaaaagttagcacaaacgtttacgtctaattatggtcaattggctaaagataagggtgcggacattactaaggtagatggatttaatcaatcaatggacttactattatctaaacgtgtagatggtacatttaacgacagtttatcttacttagattacagaaaacaaaagcctaatgctaaaattaaagcaatcaaaggacatgcagaacaaaataaatcagcatttgcattctctaagaaggttgatgaaaaaacgattgagaaatttaataaaggcctagaaaaaattagagataatggtgaattagctaaaattggtaagaaatggtttggtcaagatgtttctaaacctgaataa

SEQ ID NO: 910 - DNA, 327 bp, Staphylococcus epidermidis
gaaggtgtaagaatgaaaggtaaagaaaaggttaaagttacaacaatgaatgaaatgattcctcaaataggcaaaaaagtagttgtaaacgaaaaagaaataggtatttttcttacagataatggtgatttatatgccattggaaatatatgtccacataaagaaggaccgttgtctgaagggactgtaagtggtgattatgtttactgtccgttacacgatcaaaaaatagctttaaaaactggagaagtacaacaacctgatacaggatgtgtagaaacatatgaagtagaagttattgatggagatatttacttatgtctataa

SEQ ID NO: 911 - DNA, 711 bp, Staphylococcus epidermidis
attatagaaaggaagtttttatttatgccaaaattaatactatgtcggcacggacaaagtgaatggaatgcgaaaaatttatttacaggttgggccgatgtcaaactatcaaaacaaggaattgaagaggcgcaatcagcaggtaaaaaaatttacgacaatcaaattgaaattgatattgcgtttacctctttactcactagagctttagaaacaacacaatatattttagcaggttctgaccaacagtggattcctgtttataaaagttggcgtttaaatgaacgacattatggtggtttacaaggtttaaataaagatgatgcgagaaaaaaatggggggaagatcaggtgcatcaatggagacgctcatatgatgtacgtccgcctagagaaagtgaagaacaacgagaagcatatttaaaaaatcgtcgttatcaacatattgatcaccgtatgatgccttattgtgaaagtttgaaagatacattagaacgagttgttccgttctggactgatcatatttcacaacacctattagatgataaaactgtacttgtttcggcccacggaaattccattcgcgcattaattaagtatttggaaggtttatcagaagaagatatcgtcggatatgaaattaaaacgggtgcaccgctagtatatgaactcacagatgatttagttgttaaggataaatattatttataa

SEQ ID NO: 912 - DNA, 1362 bp, Staphylococcus epidermidis
aattcgttgagagtttacaaatataatcatgccaaatgtatttatatttactacataattacatttttaaatatctcaaataattcatatttagagaggatttcatttatgaaaaaattgattactcttattgtcatgatatcttttgttttagcgagctgtgggggcacatcaagtacagacaaagacaccctcaatgttgaaatacctttgaaaactaaatcaattgcaccttacgaaactgatatcccagttaaaacaggtgccttggaatcgctttttaaaatgtcgaagaatggtaaagtaaaacctttattagtcaaaaattatcatcaagtatctgacaatcaactagaactcactttaaaagataatattaaatttcaaaacggtcatcatttaacaggcgaagctgtaaaacgcagtctcgaagaaggaatgaaaaaaagtgatttgttaaaaggatcacttcctattaaatcaatcaatgctcatggacaaaaagtcacaatcactactaaagaaccttatccagaattaatgtctgaactcgcaagcccatttgctgctatttacgacacaaaagctaaaaacaaagtaactgatcaacctgttggtacgggtccttataaaattgatcagtataaacgttcgcaaaaaatcgtactaaaacaattcaaagactactggcaaggtacgccaaaattaaaaagaattaatgtcacttatcatgaagatggtaatactcgtgttgatcacttattatcaggcaaatcagatttgactactgatgttccaattgaacgcgttgatgatgtaaaaaaatctaacaaagcaaacattcaaagtacatcaggctttagaacgcatttaatgttatacaatcatgatagtaaaaaagttaataaaaaagtaagagaagcactagatatgattattaatcgaaaagacattgctaaaaatgtttctaaaaattatgctgagccagcatcaggtccttttaaccatcgattaaaatcattagaaaaagaggaaattcaatcacaagacatcaagcgtgcaaaagaacttttagctcaagaaggttattccaaatcgcatcctcttaaattaaacatggtcacatacgatggcagaccagaattgcctaaaattggacaggtgatacaatctgaagctaaaaaggcaaatgttgatatacaattacgcaatgtagatgatatcgaaggatatctcaaaaacaaacagagttgggatgtttcaatgtatagttatttaagtgtgccacgtggtgatacaggttatttctttaacactgcatacttacctgatggagcattaaataaaggtaattataggtaa

SEQ ID NO: 913 - DNA, 375 bp, Staphylococcus epidermidis
gtaggagtgagtatgttgaagaagttattagtcggggttagtgtactaactttattattagcaggttgcatgagtcacgagtacgcagacaaaatagataaagcggttaaactacaagagaaaaagcaacaaaaaattgctaaaaacgattcaggtgatgaagttaaacattttgataaaaaagatgccaatatttatgtgtttgacaaaggaaaatatgttgtattggagtataaaccacttagtgatgatgctgaagcgcgttactatacttatgaatttaaagataaaaaagcatattataataaagactttaatgcaaaagcatactaccaatctcatgagcctgactataaagaagagaatatgtattaa

SEQ ID NO: 914 - DNA, 480 bp, Staphylococcus epidermidis
ggtacatatatgacgatagaaaaaaagaaaaataagattatttttactagaacttttagtgcaccaattaataaggtatttgatgcttatacaaagcgggaactatttgaacaatggtttcatcctcaagacgcatctgtcacagtttatgattttaatgctacgaaaggaggaaacgctttttatgctattcaagctcctcagatgacaagttatactattgctgaatatctgcaagtggatgcaccatattatatagagtatttagactattttgctacgtcaaaaggggaaaaagacacaagtatgcctggtatgcatatcactttgaattttgaagaagtaaaaggaaagactactgtaacatcgacatcgacttttccaactgaaagtgccgctcagcaagcgatagacatgggtgtagaaacaggtatgaattcaacacttaatcagttagagaaattactaaatcaaaagtga

SEQ ID NO: 915 - DNA, 1044 bp, Staphylococcus epidermidis
gtggtaaatatgttggagcaaactgatttaagtttagagcaattacttaagaattattatgaaaccacgaacgagaaaattgtatttgttaatagacaaggcaaaattattgctatgaatgacgcagcaaaagatattttaactgaggaagataattataatgctatgacaaatgcgatttgtcatcgatgcgaaggatactctaatgaatatgatgtacaatcgtgtaaagattgttttttagagacaacgcaattacaacattccaatttccaagtatttatgaagacaaaagataatgaaattaagccttttacagctatgtatcaaaatattgatgaacaaagaggtattagtgcatttaccttacagaatgtggcgcctcagattgaaaggcaagaaaaaatgtatcaacaaaaaatgttacatcgttcaattcaagcacaagaaaatgaacgaaagcgtatttctagagaattacatgatagtgtaatacaggatatgctcaatatagatgttgaactaaggcttttgaagtataagcacagggataaggtgttagctgaaacatctcaacgtatagaaggcttattatcacagcttattgatgatattagaaatatgtctgttgaattaagaccttcttctctcgacgatttaggcattgaagcagcttttaaatcatattttaaacagtttgaagaaaattatggtatgcatattaaatatgattcgaacattaaaggcatgcgttttgataatgaaattgaaacagttgtgtatcgtgtagttcaagagggtgtatttaatgctctaaaatatgctgaggttaatgaaattgaggtaagtacgcatagtgatggcaagcagcttgtagcagaggttgtggatcgaggtaaagggtttagtttagatcatcaccctaaaggctctggacttggattgtacggaatgagagaacgtgcagaattagttaacggtcatgttaatatagagacacatattaatagaggtactataattacattagatataccgatttaa

SEQ ID NO: 916 - DNA, 1257 bp, Staphylococcus epidermidis
agaaatataatgaaatttgtaaatttaacttctgaagaattcgagcaatttacttcagaaaatttctcgcattatacacaatccagtatacattataataatagatcgaaaacaaaaggtgacgtacatttagtgggagttaaagatggtcaagaagatgtcattgctgcgtgcttattaacagaggcacgttctttaaaattctttaagtatttttacacacatagaggaccagtcatggactttaacaatttagttttagttcgcttcttttttaaatcacttactgcttatttaaaaaaacacaattgtttatatgtactcgttgacccttatgtattagaaaatttacgtcaacctaatggagaaatcattgaatcctttgataatcgcgcattgattaaaacaatggaagaattaggttacaaacaccaaggatacactgtaggttatgatacaatgagtcaaatccgctggttatcagtacttaaccttaaagataaatctgaagatcaattattaaaagaaatggattaccaaacacgtcgaaatattaaaaagacttatgaaatgggtgttaaagttaaaacattacccattgaagaaacaaatacattttttgaattattcaaaatggctgaagaaaaacatggctttaaattccgtgaagagccttactttgttgagatgcaaaaaacttatgaagatcatgctatgttaaaacttgcttacatcgatttacaagattatttagatacgttgcaaactaaacatcaaaaccttaatcaacaactaaaagatgttgaaaaaacattagaagaaaatccaaattctaagaaaaataaaacgaaacatacacaagtcaaacaacaattcgatagtaatgcgcgtaaaatcagacaaactaaagagaaaatagcagaagaaggtcaagttcttcatcttgctgcagcattatatatatataatgatcacgaagtgtattacttatcaagtggctctaaccctaaatataatgcttatatgggagcatatcgattacaatgggatatgattcaatttgcaaaagaacataatatcgatagatataatttctacggtgttaccggagactttagtgaaaatgctgaagatgctggcgttcaaaaatttaaagaaggatttaacgctaaaatttatgaatatattggtgattttatcaaaccaattaaaccactattttataaagtaaaacaagaattagaaagtcgtagataa

SEQ ID NO: 917 - DNA, 759 bp, Staphylococcus epidermidis
ttattcgtaataatgataatacaaaagggtgggataattatgataggtaatattctagtcgctcacggcatgagaaaaggaaatcagaatgaagctttagaagaatttatcggaactttattaaaagatgagcaatattattatgagttagcatttttagaaagtgaaacacaaaatcttgaaatcataatggagaagatgattaagcaaggaattacaaaatttcgtattgtacctttactcatttttagtgcaatgcattatatcagtgatattccacaaatacttaaagagatgaaagctcgatatccacaaattgatagtaaaatgagtgcgcctcttggtacacatccatatatgaaaacattagtagaaaatagaattgctgatgaaaaagtcagtgaaggttcaaccaaagcaactatagtaattgcccatggaaatggaagtggacgttttacgaaagcacatgatgaattaaaagcatttgttaaaacgcttgatagtcatcatcctgtttatgcaagagctttatatgggacattagcatttaaaaatgatttagataaaatctcagagcaatatgacgagttagtcattgtcccattatttttatttgatggtagattggtgaataaagtaaaacgtcttttaggtgaaatgacattgcatagtcaattacacattacgccatcgattaactttgatccaattttaagattaattattagagaaagacttgaagcgttagatatttaa

SEQ ID NO: 918 - DNA, 1569 bp, Staphylococcus epidermidis
aggaggtcaattggcttgaagattaaagcgcaagttgcaatggtattgaatctagacaaatgtattggttgtcatacttgcagtgtgacatgtaaaaacacatggacaaatcgacctggtgcagaatatatgtggtttaataacgtagaaacaaaaccgggtgtaggatatccaaaaagatgggaagaccaaggacaatataaaggtggttgggtgctaaataaaaaaggaaagcttgaattaaaatctggtaacagatggtcaaaaattgctttaggtaaaatcttctataatccagacatgccactcattcaagattattatgaaccgtggacatataactatgaacacttaaccaatgctaaacaaggacagcactctcccgtggcgacagctcactctttaatttcaggtgatagattgaatcttaaatgggggccaaactgggaagatgatttagctggaggtcacattacaggaccagaggatccaaatattcagaaaatagaagaagatattaaattccaattcgatgagacatttatgatgtatttaccaagactatgtgaacactgtttaaatccaagttgcgtagcatcttgtccatcaggagctatgtataaacgagatgaggatggtatcgtactcgtcgatcaagaagcctgtcgaggttggagatactgtatgactggatgtccgtataaaaaagtatattttaactggaaaacgaataaagctgaaaaatgtacattttgtttcccacgaatcgaagctggtatgccaactgtttgttccgaaacttgtacaggacgtatgagatatttaggtgttttattatatgacgcagatcgcgttcaagaagcggcttcagctaaagatgaaaaagacttatacgaaaaacaattagacctattccttgatccatttgatgaggaagtcattgcacaagctgaaaaagatggaataaatcaagaatggattacagcagctcaaaactcaccagtgtataaattggcaatagaatataaaatggcctttccattgcatcctgaatttagaactatgccgatggtgtggtattgtccacctttaagtcctattatgagttatttcgaaggtgaaaatgcaggtcaaaatccagatatgattttcccagctattgaggaaatgcgtttacctattcaatacttagcaaatttattaactgctggcgacacaaaacctgttaaagagggcttacaaaaaatggcgatgatgagaagttatatgcgttctcaaataacaaaccaacctttcgatacttctaaattagaacgattaggacttactgaaagacagatgactgaaatgtatcgcttactaggtattgctaaatatgaagatcgttttgttgtgccttcttcccataaagaaacatatttagatacttataaagcgcaaggaagtcaaggttacggtggagagtactttggctctaattgtgaaggttgtggtgttgcagttcaatcaggtaaaactggacaagaaatttataatgaaaatttctatggagggatcttccgtgattaa

SEQ ID NO: 919 - DNA, 537 bp, Staphylococcus epidermidis
gttgggggaattgaagtgaaaatagttatagcggatgaccatgcagttgttaggacaggattttcaatgatattaaattatcaagaagatatggaagttgttgcaactgcagctgacggggttgaagcttatcaaaaagtgttagaacatcgaccagatgttttaattttagatttgagcatgccgccaggagagtcaggcttaatcgcaaccagtaaaatttctgaaagttttcctgatactaaaattttaatacttacgatgtttgatgacgaagaatatttatttcatgtgttaaaaagtggtgctaaaggatacattttaaaaaattcacctgatgagcaattaatattggccgtacgtacagtatatcaaggtgaaacttatgttgatatgaaattgacgacgtctttagtcaatgagtttgtcaatcaatcacaaacggatgaagtgtcatcatcttcagatccatttaaaattttatcgaaacgagagttagaaatattacctcttatagcaaaagtgctatggcaataa

SEQ ID NO: 920 - DNA, 3780 bp, Staphylococcus epidermidis
tataatgactttgtgaaaaaatgtacaataaagataagacacaatacctatgcattgagaaaggatataaccttgtatggtgggaggattaataaaatgggaaaatttggattgaatttctttaaaccgacagaaaagtttaatggaaattggtcggtattagagcataaaagtcgagaatgggaaaagatgtatagagaaagatggagccacgacaaagttgtaagaacgacgcatggtgttaactgtactggatcatgttcatggaaagtatttgtcaaaaatggcgtaattacatgggaaaatcaacaaattgattatccaagttgtggacctgatatgccagaatttgagccaagaggttgtccgagaggtgcatcattttcttggtatgagtatagtccgttaagagttaaatatccttatattagaggtaaattattagatttatggaccgaagcgcttgaagaacaaaatggaaaccgaattgcggcatgggcatccatcgtagaaaatgaagaaaaagccaaacaatataaagaagcaagaggtaaaggtggacacgtcagagcaaattggaaagatgtcacagatatcattgcagctcaaattttatacaccataaaaaaagatggaccggatcgtattgctggatttactcctattcctgctatgtcgatgattagttatgcttcaggagcaagatttattaatttgttaggtggagaaatgttaagtttttacgattggtatgctgatttaccacctgcatctccacaaatttggggtgagcaaacagacgtgccagaatccagtgattggtacaacgcctcatacataatgatgtggggatcaaacgttccattaacacgtacacctgacgcacattttatgactgaagttagatataaaggggcgaaagttatttcagtagcacctgattatgctgagaatgttaagttcgccgatcattggcttgcaccacatccagggacagatgcagcggtagcacaagcaatgacacatgttattttacaggaatattatgaaaatcaaccgaatgatatgtttattaactatgctaagcaatattctgatatgccgtttgttattatgttagatgaagatgagaatggctataaagcaggtagattcttgcgtgcttctgatttagggatgtcaggtgaaaataatgaatggaagccagttattcaagacaaattgagccaacaattacttgttcctaatggcacaatggggcaacgctgggaagaagggaaaaaatggaatttgaaacttgaaacagaggatggtacaccaattgatccaatgttatcaatggttgaaagtgactatcatgttgaaacgattcaatttccatattttgatagcagtggtgatggtatctttgagagacctattgcaacgagaactattcaattagctaacggagaagaagttaaaattgctacggtttatgatttaatgacgagtcaatatggtgttcaacgttttgaacatgaactagaagctacatcttatgatgacgcatcttctaaatatactcccgcttggcaagaacaaattacaggtatcaaaaaagaattagtgacgaaagtggcaaaagaatttgcacaaaatgctattgatactggtggacgctcaatgattattatgggggctggtatcaaccattggtttaactccgatactatttatcgttcaattcttaacttagtactattgtgtggttgtcaaggcgttaacggtggtggttgggcacactatgttggacaagaaaaatgtcgaccaattgaaggatggaatactattgcatttgctaaagattggcaaggtcctccacgtttacaaaatggtacaagttggttctatttcgctacagatcaatggaagtatgaagaatcaaatgtagataaattaaaatcaccattagctgaaaatattaagcatcaacatccagctgattacaatgtaacagctgctcgtatggggtggttgccttcatatccacagtttaataaaaacagtctattatttggtgaagaagctaaagatgaaggtgatgattcaaatgaagccatcttacaaaaagcgattgaatcagttaaaaataaagatacacaatttgcgatagaagatccagatttaagaaaaaaccatcctaaaacattatttgtatggagatctaatttaatttctagttcagctaaaggacaagaatactttatgaagcacttgttaggtgcgcgctctggtttaatggcagagccaaatgaagatgataaaccagaggaaattaaatggcgcgaggatacagaagggaaacttgatttattagtatcacttgatttcagaatgactgcgacgccattatattcagatatcgttttacctgctgcaacttggtatgaaaaacatgatttatcttctacagacatgcatccatttattcatccatttaacccagcgatcgacccattatgggaatcgcgttcggactgggatatttataaaactctaagtaaagctgtttcagaaatggccaaagattatcttccaggtaaatttaaagatgtcgtaactacaccattaggacatgattcaaaacaagaaatttcaactgaatacggtattgtaaaagattggtctaaaggagaaattgaaggtgtgccaggtaaaacaatgcctaatttttctatcgtagagcgagactatacacaaatttacgataaattcgttactgttggtccaaaactagaaaaaggaaaaataggtgctcatggtgtgagttatagcgttagtgaagagtacgaagaacttaaaagtatggttggaacttggaatgatgataatactacttcagttaaaaatgatagaccgagaatagatacagcgagaaaagtagcagatgtcattttgaatatatcctctgctacaaacggcaaattatcacaaaagtcatatgaagatttagaaaatcaaacaggtatggaacttaaagatatttctaaagaacgtgcttctgaaaagatatcattcttaaacattacttctcagccaagagaagtgattccaactgcagtattccctggctctaataaagatggaagacgctactcaccgtttacaactaatgttgaacgtttagtgccatttagaacgctaacaggacgtcaaagttattatattgatcatgaggtattccaacaatttggtgaaagtttaccggtatataaacctactttacctccaatggtatttggtgctcgtgataaaaaagttaaaggtggacaagatacattagtgcttcgataccttacacctcatggaaaatggaatattcattcaacttatcaagataatgaacgcatgttgacattgtttagaggtggaccagttgtatggatttcaaatgaagacgcagctgaccatggtattaatgataacgactggttagaagtatacaacagaaacggagttgttactgccagagctgtaacatctcatcgtatgcctagaggcacaatgtttatgtatcatgcacaagataaacatatagagacacctggttctgaaattactgatactcgtggaggttctcataatgcacctactcgtattcacctgaaacctactcaattagtaggaggatatgcacaaattagttatcactttaactattatggaccaattggaaatcaaagagatgagtatgtagctgttagaaaaatgaaggaggtcaattggcttgaagattaa

SEQ ID NO: 921 - DNA, 462 bp, Staphylococcus epidermidis
ggtgaaagtgtggaaccagaatctttaaaacataatcaacatttacaaatgaatttagataagttgagagcacaagagggttatgattttggtggtatcgctttatatgattatcatcacacttcatcaccaattaaatggcaatatgtttcaggtaacacaaatgatagatataaacttatcattttgagaaagggtagagggcttgctggaatggtgatgaaaaccggtaagcgtatggttattgctgatgtagatacagctttatctccagaagagaaagttaaatttccaatcattcttagtgagtcattgacagctgtagttgcagtccctttatggttagaaaattcaatgtatggcgttttattattaggtcaaagaaatcatcagccgttacctcagtcattggaccaacttaatattgaaaaacaaatcggtatttttacagaaataaactag

SEQ ID NO: 922 - DNA, 750 bp, Staphylococcus epidermidis
ctaaaattggtaagaaatggtttggtcaagatgtttctaaacctgaataatgaacaacaacatgcattagatgcagccaaacaagcatttggtccaatgttagagggattggtgaaatactcaatccctattactttggtcactttcattctaggtttaatcattgcattgtttactgcacttatgcgtatatcaaccagtaaattgcttagaggtattgcgcgtgtctatgtatcaattattcgtggtacacctatgattgtacagttatttattattttttatggtataccggagcttggaagattggtaactaacaatgctgataatcaatggacacttgcacctgttattgctgcagtcattggtttatctttaaatgttggtgcttatgcttctgaaattatacgaggaggtatattgtctattcctaaaggacaaacagaagcggcttattctataggtatgaactatagacaaactgtgcaacgtattatcttaccacaagctattcgtgtatctataccagcactaggaaacacatttttaagtttaattaaagatacatcattacttggatttattcttgttgcagagatgtttagaaaggcacaagaagttgcttcgacaacgtatgagtatctaactatttatttgttagtagctttaatgtattgggtcgtatgttttatcatctcaattatccaaggatggtatgaatcacgcattgaaagagggtatcgctcatga

SEQ ID NO: 923 - DNA, 204 bp, Staphylococcus epidermidis
ttaaaggaattaaatactactttcggtgacaagcaacgtggtcaagtgactaatgaaatactaaatgaatctaaaaaagatattcctaacagctatatcacatacaactctcaaatagatggtgtgaataataaagtaagacattttaatgttacaccagaatctatctatttaattgattataaattaagtaaaaaagaataa

SEQ ID NO: 924 - DNA, 237 bp, Staphylococcus epidermidis
gctaatttatctttactcatcgaatataacattcttgttgaagcatacattcctgagttacctgctgataatacacttgttaatataacagcattcataaatgaagcagcaaaagctaatccagcattcttaaatactaatgtaaaaggtgaagtagctatactatcaccaccgcccattaatgccttactatcatatggaatcaacataccaataatgaaaatagctagaatgtaa

SEQ ID NO: 925 - DNA, 1704 bp, Staphylococcus epidermidis
agcttaatgttgaagttccatttgcgtttattactattaattagtactattacaatcattagttttattggtttaggcgctatcattcacaacacaatttatcaaacattaactagtaatcaaattaaaagcttagatagtgaagcccgtaattatgttaatctctttaataataataaagagaaagaaatcactaatatagctcataatgaaaaaaatatcatattaataaaagaaaaagataaagataaaattatttactcaagtggaaatattaaagatattgaccatagaattgataatgaagctaatccttcgaaattaatcaataaaaacacaaaactcggtatgcgttacacctataagaatacaatagatgataaaacaatatacataagtggaattaataatgaaattattgatttacaaaaggatttatggaaatacttgtctattgttggagtcattgtattatttacggtctatttagcaagtagaagtatcaatcgaacatatattagacctatcaatgaagtaacttatgctacatcacttctagcagatggatattaccatgttcgtgttccagaaagtaatgtgaaggaaactagggcattatttgtgactacaaatgacttagcacgacgattgcaaaaattaaacaatagtcaaaaaattcaatccaatagattaaaaactaccttagaaaatataccgagttcagtactgatgattgataaacatggagaaattgtagttgctaatcatgcttattatcaggtgtttaaccctgatcaaatggtagaaaataaaagttacattggtttcatagatgatagtattgaaaaattaattattgaaagttttagaactgaaaaagttatctatgaacaattagaagttgctattaataacgtacatactaaatatttcgatgtatcttgtatccccattttaactaaatctaaaaaaaatttacaaggtatggtggttgtgcttcatgacattactaatttgcagaaattagaaaaccttagaagggaatttgttgcaaatgtgtcacatgaactaaaaacaccgattacttcaatcaaaggttttgcagaaactctgattgaaggtgctaaaaatgatgaacaatcgcttgatatgtttttaaatattattttaaaagaatctaatagaatagagtcattggttacagacttattagatttatcacatatagaacagcaaaaagaacttgaaataaattacatgaatttatctgaattagctattaatataatagataatttgcaaacacaagcatacaataagagaatcaaaatacaatctgaaattgaaaaagatgtcatcattgaggcacatgaaaataaaatagcgcaagttattactaatttgctatcaaatgctataaattattcttcagaagataataaggtaatagtaagagtatatagaaatgacaataaagtttatttagagattcaagattatggtattggtataagtgaaacagatcaaaagcgtatatttgaacgtttctatcgtgtagataaagcgagaagtagagattcaggtggtacaggacttggtctgtctataacaaaacatattgttgaagcacataatggtagaatagacgtgaaaagtgcacctggcaaaggttcgatattcaaagttctatttaatgataattaa

SEQ ID NO: 926 - DNA, 249 bp, Staphylococcus epidermidis
aacaatacgccaatagcaattaaaataactactaatattgctaatatgataaataacaccatatacttctcctcctattttatcatcttacattataacgtaattttgtgcgtcgttaaatcacaaaatcaattaattgatagattatttttaaaagattatactaaattaaaaattgtagtaacgaggtatgacgatgacaaagaatattccaacaaattacaaactgatatcaaaacaacttgctag

SEQ ID NO: 927 - DNA, 507 bp, Staphylococcus epidermidis
gaggtcgttacgatgactcaaattacatttaaaaataatcccattaaattatcaggttctgaagtgaatgaaggtgatatcgcaccaaatttcacagtgcttgataatagtttgaatcaaattactttagatgattataaaaacaaaaagaaattaattagtgttataccatctattgatacaggagtatgtgatagtcaaactcgaaagtttaatgaagaagcttcagcagaagatggtgtagttttaacgatatcagtagatttacctttcgcccaaaaaagatggtgtgcatcaagcggattagataatgtaattactttaagtgatcataaagatttatcttttggtcgaaattatggacttgtgatggatgaattacgcttacttgcacgttcggtatttgtgttaaacgaaaacaataaagtagtatataaggaaattgtcagcgaaggtacgaattaccctgattttgaagctgcattaaaagcttacagaaatatttag

SEQ ID NO: 928 - DNA, 1149 bp, Staphylococcus epidermidis
ggacacgttacgataaggttggaggtagataatatgaaaattgggattcctaaagaaataaagaataatgagaatcgagtggggttatccccaagtggtgtacatgcacttgtagaccaaggacatgaagttttagtagaaacaaatgctggtctaggatcttactttgaagatggtgattatcaagaagccggtgccaaaattgttgatgagcagtcaaaagcttgggatgttgatatggtcatcaaagttaaagaaccacttgaatcggaatacaaattctttaaagaagagttaatcttatttacttatttacaccttgcgaatgaacagaaattaactcaggcacttgtggacaacaaggttatatctattgcctatgaaactgtacaattaccagacggttctttaccgttattaacaccaatgagtgaagtggctggtagaatgtctacacaagtgggagctgaatttttacaaagatttaatggaggtatgggtatcttactaggtggcatacctggagtacctaaaggcaaagtcactatcattggtggtggtcaagcaggtacaaatgcagctaagatagctttaggattgggagctgaagtgacaatactagatgttaatcctaaacgtttagaagaattagaggacttatttgatggcagagtaagaacaattatgtctaatccattaaatatagaaatgtatgtgaaagaaagcgatttagtgattggagcagtccttattccaggtgctaaagctccaaacttagtgactgaagatatgataaaagaaatgaaagatggatcagtgattgtagatattgcgatagatcaaggtggaatttttgaaacaactgataagattactactcatgataatccgacttacactaaacatggtgtcgtgcattatgctgtagctaatatgccaggtgccgttccacgtacatctacaattggattgaacaatgcaacattaccttatgcgcaattattggctaataaaggttatcgtgaagcatttaaagtaaatcatccattatctctaggtctgaatacatttaatggacatgtgactaataagaatgtagctgatacatttaattttgaatacacttcaattgaagatgcattgaaataa

SEQ ID NO: 929 - DNA, 378 bp, Staphylococcus epidermidis
cgaggtatgacgatgacaaagaatattccaacaaattacaaactgatatcaaaacaacttgctagtttaatcgaagatgaaaagaatttaattgcaatattaagcaatacttctgcccttcttaacgatacaattgatcaaattaattgggtaggtttttaccttattgaaaataacgaacttattcttgggccatttcaaggtcatcctgcttgtgtacatattgctattggtaaaggggtttgtggcactgccgtttcatctggtgaaacacaacgtgttaaagacgtccatcaattccctggccacatagcttgtgacgcaaatagtcaatcagaaattgttattctcattacatcgtcttcgaccacagggtat

SEQ ID NO: 930 - DNA, 1332 bp, Staphylococcus epidermidis
aaagactgttataaagaaataagaggtaacgggatgacaaagaatgaacaaataattaaacatatcgaatctttatcaattggctctaaaatctctgtacgaaagattgctaaagatcttaatgtgtctgaaggtactgcgtatagagcaattaaagatgcgagtcaacttggaattgtagcaactattgacagagttggtactgttagaatcgagaaacgaagtagggaaaatttagataacttaacgtttaatgaaattgcaaatattgtcgagggccaaatacttgccggtagagctggacttaataaatcagtttcaaaatttgcgataggagcaatgcaatttgatgatattctgaaatatataggcaaacacacattattaattgttggaaatagagaaaatgtacagattgaagctttaaaacgtgaaacttcaatactcatcacaggtggttttcgtccaagtgctgaaattatacgttatgcagatgagcatgaattaccaattatttcttcaagttatgatacattcttagttgctaatatcatcaataaagcaatgtttaatcaaaaaatacgcaaagaaatacttgtggttgaggatatagttaaaccaatcaatgaactatcagtgttatttgattcaatgacaatacatgattacaaaaaaatagcgaatgaaaccggccatacaaggtttcctatagtaaacgaagaatttaaattagtaggtatagtaactagtagagaaatcattaatatgaacgaagaagacctattaggtaaagttatgactaaaaatccattgagtgttaaattaacaaatacggttgctagttgtgcccatttattaatttgggaagggattgaattattaccagtaactgataataataaaaaagctgtcggtgtgattaacagacaggatgttttaaaatcaatgcaattattaggtagacaacctcaaattggtgaaacagtcaatgatcaaattgccaaacatatttcaatacatcaacaaggaataaatgtcgacgtatctccactcattacaaatcattacggtacactaagtaaagcagtatttgttggaattattgaggaaacgattcggcacgaaatgagaaagtataaaaaaggtaatgtcatgatagaaagtatgagtattatctatattaagactgtaccaattgaatctactattgaagtacattatgaaatgttagatgttggccgatattttgctaaattagaagttactatgattaataatggtgaaaaagttgctaatgcattagtaatttgtcaaatgtttgatggattttaa

SEQ ID NO: 931 - DNA, 1707 bp, Staphylococcus epidermidis
gaggagaagtatatggtgttatttatcatattagcaatattagtagttattttaattgctattggcgtattgttttatatgcgctcaaacaaaagaaatttaattgaaaaaacagaagagcgtaagaacgaaattgaacaattacctttagatgataacctaagaaaacttactggtttaaatttaaaaggtgaaacaaagactaagtatgatgcaatgaaaaaagacaacacagaaactacaaataaatacttagctccagtggaagaaaaaattcaaaatgctgaagagttgttagagaaatttaaattcacggcagcacaaactgaaattgatgatgctcacgaattaatggatcaatacgaagagaattatcagcatcaagtaactcaagtggacgacattataaacttacataaagaaaatgaagcattgtatgaaaagtgtaaagttgactatcgtgaaatgaaacgtgatgtattagccaatcgtcatcaatttggtgaagcagctgaaccacttgaaaatgaaatcgaaaattatgagcccaagttaaatgaatatgagaatttaaaaagtgaaggtaattatgttcaagctcataatcacattgctgctttagaagatcaaattaaaaatttaaaatcttatatggatgaaattccagaattaattcgagaaactcaaaaagaattaccaggacagtttcaagatttaaaatatggatgtagagacttaaaggttgaaggctatgatttagaccatgtcaaagtcgatggtacaatacaaagtcttaagacagaattaagttttgttgaaccaatgattagtcgattagaattagatgaagctaataataaacttgaaaatattaatgataaattagatgaaatgtatgatcttattgaatatgaagtaaaagccaaaaatgaagttgaagaaacgaaagatatcattactgatgacttatttaaggccaaagatatgaactatacattacaaaccgaaattgaatatgttcgtgaaaactactatattaatgaatcagatgctcaaagtgtaagacaatttgaaaatgaaattcaaagtctcatctcagtttatgatgatattttaaaagaaacttctaaatctgcggtacgttacagtgaagtacaagataatttacagtaccttgaagatcatgtatctgtgattaacaaagaacaagataaacttcaaaatcatcttatccaattacgcgaagatgaagctgaagcagaagataatttattgagagtgcaatctaagaaagaagaagtttatcgacgtttattagcttctaatttaactagcgtcccagaacgttttattatcatgaaaaatgaaattgataatgaagtaagagaagtaaatgaacaatttagagaacgtccaattcatgttaaacaactaaaggataaagtagcaaaaattgttattcaaatgaatacatttgaagatgaagctaacgatgtacttgtaaatgctgtatacgcagaaaagcttattcaatatggtaatagataccgtaaggaccatcatcatgttgataaaagcttaaatgaagctgaacgattatttaaaaataaccgatataaacgtgcgatagagatagctgaagaagcattagaaagtgttgaacctggtattaccaaacatattgaagagcaagtgattaaagaatag

SEQ ID NO: 932 - DNA, 1113 bp, Staphylococcus epidermidis
aaactatatcttattagcatagaattaatatatcatcacatgatggaggttcattatatgactaaaataaaagaaatcaaaaaagttttacaaaaagaagatgctgatgcagcatggattacgacacccttaaacatcttttactttactgggtatcgaagtgagccacatgaaagactcttcgctttgcttattccatcaaatgaagagcctgttttattttgtccaaaaatggaagttgaagaagtaaaacaatcaccgtttaaaggtaaaatcatcggttatttagatactgaaaacccattcgacaaatactctaaaactttctctaaaatgctcattgaaagtgaacatcttacagttaaacgtcaaagagaactaacaaaagcctttaatatagaacactatcaagatgttgatcaatcaatcaaggacttacgcaatatcaaatcagaagatgaaattatcaatataaaaaaagcagctgcgttagctgataaatgtattgaaattggtaaatcctttcttaaagaaggtgttgaagaaagagaagttgtcaaccatatcgaaaacgaaataaaaaaatatggtgttaatgaaatgagtttcgacacgatggtactcttcggtgaccatgctgcttcaccacatggaacacccggtgacagaaaattacagcaaaatgagtttgtactatttgatttaggtgttgtataccatcattattgcagtgatatgacacgcacaattcattttggcacacctaataaggaagcacaaaatatatataacattgttttaaaagcagaaacagaagcaattaaatctattaaaccaggagttaccatcaaagatattgataaaattgctagagatatcatcgaagaagcaggttatggtgattacttcccacatagactaggtcatggattaggtcttgaagaacacgaatatcaagatatatcaagtgtaaataataatcaacttgaagcaggcatggtgattactatagagcctggcatatatgtccctcatgtggctggtattagaattgaagatgatattttagtaactgaaaatggttatgaaatattaactcaatacgaaaaataa

SEQ ID NO: 933 - DNA, 1161 bp, Staphylococcus epidermidis
aagccatttcataaagaaacagtaaaggggaaatttatcatggcagaattaaaaagaggtttagaaggggttattgcagctgaaactaaaattagctcgataattgacagtcagttaacatatgcgggctatgatattgacgatctcgcagaaaacgcgcaatttgaagaaataatttttttactatggaattatagacttcctaatgaaaatgagttaagtgaattaaaagaaaaattatttgattatatgactcttaataatagagtatacaagcactttgaggagtatgtgacggatcatgtacatccaatgactgctctacgtacatcagtatcatatgtagctcattttgatccagaagcggaaaatgaatctgatgagaataaatatgatagagctattcgtattcaagctaaaatcgcttctttagtaacggctttcgctagagttagagacggtaaagaacctgtcaaacctaattctgaacttagttatgcagcaaatttcttatatatgttaaggggagaactaccaacagaagttgaagttgaagcatttaataaggcattaattttacatgctgatcatgaacttaacgcatctgcatttacggcacgttgcgcagtatcttcattatcagatatgtattcaggtgttgttgcagctattggttcattaaaaggaccattacatggtggtgcaaatgaacgagtgatgtcaatgcttaaagaaataggaagcattgataatgtagatcactatttagatgaaagatttgcaaataaagataaaattatgggctttggtcatcgtgtttataaagatggtgatccaagagctaaatatttaagagaaatgagccgtaaaatcactgaagaaacagggcaaagtgaactgtttgaaatgtcattagccattgagaagagaatgaaagaagaaaaaggacttattcctaatgtcgatttctttagtgctacagtctatcatagtatgaatattccacatgacttattcacaccaatatttgcagtaagtcgtacttctggttggattgctcatattttagagcaatatcgagacaatagaattatgcgaccaagagctaaatatataggtgaacaaaatcgtaaatatgtgtctattgaagaaagaccataa

SEQ ID NO: 934 - DNA, 1371 bp, Staphylococcus epidermidis
gggagttgtcttatggctgagaatttacaaagagaattgagcaatagacatgttcaattaattgccatcggaggtgctataggaactggtctgttcctaggtgccggacaaactatcgcaatgactggtccctcaatattacttacttatattattatagggttcatgttatttatgttcatgcgtggattgggagaaattattattcaaaatacgaatttcaaatcttttgctgacgtgaccaacacatatataggaccgttcgcaggatttgtaacgggttggacttactggctatgttggattattactggtatggctgaagtgactgcagttgccaaatatataagtttttggttcccagacatacctaattggattagtgctttattctgtgtacttattctaatgtctttcaatttattaagtgcaaagttgtttggtgagcttgaattctggttcgcaatcattaaaatagttacaatcattgctttaatcgttataggtgtaatcatgattttattcgcattcaagacaccatttggtaacacaagtttaactcatttgtatcaacatggaatttttccaaaaggagcttctggattctttatgtcattccaaatggcattgttctcatttgttggtattgaaatgattggtgttactgccaggagaaaccaaagatccagaaaaactatacctaaagctatcaatagtgtacctattagaattttaatcttttatgttggtgcattagcagtcatcatgtccattattccatgggataaagtagatccagataatagtccattcgttagattgtttgcattaattggtataccgtttgcagcaggaataattaatttcgttgttttaacagctgctgcctcttcatgtaacagtggtattttctcaaacagcagaatgctttatggactttcaaaccaaaatcaagcaccaccaacatttgctagtactaataaacatggtgtgccacataaagcaatcattgcatcatcagctttattgttaattgcagcactactgaattacatattccctgatgcaacacttgtatttacttatgttactacgatttctacagtattatttgttgtggtttgggcattaattattattgcttatattaactatagtcgtaaaaatccagaacttcataagaaagcgacatataaactaccaggcggtcaatacatgggataccttatacttattttctttgtttttgtatttgccttgttatttataaatgttgatacaagaagagcgatttactgcacgcctatttggtttattttattaggtttaatgtacttaagatacaaaaaagctgataaagaatcacgataa

SEQ ID NO: 935 - DNA, 1371 bp, Staphylococcus epidermidis
atggggttacaaacctatgaatatggtctaaaaccacaagatggatttgaggtgattacacatttcgaattcacctcacaacatttagatattttaaatcgactattcacccctttaatcggagttgaatcaattggactctatcattttatgagtcaattcatagatgaaagtcaacaactcgggttaacgcattatatattcatgaatgaactaaaaattaacttattagatttcagggagcaaatggacaatttagaggctattggattgattaaaacatttgtaaggcatgaaaaaaagtactctcactttgtttatgagttaattcagcctccaacagcctatcaattttttaatgatcctatgttatcagtatttttatttagtgaggttgataaaaaacgttatcaagcacttaaatcttatttcgaaaaagatgagaaagatttaagcaaatatcaacagacaactagaaaatttacagaagtattcaacgtacctaaaaaggtcaatgtttctgatcaaattaatttaaagcaaatcaaacactatgatggtatagatttatctaatgaaacttttgattttgaaatgttgagacagatgttgaaccatcattttattagtaatgaaattatcgataaagaagctaagaatttgattatacaacttgcgacactttatggaattactgaagatggtatgaaaaatgttatattaagttccattaccagtgcacaacaattatcttttgaagaaatgcgtaagaaagctagaacttattacctgattgaacatgataatcaattaccaaaattagagcatcaaacaaataaaattaacgatgaaaaaaaagatcgacaagcggaagatacaacaaatgattggttacaactgctagatgaaacaagtccgattgatatgttagcaagttggtctgattcggaacctacacagtcgcaaaaaagtatgatagaagaattgattaaccgtgaaaaaatgaattttggtgtaatcaatatacttttacagtttgttatgttaaaagaagatatgaagttgccaaaatcttatatttttgaaattgcttccaactggaagaaaattggtatttcaaatgccaaacaagcatatgaatatgcattacaagttaatcaacctaaaaattacgaaacacattctaatgataaacgacagaacaatcgtggaagacaaaatcaatttttatccaaagaaaagacacctaaatggcttcaaaatagggacgatcaagaagaaaataaagaaataaatgatgacactctcgaagaagatcgacaagcatttcttgaaaagttaaatcaaaagtggaaggaggaagataactaa

SEQ ID NO: 936 - DNA, 1239 bp, Staphylococcus epidermidis
ggagctgttaaagtaatgcaatatgatcatttattagttagatatggagagcttacgcttaaaggtacgaatagaaaaatgtttgttaatcaacttaaagataatgtgaaacgcgcgcttattccattaagtggttatcatgtcaaaggaaagagggatagaatgtacatagaattatcccctgaagcagacataaatgaaatcattcaacgcttatctaaagtttatggtataaaatcaattagtccagttataaaaattgataaaaacgaagagaaaattaatcaatcagcaatacagttatctcatgactttgaaaaaggttcaacttttaaggttgatgtaaaacgcgttgacaagtcatttcgattggatacgtacgaattgcaacgtcaagtcggtggagcaatactaaaaaaaaataataatataacagtgaatgttaaaaatcctgactatgaaattaaaatagaagtaagaatggatgctatttatatttatgaaaaagtaatcgctggtgcaggtggactgccagtcggtacaggtggtaagacattacttatgttaagtggtggtattgattctcctgtagcgggaatagaagtaatgaaacgtggtgtaactgttgaagcaatacattttcatagtccaccgtttacgagcgaaaaagctaaagataaagttatcgaattaacaagaattctagcggaacgtgttggtcctatcaaattgcatctcgtgccatttacagaaatacaaaagcaaattaataaagttgtacatcctcgttatacgatgacttctacaagaagaatgatgatgcgtatatctgataaagttgtacatcaaataaatgctaatgctatcgtaaatggagagaatcttggtcaagtagcaagtcagacgctaaagagtatgtacgctattaatcatgttacagctacacctgttttaagacctctattaacgttagataaagaagacattattaagaaagcgaaagaacttggtacatttgaaacatctattcaaccctatgaagattgttgtacaatatttactccgaaaaatcctgtaactgaaccggactttgacaaagtaataaaatatgaaagtgtatttaattttgatgaaatgatagaaaatgcagttgaaaatattgaaacattaacaatagatcaaaattataaaagtgcgaaagaacaatctacagattcattgattaaagatttattctaa

SEQ ID NO: 937 - DNA, 1038 bp, Staphylococcus epidermidis
tggaacgttaaaaaaatttatggtaatttagagttgaagataaatctagttaaggaaaggtatgtcgtcatgaagaagattgcagttttaactagcggaggagattctccgggtatgaacgctgctgttcgtgcagtgactcggacagcaatttacaataatattgaagtttatggtgtttatcaaggttaccaaggtttacttgatgatgatattcataagcttgaattgggttcagtaggggatacaattcaacgaggaggaactttcctcttttccgcaaggtgccctcagttcaaagaagaggatgtacgtaagaaagctattgagaatttacgtaagcgtggtatcgaaggtttagttgttattggaggagatggcagctatagaggggcacaacgaattagtgaggaatgtaaagaaattcaaacaattggtattcctggtacaattgataatgatattaatggtacagattttacaattggttttgatactgcattaaacactattattgaatcagtcgataagattagagatacggcatcaagtcacgcaagaacgtttattgttgaagttatggggcgtgattgtggagatttagctttatgggctggattatctgtaggtgctgaaacgattgttttaccagaagtcaatacagatattaaggatgtagctgaaaagattgaacagggtattaaaagagggaaaaaacattctatcgttatggttgcagaaggttgtatgagcggccaagaatgtgcagatgagttaacgaagtatattaacattgatacacgagtttcagtgttaggtcacattcaacgtggcggtagcccatctggtgctgatcgagtattagcttctcgacttggtggatatgctgttgaactattaaaacaaggtgagacagctaaaggtgttggcattaggaataatcaattaacctctacgccgtttgatgaaatttttgctgaaagtgatcgcaaatttaatagtcaaatgtatgaattagcaaaagaattatcaatttaa

SEQ ID NO: 938 - DNA, 387 bp, Staphylococcus epidermidis
ataagaactaatgacaatgctataatgattagcggttttaaaatatttgctggtatgtatgtcgcaatgatagcaccaccaccagaagcaacaaatattagtggaaacatctttcctactattttcaagtcaactttacctgaacgtaaaaattttaatgcacttgttaacgtactaaaagaactcgcaaatttatttgtacctaaagcaacagatggtggcaaaccaactgcaagtaatgcgggggttgaaattagtccacccccaccaactacagaatcgacgaatgaagcgataaaaccaaaggcaacaatcatcaacataatcgataaattccaatccatattaagcctaacccctttgtttttattacattacgaattttag

SEQ ID NO: 939 - DNA, 417 bp, Staphylococcus epidermidis
tttatgtataaacatattctacttggggtagacactcaaattaaaaatgagaaagctcttaaagaggtgtctcgtttagctggtgaaggaactatcgtcacagttttaaatgccattaatgagcaagatgctcaagcgtcaatcagagctggcgtacatttagataagctaaccgaaaagcgttctaaaggtttagaaagtacacttaaaactctagaagactacggcattgattatgatgaagttattgtaagaggcaatgctaaggatgagctattaaaatttgcaaatagtggtaaatatgaaattattgttctaagtaaccgaaaagctgaagaaaataagaaatttgttttaggtagcgtaagtcataaagtagctaaacgtgctactattcctgttttaattgttaaataa

SEQ ID NO: 940 - DNA, 888 bp, Staphylococcus epidermidis
agaaaggataatatcatgcctgaactacctgaagttgaacatgttaaaagaggtattgagccatttataaaaagtgcaaaaatagagaaagtaacttttgctaaaaatgtaattaacggtaagaataataaccgtgagacgattataaaaggtatggaattagatacttttaaaaaacttactgaaggttatgttataaaaaaagttgaaagaagaagtaagtacattattttttatatagcggatcatgacgatgatagaatcttagttagtcatttaggtatggcaggcggattctttgttgttaataaccttgatgagataagtacaccgaattatcgaaagcattggcaagtcattttcgatttggataataaacaaaaattagtctattctgatatcagacggtttggagaaattagaaatatagtcaattttgatagttatccatctttattagaaatcgctccagaaccatttgaagaggtggcatttgaacactatttagaatgtttgacaatgaaaaaatataagaataaaccaataaaacaaacgattcttgatcatcgtgttatagcaggagctggaaatatctatgcctgtgaagctttattcagagctggtattactccggataaaattactaattcactcactaaacaagaaagaaaatccctcttttattatgttcgagaagttttagaagagggtataaaatatggaggtactagtatttcagattataggcatgcagatggtaaaactggacaaatgcaattacatttaaatgtatataaacaaaaaaagtgcaaggtttgtggtcattcgattgaaacaaaagtgatagctggtagaaatagtcatttttgcccaaactgtcagagataa

SEQ ID NO: 941 - DNA, 1428 bp, Staphylococcus epidermidis
tgtggtaacaagttagcctctacttatgaaggaaagggagcttctatgaaaaagaataataaacaaaatgacggtgttcaaagaggattaaaagatagacatatttcaatgattgccattgggggatgtataggaactggtctattcatgacttctggtggagctatacatgacgcaggtgcattgggtgctttgattgcctatgcagttattggagcgatggtgttctttctaatgacgtcgttaggggagatggcgacatatttgcctgtgtcaggttcatttagtacttatgctacacgctttgtcgatccttcactaggttttgctttaggatggaattattggttcaactgggtgataacagtagcagctgatgttactattgcagcgcaagttatacaatattggtcccctatgcaaggtataccagcttgggtctggagttgtattttccttattattattttcgcgcttaattctttatccgttagagtatatggagagagtgaatattggttcgcacttatcaaagtagttacagtcatcatatttataggaattggtatcttaactattttagggattatgggtggagaatttgtaggatttgatacgtttacaaaaggagatgggccaatactaggtgggaatttaggaggtagcttgctatcaattcttggtgtatttctagtcgcaggcttctcattccaaggaactgaacttattggtattacagcaggtgaatctgaaaatccagaaagagcagttccaaaagcgattaaacaagtattttggcgtatacttttattttacattctagctattttcattattggtatgttgattccatatgatagtaaggcattaatgggcggtggtgatagtatagctacttcaccttttacattagtatttaagaatgctggattagcttttgctgcttcatttatgaatgctgttatattaacaagtgtattatcagcaggtaactcaggaatgtatgcttcaacaagaatgttatattcgatgagtaaagataaattagcttataattcttttggaaaaacaaataaaagtggcgtaccttatgtatctctaattgcaactggagtactagtcattcttattttcgcattgcaacatttaagtggagatgcatatgaatacattgtagctgctagcggaatgactggttttattgcttgggttggtatagcaatcagtcactttagatttagacgcgcatttgataaacaaaattatgataaatcaaaattaaaatataaagcgaagttattcccatttggtccgatttttgcaggtattttatgtgtaatagttatcattggacaagatgtagattttattaaaacaggtaactttgatatgaatagattttttataacgtccatgggaataccttta

SEQ ID NO: 942 - DNA, 738 bp, Staphylococcus epidermidis
atgtataaaaagattaggaggcacactatgtcacaaaaaatattagtggttgatgatgagcaatccatcgtgaccttactaaaatataatttagaaacagcagggtatatagtcgaagtcgcttatgatggtgaagaggcattgaaaaaagttgaaacagaacaaccggaactaattgtattagacgttatgttgccaaaaaaagatggtatagaagtatgtaaaacaatcaggtctgataaaaatttagtaccgattttaatgttgacagcaaaggacgatgaatttgatcgagttttagggcttgaactaggtgctgatgactatatgacaaaaccattttcacctagagaggtagttgccagagttaaagcaatattaagacgttctcaatttgtaaatgaaattgagaaggaagatgttgatgatgaagatattatcattggttcaattagaattcgacctgaattctttgaagtctataaagaagatgaattattagaattgacgccaaaagaatttgaattgttattatatttaattgaaagacaaggaagagttattactcgagaacatatgttgaattcagtgtggaattatgaattcgctggagattctcgaattgttgatgtacatataagccacttaagagataaattggaagaaaatcctaagcaacctaaattgataaagactgtacgtggtttaggttataaactggagagacctaaagcttaa

SEQ ID NO: 943 - DNA, 795 bp, Staphylococcus epidermidis
tgtaataaaaacaaaggggttaggcttaatatggattggaatttatcgattatgttgatgattgttgcctttggttttatcgcttcattcgtcgattctgtagttggtgggggtggactaatttcaacccccgcattacttgcagttggtttgccaccatctgttgctttaggtacaaataaatttgcgagttcttttagtacgttaacaagtgcattaaaatttttacgttcaggtaaagttgacttgaaaatagtaggaaagatgtttccactaatatttgttgcttctggtggtggtgctatcattgcgacatacataccagcaaatattttaaaaccgctaatcattatagcattgtcattagttcttatttataccgtcatacaaaaagattggggaaatataagaacatttaccgattttacttttacaaaagcagtattatttacattaatatttattgttattggattttatgatgggtttttaggtggtggtacaggctcctttatgctatttacacttttattatttggctttgactttttaagtgcagctggtaatgcaaaggttttaaattttgcatcaaattgtggtgcgttattatttttcatgattttaggtcaggtcaattatttttatggtattattatggcttctagcatgatgataggtgtgttgttaggtgctcaatttgctttgaaaaaaggggtaggatatgtaaaagctttatttttagtggttactgcaatattaattataaaaaatctctacgattttattgtgcagtaa

SEQ ID NO: 944 - DNA, 1953 bp, Staphylococcus epidermidis
ataggaggaaaaaatatgaatcaaattaatattcaatttccagatggtaatacaaaagaatttgataaagggactactacagaagacatcgctcaatcaattagtccaggattaagaaaaaaagcagttgcgggaaaattcaatggtcaacttgtagatttaacacgccctttagaacaagatggagctattgaaattattactcctgggagtgaagaagcgttagaagtacttcgtcattcaacagctcatttaatggcacaagcattaaaacgtttatacggagacgttaaatttggagttggacctgtaatagaaggcggattctattatgattttgatatggatgataaggtttcatcggatgattttgataaaattgagaaaacaatgaaacaaattgtgaacgaaaatcataaaattgtaagagaagtagttagtaaagaaaaagcaaaagacttcttcaaggatgacccttataaattagaacttattgatgcaattcctgaagatgagagtgtaacactttatactcaaggtgaatttactgatttatgtcgaggtgtacacgtaccttctacttctaaaattaaagagttcaaactattatctacagctggtgcttattggcgtggaaatagtgataataaaatgttacaacgaatttatggtacagcattctttgacaaaaaagatttgaaagcacatctaaaaatgttggaagaacgtcgtgagcgtgatcatcgtaaaattggtaaagatttagaattgtttacaaacaatcaactcgttggtgctggtttaccattatggttaccaaatggtgctacaatacgtagggaaatagaacgttatattgtcgataaagaagtaagtatgggatacgatcatgtttacacaccagtattagccaatgttgatttatataaaacatctggtcactgggatcattatcaagaagatatgttcccagcaatgaagttagatgaagacgaagcaatggtcttaagaccaatgaactgtccacatcatatgatgatttataaaaacaaacctcattcttatcgcgaattacctatacgtattgctgaattgggtactatgcatcgttacgaagcaagtggtgcagtatcaggtttacaacgtgttcgaggaatgacattgaatgattcccatattttcgttagacctgatcaaattaaagaagaatttaaacgtgtagttaatatgattcaagatgtgtacaaagattttggttttgaagattatcgcttcagattgagttatagagatcctgaagataagcataagtactttgatgatgatgaaatgtgggaaaaagctgaatccatgcttaaagaagcatcagatgaattaggtttaacttatgaagaagctattggtgaggcagcattctatggacctaagttagatgttcaagtaaaaacagctatgggaaaagaagaaactctatcaacagcacaacttgattttcttttaccagaacgttttgacttaacgtacattggtcaagatggagaacaacatcgtcctgtagttatacaccgtggtgtagtttctactatggaacgttttgttgcatttttaacagaagaaacaaaaggtgcatttccaacttggttggcgcctatgcaagttgaaattattcctgtaaatatagatttacattatgattatgcaagacttttacaagatgaactaaaatcgcaaggtgtccgcgttgaaattgatgaccgtaatgaaaaaatgggatataaaattcgtgaagctcaaatgaaaaaaataccttatcagattgttgtaggtgaccaagaagtagagaatcaagaagtaaatgtaagaaaatatggttctgaaaaacaagaatcagttgaaaaagatgaatttatttggaatgttattgatgaaatccgtttgaaaaagcatagataa

SEQ ID NO: 945 - DNA, 2718 bp, Staphylococcus epidermidis
tgcgtagtgaatactaaactcgcttactcgttatgtatttgtatatatgctaaaatatatgtaaatctgttctggaggttacgtattttgaataaattagtattaatagatggtaatagtctaagctttagagcgttttatgctctccctttactttcaaaccatgcaggtattcatacaaatgcagtttacggctttgctatgctcttagaaaaaataattaaagaagaaaaaccgaatcattttttagttgcatttgatgcaggtaaaacgactttcagacattctaagtacagtgaatataaaggtggtcgtcaaaagactccacctgaattaagtgagcaatttccatatattcgtcaacttttagatgcgtatcatattaaaagatatgaacttgataattatgaagctgatgacattataggaaaattaagtagacaagctgatgaagaagattttgaaaccattatcattacaggtgatagagacttaactcaattagccactgataatgttacaatatattatacaaaaaaaggtgttaccgacgttgatcattatacacctaaatttatagcagagaaatataatggtttagtgccgaaacaaattatcgatatgaaaggtctaatgggggatacctctgacaatattcctggcgttgctggtgtcggcgaaaagacggctattaaattacttaatcaatttgagtcagtagaaggggtctatgaacatattgaggaggtcactgcaaaaaaattaaaagaaaaactcatcaatagtaaagatgatgccttaatgagtaaagatttagcaacaatcaatgttcacagtccgattgaagtatcattagaagatacaaaattaactctacaagacgacactacagaaaaaattgaactatttaaaaagctagaatttaaacaactattagcagatatagacacatcctctacgaatgaagaagtcatagataaaacttttgaaattgagcaagactttcaaaatgtagatttgaatgatttaaacgaagcggtaatacattttgaactcgaaggcactaattatcttaaagacactattctcaagtttggtttttatacaaatcatcaacatgtagtgataaatgctgaggatgtaaaggattataaacatttagttcaatggcttgaagataaaaatacaactaaaattgtctatgatgcaaaaaaaacttatgtatctgctcatcgattagggattaatatagaaaatattgaatttgatgttatgttagcaagctatattattgacccatcacgttctattgatgacgttaaatctgtggtaagtttatatggacaaaattatgtaaaagataatattacaatatttgggaaaggtaagaaacatcatatacctgaagaaccaattctaaacgaacacattgcctctgtgacagaagctatagcagctgtaactccaaccatgaaatcacagttagaagattataatcaaattgaactgttgaaagatttagaattaccattagcaagaattttaagtgaaatggaagaaattggtatatataccgatatcaatgatttgaaagaaatggaattcgaaattcaaaaaaaattggatgtattaatatccaatattcatgagtcggctggtgaagcgtttaatatcaattctcctaagcaattaggtgttgttttatttgaaacattacaattgcctgtcattaagaagaccaaaacgggctattcaacagctgtagacgtattagaaaaactacaaggtgagcatcctattatagatgatattttagaatatagacaacttgctaagttgcaatctacgtatgtagagggattacaaaaagtaataagcaaagatcatagaattcacacacgttttaatcaaacgcttgctcaaactggtagattatcaagtatagatcctaatttacaaaatatacctatacgattagaagaaggaagaaagattagaaaggcctttaaaccaacttctaaagatagtgtgattttatctgctgattattcacaaattgagttacgtgtacttgctcatattacgcaagatgaaagtttaaaacatgcatttataaacggacatgatattcacactgcaacagcaatgaaagtatttaatgttgaatctgaccaggttgatagtttaatgagacgtcaagcaaaagctgttaactttggtattgtatatggtatcagcgattatggattgagtcagagcttgggtattactagaaaacaagcaaaagcatttattgatgattatttagctagttttccaggtgtaaaacaatatatgtcagacattgttaaagatgcaaaagcacaaggttatgtggaaacactacttcatcgtcgtcgatacattcctgatataacaagtagaaacgttaatttaagaagttttgcagaaagaacagcaatgaatacacccatacaaggtagtgcagctgacataataaaattagcaatggttaaattcagtgaaaagattaaagaaactaaatatcatgctaagttattattacaagttcatgatgaactcatatttgaaataccaaaatcagaagtagaagattttagtaaatttgtagaagaaattatggaacaagcattagtgctcgatgtacctttaaaagtagattcgaattatggtgcaacatggtacgatgctaaataa

SEQ ID NO: 946 - DNA, 1026 bp, Staphylococcus epidermidis
atggcaacgaatattgcaattaacggtatgggtagaataggtagaatggtgttacgaatagcactaaataataaaaatttaaatgttaaagcgattaacgctagttatccacctgaaacaattgcacatttacttaattatgatacgacgcatggagtttatgataaaaaagttgaaccgattgaaagtggtattaaagtgaatggacatgaaattaaattactttctgatcgcaatccagaaaatttaccatggaatgagatggatattgatgttgttatagaagcgacaggtaaatttaatcacggagataaagcagttgctcatattaatgcaggtgctaaaaaggtattactcactggaccgtctaaaggtggagacgttcaaatgattgttaaaggagtcaatgataatcaacttgatattgatacatacgatatttttagtaatgcatcttgtactactaattgtatcggaccagttgcaaaagtcctcaatgataaatttggaatcataaatggtctgatgacaactgttcatgcaataacaaatgatcaaaaaaatattgataatccacacaaagatttaagaagagcacgttcttgtaatgaaagtattattccaacgtcaacaggtgctgctaaagcacttaaagaagtattgcctgaagttgaaggtaaacttcatggaatggctttaagagtaccaacaaaaaatgtctctctcgttgatttagttgttgatttagaacagaatgttacagttacacaagttaatgatgcatttaaaaatgccgatttatcaggtgttcttgatgttgaagaagctcctttagtttctgtagactttaacacaaatcctcattcagcaattattgattctcaatctacgatggttatgggacaaaataaggtgaaagttatcgcttggtatgataatgaatggggttattcgaatagagttgttgaagtagctgacaaaattggacaattaattgatgataaagcaatggtaaaagccatttaa

SEQ ID NO: 947 - DNA, 1167 bp, Staphylococcus epidermidis
ttaaaatttgaaggagaagtgttatcagtgatttatttagacaatgcagccactaccaaagctgatcaagatgttgttgattcattcgtgaaagtgaaccaaacattatacttcaatccaaatagtcctcatcatgcaggggttcaagctgaacaattattattaaaagcaaaaagtgaaatcaatcgtatattaaacttaaataatcagtttgatatcatttttacaagtggcgcaactgaatcgaataatatactgctaaaaggtattgcgtatatgaaaaaagaaactgctaatgagattatcacatcagtcttagaacatccttcagttttggaagtaatgaggtatttggaaagggaaaaaggttttaaattaaaatacgttgatgtgacaaaagaaggtaagttggacacagaacacttaaaatcattaatgacagataaagtaggacttgtgacatgtatgtatgtcaataatattatgggacaaattcaacctattgaagaaatagcaaatattgtaaaaaattacccacgtgcacactttcatgttgatgcagtccaggctttaggtaaagtgcctatgcaaattaatcatattgatagtttgagtttaagtggtcataagtttaatggacttaaaggtcagggactactacttttaaaaaatattcaaaacatagaacctatagtacatggtggtgggcaagaatatgggctacgaagtggtacaattaatctaccaatggctatctctatggttagagctataaagaatgcagttgatcaaacaaaagagcttaatttacgtttaagcaattataaaaataaattactttcatttttagcagaatataaaaatgtatttatcaactctcctcaaaatgcatcacctcatattataaatataggatttccaggtgttaagggtgaggtacttgttaatgctttttccaaacaaaacgtaatggtttcaactacaagcgcttgttcttctaagatgaataaattgaatgaggttttacttgcaatggaaattgcagagtcaaaaatagaaggtagtataagaatttctttaggggcacatacgactgaaaacgatatattaagttttatgaatgcatttgaatctgtatataaggaaattaaggagctgttaaagtaa

SEQ ID NO: 948 - DNA, 627 bp, Staphylococcus epidermidis
aggaagagtgaaataatgtctaaagtgattgggataactggtggtattgccactggaaaatcaacagtttcagaattattaacagcatatgggtttaaaatcgtagatgctgatattgcttcacgcgaagcagttaaaaaaggctctaagggtcttgaacaagttaaagagatttttggggaagaagcaattgacgaaaatggtgagatgaatcgtcaatatgtaggagagatagtttttaatcatcctgacttacgcgaggctcttaatgaaatagttcatcctattgtaagagagataatggaacaagagaaaaacaattatctagaacatggatatcatgtaattatggatatcccattgttgtacgaaaatgaactacaagatactgtagatgaagtttgggtggtttatacatctgaaagtattcaaatcgatcgtttaatggagaggaataatttatcattagaagatgctaaagcacgtgtttatagtcaaatatctatagataaaaaaagtaggatggcagatcatgtgatagataatctaggtgataaattagaacttaaacagaatttacaaaaattacttgaagaagaagggtatattcaatcggagagtgaatag

SEQ ID NO: 949 - DNA, 948 bp, Staphylococcus epidermidis
ctaatgttagattttgaaaaaccactttttgaaattagaaataaaattgattctttaaaagaatcgcaagaaaaaaacgaagttgatcttcaagatgaaatagatatgctggaagcatcattaaaaagagaaactacaaaagtgtacactaatctaaaaccttgggatcgtgttcaaatcgctcgtttaccagaaagaccaaccacattagattatattccctatatttttgattcatttattgagttacatggcgatagaagttttagggatgatccagcaatgattggtggaattggttacttagatggtaagtcagtaacagttataggccaacaacgtggtaaagacacgaaagataatatttatcgtaattttggtatggctcacccagaagggtatagaaaagctttgcgtttaatgaaacaagcagagaaatttaatcgtccaatatttacttttatagatactaaaggtgcttatccgggtaaagcagctgaagaaagaggtcaaagtgaatcaattgcaaaaaatttgatggaaatggcttcattaacggtaccagttattgctgttgttattggtgaaggcggaagtggcggcgctttaggaattggaatctcaaatcgtgttctgatgcttgaaaatagtacttattcagttatttcacctgaaggagcagctgcacttttatggaaagatagtaacttagctcaaattgccgctgaaactatgaaaatcactgcgcttgatttactagatttaggtattatagatgaagtgattaatgagccacttggtggtgcacaaaaagatgaagaagtacaagctttatcaattaagaaaatgttccttaaacatttaaatgaattaaatcaactcacacctgaagaattagcaaatgatcgttttgaaaaatttagaaaaattggttcagttgtggagtaa

SEQ ID NO: 950 - DNA, 210 bp, Staphylococcus epidermidis
cgtcatctagaagcctctaaccttatcttgtcaatttctacaatcattatctttcaattaatcattcttttattacttttattattcaaatacagaaatatatcccctctatatttattttttatattttttgtaaattataaaaaatacaatatagatgacatttggtgttctactttaaaatcaataactagtgttataaaaggttga

SEQ ID NO: 951 - DNA, 189 bp, Staphylococcus epidermidis
agcattctgctgtttgagaaaataccactgttacatgaagaggcagcagctgttaaaacaacgaaattaattattcctgctgcaaacggtataccaattaatgcaaacaatctaacgaatggactattatctggatctactttatcccatggaataatggacatgatgactgctaatgcaccaacataa

SEQ ID NO: 952 - DNA, 972 bp, Staphylococcus epidermidis
ataatatttagaagtttaaagggagtaattaatatggaagtaaaaatgaatgaaataatggaagcattagaacaaagtgaattaattattattcacagacatctaagaccagatccagacgcatatggttcgcaattaggtttgaaatattacttacaaaagaagtttccaaacaaacaaatttatgcagtaggagctaatgaagattctttgaaattcataggtttgatggacgaaattgacgatgatatgtacaagaaagcgactgtagttgtatgtgatacggcaaatgcgccaagaatagatgaccaacgttatgatacaggtaccaaacttttaaaaattgatcatcatcctgctactgatcagtatggagatattaactatgttaataccaaagcttcttccactagtgaaataatttacgaattcattttacatttcaatgatgaacatatcattgatgaacaagttgctagagtattatatcttggcatcgtcggtgatactggacgttttttatttaataatacaacgccacgaacaatgcaaattactggaaaattacttacatatccttttgatcacaaccaagaattaaacaaaatgtctgaaaaggatccaaaactattaccatttcaaggatatatattgcaaaattttgatttaaatgataaaggattttgcaaagttaaaataactaaagacatacttgaaaaatttcaaatacaacctaatgaagcgtctttatttgtaaatacaatcgcagatattcgaggattaaaaatatggatgtttggcgttgatgaaggagatcaaattagatgtcggttgcgttctaaaggtcatattattattaatgatgtcgctaatacatttggtggtggtggacatccaaatgcatctggagtttcagtaaatagttgggagcaattcgagcaactcgccgaagctttaaacgacaagttataa

SEQ ID NO: 953 - DNA, 1230 bp, Staphylococcus epidermidis
atgtctttaagagatgacgctttagaaatgcatagagagaaccaaggtaaactagaaattacaccaaatgttaaagtgacaaataagcaacaattaagcttagcatactcacctggcgttgcagaaccttgtaaagaaatccatgaagattcaagaaaagtatatgagtacactattaaaggaaatacagttgctgttgtaacggatggaacagctgttctcggtttagggaatattggagcagaagcaagtattccagtaatggaaggaaaggcagcactgttcaaaagttttgcgggtattaatggtgtgccaatatctctagatacaactgacactcaagaaatcataaaaacagtaaaacttattgcaccaaactatggtggaattaatcttgaagatatatcagctccccgctgttttgaaattgaagaaaccttaaagaaagagaccaatatacctattttccacgacgatcaacatggtacagctattgttactatggctgggttaatcaatgctttaaaaattgtagataaagagttaacgaatataaaagttgtattaaatggtgcaggtgcagcaggtatcgctatagtgaagttacttcatgcttatggtgtgaataatatgattatgtgcgattcaaaaggtgctatttattctggcagaaattttggtatgaatgatacaaaaacatatgtagctaagtggacgaataaagataaagttgaaggttcacttgaagaagtgattaaagatgcagatgtttttataggtgtatctgtagcggatatattaactcaagatatggtgaagacaatggctgatgatccaattatttttgctatggctaatcctaatcctgaaatcaatcccaatgaagccaaacaggcaggtgcaaaggttgtgggtacaggtcgatctgattttccaaaccaaattaataatgtattagcatttccaggtctttttagaggtgcattggatgttgaagccactcatattaacgaagatatgaaaaaggcagctgtagaagctatcgttcatttaatagacgaaaatgagttacatcctgattactgtataccaggaccgtttgataaaagagtagctccatcagtagccaaaaatgtagctaaagctgctatggaatccggtgtagcaagaattaaaattgatacacaagaaatatttgataaaactatgaaacttactgacttaaaatag

SEQ ID NO: 954 - DNA, 1806 bp, Staphylococcus epidermidis
attagcaaaagaattatcaatttaaatttatttgggaggattataaaaatgagaaagactaaaattgtatgtacaataggaccagcttcagaatcagaggaaatgctcgaaaaactaatgaatgcaggaatgaacgttgcgcgtttaaatttctcacatggtagtcatgaagaacataaagcaagaattgatacaattcgtaaagttgctaaacgtttaaataaaacaattggcttgttattggatactaaagggccagaaattcgtacgcacaatatgaaagatggacttattgttttagaaaaaggcaaagaagtcattgtcagtatgaatgaagttgaaggaacacctgaaaaattctctgtaacatatgaaaatctaatcaatgatgtcaatattggatcatatatactattagatgatggtttagttgaacttcaagtcaaagaaattaacaaagataaaggcgaagttaaatgtgatatcttaaatactggtgaattaaaaaataaaaaaggtgttaacttacctggtgttaaagttaatttacctggtatcactgataaagatgccgatgatatcagatttggtataaaggaaaatgtagactttatagctgcaagttttgtaagacgtccaagtgatgttttagatatccgtcaaattcttgaagaagaaaaagcagaaataacaattttccctaaaatcgaaaaccaagaaggtatcgataatattgaagaaattcttgaagtatctgatggattaatggtagcacgtggtgatatgggtgttgaaattccaccagaaagcgtaccaatggttcaaaaagatttaattagaaaatgtaataaattaggaaaacctgtaattactgcgactcaaatgcttgattctatgcaacgtaatccacgtgcgacacgtgcagaagcaagtgacgtagctaatgcaatatacgatggtactgacgctgtaatgttatcaggcgaaactgcagcaggtcaatatcctgaagaagctgttaaaactatgcgtaatattgcagtttctgctgaagcagcgcaagactataaaaaattattaagtgatcgtactaaattagttgaaacttcattagtaaatgcaattggtgtttctgttgcacatactgccttaaacttaaatgtaaaagctattgtagcagcaactgaaagtggttcaacagcacgtacgatttctaaatatcgtccacattcagatatcattgctgtaacacctagcgaaaaaactgctagacaatgtgcaattgtatggggagtaaatccggtcgttaaagaaggacgtaaaacaactgatgctttactaaataatgctgtagcaacagcagtagaaactggtagagtttcaaacggagatttaattattattactgctggtgtacctactggagaaaaaggaactacaaatatgatgaaaatccacttagtaggtgatgagattgctaaaggccaaggtgttggtagaggatctgttgtaggccatgcaattgtcgcagatagtgctagtgatttagaaggtaaagatttatctgataaagttattattacaaattctgttgatgaaacattagtaccatatgttgaaaaagctataggtctaattacagaagaaaatggtattacttcaccaagcgcaattataggtttagaaaaaggcatacctactgttgttggtgtagaacaagcaactaaagaaattaaaaatgatatgttagtgactttagatgcgtcacaaggtaaagtgtttgaaggttatgctaacgtcctttaa

SEQ ID NO: 955 - DNA, 924 bp, Staphylococcus epidermidis
ctaatgaaaagtttcagaaatatcatgggcgattctcaaaatctagataaacgtatacaaaaaataaaacaaaatgtaatcaatgatactgacgttaaacattttcttgagaaaaatcgtagtaatataactaatgagatgatagacgaagatttaaatgttcttcaagagtataaagatcaacaaaaagtttatgatggacatcgctatgatgattgtccgaattttgtaaaaggacatgttcctgaactatatattgaaaatgaaagaatcaaaattagatatctaccttgcccgtgtaaaattaaacatgatgaggaacgatttgattcacaacttattacatctcaccatatgcaaagagatacacttcatgcaaagctcaaagatatttatatgaataatcgagagagacttgatgtagcaatggcagctgatcaaatctgtacagcaattactaacgatgaaaaagtaaaggggttatatttatatggtccttttggtacaggaaaatcattcatattgggtgctattgcaaatcaacttaaatcgcaaaagatttcatcaacaattgtatatttaccagaatttattcgcactttaaaaggtggctttaaagacggtagttttgagaaaaaattacaacgtgtgcgagaagctaatattttgatgttagatgatattggcgcagaagaagtcacaccgtgggtaagagatgaagtgattggtcctttattacattatagaatggtacatgaacttcctacattttttagttctaactttaattatagtgagcttgagcatcatctttcaataactagagatggcactgaaaagactaaagcagcacgaattattgaaagaattaagactttatcgacaccttattatttgactggtaaaaattttagaaacaattga

SEQ ID NO: 956 - DNA, 1278 bp, Staphylococcus epidermidis
acaaatgatggaggacaatgtcttatgtcaaaattaattttggcggtaaatgctggtagctcatctttaaagttccagctaattaagatgcctgaagaaaaactagtaactaaaggtgtgatagaacgtattggtttaagcgattctatcttcaccattcatgttaatggcgagaagcttactgatatcagagatatccataatcatgaagaagccgttaatataatgttagatagttttaaagaacatgaaatgattaaagacatcactgatattcaaggaacaggtcatcgtgttgtacacggtggtgaaactttccctaaatcagttgttgttactgatgaagtagaatctcaaattgaagaattaagtgaattagcacctttacacaatccagctaatttaatgggaattagagcttttagaaagttattaccagaaatcccacacgttgcagtgtttgatacttctttccatcaaactatgcctgaacaagcttatttatatagcttgccatatcattactatgaagactatggcatacgtaagtatggtttccacggtacaagtcataaatatgtatctcgtagagctgctcaaattgttggtagaccaattgaagatttaagaattatttcttgtcacatcggtaacggtgcatctattgcagctatagatggtggagaatctattgatacatctatgggattcacaccacttgctggtgtaacgatggggactcgttcggggaatcttgatccagcattaataccattcattatggaaaaaacgggtaaaacagctgatgaagttttagaaatacttaataaagaatcaggattattaggtcttactgggacatcaagtgatttgcgtgatttaactgaagaagctaaacatggacgtcaacgttcccgtgttgctctggatttatttgcttcaaaaattcacaaatatattggctcttatgcagctagaatgcatggtgtagatgttattgtatttactgcaggaataggtgaaaattcacatattattcgtggtaaagttttagaaggacttgagtttatgggtgtttattgggatcctaagaagaatgaaagtttacatggtgaagaaggttatattaactatccacattcacctgtaaaagtacttgttgtacctactgatgaagaagtaatgatatctcgtgatgtgattaaatatggtaaacttaatgataatacacccaaaaaagaagaatttgataccaacgaaagtatcgaagtgaattaa

SEQ ID NO: 957 - DNA, 207 bp, Staphylococcus epidermidis
tctttatacataaggcacctcgttaattttgtttattggtatttattaaattatgcgaaaggtccttatttttcaaagtattttaatgtaaaattacatataaactcaaagtattttggcgagactcttgagggaacaggacaagctgaagactacaggctgaagctgtcccctaagaaagcgagccaacaaaacgaagtattgtaa

SEQ ID NO: 958 - DNA, 570 bp, Staphylococcus epidermidis
ttattattaattaaatattctgtttattatgttaaaatagaattaagaaagataaagggggcaataatgatgatttcttataaaaacatattaatcgcagtcgatggatctcacgaagcagaatgggcttttaacaaagctgtcggtgttgctaaacgtaacgatgctcaattaactattgtgaatgtaattgactcacgtacgtattcttcttatgaagtatacgatgctcaattcacagaaaaatcaaagcatttctccgaagaattacttaaaggttataaagaagtagccacaaatgcaggtgtaaaaaatgtggacacacgtttagaattcggctcacctaaagcaattatacctaaaaaattagcgcgtgatgttggtgctgatttgattatgagtggtacatcaggtttaaatgcggtagaacgttttattgttggctctgtatcagaagcgattgttcgacatgcaccttgtgacgtattagttgtgcgtacagaagaaatgcctgaagatttccaacctcaagtagcaacacctcaattacgtgaaaaatatcaagattag

SEQ ID NO: 959 - DNA, 504 bp, Staphylococcus epidermidis
tgtacggtgattaaacttgggagggtgacatatatgaaatgcccaaaatgtaattctacacattccagagtggttgattcaagacatgcagatgaggccaatgcgattagacgtagaagagaatgtgaaaattgcggaacgcgttttacaacatttgaacatattgaagttagtccattaatagtagtgaagaaagatgggactagagaacaatttttaagagaaaaaatattaaatggtttagtaagatcttgcgagaaacgaccagtacgttatcaacaacttgaagacataactaataaagtggagtggcaacttagagatgagggacaaactgaaatttcttctagagaaattggagagcatgttatgaatttgttaatgcatgttgaccaagtttcctatgtaagatttgcatctgtatataaagaattcaaagatgttgatcaactcttagagtcaatgcaaggtatcttgagtgataataaacggagtgataaatag

SEQ ID NO: 960 - DNA, 273 bp, Staphylococcus epidermidis
gttaaacttgtgttaccaaatggtgtcttgaatgcgaataaaatcatgattacacctataacgattaaagcaatgattgtaactattttaatgattgcgaaccagaattcaagctcaccaaacaactttgcacttaataaattgaaagacattagaataagtacacagaataaagcactaatccaattaggtatgtctgggaaccaaaaacttatatatttggcaactgcagtcacttcagccataccagtaataatccaacatagccagtaa

SEQ ID NO: 961 - DNA, 192 bp, Staphylococcus epidermidis
aatattagtgtctcaggtttttttattaacaataaatttaaaataaacctatttctatcttatcttgaacattcactctgcttaaatttcatatttcttttattaaagtttcctttaagaaaatatatgttgaagttactatttcgtataattgttaagggtaaatttataacttttattaagattatgtaa

SEQ ID NO: 962 - DNA, 1014 bp, Staphylococcus epidermidis
ttatttagagttaattcatactatcaatcacggatggacacttttttaaatagaaagggatattttatgtctgaagaaaatactattatggaacgtctatttcataaattagatgataaagctaaaacgttaaacaaagaaaatggacagagttttatcgaaaatttagggttagctatggaagatatttatacaaaccaaagagaacttttagaacaagcaacgcttcaagatagaaggaaagcttttcaatttgcatatttaagtttattacaagaagaaaatattcaagctaatcatcagatcacgcctgactctataggactcattctcggttttcttgttcaacgctttttagaacataaaaaggaaatgcacattgtagatattgcaagtggggcaggtcatctaagtgcagctgtgaaagaagtactttctgataaaacaattatgcatcatctgatagaggtagatccagtgctatcacgtgtaagtgtgcatttggctaattttttagagataccgtttgacgtttatcctcaagatgcgattatgccattaccattggaagaggctgatgtcgtgattggagatttcccaataggatactatcctttagatgaacgtagtagagaaatgaagttaggctttgaaaagggacacagttattcccatcatctgttaatagaacaatctattaatgcgctaaaaggggcaggttatgcatttttagttgttcctagtcatctctttgaagatgataaagtgaaacagttggaaaatttcattgctacagagactgagatgcaagcatttttaaatttacctaaaacattatttaaaaatgaaaaagcacgtaaatctatattgattttacaaaagaaaaaatcaggcgaaactcgaccagttgaagtcttattagccaatatccctgattttaaaaatcctcaacaatttcaaggtttcatttctgaattgaatcagtggatagtcacaaatcatacaaaaaaatag

SEQ ID NO: 963 - DNA, 3204 bp, Staphylococcus epidermidis
gagaccatggtagcacatttaaatattcatacttcttttgacctgttagattctagtttaagaattgatgcattaatagataaagctaaaaaagaaggatatcgtgcgcttgcaataaccgatacaaatgtattgtacggttatccaaagttttatgatgcttgtattgcagctcacatacatccaatctttggtatgactatatatttaacggatggtctctatactattgaaacggttgttttagcaaaaaataatcaaggactcaagtcattatatcaaatttcttctgctataatgatgagaaataaagaagaagtgccaattgaatggctaaaaagatacgacgaacatttaattatcatatttaaagaggctgagttgtctcataagcaaattattgatgcttttgaaggtaagaaagaattatatttaaatcacaatagtaataatacattgactggcaaacgtgtatggatgcaatctgcaagatacttaaatgaagatgatgctgaaaccattccagcgttacatgccataagagataatactaagttagatttaatacatgagaaagaaacacttgatgaacattttcctagtatagaagaacttcaaacactaaatcttagtgaagatatgattactaacgcgaatgaaattgaagaattatgccaagcagaaattgcataccatcaatccctgttgccacaatttgtgacacctaatggtgaaacttcgaaagattatctttggacgatacttatacataggttacgagaatgggaacttaatgataaaacttatttcaatcggttgaaacatgaatataaaattattactgatatgggtttcgaggattattttcttattgtaagtgatttgattcattttgctaaaacacatgaagtgatggttgggccaggtcgtggttcatcagcagggtcattagtaagttatttattaggtattactactatagacccgttaaaatataatcttttatttgaaagatttcttaatcctgaacgcgtaactatgccagatattgatattgattttgaagacacgagacgtgaaaaagtaattaagtatgtacaagataaatatggtgaacatcatgtatcaggtattgtgacatttgggcatctgttagctcgtgctgttgctagagatgtaggaagaataatgggatttgatgaaacgagtttaaatgagatttcaaaacttattccacataaattaggtataactcttgaagaagcataccaaaagccagagtttaaagcatttgttcatcgtaatcatagaaatgaacgttggtttgaagtgagtaaaaagttagagggattaccaagacatacgtctacgcatgctgcaggtatcattatcaatgatcaaccattattcaaatttgccccattaacaactggtgatacaggattattaacgcagtggactatgacagaagcggaacgtataggattattaaaaattgatttcttgggattacgcaatctatcaattattcatcaaattattttacaagttaaaaaggatttaaatataaatattgatatagaagctataccttatgatgataaaaaagtttttgatttattatcaaacggtgacactacaggtatatttcaattggaatcagacggtgttagaagcgtattaaaaagattgcaacccgaacattttgaagatatcgtagctgtcacatcattatatagaccaggaccaatggaagaaataccaacttatataacccgtagacataatcctaaccaagttgcttatttacatccagatttagaaccaatcttaaaaaacacatatggtgttatcatttatcaagaacaaataatgctaatagcaagtcaagttgctggttttagttatggtgaagcagatattttaagaagggcaatgagtaaaaagaatcgtgcaatcttagaaagtgagcgtcaacatttcattgatggtgcaaaaaataacggttacggtgaacagataagtaagcaaatttttgatttaatacttaagtttgcagattatgggttcccacgtgcccatgctgttagttactcaaaaattgcatacattatgagctatttaaaagtgcactatcctcattatttttatgcaaatatcttgagtaatgtaataggaagtgaaaaaaagactgcagctatgattgacgaagctaagcatcaaagaattagcatcttgcctcccaatattaatcaaagtcattggtattataaggcaagtaataaaggaatatatctgtctttaggtacaattaaaggaattggatatcaaagcgttaaattaattattgatgaacgtcagcagaatggaccttatagagatttctttgatttttcaagacgtataccaaaaagggtgaaaaatagaaaattacttgagtctcttatcttagtaggcgcattcgacacttttggcaaaactagagcgacattattacaagcaattgatcaagtattagatttgaattctgatgttgagcaagatgaaatgcttttcgatcttttaactcctaaacaatcgtatgaagaaaaagaggaactacctgatcaattattaagtgattatgaaaaagaatacctaggattctatattagtaaacatccagttgaaaagaaatttgaaaagaaacaatatttaggcatatttcaattgtctaatggaagtcactaccaacctatacttgttcaatttgaccatatcaaacaaataagaacgaagaatggtcaaaatatggcatttgtaacgatgaatgatggaagaacgatgatggatggagtgattttcccagataagtttaaaaaatacgaaacttctatttcaaaggaacagatgtatatcgtattaggtaaatttgaaaagcgtaaccaacaaatgcaacttatcatcaatcaactttttgaagttgaagcgtatgagcaaacaaaattgtctaattcgaaaaaagttattttacgtaatgtaacacatctagaaccacaatttgaacattcaaaagtagaatctaatgaacaacatgcattaaatatttatggttttgacgaaagtgcaaataagatgacaatgttgggacaaattgaacgtcaacgtcaaaattttgatctattaatacaaacttattcgccagctgatattagatttatttaa

SEQ ID NO: 964 - DNA, 1287 bp, Staphylococcus epidermidis
aatatggaggttaattgtatgtctgcagaaaaaataacacagagtaaagatggtttaaatgtacctaatgaacctattattccgtttattattggtgatggtattggaccagatatttggaaagcagctagccgagtaatcgatgcagctgttgaaaaagcgtataatggagaaaaacgtatagaatggaaagaagtcttagcaggtcaaaaagcttacgatgaaactggagaatggttgccacaagaaacgttagaaacaatcaaagaatatttaattgctgttaaaggtcctttaacaactccaattggtggtggaattcgttcattaaacgtagcactgagacaagagttagatttattcacttgtttacgtccggtacgttggttcaaaggcgttccttcaccggttaaacgacctgaagatgttgatatggttattttccgtgaaaataccgaagatatatacgcagggatagaatttaaacaaggtacatcagaagtaaaaaaagttatagatttcttacaaaatgaaatgggagcaactaatattcgtttccctgaaacttctggtattggtataaagccagtatctaaagaaggtacagaacgtctagtaagagcagctattcaatatgcacttgataataatcgtaaatcagtaactttagttcataaaggtaatattatgaaatttactgaaggttcatttaagcagtggggctatgatttagctcataatgaatttggtgataaagtgtttacatggcaacaatatgatgaaattgttgaacaaaagggtaaagatgctgcgaatgaagcacaaagtaaagctgaacaagaaggtaaaattattattaaagactctattgctgatatcttcttacaacaaatattaactcgtccagctgaacatgatgttgtggcaactatgaatttaaatggtgactatatctctgatgctcttgcagctcaagttggaggcattggtattgcgcctggtgctaacattaactatgaaactggacatgccatttttgaagcaacacatggtactgcacctaaatatgctgatttaaataaggttaatccgtcatcagaaattttaagttcagttttaatgcttgaacatttaggttggcaaaaagccgcagataaaatcactgactctattgaggcaacaattgcttcaaaaatcgtaacatatgattttgcgcgtcttatggatggtgcaaaagaagtttcaacatctgattttgctgatgaactaattaagaatattagataa

SEQ ID NO: 965 - DNA, 732 bp, Staphylococcus epidermidis
ggtatactattaaaagatattacttttaggagggtaactcttatgaaactttcatttcatggtcaatcaacaatttattttgaaggtaacggcaagaaagttatagttgatccatttatctctggcaacgataaatgtgacctagatgaacaaacgttagaggtagattacattatcttaacacatggtcacgctgaccattttggtgatgtagttgaattggctaatcgtaatcatgcaactgtgattggttcggcagaattacaaggatatttatctacttatcacggagtcgaaaatgttcatggcatgaacattggtgggaaggctaaatttgattttggaacagtcaaatttgttcaagcattccatagttctagctttacacatgacaatggtgtgcctgtatatttaggtatgcctatgggaattattgtcgaagctgaaggcaagactatctatcatactggggatacaggattatttagtgatatgaaactgatagcagatagacacccagttgatgtatgttttgttcctattggagataactttactatgggaatagaagatgctagttacgctattaatgaatttattaagcctacaatcagtgttcctattcattacaatacattcccgttaattgaacaagatccagagcaatttaaggatgcagttcaggtaggggaagtacaaattcttaaaccgggtgaatcagtggaattttaa

SEQ ID NO: 966 - DNA, 882 bp, Staphylococcus epidermidis
cagaggatatttggaggtttaccaatgtttaaagatttttttaatcgaagtaagaaaaagaaatatttaacagttcaagattctaaacaaaatgatgtacctgctggtataatgacaaaatgtcctaaatgcaaaaaaataatgtatacaaaagaattgaatgaaaatttaaatgtatgctttaattgtgatcatcatatagctttaaccgcatataaaagaatagaagcaatttcagacgaaggatcatttatagaatttgatagaggtatgacatctgctaacccattagactttcctgggtatgaagaaaaaattgaaaaagatcagcagaagactggacttaatgaagcgttagtgtctggtactgcgaaattagacggaatacaatatggtgtcgcagttatggatgctcgttttagaatgggaagcatgggctctgtagttggtgaaaaaatatgtagaattattgattattgtacagaacatcgtttgccatttattctgttttctgcgagtggtggagctagaatgcaagagggaattatttctttaatgcaaatggggaaaacaagtgtttctttaaaaagacattctgatgcaggactattatatatttcttacataactaatcccactactggaggggtttctgcaagttttgcttcggttggagatattaatttaagtgaacctaaagcactaatcggatttgctggtagacgtgttatagaacaaacaattaatgaaaagttgcctgatgatttccaaactgctgagtttttattagagcatggtcaacttgataaagtcattcatcgaaaagatatgcgtgagactttatcaaatattttaaaaatccatcaagaggtgagtaactaa

SEQ ID NO: 967 - DNA, 309 bp, Staphylococcus epidermidis
tctactgctttagatctagaaaaaatgatacctactacaaaaatcacagttaatagagcaaatattataccaaaaataagatttgcagtgaaaaaagaaaaaatagaaagtgctgctgatagaatagtcaaaacaataaatcctattctcaaaaacttttgtcttttatttttttgtgtttgttcttcttcaaaagtttcttttaacttttcatacaagttctctttttcatgtaattctaaaacttgttgtgtatattcctttttcttttcaaaggtttcgtcaggaacaagctcattctcaacttga

SEQ ID NO: 968 - DNA, 1263 bp, Staphylococcus epidermidis
atgatatttacatccatgtcacacaaggtagtagtgcttatgaataacgaggcgttaactttgtttagaaaacgacaacaagctatacgtaaggagaaaaactattataataaatttatatttaatggtcactttacagtttttctacttatactattaggagcatttatatttggatatggcgaatggttaagtcacattcctccccaaatagactatgcactatttgctagtatagcattagctgttgtttcattattcccaattcgtacactcttaaaagaagcggaccaaatcttcttactaccttttgaaagacacatgaaaaattatattaatgcaagtctgttttatagttatatttcaagaatcagtttaccgttcattttgctaatcgtattctttccattgttttataaattaagtcacaatcattatggattttatatcgcattttctataagtacattgctatatccatatttggtattactcatcaaatggcaatgggttaaattaaataaaaatgtgttcattatcaacatattattatttatacctttagcagtaacgcattacatgattttaagatttcataactatttagcttttttaataatgattatattatttgtaatttatttagtcctaaagactaaagcagatcactatttacttccttgggaaaaagtgattgcaattgaacaacaacatcacacaaattattataaattcgttaatatgtttacagacgtaaaacacctaagagaatcagcagtacgtcgtagttatcttgatttcttactacccgttcctaaaggtgccaaatttaatgagaatcggatgtatttatatttatttataagaagttttgtcagaggacgcgatgctttttctattattttaagattagttattatcgctattatattaatggtatggttatcacaaccggttgtttcattaattatcggtagtttgtttatgtatattattttattacaaatgtctcaattttatacgcaacaagcatacggtttatggcctcaagtttggcctgtatctgatacaaaagttattgcgggatatcagcaatttttaaatcgcttgatgattataatcgctattacatttacgattgtttatgtaatcaaacaccatgacttattcttttttgctgtattattctttatagtaggctggctaaccattcgaaatgcagttaaaaaattaaaatatcaagaaacattattacgtgactaa

SEQ ID NO: 969 - DNA, 624 bp, Staphylococcus epidermidis
atgtttgaaacgataacgacagccgccatcctgtatattgctacagcggttgatttattagttatattattaatattttttgcaagagctaacaattatcaacagtataaagatatttatattggacaatatctagggtcattaactttaatttttgtaagtttgttttttgcttatgtacttaactatgtaccagataaatggattttaggattgcttggtcttataccaatttatttaggaattaaggttgctatattcgatgattgtgaaggggaaagaagagctaaagatgaactaaataaaaaaggattatctgagttatcaaaatctgtagcagtagtcacattagcaagttgtggtgcagataatataggattatttgtaccatatttcactaccataaataattatgaattagttatcactttaatcacatttgtaatcttaatttttattcttgtctttaccgctcaaaaattggctaatatacctggcctaggtgaagtcattgaaagatttagtaggtggataatgtcaatagtctatattggtttaggactattcattatcattgaaaacggaacagttcaaaaactctttcattttgtttttttagtgtaa

SEQ ID NO: 970 - DNA, 522 bp, Staphylococcus epidermidis
agaagtgcagctcgaaatgaaaaaaggtttgcaaatgaggagagaacaaaaatgacaaatcatattgtactatatcaaccagaaataccagcaaatacaggaaatattgcacgtacttgtgcgggtactttaacccatcttcatctaattaaaccactcggctttagtacggaagacaaaatgttaaaacgtgcaggacttgattattgggagcatgttaatattacatatcacgatagtattgaggaattttttgctaatacagaaggtcattactatttattaacaaaatttggtaaacagacctacagcgattttaatttttctaatactaatgaggattattattttatctttggtaaagaaactactggtcttcctgaatgggttaaggagaaatatgcaaaaacagctttaagaattccaatgagtgacaatatacgctctcttaatctttctaatactgctgctttactgatttacgaagctttgagacaacaagattatcctaacctttcataa

SEQ ID NO: 971 - DNA, 507 bp, Staphylococcus epidermidis
gccatgtatttatatacatcttatgggacttaccaatttttaaatcaaattaaacttaatcatcaagaacgtaatttatttcaattttccactaatgattcctcaataatcttagaagagtctgagggaaaatcaatcttaaaacatcctagtgcatatcaagtgattgatagcacaggtgaatttagcgaacatcatttttatagtgctatttttgtccctacatctgaagatcaccgtcaacagctagagaaaaaattattacacgtagacgtacctttaagtaattttggtggttttaaaagctatcgtttattaaaacccactgaggggtctacctacaaaatttactttggttttgcaaatcgaacagcatatgaagatttcaaagcttctgatatatttaatgaaaacttttcaaaagatgcattgagccaatactttggtgctagtggtcaacattccagctattttgaaagatatttatatccaatagaagatcattaa

SEQ ID NO: 972 - DNA, 1161 bp, Staphylococcus epidermidis
aacattttctatttaaagggagtgtatatgatgcataccatattattagtagtttttatgataattttaggagcaataattggtggagtaactaatatgattgcaattaaaatgttatttcatccatttaaaccgtattatatttttaggtttcgtattccattcacaccaggtttgatcccaaaacgtcgtgaggaaatcgccagaaaaattggacaagttattgaggaacatcttattactgaagaactaattcgacagaagttaaatcaaccgcaatcgagaaatatgatacagcaattaatccataaacaaataagtaaattaaaaaatgatgatgtgacaataaaaaaaatagctggatttttagggatagatgttaatgagttggtagattataaattgactactaaatttctaaataaactaaacttttggtatgagtcaaataaatatagaaagttaagtgaaatattacctcagtctttcttagatcaatgtaaaggtcaaatagaatatattactgacttcctatgtgaaagggctagaaattatttaagttctgaaaaaggtgaacgtgatatttatgaaatgttagacacatttttcaatgaaaagggacgcatcattggtttactacaaatgtttatgacaaaagaaagcattgctgacagaattcaacatgagttgattagactaactcaacatcctcaatctcaaaaaataattactaaagtattaaatgatgagtatgaaacatttaaagataagaacttagatgagatcattaaagaacaacaatttaaaaattatagtcaattagtacttaatgaattaaaaacttatttaaatctaaaagataaaacagagagacctatcaaacaagttgttccgcagtttattcaattcctagaagatgatacatcaaaacgtatgactgattttattattaaaggtacttcaaaacatttaacaaacattatgaaaaagattaatttacgtcaattagttgaagaacagattaatacatttgacttaaagtatattgaaaatctaattattgatattgccaacaaagaattaaaattaatcatgacattagggtttatattaggaggtatcattggatttttccaaggagtgattgcaatctttgtctaa

SEQ ID NO: 973 - DNA, 1254 bp, Staphylococcus epidermidis
acaatcttgtacattttttcaattaactttgcagatattctaaggagaatcaaacttatggttaaatttatacactgtgctgatttgcatttggacagtcctttcaaatctaaaagttatcttagtccaaatatttttgaagatgtccaaaagagtgcatatgaaagttttaaaaacatagtcgacttagctttaaaacaggaagtcgattttattattatagcaggtgatttatttgatagtgagaatcgtacattgcgtgctgaagtctttttaaatgaacaatttgaaagattaagaaaagaacaaatatttgtttatatttgccatggcaaccacgatcctcttacttctaaaataacaagtcagtggcctaataacgtatccgtattttcaaatcaagtagagacatatcaagctatcactaaatcaggagaaacaatttatattcatggattcagctatcaaaatgatgcgagttatgaaaataaaatagacgcatacccatcaagtcaaggtcagaagggcatacatattggtgtattacatggaacttatagtaaatcttcggtgaaagaccgttatactgaatttaggttagaagacttaaatcaacgtttataccactactgggcattaggacatatacaccaacgtgaacagttaagtgacatgccagtcattaactatccaggtaatatccaaggaagacatttcaatgaattaggagaaaaaggttgtctattggtcgaaggtgatcatcttaaactcactacacaattttatcctactcaatttattaaatttgaagaagctacaattgaaactgatcatacatctaaacaaggactttatgatgttattcaatcttttaaagataaagtaagaactgaagggaaatcattttatagattgaacgtacgcattaatagtgaagacattattgcaccacaagatttaattcaattaaaagaaatgattactgagttcgaagaaaacgaaaatcaatttgtttttattgaagatttaaatcttcaatatgttcaaaatgacgaaatgccaatagttaaagagttttcaccagaattacttgatgatgcgtcactttttgattcggcaatgactgatttatatcttaatccaagggcttctaagtttttagatgactataatgaatttgataaagttgagttagtcaatcatgcagaaagacttttaaaggatgaaatgagaggtgaacaaaatgataattaa

SEQ ID NO: 974 - DNA, 993 bp, Staphylococcus epidermidis
aggagctatcaacttatgaaattaatgaataaaattatcgtacctgtaacagcaagtgcacttttgttaggtgcctgtggttcaaatgcaactgaatcgaaggataacacacttatttcttctaaagctggtgatgttaaagttgctgacgtaatgaaaaaaatgggcaaagaacaaattgctaacacatcttttagcattgtattaaacaaagttttagcagataaatataaagataaagtagatacaaaagatattgataaagatattaaaaaagaagagaaacaatacggcggtaaagatcaatttgaaagcatgttaaaacaacaaggtatgtcacttgatgattataaagaacagaagaaattatcagcttatcagaaacaattgttactagataaagttaatgtatcagataaagaaatcaaagaaaactctaaaaaaacatcacacattttaattaaagttaaatctaaatctagcgataaagaaggtttatcagataaaaaagcgaaagaaaaagctgaaaaaattcaaaaagaagtggaaaagaatccaaataagtttggagaaatagcaaaaaaagaatcaatggacagttcttcagctaagaaagatggttcattaggttatgtgattaaaggtcaaatggtagatagcttcgaaaaagcactatttaaattaaaagaaggagaagtttctaaagtcgtaaaaacagactatggctatcacattataaaagcagataaagaaactgattttaatagtgaaaaatcaaatatcaaacaaaaattaatcgaagaaaaggtacagaagaaacctaaattattaactgatgcatacaaagaattattaaaagagtataaagtagactacaaagatagagatattaaaaaagcaattgaggattctattcttgatccagataaaatcaaacaacaacagcaacaacaatcacaaggtggttctggattaactaattcaggttcttaa

SEQ ID NO: 975 - DNA, 603 bp, Staphylococcus epidermidis
ataatacgtaacgaatattcacatagagaagaggcatatattatgtttttatgtactcggcaaatcgatatacatgcacggttcggtattcaaagaattgcatttttaagtttagttgcgacaatatttacatttttagttagttatgaagtgatgtattattttttagatacaccactctcagatagacatttttttgtacttatagtgtttatattgctcatgtaccctattcataaaatagtacatcttttattctttttgccttattataaatcttttaaaatccataaattatctagtaagaaatgggtaccatattttaatacttatgttaatacgcctgttcacaaaatttatttttgtattaatctcattctacccatctttttcctatctggtatatttataatgctaagtatatatttacctcaatatggacattattttatgtttttattatcacttaacataggctgttcaatgatggatattttatatttaaagatacttctattttcaaatgatggacattatgtcgaagaacatcaatcaggtcttcatattttaaacaaggtagacaatccttatatacaacactga

SEQ ID NO: 976 - DNA, 636 bp, Staphylococcus epidermidis
aggagcatccttatgcataaagtcattctcgtcgatgatcactatattgtaaggcaaggtttagagtttttattatcaactgtagatgatttatcagttttaaagggttttaaagatggcgcaacatttttatcttatttaaaaaacaatgaaagaccggacatcgtgcttttagacttagtaatgccagagatgaatggtatagaaattactgaaatactcaaacaacaatatcctgaaatcaaagtattagtacttacgagctatgtagatgatgaacatgttatttcagctattgataaaggagctgatgggtatgaaatgaaagatgttgaacctcaaaagttaattgagacaattcataaagttttgcaaggtgaacgtatcatacatcctcaagctaaaagcgtgattaaggccgtatcaaaaaaaccgcattatacgaataagttatctaaacgtgaaaaagaagtgcttaaggaaatggttaaaggtaaaacaaataaagaaattgcaagagcattgtttgtatcagaaaagacagtaaaaacacatgtgagtcatatttttagcaaactagaagtctccgatagaactcaagccgctatttatgcaatggaaaataaattgatttaa

SEQ ID NO: 977 - DNA, 2952 bp, Staphylococcus epidermidis
gaggtgaacaaaatgataattaaatcattagaaatatacggatatggccaatttgttcaacgtaaaattgaatttaatcgtcaatttactgagatatttggtgagaatgaagctggtaaatctactattcaagcatttattcactctattttgttcggatttcctactaaaaagtccaaagaaccacgtttagaaccaagattaggtaatcaatatggtgggaaattatcactcattttcgacgatggcattgaagcagaggttgagagaatcaagggaagtgctcatggagatgtcaaaatttatcttaaagatggtactattcgagatgaagtttggctaaataaaaaacttaattacatttcaaagaaaacatatcaaggtatattctcttttgatgttttaggtcttcaagatattcataaaaatctagatgaagagcaactacaagattatttattagaagcaggtgcacttggatcaactgaatttacaagtatgagagatagaattggacaaaagaaagaagaattatataaaaaatctggaaaaaatccaattattaatcaacaaattgagcaacttaaacaattagaaaatcaaattcgaaatgaagaaagtaaacttgatacatatcatcgacttgtagacgataaagataaatcatcaagaagactagaaaatttgaagcaaaatttaaatcaattatcaaaaatgcatgagcaaaaacaaaaagaggttgctctacacgatcaaacacaagaatggaaaaggttagaacagtcgcttaatatagagcctataaattttcctgaaaaagggatagatagatacgaaactgctaaatctcacaaacaatcacttgaacgagataaaagtttgcgagaagaaagattaagcatattaaataaagaggcggagtccatcaatccagtagaccaaaagtatattgattcgtttaatagcctttatcaacaagagactgaaattaaacaaaaagaatttgagttacgttcaatagagaaagatattgctgataagcaacgtgaactagaagctcttcaatctaatataggttggcaagaagtgttttacgacgcagacagtactgaagcgatgaaaagtcatatgagtgatttagtattaggcaagcaagaacaaattgcttatatcaatcagttagaacgtggacttgaagaaaataaaattgaaagaaactctaattctaatgagattaatcaagttgagaatgagcttgttcctgacgaaacctttgaaaagaaaaaggaatatacacaacaagttttagaattacatgaaaaagagaacttgtatgaaaagttaaaagaaacttttgaagaagaacaaacacaaaaaaataaaagacaaaagtttttgagaataggatttattgttttgactattctatcagcagcactttctattttttcttttttcactgcaaatcttatttttggtataatatttgctctattaactgtgatttttgtagtaggtatcattttttctagatctaaagcagtagattatagcacagcaataagtcaggaaattaatgatttagaaaaccaactcacgcaacttgaaaaagaatataatcttgacttcgatttagaatatcaacaacaagttcgtgaacaatggcgtcatgctaaaaaaaataaaaaaatacttgaagaaaaacatcaatatatcaatcaatcattaacgactgcaaatgagcgattagatagtttaaaacatagcattattgaaataaaaaaagagttacgtttatcagaaaaactttctgatgaattagtggttgaaagtatctcaaccattggtcaaattaaagcgcatgataaatacattattgatttaaatcaacaacgcaataatctgctaaaagatatcaatcacttttatgaacgtgcacaatctgtaactgaaccacatttaaaactatttaatcagatgtctttcttccatgatgtgaaacagtggttaaaaaatgcagaagaacaaaatgaggcttggaataaaaatcaaactgaaacgcaattactcaataatgaattaaagcaattgaagtcacgcttaagtgaaacgaatcaaatgattaagcaattatttgattatgttgatgtagataatgaagaagattattatacacatcatcatcattttgaaacatatcaaagtgatttaaatcgatttaatgatttaaatcaatatttagaaaatcaaaattacacttatgaaatgagttcgcaattaagtgagaaaactactgctcaactagaagaagaagatcatagattggctaaacaagttgacgattacaatgatcaatttttagaaatgcaagcagaagttagtgatttaaatgctcagattaatcatatggaaacagatagaactttagcacaattaagacatgaatattatagcttaaaaaatagacttaacgatattgctaaggattgggcaagcttaagttatatgcaagctttagtggaagaacatatcaagcaaataaaagataagcgtctaccacaagtgattaatgaagctgtatctatttttaaaaatttaacaaatggtacttacaatatgattcattatactgaaaatcataaaatacatgtaaagcattctaacggacaagtatttgagccagttgagttgagtcaatctacaaaagaattattatatgtggctttacgtattagtcttattaaagtattaaaaccgtattatccattcccagtgattgtagatgatgcatttgttcattttgataaatatcgtaaagaacgtatgttgaaatatttgagagaactatcagaacattatcaaatactttattttacttgtacaaaagatcatgtcataccggctaaagaagtattaactttaaataaattacaggaaggcgggaaaaaatga

SEQ ID NO: 978 - DNA, 993 bp, Staphylococcus epidermidis
aataagggcaaaataggggtcattaagagaaaaggcacaaacggacatgaagataaaaaaatttcttcactcaatagattacctgaagctatattatctgtaaaaagtggaaaagtaacaggtgtagttgttgaaaaaccagtaggtgaggcatatttaaaacaaaattcagaactaacattttcaaagattaaatttaatgaagaaaagaaacaaacatgtatagctgttcctaagaactctcctgtacttttagataagctaaatcaaacgattgataatgtaaaagaaaaaaatttaattgatcaatacatgacaaaagcagccgaagatatgcaagatgatggaaattttatttctaaatatggcagttttttcattaaaggaattaaaaatactattttgatttcattagtaggtgtggtattggggtctattttaggctcttttatagctttattaaaaataagtaaaattagaccattacaatggatagcaagtatatacatagaatttttaagaggtactcctatgcttgtgcaagtgtttattgtattttttgggactactgcagctttggggttagatatttcagctttaatttgtggtactattgcgcttgttataaattcttcagcctacattgccgagattattaaagctggtattaatgctgtagataaaggacaaactgaagctgctagaagtttaggattgaattatagacagactatgcaatcagtagttatgccacaggcaattaagaaaattttacctgcattaggtaatgaatttgtaaccttgattaaagaatcgtctatagtttccacaattggagtgagtgaaatcatgtttaatgcacaagttgtacaagggatatcttttgatcctttcacaccattgttagttgcagcattactatatttcttacttacatttgcacttacacgtgttatgaattttattgaagggagaatgagtgccagtgattaa

SEQ ID NO: 979 - DNA, 261 bp, Staphylococcus epidermidis
ggattttcaaatatgttttgtggtgtaccagattcaaccacaacaccatcggccataaatactactttatcacttatttctttagcaaagttcatctcatgcgtgacaatcaccattgtcatactttcattcgctaattgtctcattacttttaaaacatcccctactacttcaggatcaagtgcagatgttggttcatcaaataacataacatcaggttccattgccaaagctcttgcaatagcaactctttgtttttga

SEQ ID NO: 980 - DNA, 405 bp, Staphylococcus epidermidis
atgttaagaaaatactggattcactttgtcatagttactgttatagtgagtttgatatctataaaaggttttccacttgctttaggcgctttatacttgccactactgttcaaaattgtacaacttcagcttaatttatcaaaaggtcttattgataatgtcaatgtacatacatttataaaaagtaatcagtctggtgtggtgatcagtgtgatttgttgtctattaataacgggagttttgacatacaccttggatgatttttataatgaattaccaggatttttaggtgttttagtaagtataagtcctgttactctcactataggcgtgatactatttgttttaactgcaattgctattgttcaggctactaaagcaaaatatcaacaatctaagaattaa

SEQ ID NO: 981 - DNA, 183 bp, Staphylococcus epidermidis
atgatggcgaacaaaaaagattccaaattaaattatcatgaagaagaaaatgctatggttaccgacttagatgatttaaaagaattaggaaaagaaatggaacagatttcacaggaaaatgatgaagaaaaattaaatcaatctcatgataacgaagttcgttcagatttaaaaaaacagtaa

SEQ ID NO: 982 - DNA, 981 bp, Staphylococcus epidermidis
attccaaaccttacttcattgattcaaattaaagatttaaaaggaaggtttttattaatgactaaaacaataggcttattagtaatggcgtatggtacaccatataaagaaagtgatatagagccttattacactgatattagacgtggaaaaaaaccaactgaagaagaactgcaagatttaaaggatagatatgaatttattggtgggctttctcctttggcaggaacaaccgatcgtcaagccgaagcattactcgaagcattaaataaagaacaagatgatgtgaattttaaactttatctcggattaaaacatatatctccatatattgaagaagcagtagagcaaatgcataatgatggaattaaagaagcagtaacagttgttcttgcgcctcattattctagtttttctgttggctcttatgatcaacgtgctcaagaaaaagcagatgaatatggcatccagttaacacatattaaacactattatcagcagccaaaatttattaaatattggacggaaaaaattaatgaaacattagaacaaatacctaatcaagaacatgatgaaactgtattagtagtttctgcacatagtttaccaaaagggttaattgaaagaaataatgatccatatcctcatgaattgcatgaaacagcggaaattcttaaacaggaatctaacatcatccatgttgctgaagggtggcaatcagaggggaatactggaacaccttggttaggcccagatgtccaagatttaactcgtgatttatataaggaacaccagtttaagcactttatctatacgccagtaggttttgtttgtgaacatttagaggtgctttatgataatgattatgaatgtaaagtggtttgtgacgatattggggtaaattactatcgtccagaaatgcctaacacacatccattatttatcggtgctattgttgacgaaattcaatcacatatataa

SEQ ID NO: 983 - DNA, 1167 bp, Staphylococcus epidermidis
aatagcatatgtaattttaaaaaggtggcaaagctaatgaacaataaactaaaaaaagaaattatagactttgctcattctataggcattgatagtattggatttactactgcagatccttttgatgaattgaaacaaaaattagaggaataccatgcaaaagggtatgcatcgggttttgaggaatcaaatatatcattacgtacagaacctaaactaagcttacctagcgcacgttctattattgcaatagctgtgggttatcctaataaacttaaaggtgcaccaaaaagtgttaaaggtgatcgtagaggcatgtttgcaagagcatcatggggccaagattatcatagcattatgcgtaagagacttgataaattagctgatttcatcaaagaaaaagtacctgatgtcgaaatccaatcgatggttgataccggtgtattgtcagatagagcagtagcagaaagagctggattaggattcacgggtaggaatggatttgtgatttctcctgaattagggacttggtcttacctaggtgaaatgttagtaagtataccgtttgaacctgatgatcctttattagatagttgtggtgactgcacaatttgtgttgatcgctgtccaacaggtgcacttgttggaaatggtcagttaaatagccaaaaatgtattagttttttaactcaaactaaaggttatcttcaagatgaatatcgatataaaattggaaatagattatatgggtgtgatacatgtcaacaagtttgtcctaaaaatcgtggtattaatactcagcatgatgatattgtcttggaacctgaaattttgaaaccacgtcttgtacctttacttcaaatgagcaacaagaaatttaaaagtacatatgggcatttggcaggtgcttggagaggtaaaaaaccaatacaaagaaatgctattatagctttggcacattttaaagaagaaagtgctataccagaactaaaagaagttgcattaaatgatccaagacctatgattagaggtactgcatattgggcaattggacaaattttagaggatgatgctatatcttttattgatgagcattatgaaaatgagattgaagaagtgcagctcgaaatgaaaaaaggtttgcaaatgaggagagaacaaaaatga

SEQ ID NO: 984 - DNA, 1386 bp, Staphylococcus epidermidis
atgtcagtcagaattgaacatgatacatttggagaaattgaagtaccagaagacaaatattggggtgcacagactgaaagaagtaaacgaaattttccagtcggcaaagagcatatgcctatacaagtcatttacggatttgctcaactaaaaagaggtgcagccttagcaaatcatgaattaggaaaattgagtgatgaaaaaaagaacgccatcgtttatgcttgtgatcgtattttaaatggagaactagataatcattttccacttgtgatttggcaaacaggtagtggtactcaaagcaatatgaatgtaaatgaagtcgtaagctatgtagctaatgaataccttaagaaacatggaagtaaggaaactatccatccaaatgatgatgtaaataaatctcaaagttcaaatgatacatttcctacagctatgcatgtcgcattgttccatgaagttgaaactaagttagagccagcacttaaccatttacgtcaaacttttaaagaaaaagaagaccaatatcaatcaatcattaaaattggacgcacacatttgcaagatgcaacgcctattaaactaggtcaagagataagtggttggcgctatatgttagaaaaatgtgagcaattactatcagaatcaaaaaagcatattttaaatttagcaattggtggaactgcagtaggaacgggaattaatgctcatccagaatttggtcataaagtagccaaatatatttcccaaaacacagggtatgctttcgtatcatctgaaaacaaatttcatgctttaacttctcatgatgaaattgtacaattacatggaacattaaaagcgctagcgacagatttaatgaaaattgcaaatgatattagatggctagcctctggaccgcgtgcaggtcttgctgagatttcaattccagaaaatgaacctggatcttctattatgccaggaaaagtaaatccaacacaatgtgaaatgttaactatggtagcagtacaagtcatggggaatgatacgacggtaggtatcgcaagttctcaaggtaattttgaactaaatgtatttaaaccggtaattatgcataacactttacaatctatttacttattagcagatggaatgaatacctttaataaaaactgtgcaattggtattcaaccgatagaagaaaatattaataattatttaaatcaatcattaatgctagttacggcactgaaccctcatattggatatgagaaagcagctcaaatagctaaaaaggcacacaaagaaggacttactttaaaagaatctgcaatagaaagtggatatgtaactgaatcacaatttgaagagtggataaaaccagaagatatggtagacccacattga

SEQ ID NO: 985 - DNA, 234 bp, Staphylococcus epidermidis
aatatctgcagtatattctgctactttttcactattatcaaatactttaaaattcattgccatgttaactacactcctctaagtttgctcttttatttaagtcgatttaatttaaagtataccctttgtattaattatcaaactattattttttattggctcacaattaatataacatttcttgggtttatcttgcatttactttatctattagcgttaattatgaaaggttag

SEQ ID NO: 986 - DNA, 963 bp, Staphylococcus epidermidis
attacaggaaggcgggaaaaaatgagaaatgtagaaaaattaaatcccggcgactcagtggatcattttttcttgatccatcgtgcaactcaaggtgttacagctcagggtaaagattacatgacactatttctgcaagataaaagtggtgatattgaagctaaattatggactgctacgaaagatgatatgcaaactttaaaaccagaaacaatagttcatgtcaaaggtgatatcatcaattatcgtggacgcaaacagatgaaaatacatcaaatacgtcttgcacaagctgaagacaaagtgtcaactaaagactttgttgacggtgcgccaatgtcacctacagaaatacaagaggaattatcgcattttatgttagatattgaaaatgctaacttacaacgcattactagacatttaattaaaaagtatcaagatcgttttttcacttatccagcagctagttctcatcatcataatttcgcgagtggattgagttatcatgttttaacaatgttgcgtatagcaaaatctgtatgtgatatttatcctctgttgaatagaagtctattatatagtgctatcattttgcatgatttaggtaaagtaagagaattgagtggtccagtggcgacgacctatactgttgaaggaaatttacttggtcatatctctatagcaagtgatgaagttgctgaaacagccaaagagttaggcattgatggagaagaggttatgttacttagacatatgattttagcgcatcatggtaaaatggagtttggatcgcctaaattgcctcatttaaaggaagctgaaatactttactttatagataatattgatgctaaaatgaacatgtttgataaagctttcaaaaaaacagaaaaaggtcaatttacagaaagaatttttggtttagaaaatagacaattttataatccaacaacacttgattaa

SEQ ID NO: 987 - DNA, 696 bp, Staphylococcus epidermidis
agtcaatggaggtgccttatgacagtaaaagttgaacatcttacagggggatatggaaaaaaacctgtaattaaagatttgaattttgaattagaaaaaggtgaaattgtaggtttaataggtctaaatggtgctgggaaaagtactacaattaaacatatgctaggattgattaatccaatggaaggcaaattatcaatttcaaatattaaaattaatgaagatattgaaaattatagaagaaagttatcttatatacctgaatcaccagtcatctatgatgaactaactttagaggagcacattgaaatgacggcgatggcttatcaattaagtagagaagaggttatgcgtagagctaaaccattacttaaagtttttagattagaaaatgaacttaaagtatttccaagtcatttttctaaagggatgaaacaaaaagtgatgattatttgtgcatttatagttgatccagaattatatattattgacgaacctttcctcggtttagatcctttggggatacagtctatgttagatttaatggtagaaaaaagaaatgaaaatcgaacagtattaatgagtacacatattttggctacagccgaaaggtattgtgatagatttattattttagataaaggtgaaattgttgcatttggtaatcttgatgagttacggaacaaacaggattaa

SEQ ID NO: 988 - DNA, 600 bp, Staphylococcus epidermidis
  unsure (552),(600): Identity of nucleotide at the above locations are unknown.
agtgtttttatttacaatagaattaataaaggagtgagaggaaagatgacagacattataattgtacactcaaaacatggtaattctaaaaatcattggtacgaatggttaaggcataatttaactttggaagggtatgatgtttctttattcaatcttgaagcaaatgatcatgctcaaattgatgagtgggttaatgaaatgaaacaacaactacatatccgtaaaaaagatacatattttgtgacccacggatttggctcaatcgctgctttaaaatttcttgaagaaacgcatcatcacattgaaggtttctttagtatcgcaggatttaaagaagatgcacaagatatagacgaagatgtagatttaaaaggggtaaccatcgattacgataaaataaaagagcaagtagataaattttatggactcacgtctaaagatgatcaatatgtttcatacaaggaaacacaaaggctgatgaattcacttaatggacatacacgtgtagtagaagatgggggacactttttagaagaggaaggttttgtnacatttacttctttaattaacagaatgcaaggatatatgactaggtan

SEQ ID NO: 989 - DNA, 1458 bp, Staphylococcus epidermidis
agtcggtatatggcgtattttaataaatttttaagcaattctgaaaggaagcgtggaaaagtgagtaagaaagtggcaattattggagcgggaatcactggtttatctagcgcatatttcattaaaaaacaagacccttctattgaagtaactatcttcgaagcctcaaatagagtaggtggaaagattcaaacatatagatcagatggttacacaattgagttaggccctgagtcttatttaggtcgtaagacaattatgactgatgtggcaaaagatattggattagaaaatgaccttataacaaatactactggccaatcttatatttttgctaaaaataaattatatcctattcctggtggctcaattatgggaattcctacagatattaaaccatttattaaaacaagactcatttcacctattggtaaattaagagcggggcttgatttgtttaaaaaaccgatagaaattgaagatgatatttctgttggtagtttctttagacaacgattaggtaatgaagtattagagaacttaattgaaccactaatgggtggtatttatggcactgatattgatcaattgagcttaatgagtacatttcctaactttaaggaaaaagaggaacaatttggtagtttgattaaaggaatgaaagacgaaaaagaacaacgtattaagaaacgtcaattatatccaggtgctcctaaaggacaattcaaacagtttagacacggattgagttcttttatagaggctcttgttaaagatattgaaagtaaaggtgtccacatacgatataacacgccagtcaaagatatattgatttcgcaaaaagattatgaaattttattagaagatgacagtaaagagaaatttaatggcttacttgtaacaacaccacatcaagtatttctgaactggtttagtcacgatccagcatttgattactttaaaaacatggattctactactgtcgcaacagttgttttggcctttgatgagaaaaatattaccaatacgtacgatggaactggctttgttattgcaagaacaagtcaaacggatattactgcatgtacttggacatcaaagaaatggccatttactactccagaaggtaaagttttaattcgagcatatataggaaaaccaggtgatactgtagtagatgatcacaccgatgaagaaatagtatcaattgttagaaaagacttaagccaaatgatgaccatctcagggaatcctgattttacaattgtaaatcggttacctaagagtatgccccaataccacgtgggtcatattaaaatgattaaagaaattcaacaacatattaaaacaacttatcctagattacgtgttacaggggcaccgtttgaagctgtcggtttaccagactgcatacaacaaggtaagaatgcagttgatgaaatattagaagagttataa

SEQ ID NO: 990 - DNA, 474 bp, Staphylococcus epidermidis
ataaatagtattgatagacagagtttcacagatttaattcaaacaaaatttaagatggtccgtatagaagcaggctatactcaagatacaatggcacaaaccattggactttccaaaaaaacattggttcaaattgaaaaagaaagagttctaccaaactggactacatgcgtatcaatttgtgctttattcagagattcagatgtattaaatagtacattcggttgtgatccgctcgaaattgtacaaacaatttctagaaaccattgtgcttatccaaatcactcaacaacaagtgatatttactggaatactattgatacacgtaatggtttcattttacaaagtaataaagtaagtaacatttatcgtgttctcaataatgaaaaacagccaatctttggtacttcaaaaatgagggaagctgaaacttacttcaatagaaatgctaaagaagaattaatacacgtataa

SEQ ID NO: 991 - DNA, 441 bp, Staphylococcus epidermidis
aggagtgtcattattatgtcagaaacgatattcagtaaaattatttcaggtgagattcctagttttaagatatatgaaaatgattatgtttatgcattccttgatatatctcaagtttcaaaaggacatacgctattagtacctaaaaaaccttcagcaaatatatttgaaactgatgaagaaacaatgaaacatataggggttgctttacctaaagtagcaaatgcaattaaaaacgcatttcaccctgacggcttaaacattattcaaaataatggtgaatatgccgatcaatcagtatttcacattcatttccatttaataccgagatatgaaaatgatatagacggatttggctataaatgggaaacacatgaagatgtaatcgatgatgaaactaaacaaaaaatagcaacacaaattcaagcacaaatatcttaa

SEQ ID NO: 992 - DNA, 1116 bp, Staphylococcus epidermidis
catttaagcatattaaaatacttaattaagtgcaatatgctatcattggtaagaatgattcaattgtggggggactcaagggtgcgcagcaaaaacgatacaattttaaaagctataaaaggagaaagtacgtcacatacacctgtttggtttatgagacaggctggacgttctcaacctgagtatcgaaaattaaaagaaaaatattctctatttgaaatcacacatcaaccggaattgtgtgcatatgtgacacatttaccagtagataattatcaaaccgatgcggctgtattgtacaaagatattatgacaccactcaaaccaattggtgtagatgtcgaaattaaatcaggaataggacctgtaatttccaatcctattcaaactgttaaagatgtagaaaggctatcccaaatagatcctaaaagagatgtcccatatgtattagatacaattaagttactcactgaagaaaaacttaatgtacctttaataggttttacaggagcgccatttactttagcatcttatatgattgagggagggccttcaaaaaattataattttactaaagcgatgatgtatagagatgaggaaacatggtttgctttaatgaaccatctcgtcgacatttctattgattatgttgtagcacaagtggaagcaggagcggaaatcattcagatttttgattcctgggttggtgcactcaatgtgaaggattatcgctattatattaagccagccatgaataaattgatttctggcattaaagcttattatgatgtacctatcattctttttggtgtcggtgcaagtcatttaattaatgaatggaatgatttaccgatagatgtactaggccttgattggagaactacaataaagcaagctgacaaaatgggagtcaataaagcaattcaaggtaatttagacccatctgtactgttagcgccatgggatgtcatagaatcacgactcaaagacatattaaatcaaggtttaaatcgtggaaagcatattttcaatttaggtcacggtgtatttccagaagttaaaccagaaactttgcgaaaagtgactgaatttgttcataattatacagcgaaatag

SEQ ID NO: 993 - DNA, 1143 bp, Staphylococcus epidermidis
ggggataaaatggagaaaccaactagacttgcattacttaaggaaatagccgaatttctaaatgaagaaactgaaatatatagcatgatgcaaggagctttgcgtttacttataaatgggagcgacttttcaactggttggattttctatattgatgaagaggggcaccatgatttagtttcctctgtagatttacctgaagctttatctaaaaaccattgttactatttgacaaatggttcttgttggtgtgtgcaagcatatcaaaatcataaattaactaaagcttctaatataataaattgttctagaatcaatttagctaatcatgcttatgataaagaaacgaatcatattactcatcatgctactgttccattgcagtctgggagcgaaagattcggtttgcttaacgtagcatctcctaacaaagaacattatagtgaagaagacttagaactattagaatctgtagcatttcaaattggttcagctataaagagaattcagctaactaataaagaaaaagaaaatgccaaaattaatgaacgtaatcgactagctagagacttacatgattcagtaaatcaaatgttattttctttaaaattaacggctcacgctgcaaaagggataactactgacgagcaagcgcaaagagcttttaagactattgaggaaacaagtcaaaatgcagtaaatgaaatgagagcactgatttggcaactaaaaccagttggattagaacaaggcttaattcatgcattacactattatagtaaaatgttaggattagatttgaaagttactattaatggactaatagatttatctaatgatatcgaagaaaatgtatacagaattattcaggaagcaatgaataatgttattaagcacgctaaaactaacaaagtttatcttgatttatcacaaaatgttgattatcttgaggtagatattagagataacggtcaaggttttgacacgcaatcaattaatacgtttttatttaatggtttaaaaaacataaagcaacgtacacagtatttgaacggtaaagttactatagaatcaaaaataaatcagggcactcggatttatattaaaattccattgaagttaaaggagcatccttatgcataa

SEQ ID NO: 994 - DNA, 834 bp, Staphylococcus epidermidis
gaggaaaaaatgaaatttacaatacctaaacaatttaacgattatacattgagagagattttccaatatttaaaattacctaaaaaagacttacatcaactgaatatgtctaaagaaattttaattaataaagagtacggtacattattaaataatgttaaaactggtgatcatgttgagataccaacccctaatgaagtaagtaattatttaccaagttatcgatatgctcaaatttattacgaggatgatgacttggccattgtcatgaaaccaaaaggtgttaaaacgcatcccaatgatttaaaagagagcaacacacttatgaaccatgtgatttacactgttgatagtgaatatgttgagcccatacatcgactagatcaagaaacagtaggtttattgatagttgctaaaaatccgcttatgaaaaaaatcttagaccgaatgttagaatataatgaaattacgcgtatatataaagcaaatgtcaaagcgttgttacctattaagccacaaacgatagatatgcctattggtaaagataaatttcattcaaacaaacgaagaatttccaacacaggtcaacgtgcaatcactcacattattaactctaaaatgattaaagaaggtgtatgtcaactcgacattaaactagatacaggtcgaacacaccaaattcgtgtgcaccttgctgagattggccatccagttattggggatccactttatggaacttcaacattacgacaattagagctaaatagtcatcaaattgaatttactcatccactgactcaagaaattatttctgtaagtctagatgataaatag

SEQ ID NO: 995 - DNA, 729 bp, Staphylococcus epidermidis
gtgccagtgattaatattaaaaatttaaataaaaaatttggagcaaatgaagtattgagagatattaatcttactgttgaaaagggtgaagtggttgcaataattggaccatctggaagtggtaaaagcactttactccgttgtatgaatttgttagatgtaccttcaaaaggtaaagttatatttgaagataatgaattaactcaacataatgttcatttagataatttacgacaaaaaatgggtatggtatttcaaaattttaatttatttcctcataaaaaggtcattgaaaatgtaatgttggcaccacttttattacataaagatagtaaagatcaattaaaagagaaagctttatatttacttgaaaaagtggggcttaaagacaaagcagattcatatcctaatcaactgtctggaggtcaaaaacaaagagttgctattgcaagagctttggcaatggaacctgatgttatgttatttgatgaaccaacatctgcacttgatcctgaagtagtaggggatgttttaaaagtaatgagacaattagcgaatgaaagtatgacaatggtgattgtcacgcatgagatgaactttgctaaagaaataagtgataaagtagtatttatggccgatggtgttgtggttgaatctggtacaccacaaaacatatttgaaaatcctcagcacagtcgaactgaaaattttttatcacgagtgttataa

SEQ ID NO: 996 - DNA, 615 bp, Staphylococcus epidermidis
aggagtgtagttaacatggcaatgaattttaaagtatttgataatagtgaaaaagtagcagaatatactgcagatattctacgtaagcaatttaataataatccaactactattgcaggatttcatttgagcaaagaacatgcaccagtgtttgatgaacttaagaaaaatgtagaaaatcatacagttgatttcagtcaaataaatattttagattatgatgataatcattcttattatgaggctttgggtgtgccaacaggccaaatttattccatttcttacgaaaatgatgcaattgactttatctcagataagattaagactaaagaaaataaaggcaaactgacaatgcaagtccttacgattgatgaaaatggtaaacttgacattagcgttcgtcaaggtttgatggaagctagagaaattttcttagttattactggtgctaataaacgcgatatggtagaaaaactttaccgtgaaaatggtaagactagttttgaaccatcggatttaaaagcacaccgtatggtcaatgttatcttagataaagaagcggctgcaggcttacctgaagacgtaaaagagtacttcactgcacgttttgcataa

SEQ ID NO: 997 - DNA, 366 bp, Staphylococcus epidermidis
ctcaaaggagtgcaaagacttatggcagtaaatttatatgattatgcaaatcaattagaacaagctttaagagatagtgatgaatataaagctattaaagatgcatttgctaaagtaaaagaaaacgaagaatcaaaaaaattatttgatgaattccgtgaaactcaaatgagcttccaacaaaaacaaatgcaaggggaagaaattcctgaagaagatttacaaaaagctcaagaacaagctcaagctatagaaaaagatgaaaatatttctgaattaatgaatgctgagcaaaaaatgagccaagtattccaagaaattaatcaaatcatcgtaaaacctttagatgaaatttacgctgactaa

SEQ ID NO: 998 - DNA, 447 bp, Staphylococcus epidermidis
tcatgcatatttcttgttatactgggtatgaaatactattacaattatccgacaaataaagtgaggagaatcataatgaaagtctcaagaatattatttggtttaggtgtaggtgctgttgcaggatttgcagttgctttaagacatcgtgataaccaaagcgtaaaaaatcatacgattgatgctagtcaacccactggagctcaatcagaattacaacgtgaaatagagaatatgaaacaatccttcaatgatattcttaattacggttcacaaatcaagaatgaaagtattgaatttggaagttcaattggcgaagagtttaaaggattgattggtaattttaaatctgatattaatccaaacatcgaaaaattacaaagccacattgaaaatttacaaaatcgtggcgaagatattagtaataacctttcaaacgataagtag

SEQ ID NO: 999 - DNA, 186 bp, Staphylococcus epidermidis
gatttaatctctgttgaattatattattgtactttagaaaataaaaaaggagcctcattcaatgagactcctttttgttatagcgtcctgggagggattcgaacccccgaccgatggcttagaaggccattgctctatccagctgagctaccaggacattttcaacacaagaattattatatctaa

SEQ ID NO: 1000 - DNA, 183 bp, Staphylococcus epidermidis
atcaatgactccaataggtttattcatacttcttcacccttatttttacaattaccttacattgtatcacagtatcatataactgtagatatttacgtttatagttcttgtaaagtgatattcctatctttattctacaatcatcaaaaaatgaccaaggcaaggttgccttggtcactataa

SEQ ID NO: 1001 - DNA, 1374 bp, Staphylococcus epidermidis
gtttatggattggagtgcattaaattgctaaattacactgaattagaaaataaaaatgttttagtagtaggcttagcaaaaagtggatatgaagcggcgaaacttctccttaaattaggggctaacgttaaagtcaatgatggaaaggatctttcacaggatgcacatgctaaagatttagaatctatgggcattgaggtaattagcggtagtcatcctttttctttattagatgatgatcctatcattgtgaaaaacccaggtattccatatactgtatcaattattaaagaagcagcaaatagaggccttaaaatcttaacagaggttgaacttagctatttaatttctgaggcaccaatcatagcagttactggaactaacggtaaaactactgtcacttcactaatcggtgatatgttccaaaaaagcgtgttgactggacgactttctgggaatattggttatgtagcctcaaaagttgcacaagaagttaaatcagatgagtatttaataacagaattatcatcttttcaattattaggcattgaggaatataaaccacatatcgctatcattactaatatttattctgcacatttggattaccatgaaacgttagagaactatcaaaatgctaaaaagcaaatatataaaaatcaaactaaagacgattatctcatttgtaattatcatcaaaggcacctaattgaatcagaaaatctagaagcgaaaacattttatttttcaacacagcaagaagttgatgggatatacattaaagatggtttcattgtttttaacggcattcgcattattaacactaaagacttagtgctaccgggagaacataacctggaaaatattttagcagctgttctagcatcaatcattgctggagtgccagtcaaagctattgtagatagtcttgttactttttccggtattgatcatagacttcagtatattggtacaaatcgcacaaataaatattataatgattcaaaagcaactaatactttagctactcaatttgcgcttaactcttttgatcaaccaattatttggttgtgtggtggattagatcgtggtaatgaattcgatgaacttattccttatatggaaaatgtacgtgtgatggttgtttttggagaaacacaagataaatttgctaaattgggaaatagtcaaggtaagtatgtgattaaagcaacagatgtagaggatgctgttgataaaattcaagatatagtcgagcccaatgatgttgttctattatcaccagcttgtgcaagttgggatcagtatcatacatttgaagaacgtggtgagaagtttatcgatagattccgagcgcacttgccatcatactaa

SEQ ID NO: 1002 - DNA, 207 bp, Staphylococcus epidermidis
aatatgtctccatcttcaaaagtttataattctattgtaagtgaatatatatcattttcaaagtcaataatgatgtattctttaaaattgatatatcctttgaaaattaatcaaatttgtatttcttttatttcagcgattttaattttaaaacgtatgattattgttttgaaaacagaaaaaatattcaataattattttatatag

SEQ ID NO: 1003 - DNA, 2409 bp, Staphylococcus epidermidis
acaataatgttaatttcaaatgaatggctaaaagattatgtgaatgttgaccagtcagttcaagcgttagcagagagaattacaagaactggaattgaagtcgatgatattattgactatacaaaagatattaaaaaattagtagttggacatgtcttgtcgaagacgccacatccagatgctgataaattaaatatttgtcaagtagacttaggtgaagaagaaccagttcaaattgtttgtggtgcaccaaatgtagatgaagggcaacacgtgattgttgctaaagttggtggtcgtttacctggtggaattaaaattaaacgtgccaaattacgtggcgaacgctctgaaggtatgatttgctcattacaagaaataggtatttcaagtcatgtaactcctaaaaattatgagtcaggtatatatgtatttccagaagcagttaaacctggaacagatgcgttagaagcaatatatcttaatgaccaagtgatggaatttgatttaacacctaatcgtgctgatgcattaagcatggtaggtactgcgtatgaagtcgcagctttatatcaaactaaaatgaataaacctcagttaacaagcaatgaaagtcaagaatctgctaaagatgaactaacaatagaagttaaaaatgaagataaagtaccttactatagtacacgtgttgttcatgacgtgactattggtccttctccagtatggatgcagttccgattaattaaagcgggaatacgtccaattaataatgtggtagatatttcaaattatgtacttttagaatatggccaacctctacacatgtttgatcaagaacaaattggttcgcaatctatagaagttagacaagctaaaaaagatgagacaatgagaactttagatggtgaagaacgtcgattgttagatactgatattgtcattacaaatggcaaagaccctattgcattaggaggtgttatgggaggggatttctctgaagtcactgaacaaacacgacatgttgtagtagaaggggctatctttgatcctgtatctattcgacatacatcacgccgtttaaatttaagaagcgaatcatcgagtcgatttgaaaaggggattgcaactgaatttgtcgatgaagctgtagatagagcttgttatttacttgaaagatatgcttcaggaacagttttaaaagaccgagtttcgcatggagatttaggatcatttgtgaccccaatagaaatcactgctgacaaagttaaccgtacaattggttttaatttaactgatgaagaaatcattgatatttttgagcaattaggatttgacactgaaaataaaaatggtgaaattaccgtgaatgttccatcaagacgtaaagacatttctattaaagaagacttaatagaagaagtagcacgtatatatggatacgatgaaataccatcaacgctacctgtatttaaagatgttacaagtggagaactaacagatcgacagtttaaaacgcgtactgttaaagaaacgcttgagggcgctgggctagaccaagctattacttattcattggtatcaaaaaatcatgctaccgattttgcactacaaaatcgtcctacaattgaattacttatgcctatgagtgaagcacattccacattacgtcaaagtttattaccgcatttaattgatgcagtatcatacaatgttgctcgtaaaaatacaaatgttaagttatatgaaatcggacgtgtcttctttggtaacggtgaaggtgagttaccagatgaagtagaatatttgagtggtatattaactggagactttgtaaataacacttggcaaggtaagaaagagtcagttgatttctatttaactaagggtgttgttgaacgtattgctgaaaagcttaatcttcaattcgattttagagctggtcaaatagatgggttacatccaggaagaacagcaattgtgtcacttaatggtaaagatattggtttcataggtgagctacaccctacgttagctgcaaacaatgatttaaagcgtacgtatgtatttgaacttaattatgatgcaatgatggaagtttctgtgggatatattaattatgagcctatacctagatttccaggtgtaacacgtgatattgcattagaagttaatcatgaagttacttcatctgaattgttatccattattcatgagaatggtgaagatattttaaatgatacactcgtatttgacgtatacgagggtgaacatttagaaaaagggaaaaaatctattgcaattagacttagttatctagatacagaaaacacacttaccgatgaacgtgtaaatgctgtgcatgataaaattttagaagcacttaaaaagcatggtgcaattattagataa

SEQ ID NO: 1004 - DNA, 189 bp, Staphylococcus epidermidis
cgaatcaaaacgtatccgatcgttttggagttattaactcatttaggagtgttaataatgaaattatttaacgcttttaaagacatcttagaagcagccatcactaacgatggcactcaattaggggcaagtattgttaacatcatagaaagtagcgttgatatggtgaatcgatttttgggaaattag

SEQ ID NO: 1005 - DNA, 468 bp, Staphylococcus epidermidis
aataaagaaacaaagggggataacgttatgggtgaagttaaacatttacaaatcaattacaaaacagatgagcttttcgctgatttcagagaatttggtaacaagaacctatatatgattgaggagttaaagggacaaatgattgatgcaagttccgattctcctttttatggaatttttgttggtaataaattagttgcgagaatggcattacttgataaaggagaagtagaagaaacctatttccctaatagcaatgactatattcttctttggaaattagaagtattagatacgtaccaaagacgtggatatgctaagcaactattaaactttgctaaagaaaataaaaaaccaattaaagctattgctagaaataactcaaaagaattctttttaaaacagggttttaaagatgtagaaaccaaaaatcctgaggggcacgacatcttaatatggaatccataa

SEQ ID NO: 1006 - DNA, 1896 bp, Staphylococcus epidermidis
ataaacatctataagattaacataaataaagactggggcattacattgagtaattgctccagctttattttgttttcattaatcaatttgataatggaaaggaggagccctttggaggaatatcaaaagaaaattaaagaaaaattaaacgtagtccctttagagccgggttgttacttaatgaaagatagaaatgatcaggttatatatgtggggaaggcaaagcgtttaagaaatcgtctacgttcttattttacaggcgcacatgatgctaaaacaacccgtttggttggagaaatacgtaactttgaatttatcgtgacatcaagtgagacagaatcgctactgctagagcttaatcttataaaacagtatcaaccccgatataatattttattaaaagatgataaaagttacccttttattaaaattaccaaagaaaagcatccacgattacttgttactcgtactgtaaaaaagaattcaggcaaatactttggtccataccctaatgcatattctgcacaagaaacaaagaaattacttgatcgtatctatccatttagaaaatgcgataatatgccagataagctgtgtctttattaccatattggacaatgcatgggaccgtgtgtctatgatgttgatttagagaagtatgctcaaatgacaaaagaaattacggactttctaaatggggaagataaaacaattttgcatcatttagaagaccgcatgaataaagcgagtgaacagttagattttgaacaagcaaaagaatatagagatatgattcaacacattcacaatttaactaaaaaacaaaagattatgtcttcagataatacaattagagatgtttttggttatagtgtttctaaaggctggatgtgtgttcaagtcttcttcgttagacaaggtaatatgataaaacgtgatgctacaatgataccgttacaacaaacagaggaagaagaattttatacttttataggtcaattttatagtttaaatcagcatctattacctaaggaagttcatgtacctaaaaatcttgataaagacatcattcagtcagtggtagatactaagattgttcaaccagtacgaggagctaaaaaagacatgattaatttagcgaatcacaatgctgaagtacaactcgataataaatttgaattaattgctagagatgagtcaagaacaatcaaagcaattgaagaattaggagagcgtatgggtatccaaacaccaataagaattgaagcttttgataattcaaatattcaaggtgttgatccagtttcagcaatggttacatttgtagatggcaaacctcataaaaaagattatcgaaaatataagattaaaacagtggaaggacctgatgattataaatctatgagagaggtcgttcgtagacgctatacacgtgtactcaacgaggggctacctctaccagatttaataatagttgatggtgggaaaggtcatatgaatggtgtgatggatgtactcgaaaatgagcttgggctagatataccagttgctggtttacaaaaaaatgataaacaccaaacatctgaactactttatggagcaagtgctgaaatagtacctttaaaaaagaacagtcaagcattttatctattacaccgcatacaagatgaggttcatcgatttgcaattacattccaccgacaaacacgtcaaaaaacaggtctgaaatctgttctagatgacattgatggtattggaactaagagaaaaacttcattattacgtacatttggatcgattaagaaaatgaaagaagcatcctttgatgaattacgacaagcaggcttgcctgaaaaggttgctaaaaaccttcaaaacgcgttacaaaacaaataa

SEQ ID NO: 1007 - DNA, 1626 bp, Staphylococcus epidermidis
aggagtaaatacatgaagtgtaatacgttaaagttaactgaacaggatcagttcattaataaaataaaaaatagtgaatctcaaattacatctttttatgaatatgatgcagcgaaaaaggaaagcttttatagaagattaaaaacacctaataatggaagggaatttcatttatcacgagtgattaaatcttacatgaatgaattaaagttaacacatcagcagctgaataacatagatgctttagctgatggtgcaaaagtagtgattggtggacaacaagctggtctttttgggggtccactgtatacgtttcataagattttctcaattataactttaagtcgtcaactttctgaggaatatgatactcctattgtacctgtgttttggattgcaggtgaggaccatgattttgaagaggtgaatcatacgtatgcattcaataataaagaaactaccttgaaaaaagtaaagtatcatacgatgacaccaccagatagtaatgtttcaagatatactcctgataagaacgaattaaaagcatcattaaatcacttttttaaagaaatgaaggaaactgtacatactcaagatgtttatcaaatgtgcgtcaatattattaatcaatttgattcatggactgatatttttaagggattgatacatgaagtgtttaaggattatgggattttacttattgatgctcaataccctgaattaagacagatggagaaaccgttgtttaaagagatattagaaaagaggaatcaagtcgatcaatcttttcgtgaaactcagatacgaacaactcaacaacaacttccatcaatgatacaaacagagacaaacacacatttatttatccatgaagacggaatgagacagcttttaaattttgatggcacttattttaaactgaataaaactgagaaacgttacacgaaacaaaatttattagatattatagaaagagagcctgaaagaatttctaataatgttgttactcgtccagttgtagaggaatggttgtttaacacagtagcatttatcggaggtccaagcgaaatcaaatattgggcagaattaaaaggtgttttcgatacgttaaatgtagaaatgcctattgttatgccaagattaagaatcacgtatttgtatgctagaactaaaaagttattaaaacaatataatttatcgatagagtctgtcattgctaatggagtagaacaggaacgtcaacgttttgttcgtgaaaaagcatcaaataattttataaatgaagtagaagaaatgaaaattcagcaacaagaactttataacaatttattcacctatgtggaaaataaccatgacaaccaacttcttttagaaaaaaataatcaaattcatctcaatcagtacgattatttaatcaaacggtacttactgaatattgaaagagaaaatgatataagtatgcgacagtttagagaaattagtgaaacactccatccaatgggtggtctacaagaaagagtttggaatccacttcaaattatgaatgattttgggatagatgtgttcagtccctccacctatccaccactttcttactcgtttgatcatttgattataaatccttga

SEQ ID NO: 1008 - DNA, 702 bp, Staphylococcus epidermidis
ataggagatttgaatatgaaattcaaaaatatattatttgatttcgacgatacattagtggatttttatgacgctgagaaaaaagcgttttataatttagcacagaaatacaatcatcagccaactcaacaggatttcgaacattttaagaaagtgaaccaagcgcattgggaagcatttcaacaaaataaattgactaaagatgaagtgctgtcacaacgatttattaattattttaatgactatcaaattcatgtaaatggaaaagaagctgataagtgctttagagctgaattagcaatggcaccagttaaattatttgatcatacattagaagttatacaacaattaaaattaaatcattctctctatatagtaaccaatggtgtaacagaaacacagctacgacgaattgctcagacacaatttaatgaaatatttcaagatgtctttatatctgaaaaagctggatttcaaaagccgatgacagagttcttcgattttgtgtttgaacatatcggagagaataacaggaatcaaactctaattgtgggagattctttaacgtctgacatattaggtggtaaaaatgctaatatatcaacatgttggtttaatattagacaaaaagaaaaccatacgtctattcaaccggattatatcattaatgatttatcagaaatgattcgcattgttgagtga

SEQ ID NO: 1009 - DNA, 936 bp, Staphylococcus epidermidis
atgtttcatcatgtgagcgtcatgttaaacgaaaccattgattatttaaatattaaagaagatggtgtgtatgttgactgtacgttgggtggagcaggacatgccctctatttacttaatcaattaaatgataaaggtagacttattgcgattgatcaagatttaacagccatagaaaatgcgaaagaagttttaaaagaacatttgcacaaagtcacttttgttcataacaactttcgagaattaacaaatattttaaatgaattagaaattgaaaaagtagatggtatttattatgacttaggtgtttcaagcccgcaattggatgtgcctgaaagaggctttagttatcacaatgatgcgaaactagatatgcgaatggatcaaacacaatcactttctgcgtatgaagtagttaatcaatggtcttatgaagcattagttaggattttctttcgttacggcgaagagaaattttctaaacagattgcacgcagaattgaagcccatcgagaacaacaacctatagaaacaactttagaactagttgatgtcattaaagaaggcataccagcgaaagcaagacgaaaagggggacatcctgcgaaacgcgtgttccaagctattcgaattgctgtgaatgatgagttatcagcttttgaagattcagttgagcaagccattgaatgtgtgaaggtcggaggtagaatttcagttattactttccactctttggaagatcgtttgtgtaaacaaattttccaagagtttgagaaaggtccagacgtaccaagaggtctacccgttattcctgaagcatatacacctaagttaaaacgagtaaatcgtaaaccgattaccgctactgatgacgatttaaacgaaaacaatcgagcacgtagcgccaagttacgcgtagcagaaatattaaaataa

SEQ ID NO: 1010 - DNA, 759 bp, Staphylococcus epidermidis
agatggagacatattttaatggaacaaattacttctgctcaaaatagtaaaataaaaaatgcgaataaattaaaaaagaaacgtgagagggataaaacgggtcttgctttaatagaggggattcatctcatcgaagaagcttatcaaagtcaaattgaagtaatacaattgtttatcgttgattccgatagaatgtcatcttcaataattgattatgcgaaagaagtgtatcaaattaatctaaaagttgctgaagcactttctggaactgttacacctcaaggtttctttgccattataaaaaaaccaacctatgataagacactagccaaacaagtattattaattgaccgtattcaagatcctggtaatctaggaactttaattaggacagctgatgctgctggattagatttgatagttatggagaaggggacggctgatccttttcaagataaggtgatccgtgctagtcaaggaagcatttttcatataccagtcatttttgatgacatcaacaattatattcatcaatttaatggtccagtgtatggtacggcacttgaaaacgcagtgagcttcaatgatgttgaagcgcaagtcaattttgcgcttatattaggtaatgaaggagaaggtgttaacccagatttactaaaagaaacaacgcaaaatctcactattcctatttatggtaaagccgaaagtttaaatgttgctattgctggaagtatcttaatgtatcagctgaaaggttga

SEQ ID NO: 1011 - DNA, 300 bp, Staphylococcus epidermidis
aatcattttaatccaaggtcaggagaaattagtatgggtgaatttaaaaatagaataaatgttacgattaatgatcaacatttcacaatcattggcgaagatagccctgaacatattcgttatgtagcacatcttgttgatgaaaaaatgcaagaattaggtcaaaaatcagcaggtttagatacaactcgaaaagcgattttaacatctgtgaatattatgcatgagaaagttatattagaagaagagaacagacgattacaacaagaaataaatcaattaaaacaaagagatgaataa

SEQ ID NO: 1012 - DNA, 846 bp, Staphylococcus epidermidis
gtaatggctaatcaatcattaaaagaaactccaaaaactcaaagtaatccacaaactcaagtacaaggtcaaaatcaacaaccaaaacaaaaaacagtaaaattgataattaaacgtcaagataatagcgaatcaaaaccttatgaagaatcatttgaaattccttataaggaaaatttaaacgtaattgcatgtttaatggaaatcagacgaaatccagtcaactctaaaggcgaaaaaacgacaccagtcacatgggatatgaattgcctcgaagaagtatgtggcgcttgttcaatggttattaacggccgtgcaagacaatcatgttcagctattgttgatcaattagaacaaccaattcgtcttgaaccaatgagtactttccctgtcattcgagatttacaagttgatcgctcaagaatgttcgataacttaaaacgaatgaaagcatggattcctattgatggaacatatgacttaggacctggaccacgtatgccagagaaaaaacgccaaactgcatatgaattgtctaaatgtatgacttgtggtgtatgcttagaagtatgtccaaatgtcacaaaaaataataaatttgttggtgcacaagctatttctcaagtacgtttgttcgacttacatcctacaggttccatgactaaagatgagcgtttagatgcattgatgagtgcaggaggactgcaagaatgtggtaattctcaaaattgtgtgaatgcatgtcctaaaggtataccattgacaacgtcaattgccgcaatgaatagagaaacttctttccatatgtttaaatcattctttggttctgaccaccaagtagattaa

SEQ ID NO: 1013 - DNA, 522 bp, Staphylococcus epidermidis
agggtgaacaacatgtctaagtggattattcttagtgataatcacaaagaaacaggtatcttatatcatatttatgaactacataaagatgcagataaatttttacatttaggggattctgaatttagttataatgacacagaacttagtttgtatcagcgtgtgaaaggtaattgtgatttttatccagagtttttagaagaagaaatcactgaagaaaacggaatccgtgccttttatactcatggacatctttatcaagtaaaccaaacacgaatgaaactggctgaaaaggcaaaagaattaggatgtttgtttgccttttatggacatacacatgttgcaaaatatgagcaaataggtggtatccatgtaattaatcctggtagtatttctcaatcacgtagtcaaattgaagaaacttttgccgaactcgtatacaaggaagatgaaaataccatcattttgaattttagaaatagagaaaatcagatcattgaaacagttaagattgaattttag

SEQ ID NO: 1014 - DNA, 1005 bp, Staphylococcus epidermidis
aaagagctaaaattagaaagtgaagaaaaggagatttatatgatctttatatacgcaatcatcgcattactgataacatttattttagtccctatacttattccaacattgaaacgtatgaagtttggacaaagtatccgtgaggaagggcctcaaagccatatgaaaaaaacaggtactcctactatgggtgggcttacatttttaattagtattataattacctctatcattgcaattatctttgtagaccattcaaatccaattattttgttactatttgtaacaatcggttttggtcttattggatttattgatgattatattattgtagttaaaaagaataaccaaggattaactagtaaacaaaagtttctagcacaaataattattgcagttatattctttgtgctaagtgatgtatttcaccttgtgcattttacgacagatttgcatattccatttgtgaattttgatattccgttgtcatttgcttatgtgatatttatcgtcttttggcaagttggtttctcaaatgctgtaaacttaactgatggtttagatggattggcaaccggtttgtcaataataggttttgcaatgtatgctgtaatgagttacatgttagattcaccggctattggcatattttgtattataatgattttcgctttactaggtttcttaccttacaatttaaatccagcgaaagttttcatgggagacacaggaagtcttgctctaggtggtatttttgcaacgatttcaatcatgttgaatcaagaattatcattaatattaattggttttgtgtttgtagttgagacattatctgtaatgttacaagtagcctcatataaattaacgaagaaacgtattttcaagatgagtcctatacatcaccacttcgaattaagtggttggggtgaatggaaggtagtaacagtattttggacggtaggtttaattacaggattaataggtttatggattggagtgcattaa

SEQ ID NO: 1015 - DNA, 957 bp, Staphylococcus epidermidis
aagagtacaaaaaaagagaggattcaattaatgggaaatgtcgtatacaaactcacgtcaaaagaaattcaatcattgatggctcaaactacttttgagacgacgaagttacctcaaggtatgaaagctcgtacgagatatcaaaatactgttatcaacatctatagttctggcaaagtaatgtttcaaggtaagaatgctgatcaacttgcgagtcaattgctaccagataaacaatcaacaactggcaaacatacatcatcaaatacaactagtattcaatataatcgttttcattgtattggaagcgatgaagcaggcagtggcgactattttggtccattgactgtatgtgcagcttatgtgagccaatcacatatcaaaatcttaaaagaacttggtgtagatgattcaaaaaaactaaacgatactaaaatcgtcgatcttgcagaacagctcattacctttatcccgcattctttattaacattagataatgttaagtataacgaacgacaaagtataggatggtctcaagttaaaatgaaagctgtcttacataatgaagctatcaaaaatgtgcttcaaaaaattgagcaagatcaactggattatattgttattgatcaatttgcaaagcgagaagtttatcaacattatgcattatcagcattaccttttcctgacaaaacaaaatttgaaacaaaaggtgaatctaaatcactagcaatcgcggcagcaagcattatttctcgttatgcatttgttaaacacatggaccacatctctaaaaaactccatatggaaataccaaaaggagcaagtaacaaagtagatttaattgccgctaaagtcattcaaaaatatgatattcaacaacttgatactatttcaaaaaaacattttaaaaacagagataaggcaattcatctaatgaatcaaaaatacaataaataa

SEQ ID NO: 1016 - DNA, 810 bp, Staphylococcus epidermidis
agaagtatgaataaacctattggagtcattgattcaggtgttggtggtcttactgtagctaaagaaattatgagacagttaccaaatgaaactatttattatttaggtgatatagcacggtgtccatatggtccaagaccaggagaagaagttaaaaaattcacaacggaactagctcaaaaattgatggaatttgatataaaaatgctagttattgcttgcaatactgctacggcagttgcattaaattatttacaaaacatattacctattcctgtcattggtgttatcgaacctggagcaagaactgctataatgactacaaaaaatcaaaatgtattagttttaggaactgaaggaacaattaaatcagaagcgtatcgcacacatataaaaaagataaatccaaatgtgaatgtctatagtgttgcatgtccgggctttgttcctctagttgaacaaatgcgctataaagaccctacaattactaatattgtgattcatcaaacgttgaagcaatggagaaacagtgatgcggacacggttattttaggatgcacgcactatccgttgttatatcagcctatttatgaatattttagtggtactaaaacagttatctcatctggcttagaaacagcaagagaagtaagtgcattactcacgtttagcaatgagcatgccagttacacagaacatccccaacatagattttttgcgactggtgacaccacacatattaaaaatattattgatgaatggttaaatatgaaagttgaagttcaaagaataactgtagatgattcatag

SEQ ID NO: 1017 - DNA, 522 bp, Staphylococcus epidermidis
atgctcattgatatagttgttcttcttattatttgttactttatagtgatagggtttcgtagaggtatttggttatcgatattgcactttgcttcttcaattgtatctttatatattgcgtcacaacattatcaatcgattgcgcaacgtttagttgtatttgtgccatttccgaaaacggtggcgtttgatatggtctatactataccttatgatcatttgcaatacagatttgaaaaagtgatagcatttattataatatttggtatgtgtaagcttattttgtatctagttgttgttacatttgataatataataacgtataaaaagatacatttagtaagtcggatatcgagtgtcgttttgagtatcatatcggtttttatatatttacaaattggactttatttattatcgctatatccgcattcatttatacagtaccaattatctcaatcgctagtaagtcgagttgtgattgaacaaattccttatttatcacaatttattttaaatttataa

SEQ ID NO: 1018 - DNA, 1827 bp, Staphylococcus epidermidis
tttatatctgaaattaaaagtagggctttagatttaaatattcaggggagtgacatttctatggcagagaaaaaaattattgttgtcggtggaggactagctggtctgatgtcaacaattaaagcggcagaacaaggtgcacatgtagatttattttccattgtaccggtaaagcgttcgcactctgtttgtgcacaaggtggcataaatggtgctgttaatactaaaggtgagggagattcaccgtggattcactttgatgatactgtttatggtggagacttcctggctaatcaaccaccagtcaaagcaatggctgatgctgcacctaaaatcatccatctgttagatcgtatgggggttatgtttaacagaacgaaagaaggcttattagactttagacgttttggcggtacactacatcatagaacagcttttgctggcgcaacgacaggtcaacaattgctttatgcattagatgagcaagttcgttcatttgaggtagatggtttagtaactaaatacgaaggatgggaatttctaggtattgttaaagacgaagaagatgctgcaagaggtattgtcgctcaaaatatgacaacatcagaaattcaatcattcggttcagatgctgtcatcatggcaacaggtggtcctggtattatctttggtaaaacgacgaattcaatgattaatacaggttcagcggcgtcaatcgtttatcagcaaggtgcgatttatgcaaatggtgaattcatccaaatacatccgactgcgattcctggagatgacaaattacgtcttatgagtgaatcagctcgtggtgaaggtggacgtatttggacgtataaagatggtaaaccttggtacttcttagaagaaaaatatccagactatggtaacttggttccacgtgatatagcgacacgtgaaattttcgatgtttgtattaaccaaaagttaggtatcaatggagaaaacatggtataccttgatttatctcataaagatccacacgaattggatgttaaattaggtggtattattgaaatttatgaaaaattcacaggtgatgatccacgtaaagttccaatgaaaatcttcccagcagtgcattattcaatgggtggtttatacgtagactatgatcaaatgactaatatcaaagggttatttgcagctggagaatgtgatttctcacaacatggtggtaaccgtttaggtgccaattctttactttcagctatttatggaggtacagtagcaggtcctaacgctatcaaatatgttgaaaatgttgaaaaatcgtatacagatctagatgacagtattttcgaagctcgtgttaaagaagagaaagaaagatttgatcatttattaaatatgcgtggaactgaaaatgcttataaacttcaccgtgaattaggtgaaattatgacagctaacgtaactgtagttcgtgaaaatgaaaagttgcttgaaacagataaaaaaattcaagagcttatgaaacgttatgaagatatcgatatggaagatacgcaaacatggagcaaccaagcagtattcttcacacgacaattatggaatatgttggttcttgctcgtgtgattacgattggtgcatataatcgtaacgaatctagaggtgcacattacaaacctgaattcccagaacgtaatgatgaagaatggttaaaaacaaccatggctcgttataaaggtagaagtgaaaagccagaatttacttatgagccagtagatgtaagtttaattccacctcgtaagcgtgactacacaagtaagtctaaaggaggtaataagtaa

SEQ ID NO: 1019 - DNA, 1398 bp, Staphylococcus epidermidis
atgctcatggaagagaataaaaatcaacctaataaggagaatatgtcgaataaagacgataatgcaactcatttgaatgacagtcacagaaatgaagacttagagctttttagacggaataaaaacgctcgccaacgcagaagacgtcgtatagataaccaaagtaaagaaaaggatgctacgtctacacaatcacagttagaaactaaaccaatggataaatttatagataatcacaagtcgcataatcaaaacaaagaaataaaaagtgacttaattgaagaaaatgttaatgatgaaaacgacaatcaaaaaaatattaatgataaattaaatgaccgtattgtccaagaaacaaatgaaagtcgtcaaagtactgaagacgatgaggaatttccacttgatcatcggagtgaacaacaacctaaagcctctcgtcattctaaaaagcataaattactaagtaaatttacttctaaaaaagaaaaggaaacatctacatcgttcaatagtaatgagaaggtaactcaaattaaaccgcttagtttagaagaaaaaagagccataagacgtaaaaagcaaaaaagaatccaatataccattatcacactactcattcttatcattgttctcattttactctatatggttacaccactgagtaaaatatcaaatgtaaatgttaaaggtaataacaacgtaagtacgagtaaaataaagaaagaacttaacgttacttcgcgatcacgaatgtatacttttagtaaaaataaagcgattaggaacttaaaacagaatcctttaatcaaagaagttgatattcataaacaattaccaaacacgttaactgtcaacgtgactgagtaccaaattgtcggtttagaaaaaaataaagataaatatgtgccaattatagaagatggtaaagaattaacagaatacaaagatgaagtgtcacatgatgggcctatcattgatggtttcaaaggagacaaaaaaacacgaattataaaagctttatcagaaatgtcacctaaagtgagaaacttaattgcagaggtgagttacgcaccaactaaaaataaacaaagtcgcataaagatcttcaccaaagataatatgcaagttattggtgacattacaacgattgcagacaaaatgcaatattatcctcaaatgtcacaatcattaagcagagatgactctggcgaacttaagacaaatggctatattgatttatcggttggagcgtcatttattccttatcaaggttcatcaactgttcaatcgggtacagaacaaaatgtaaccaagtcaacacaagaagaaaatgatgcaaaagaagaacttcaaaatgtgttgaataaaataaataaacaatctaaagaaaataattaa

SEQ ID NO: 1020 - DNA, 1776 bp, Staphylococcus epidermidis
catgaggtcaggacaaattcgaacgttaatgttatgtcctggtcttctttttatggagtgatattgatgacaaaaaaagatgtaattcaattattagaaaaaatagctatatatatggagctaaaaggagaaaatacatttaaagtttcagcgtatagaaaagccgcacaaagtttagaggttgatgagcgtacattagaagagattgatgatgtaacagaacttaaaggcattggaaaaggcgtaggagaagttattaatgaatttaaaacacaaggtcaatcatcgacccttcaaacacttcaagatgaagtacctgaagggttagtgccacttttgaaaatacagggattaggcagtaaaaaaatagcaaaactatatcatgaacttcaaattacagataaagaaacacttcaacaagcctgtgaagaaggtaaggttagtactttaaaaggttttgcaaaaaagacagagcaaaacattttagaagcagtgaagtcgataggtgctaaaaaagatcgttatcctatagagctaatgagaggactcaaccaagaaattgtaaaatttattgaacagttagaaggagttgaacaatattcaactgctggtagttttcgaagatataaggaaatgagtaaagatttagatttcattattagtacatcggagcctaaaaaagttcaacaacaattacttcgtattccgaataaagtcaaagatgttgctgttggggatactaaaatttctctggaattagcttatgatgatgagacgattggcgttgattttagattgatagaacctgctgccttttaccataccttacaacacttcaccggttcgaaggatcataatattagaataagacaattagcaaaagcacgcgacgaaaaggttagtgagtatggtatcgaacaacaagatggtaagctattacaattacaaagtgaagaagcgatctatcatcattttggtgtagattggattgcgcctgccatgcgtgaagatggtagtgagtttgataaagatctgagtcaaatcattcaattagatgatatcaatggagatttgcatatgcacacaacatatagtgatggtgccttttcgattaaagaaatgattgaggcaaatattgaaaaaggttatgaatttatggtcattacagatcactcacaaagtttaaaagtagctcatggattacaagtcgaccgtctgctaagacaaaatgaagaaataaagcaattaaatgaagaatataaagaaatagacatatattcaggaacggaaatggacattttacctgatggaacattagattacgatgatgaagttttggcacagcttgattatgttatcgcagctattcatcaaaactttaatcaatctgaagacgaaatcatgaaacgtttagaaacagcatgtagaaatccatatgtgcgtcacattgctcatccaaccggtcgtattattggacgtagaaaaggttataaagctaatattgaaaagttaatgaatttagccgaagaaacaaatacaattttagagattaacgcaaatccgcatcgtttagatttaaatgcagaaatcgttcgtaaatatccaaaggttaagttgacaattaatacggatgctcatcatacaaatcatcttgatttcatgaaatatggtgttgctactgcacaaaaaggatttgtcaataaagagagggtcattaatacaatgacgaaggaagcctttcgctcatttgttgaaacgaataaatataagaaatag

SEQ ID NO: 1021 - DNA, 1170 bp, Staphylococcus epidermidis
tttgtcaggaggtgcctatctatggaggaacattactatgtgagcatagatataggttcatcaagcgtaaaaacaatagtaggcgaaaaatttcacaacggaattaatgtgataggtacagggcaaacctacacaagtggtatcaagaatggtttaattgatgattttgatattgcaagacaagcaattaaagatacaattaagaaggcttcaattgcctctggtgtagatataaaagatgtatttttaaaactacctatcatcggtaccgaagtatatgatgaatcaaatgaaattgaattttatgaggatactgaaattgatggcacgcatattgaatcagttttagaaggtatccgggataaaaatgatgtgcctgaaactgaagtgataaatgtattcccaattcgttttgtagttgacaaagacaatgaagtttcagatcctaaagaattaattgcaagacattcattaaaagtagatgcaggtgtcatcgcaatccaaaaatctattttaatcaatatgattaaatgtgttgaggcatgtggtgttgacgtgttagatgtttattctgatgcgtacaattatggttctattctcacaccaacggagaaagaattaggcgcttgtgttattgatatcggtgaagacttaacgcaagttgctttctatgaacgaggagaacttgtagatgctgaatctatagaaatggccggtcgagacattacggatgatattgctcaaggactaaatactacatatgacacagctgaaaaggtaaaacatcaatatggtcatgcattttatgactctgcttcagatcaagatgtcttttcagtagatcaagttgattcagatgaacatgttcaatatactcaaaaagatttaagtgactttattgaacaaagagtcgaagatatattcttcgaagtctttgacgttttacaagagctaggacttacaaaagtaaacggaggatttgtagttactggtggatctgcaaatttactaggtgtaaaagaattactacaagatatggttagtgaaaaagtgagaattcatacaccgtcacaaatgggtatcagaaaaccagaattttcttcggctatttctacgatttctagtagtatcgcttttgacgagttattagattatgttacaattagttat

SEQ ID NO: 1022 - DNA, 336 bp, Staphylococcus epidermidis
aaattaaggaggattggcattatggcaatcgtaaaagtaactgattctgattttgatagcaaaattgaatctggtgttaaattagttgatttctgggcgacttggtgtggaccttgtaaaatgattgcaccagttttagaagaactagcaggagactatgatggtaaagctgacatcttaaaattagatgttgacgaaaacccatcaactgcagcgaaatatgaagtaatgagtatcccaactttaattgtatttaaagatggcgaaccagttgataaagttgtaggtttccaacttaaagaaaacttagcagaagtattagataaacatctataa

SEQ ID NO: 1023 - DNA, 609 bp, Staphylococcus epidermidis
ttcatagaaggagagaatgatatggaagatattgttattgcaactaataatcaaggtaagataaacgattttaaagctatttttaaaaatcaacatgttattggaatttctgagttaattgaggattttgatgtagaagaaacaggtgccacatttgaagaaaacgctaggttaaaatccgaagcggcagcacatgcattaaataagcgtgtcattgcagatgatagtggacttgaagtgttcgcattaaatggagaaccaggcgtatattcagctcgctatgcaggattaggtaagaatgatgaagataatattgaaaagttgttaacgaacttagaagatgttcaagaccgtcgtgctcaatttgtttgtgtgattagtatgagtgcgcctaatgaaaaaacaaaaacatttaaaggaacagtttctggagtgataacaactgaacgacatggaaagaatggttttggttatgatccaatattttttgtcccagaattaaataaaacgatggcggaaattacaaatgatgaaaagggtaaaatcagtcatcgtggaaatgctattcgactgttaaaagaatatttagagggtgaacaacatgtctaa

SEQ ID NO: 1024 - DNA, 189 bp, Staphylococcus epidermidis
ataaacaagggcgtattaatattccgcaaaaatttaaggaaatatgccaatttaagtaaggaatgtacagtaattggtgtctcaaatcgtattgagatttgggacagagaaacttggaatgatttctatgatgaatctgaagaaagtttcgaagacattgctgaagatttaatagattttgatttttaa

SEQ ID NO: 1025 - DNA, 1086 bp, Staphylococcus epidermidis
agggactatataaggaggaattcagtcatgactcaaaatgatctaatgtctgagttgaagcaacaagctttagtggatataaacgaagcaaaagatgcgcaagcgttacaagaagtaaaagtgaaatatttaggtaaaaaaggttctgttagcggcttaatgaaaaatatgaaagatttgcctaatgaagacaaacctgcgtatggtcaaaaggtaaatgaattaagacaaactattcaaagtgaattagatgaaagacaaaagctaatcaaagaagagaaattaaatcaacagctttctgaagaaacaattgatgtcacattgccaagtcgtcatattgaaattggatcaaaacatcctttaacacgtacagttgaagagattgaagacttgttcttagggttaggttatgaaattgttgatggttatgaagttgaacaagattactataattttgaagctttaaacttacctaaatcgcatccagcacgtgatatgcaagatagcttttatatcacagaagaaattttaatgcgtacacatacttcaccagtacaagcacgtactatggaaaaacgtaaaggacaaggaccagtcaaaattatttgtcccggtaaagtttatcgacgtgactcagatgatgcaacacatagccaccaatttacacaaattgaaggtttagtagttgataaagatattaaaatgagcgatttaaaagggactttagagttagttgcaaaaaaattattcggtgcagatcgtgagattcgtttacgcccaagttatttcccgtttactgaaccatcagttgaagtagatgtatcatgtttcaaatgtaaaggacagggttgtaatgtttgtaaacatacaggttggattgaaattttaggagcgggcatggttcacccgaatgtattagaaatggccggattcgattctaaggaatattctggcttcgcatttggtatgggaccagatcgaattgcaatgttaaagtatggtattgaagatattcgtcacttttataccaatgatgtccgtttcttagatcaatttaaagctgtagaagatagaggtgaacaataa

SEQ ID NO: 1026 - DNA, 306 bp, Staphylococcus epidermidis
aaaatgttcatgggagaattcgatcatcaattggatacaaaaggacgtatgattataccgtccaagtttcgttatgatctaaatgaacgttttattatcacaagaggccttgataaatgtttatttggttacactctagaagagtggcagcaaattgaagagaagatgaaaaccttacctatgacaaaaaaagacgcgcgtaaatttatgcgtatgttctcctcaggtgctgtagaagtagaattagataaacaagggcgtattaatattccgcaaaaatttaaggaaatatgccaatttaagtaa

SEQ ID NO: 1027 - DNA, 297 bp, Staphylococcus epidermidis
ttcagtatcatttttaacatctgtttttgtttcatcatcattagtatttactttagcatctttatctgtaccgccagtattaccttgttcagcattttgattgttttgtttagtattaccttgttgcgtattttgattatcattatcatcttgtgtactttgatttgtttgatccccgtcttgaccattagttggtgtattattttgatctggattaggggttgcttcagcgtcttgatttggagcagatccaggtttaaccgtagcaccggcttgatcagttgttccaggtgctga

SEQ ID NO: 1028 - DNA, 1716 bp, Staphylococcus epidermidis
gacaactacattcaaaggagagattacattatgaaaaaatctagtaaattttcaaaagattttcctactagaaaaaatcattacgcaattagaaaattcacagttggcactgcttcgattatcgtaggatcattcttatttttcggacaaacacaagctcatgctgaacaggctgaagaattcgaaagagtaacaactggtacagttgatacaggtggacagcctgctagagcagatcaaggacaagaaggaccacaagcaggcgcggatacgcacaatacagcaagtcaacctggtgttacaggtcaagatgcaccaaatgaaaatcatgctggtgaccaaaatgctgcagtaacacatccggctaatcaagaaaataatgcacctcaagttggggctggtactcctggcgctgagaacacaccacaagccggtggcgaaaatcataatcaagatactgcagtaacttcagcaggtactaatggggaacaaaatggtggtaaaccagctacgtcaacaactggtcaagatgccgcgcaatccaatggacctcaaggtacttcagtagcccaacctggtaatgatgcttctagccaaggtcatgatacacctcaagctgatgctggtactcacaatacagaaggccaacctgctgtaactactggtgagcaaactggtggtaagcctgctgcaacgaaacctgaaggtgccagtgcagaaactgcgccagcgcctaataatgctgatgaaaatcacgctcaaccttcaccgcaaacaggaggtactacagcaacacaagctggacaagtaaaaccatccggtgattctacgcctaccggtgagccaaacaaagcagacgatcaagatacacaaattaaacctacaagtaaccaaggtactacagcaacaactaatgaaattggaaatcaaaaaccaagtggtcaaacaggtaatactgagaacacgcctaatgatggtactcaagtaaaacctaataatgacccagctgtgactggtacgccaaatactaatggagaacaaactggacaacctaatgcaacagtaacaccaggacaaggtaatgaagagattaacggagctagtaaacctggagaagtgtctccgaaacctgaagaaaacaatccaactgccactgaacctggtacaactgcacctggaaatactaatcaagacacacaagtaaaacctaatacagatcagactgctactggtactccagctggtactgataatcaaaatacgcaacaaggcaatactgaacaaaataaccaaaatgctcaaccatcagcacctggaacaactgatcaagccggtgctacggttaaacctggatctgctccaaatcaagacgctgaagcaacccctaatccagatcaaaataatacaccaactaatggtcaagacggggatcaaacaaatcaaagtacacaagatgataatgataatcaaaatacgcaacaaggtaatactaaacaaaacaatcaaaatgctgaacaaggtaatactggcggtacagataaagatgctaaagtaaatactaatgatgatgaaacaaaaacagatgttaaaaatgatactgaattacctgaaacaggactaagtaatgaatatgattatacaactacagtatttggttctatcgctttaatatcttcacttttattactaagacgacaaagaaaagaatctaaataa

SEQ ID NO: 1029 - DNA, 2358 bp, Staphylococcus epidermidis
agggattgcatgagacaaaaaacattagatgtcttggaatttgaaaagattaaatcatttgtggctgatgaaactataagtgatttaggtcgtgaaaaagtacaagagatggctcccgctagtaatttcgatacagtagaatttcaaatgaatgaaacagatgaaatttcacaaatctataacaagcatcgattaccaagcttaagtggtctagcaaaagtgtctccacttgttcatagggctagcataggaggcgttttaaatgtgggagaattaaacagaattaaacgcctagttcaagtgcaaaatcaatttaaaacattttacaatcaaatgctagaggaagatgaagaggttaagtatcctatactgcatgataaaatgaatcatctaccgatacttacagatttatttaaagaaattaatgaaaaatgtgatgcacacgatttatttgaccatgcgagttatactttacaaagtattagaagtaaaatttcaagaacaaatcaacggattcgtcaaaatttagatagaatagtgaaaaatcaagggaatcaaaaaaaactatctgatgcaattgtaacagtaagaaatgatcgcaatgttattccggtgaaagctgaatatagacaagatttcaatggtattgttcatgaccaatcggcatcaggacaaacactatatattgaaccgaattctgttgtagagatgaataatcaaattagtcgtttgcgtaatgatgaagcagttgaacgtgaacgtatattgactgaattgacgggattagtttcggcggaatctgatgcattactcgttgctgaatcggtcatgggtcaaatcgattttttaattgctaaagctcgttatgcgcgcactataaaaggaacaaaacctacatttaaagaggatcgaacgatatatttacccaatgcatttcaccctttattagacaaagatactgttgtagcaaatacaattgaatttattgacgatgtagaaactgtcattattactggaccaaacacgggtggtaagactgtcactttaaaaacgctaggtttgataattgtcatggcacagtcaggattgttaattcctacactggatggaagccaattaagtatctttgaaaatgtgtattgtgatattggagatgaacaatctatagaacaatcattatcaacgttttcatctcacatgaaaaatatagtggaaatattacaggatgcagatcaaaatagtctaattttatttgatgaactaggcgcaggtacagatccaagtgaaggtgcggcactcgcaatgagtatcttagattatgtacgtcgtttaggatctttagttatggcgacaacacattaccctgaattaaaagcttatagttataatcgtgaaggtgtcatgaatgcgaatgtggaatttgacgttgatactctgagtccgacttataaattattaatgggtgttccagggcgatctaatgccttcgatatttcaaaaaaacttggtctaagtctcaacatcattaataaagctaagacaatgatagggacagacgagcaagaaatcaatgccatgattgaatcattagaacacaattcaaaacgtgttgaccaacaacgaatagaattagatagacttgtgagagaagcacaggaaactcacgatgccttgtctaaacaatatcaacagtatcaaaattatgagaaatctttgatggaggaagctaaagaaaaagccaatcagcgtgtgaaatctgcgactaaagaagcggacgaaattcttaaagaacttagaaatctaagagatcataagggcgctgaagtaaaggaacatgaattaattgataaaaagaaacaacttgatgatcaatatgaggcaaaatcaattaagcaacatgttcaaaagaaaaagtatgatacgattcatgctggagatgaagtgaaagttctatcttacggtcaaaaaggtgaagtgcttgaacttgtaggtaacgaagaagcagttgtacaaatgggaattattaaaatgaaattacctattgaagatttagaaaaaacgaaaaagaaaaaagaaaaacctacaaaaatggtaacaagacaaaatagacaaactattaaaacagaacttgatttaagaggatatcgttacgaagaagctttaaatgaattagatcaatatcttgatcaggcggttttaagcaattacgaacaagtttatattattcatggtaaaggtacgggagcacttcaaaaaggtgttcaacaacatttgaaaaaacataaaagcgttagacaatttagaggaggtatgcctagtgaaggtggatttggtgtcactgtggcagaactcaagtaa

SEQ ID NO: 1030 - DNA, 186 bp, Staphylococcus epidermidis
ggaggattaatcatggcagtaccaaaaagaagaacgtctaaaacaagaaaaaataaacgccgtacacattttaaaatttcagtacctggtatgactgaatgccctaactgtggcgaatacaaattatctcaccgcgtatgtaaaaactgtggttcatacaatggtgaagaagtagtttctaaataa

SEQ ID NO: 1031 - DNA, 2337 bp, Staphylococcus epidermidis
tgcgtaataatggcgaagcgaaaaattaaaattaaaaaaaataaaataggagcagtcctacttgttggtttattcggactgctcttttttatattggtgctaaggttttcttatgtaatgattactggccactctaatggtcaagatttaattatgaaagcaaatgagaaatacttagtcaaaaattctcaacaaccagaacgaggtaagatttatgatcgtaatggtaaagttttagcagaagatgtagaaagatataaacttgttgcagttgtggataaaaaagcaagtaaagaaagtaaaaagccgcgacacgtggttgataaaaaaaagacagcaaaaaaattagctgaaatcatagatatggacgctgacgaaatagaaaaacgacttaataataagaaagcctttcaaatcgaatttggtcagaaaggtactaatttaacttatcaagaaaaagaaaaaatagagaaaatgaaattacctggtatagcactttacccagaaactgagcggttttatcctaatggtaattttgcctcccatttaataggcatggcacagaaagatcctgatactggtgaattaaatggtgcattaggtgttgaaaaaatattcaatagttatttaaatggatcaagaggtgcacttaaatatatacatgatatatggggctacatcgcacctaatacgaagaaagagcagcaacctaaacgtggagacgatgtacacttaacaattgattctaatatacaagtctttgtggaagaagctcttgatgacatggttgaacgctatgctccaaaagatttatttgcagtagtaatggacgcaaaaactggtgaaatacttgcatatagccaacgtccgacttttaaccctgaaacaggtaaagattttggcaaaaagtgggcaaacgatttatatcaaaatacatatgaaccgggctctacttttaaaacatacggcttagctgcagcaattcaagaaggtaaattcaaaccggatgaaaagtataaatcaggtcatagaaatattatgggctctgaaatttccgattggaataaaactggttggggacgtatacctatgtcgttaggttttacttattcatcaaatacgttgatgatgcacttacaagatttggttggtgccgataaaatgaaatcttggtatgaacgctttggatttggcaaaaaaacaggtggtatgtttgatggagaagctgcaggtaatattggttgggcaaatgaattacaacaaaaaacatcagcatttggtcaatccacaactgttacccctgctcaaatgattcaagcacaatcggctttctttaataaagggaatatgcttaaaccatggtttgtaagtagtattgataatccaataactaaaaagaattattactctggtaaaaaagagtttgccggtaaaccagtaacggaagaaacagccaataaagttgaagaagaacttgataaagtagtaaatagtaagaagagtcatgctatgaattatcgcgtaaaaggttatgatattgaaggtaagacaggaacagcacaagtagctgattcaaatggaggcggttatgttaaaggtgaaaatccttactttgtaagcttcattggggatgcacctaagaaaaaacctaaagtcattgtctatgcaggtatgagtcttgctcaaaaaaatgatcaagaagcatatgaaatgggtgtgagcaaagcatttaaaccaattatggagaatacgctgaaatatttaaatgttggaaaatctagtgatacttcatcaaaaactgactttagtaaagtgcctaacgtgcaaggagatgaagttcaaaaagcagaggatagcgtcaatgctcaatctcttaaacctattacgattggtaatggcaaacaaattaaacaacaatcagttaagtcaggtaccaaagtcctaccacacagtaaagtaatgttaatgacagacggggaattaacaatgccggatatgaccggatggacaaaggaagatgtacttgcttttgaagatttaacgaaaattaaagtttctactaaaggtaatggatttgtcacgaatcaaagtatctcaaaaggtcaaatcattaaaaataaagataagatagaagtgtcattatctgctgaagatacggatgatgaccaagagaaaactgatgaggactcttcggataacaaatcaaagaaagataaagctgatgaggatcattcaaatacatcttcgtcaactaagaatgataagtcaaacgccgactcgaaaaatgattctgatgacagcacaaatgaaacatcaggttctgagagaaataattaa

SEQ ID NO: 1032 - DNA, 414 bp, Staphylococcus epidermidis
ggagtaagtgtaatggctgtagaaaaaatttatcaaccttatgatgaagcgacacaaaccagtatcccacaaagacaaccacaatcgagtcctgaaaaacaaaccgttaaaagaaaagttgttgttcaacttactagatttgaaaaaattttatacatagctttaataactgtaattgctctaataagtatttatatgctatctttaaaaatggatgcgtacgatacgcgaggaaaaattgcagatttagatcaaaaaatagagaaacaatctagtgagaacagcgcattaaagtctgaaattaagaaaaattcttcatatgaacgcatttacgacaaggctaagaagcagggcatgagcctagagaacgacaatgtaaaggtagtgcgtaataatggcgaagcgaaaaattaa

SEQ ID NO: 1033 - DNA, 651 bp, Staphylococcus epidermidis
caatttaaattatatgtttcgcaggggggactctttttggctcaatcaaagaatgaattttaccttagaagattacattcgttattaggggttattccgataggtgcatttttaattgtacacttaatggtaaaccatcaagcaacgcaaggtgctgaagcttttaatagagcttcaggatttatggaatctttaccattccttattgtgatggaatttatacttatttatataccattgttataccatggtttgttcggtttacacatcgcattcactgctaaggagaacatcgggcattactcattatttagaaactggatgtttttcttccaacgtgtaagtggtattttagcatttgtttttattgcaatgcacttatggcaaacacgtttgcaaaaagctttttatggtaaatctgtggactataatctaatgcatgaaacattacaacatccgttatgggcaatcttttacattatttgtgtcattgctgttgttttccattttgctaatggtttatggtcattttgtgtaacatggggctttttacaatctaaaaaatcacaacgtgtttttacttggatttcactcatagtatttttagtgatttcttatattggtgttgcagccgttattgcgtttatataa

SEQ ID NO: 1034 - DNA, 237 bp, Staphylococcus epidermidis
ggaggtatatcaatggtacacgaattaggaacagtaggaatggtttgtccatttcctttaatagaagcacaaaagaaaatgaatcaattaaatcaaggggatgaattgaaaatcgattttgattgcacccaggctactgaagcattgcctaattgggctgcagaaaatggatatccagttacaaactatgagcaacttgatgatgcatcatggacgattactattcaaaaagcataa

SEQ ID NO: 1035 - DNA, 228 bp, Staphylococcus epidermidis
  unsure (25),(28),(46),(60): Identity of nucleotide at the above locations are unknown.
gaggagtggttagcttttgggaagntangaatggaagccccagtanacggcggccgtaantataacggtcctaaggtagcgaaattccttgtcggtaaagttcgaacccgcacgaaaggcgtaacgatttgggcactgtctcaacgagagatcggtgaaatcatagtacctgtgaagatgcaggttacccgcgacaggacggaaagaccccgtggagctttactgtag

SEQ ID NO: 1036 - DNA, 465 bp, Staphylococcus epidermidis
aaattgataactattcacaatttaaatgaaatggataaatttgctcaaatacttgtaaaacatttaagtgctaaggacttgattttattaaatggtgacctaggagcagggaaaactacattaacgcaatttataggaaaagcgttaggtgttaaaagaacgataaactcaccaacatttaatataatcaaatcttataaaggttctagcatacgattacatcatatggactgttatcgactagaaggtgaggaagatgatttaggtttcgatgaatattttgaagacaatgctatcatagttatagagtggagtaaatttatcaaagatttccttcctcctaatcacttaacgattaatataagtgtcaaaaatgcgaatgagagacaagtatccattgaaacacatgggcaacattatgcattagtaaaggaggcaattttgaatgaactatcttctaattga

SEQ ID NO: 1037 - DNA, 249 bp, Staphylococcus epidermidis
aatggagggttactaatggaacgaacaattcattttacattagttgatcaagtgagtactttgaacagaattactagcgccttcgttcgcttacaatgtaatattgatgaacttcatgttaaacattcagacaaagaaggaatttctaatatgaaacttaaagtcaatattaaagatgatgatacttttaaaattgttcttaaaaaactatcacaacaagtaaatgtactaagtgttaaaagtgaataa

SEQ ID NO: 1038 - DNA, 294 bp, Staphylococcus epidermidis; identical to SEQ ID NO: 235

SEQ ID NO: 1039 - DNA, 1275 bp, Staphylococcus epidermidis
aagacagtgacagtaagaactaaagtttcgacaaaagatatagatgaagcatatttacgtctgaaaaatatagtaaaagaaactcccttacaattcgaccattacttatctcaaaaatataattgtaatgtttatttaaaaagagaagatttacagtgggtacgatcctttaaattaagaggagcttataatgctatttcagtattatccaatgaagaaaaaaataaaggtattacttgcgcaagtgctggaaatcatgctcaaggtgttgcttatactgcaaaaaaactcaatttaaaagctgttattttcatgccagtaactacaccacgacaaaaaatcaatcaagtcaaattcttcggggatagtaacgtagaaatagtattaattggcgatacatttgatcactgcttagcacaagctttaaactatacgaagcaacataaaatgaattttattgacccatttaataatgtatatactattgcaggacaaggtactttagctaaggaaatattaaatcaagctgaaaaagaggataaaacatttgattatgtatttgctgctataggtggtggcggtcttatttcaggagtgagcacatattttaaagcacattccccccacactaaaattattggtgttgaaccaaccggtgccagtagtatgtatcaatcagtcgttatcaaccatagtatagttactttagaaaatattgataagtttgttgatggagcttcagtagcaagagttggtgatattacctttgatattgcgaaagataaagtggacgattatgttcaagttgacgaaggagctgtttgctccacaattctggatatgtactctaaacaagcgattgttgctgaaccagctggtgctttaagtgtaagtgccttagaacaatataaaaagcagattgaaaataaaactattgtatgcatagtaagtggaggcaacaatgatattaatcgaatgaaagaaattgaggagcgttcccttctatttgaagaaatgaaacattactttattttaaatttcccacaaagacctggtgctttaagagaatttgttaatgatgtcctcggacctcaagacgatattacaaaatttgaatatttaaagaaaacatcacaaaacactggaactgttattataggtatacagctgaaacatcatgatgatctcattcagttaaaagatcgtgtatgtcaatttgatccttctaatatttatatcaatgaaaataaaatgttatattcattacttatttaa

SEQ ID NO: 1040 - DNA, 339 bp, Staphylococcus epidermidis
gtgcttgtagccaagatgacactaaagaagatgaacataaaaaatcagaaaacactgctgaaaggaaagctgacgataaaaaagataagaaaactaaagaagataaaaaatctaaaaaagaaaagaaatctcaagaaaatgaagataataagtctacacaagaagataattctactgataatcaagaaacacaagatcctgcaactcaagggcaaaaacaaactcaacaagataatcaacaaaactatgatgaccaacaatcttaccacgaaccaacaaaagatgaggtatatgagtgggataaacaaaatatacctggaggtacagattatggtttga

SEQ ID NO: 1041 - DNA, 522 bp, Staphylococcus epidermidis
atggattttttacagcaaaattggactaatatattgaaaataattgtgtctttgatatcaatagtaacttttataagagtattcctttatgaaaggtctagactcaaagttaatattattggttatgatcaaatagaagaatatttagatgtttacatttctttttctaactcatcaaagttacccatttccattaatgagattcagatatttcataaaaacacaatgattggtgagatagaaaatttcacagaaaaaattctaggtcaaacagatggtaaaagtatagtctattctaacccaatgccattaaatttaaattcttattctagcgacaaagatttattcagaataaaactggtagaagaattacctttaaataaaactttaacttttaaatttataactacacgaaaaaatatcacttataagattaaagatttcaaattaccgcaatatagaaggtcattccatagaaaacttaaacatcacaaaaaggtttcaaataaaaacaaagattaa

SEQ ID NO: 1042 - DNA, 315 bp, Staphylococcus epidermidis
gttgatatttattgtaatgggagattgaaacaaatgactcaagaaataaattgtaatttcaaatcacatatccccagaataatgacagttcccggtatattgttaatacatgaaaataagttggagtttaaggcatatagtcaaaacaataatccattcaatatacaattcgaactctctagcattgtgcggtatagaacatctaaagggttattaggaaataaattgtttatttattattctgatcaggagtggtataaatttagtaacttatctaagagtgacttaaacaaactcacaaaatatttatattaa

SEQ ID NO: 1043 - DNA, 321 bp, Staphylococcus epidermidis
ttctgtatttacatcttctggatcaatcaaaccataatctgtacctccaggtatattttgtttatcccactcatatacctcatcttttgttggttcgtggtaagattgttggtcatcatagttttgttgattatcttgttgagtttgtttttgcccttgagttgcaggatcttgtgtttcttgattatcagtagaattatcttcttgtgtagacttattatcttcattttcttgagatttcttttcttttttagattttttatcttctttagttttcttatcttttttatcgtcagctttcctttcagcagtgttttctga

SEQ ID NO: 1044 - DNA, 417 bp, Staphylococcus epidermidis
ggagttacatataaaatgaaaaagatttttatattattattgagcagtttattagttctagctgcatgtgggaagaactatgaaatcagtgatattacaaacaaatttaaaaaagaaggtttaagtgtcgaaaacttacgaaaaatgaaacgtgaagattttggtatggcaccaatgaaaactgaaaatgctaaaatatttactgtttcagatgataagaatgcacgaatcttaaaatttaaaaatgaagatgacctaaaagaaatgaaaaagtattatgaagaattaggtaaatcaagtgcagcgttctattctcatgtatacactaaagatagattcttaattcaaatgaatggcgatattgacgatcatttatttgaaaaatataaaaaggctatgaatgaggcattagattaa

SEQ ID NO: 1045 - DNA, 1869 bp, Staphylococcus epidermidis
acctaccaacaactcaacaagctattatcattttattatactcgtaaggactcgaactttagaaaagttttaacttctaaatgtttaagtcctatttctagttggatgggacttaacaacgtcccaatattcattgggacgtttttttattttctaaataattatatgggggaacgatatatgcgaagtgatatgatcaaaaaaggagatcaccaagctcctgcaagaagtcttttacatgcgactggcgcttttaaacaacctacagatatgaataaacctttcgtagcaatttgtaactcttatattgatattgttcctgggcacgttcatttaagagaattagcagatatcgcaaaggaagctattagagaagcaggtgctatcccattcgaatttaatactattggtgttgacgatggaatagctatgggacatattggcatgagatattccttaccttcaagagaaattatcgcagatgcagctgaaacagttattaacgcacattggtttgatggtgtattttacattcctaattgcgataaaattacgccaggaatgttactcgcagctgttagaacaaatgtaccagctatcttttgctcaggaggcccaatgaaagcaggtctttccgctcaaggtaaggctttgacattatcttcaatgtttgaagcggttggagcttttaaagaaggaacaatctcaaaagaagcatttttagacatggagcaaaacgcttgtcctacatgtggttcatgcgccggtatgtttaccgcaaactcaatgaactgtttaatggaagttttaggtttagccctaccatataatggtacagctctagctgtgagtgaccaacgtcgtgaaatgattagacaagctgcattcaggttggttgaaaatattaaaaatgatattaaacctcgcgatattatcacacaagatgcgattgatgatgcttttgctcttgatatggccatgggaggttctactaatactgttcttcatactcttgcaattgcaaatgaagcaggtattgactacgatttagaacgtattaatgaaattgctaaaaaaacaccttacctttctaaaattgcacctagttcttcttattctatgcacgatgttcatgaagcaggtggcgtcccagctattataaatgaattgatgaaaaaggatggtactttacatccggatagattaacagttacgggtaaaaccttgagagaaaataatgaaggtaaaaacatcaaaaattttgaagttattcatcctcttgaaaacccttatgataagcaaggtggattatctgttttattcggaaacctcgcacctaaaggagcggtaatcaaggtcggtggagttgatccttcaattaaagtatttacaggaaaggcaatttgtttcaattctcatgatgaagctgttgaagccattgataatcatacagttagagaaggacatgttgttgttattagatatgagggacctaagggaggtcctggaatgccagaaatgctagcccctacgtcttccatagtgggcagaggattaggtaaagatgttgcattaattacggacggtagattttcgggagcaactagaggtattgcagttggacatatttcacctgaagccgcttcaggtggacccattggcttaataagagatggtgataaaattacgattgatttaatcaatagaactctaaacgtagatcaatctgaagaagaactatatcgccgtaaaaatcagcttgaaccattcagagcaaaggttaaaacaggctacttagctagatatactagtttagtcacaagcgctaatactggaggtattatgcaagttccggaaaaccttatttaa

SEQ ID NO: 1046 - DNA, 402 bp, Staphylococcus epidermidis
tcgagtgggcattacaacaaattgaaaataatttcgattttgaagaggagaaataataaaatgagtaatttagaacaaaatattaaacaaatgaaaaatgaagtgatagaggcagaattaaatacaaaaataaatacagttataacaatgattggtgaacacatggatagtaatgaacgatttaaatctcatttagatgcacaaggtaaagtaatggaatcatatatgttaaaagaatactatcagaactattatgtattgatggcagtgcttaactcgatattgaaagatgtaaattttatgaatgatgagattactacatttcatgatagagcattagacgaattagacaaaacaaaagcgtctagtgagaactttggcgaggaatcactaaacgcataa

SEQ ID NO: 1047 - DNA, 1755 bp, Staphylococcus epidermidis
gagatgattaaaatgtcaaatcaaaaatcaatggtttcgcctcacccttctgaacatcaaacaaaggaatcacaacccttaataacacgcagtggttcacaattattagttgaagcacttcagcaggaagatgtagattttatcttcggttatcccggtggagctgtcttacctttatacgatacattttatgacgggaaaatcaaacatattcttgctcgtcatgaacaaggtgctacacatgctgctgaaggatatgcgcgtgtctctggtaaaacaggagtcgttgttgtgacaagtggacccggtgcaacaaatgccattacaggtattactgatgcatatagcgactctttaccattagtcgtttttactggtcaagttgctacacctggtattggtaaagatgctttccaagaagctgatttactctcgatgaccacacctattacaaaacacaattatcaagttaaaaagattgaagacattccaagaattgttcatgaagcctttcatttagcgaacactggaagaaaaggtcctgtagtgattgatttccctaaagatatgggtgtgcttaaaactgatgttgaacttacaaaagatattaatattcctggttatgaagttaatagtagcccaaataaagaggatattaataagttaatatatatgattaaagaagctaagaaacctcttattcttgcaggtgctggtattaatcactctaaatctaatcatttattaacagaatttgtgacaagacatcaaatccctacagtcacaactctcctaggacttggagcagtaccttatcatcaccctttattcttaggtatggggggtatgcatggatcttatgcaagtaatatggctttaacaaattgtgatttacttatcaatttaggtagtcgattcgatgatcgtcttgcaagtaagcctgatgcgttcgcaccaaatgcaaaggttgtacatgtagatatcgacccttctgaaataaataaagttattaatacagatttaggtatagtcgctgattgcaagcatgtgcttgaaaacttatgccatgagcaagttttaacatcctcccacgaagaatggaacgattattgtattaataacaaaagtaactatccatttaaatatgatgaaaatgataaaaccttttgcaaaccacaaaaagcgattgaatatattggtaaagttaccaatggaaatgcaattgttacaactgacgtaggacaacaccaaatgtggacagcacaattctatccatttaaaaattatggacaatgggtaacaagtggtggtttaggtactatgggatttggaattccatcagcaataggagcacaattagctgaaccggagaaaacagttgtatgttttgtaggagatggcggttttcaaatgacgaaccaagaaatggctttacttccagaatatggacttaacgtcaaaatagtacttattaataacggaactttaggtatggtaaaacaatggcaagataaattctttaataaacgattttctcattctgtatttaacgatcaacctgattttatgaaaatggcggaagcatatggcattaagggattcttgatagattctccagataaattagaatcttcaattgatgaagcatttgcatatcatggaccggcactcattgaagttagaatctcacctatagaaccagttaatccaatggtacctagtggcaaatcaaatcatgaaatggagggttactaa

SEQ ID NO: 1048 - DNA, 210 bp, Staphylococcus epidermidis
atgaataataatcagtttaaagtaatcaaagaaatttataatactttacaaaaaacaattgaagataaatcaactgagtataaacacaaaataaaagatggtaacaatgaatggattgaaacagtaaatcgtgaagaacacttgcaagcgttaatcgagtgggcattacaacaaattgaaaataatttcgattttgaagaggagaaataa

SEQ ID NO: 1049 - DNA, 570 bp, Staphylococcus epidermidis
ttggaaatcaaaccaatcactatatataccggaaaaactgtaccccttttttatgacaatatagatactgaccaaatcattcccaaagtgcatcttaagcgggtctctaaatcaggctttggaccttttgcttttgatgaatggcgttacttacctgatggtagtgataatcctgattttaatcctaataaacccgaatatcatggtgcgtcaattctaattactggagataactttggttgtggttctagccgtgagcatgccgcgtgggccttaaaagattatggttttaacattattattgcaggaagttttagtgacatcttttacatgaattgtactaaaaacgcaatgttacctatatgtttaaatcagaaagaaagagaacatttagctcaatttgatgaaataactgttgatttacctaatcaaacagtgtctacggtgtctcagtcttttcattttgatatagatgaaacctggaaaaataaattaatccatggcttagacgatattgctattactttacaatttgaaaatttaatagaaaaatacgaaaaaactttttaa

SEQ ID NO: 1050 - DNA, 1119 bp, Staphylococcus epidermidis
gaatttgcaaaatatggtcctttttactataataccttagtatttatatcggaaaaaggtgataaaatggtgtggacaattataagcggactagtcgttggcatattgctaggatttgtaatgcagagaacaagattttgtttagctggtggatttagagatatgtacgttcagaagagtaacaaaatgttttatgcattgcttattgctattacagtccaaagtattggtttacttattctaaagcacttaaatattattgaggttccagcagaaacatttccagttataggaactattttgggatctttcatttttggaatagggatagtattagctggaggatgcgcgactggaacttggtatagggctggtgaagggttaattggaagttgggtggcattgattttttatgcattgacttcagccgtaactaaaactggggtacttcttccaataatgaatcaaataaataaaacgacacaagttaatacgagtatgacgagtacaactggtataccacaatggattctcgtcatgttattaattttaattacagtatttttagttgtaaaaacaattcgcaaacctaaaataatggtaccccaacttaaacaaaaatatagtggtattagacactatctatttgaaaaaagatatcatccatttgttgctggcattgcagtaggttttattgctctacttgcgtggcctatgagtgaatctactgggagaatgggtggcttaggtataacaacaccatctgcaaatcttgtgaattatcttatttcaggagatttaaaatttattgattggggtgtatttttagtactaggtatattcttaggttcttatatagctgcaaaagggtctaaagaatttagatggagattgccagatattaagacaatacgcaatagtgcgataggtggcatatttatggggtttggtgcttcagttgcaggtggttgctctatcggtaatggtctagtagagacagctacaatgagttggcaaggatggattgctttagcctctatgattattggtgtttggtttatgagttattttatttttgtacaacctatgaaaaagttacaacaagtaactcaaagctaa

SEQ ID NO: 1051 - DNA, 960 bp, Staphylococcus epidermidis
ttttttatgaaaaatatatcagatatagcaaaattagctggagtatcgaaaagtactgtttcacgctttttaaataatggatctgtgagtccagcaacgaaagaaaaaataactaaaataatagaagaaaataattatcagccaaatcaatttgcacaaagcttaagagctcgacgtaccaatttgattggagcaattattccgcgtatgaattcatacgctgttgacgaaacgattaagggtttggtacaccaatgtaatcaacatcgatatcagttattattaaattacacaggattagaaatagatggtgaaatttcggcactaaaaacactatcacgtagtaaagttgatggaatcgtgctaatggcaacacatattactgaagcgcatattgaagtcattgagaaaattgatgttcctgtcattatagtaggacaaaaacacgaccgattatatagtatttatcacgatgattatgaagctggatataaaattggagtactcattggtgaaaaaggttgtcgaaatgtacatttctttggtgttagtgaagaagatattgcagttggtattcaacgtaaactgggagttattcaagcgctgaaggactatcacataagtccgaaaatttatgaaacaacatttaagcatgaacaagcttttaaagatgtaagtcagcaacttgaaagagtacatcatgctgatgcgatagtcggagcaactgataccattgcttttgcaatccataaatactgctctgatcatcaacaaaggttttacaattgttcaatatatggatttggtggagaccctatgactcaaatagtatcacctgtcattcaaacggttagctataattactttgaagcaggagagcaagcattaaaagaaattaaccaactattaaaaggtgaacaaacagcattaaaaataaaaattcctatccaattgaattaa

SEQ ID NO: 1052 - DNA, 648 bp, Staphylococcus epidermidis
atgaatatgaatatagaaatcatcgcaaatcaatttgaaacaagagcagctacgttattaaggtactacacaggattgttagagagcagtagagataaccacttcgcttttaaaatatataatgatccatttgatatggtttatgtgatgatgaacgggaagttattcggtcatgtatatattaaagattgcaaagtaagaaattcattcgaattagcgtctagtaagcacacagagggtcaaataagaagtattgagggatattataacggttttgaaatacacgatgataagcacctatctattagtgatatgatggcaagacaattattcgaagatgaatatttcatgtatggattggagacattcgcagaaagtaataacacagatatgttcacttatattgagggtggattaaatgttgaagaacttgagggcgttcagtctagtaatgctgatgtgataggtaatatcgaaatattatatcaattagctactgggattaatgaacctgcaagtgagctagttgagagcttgaaattggttactgcatttgtacaagatgagaacgctacacaagacgattacaagacgttagagcgtaagttaagtgagttgaaaacatcctattacagtgtgagtaaatag

SEQ ID NO: 1053 - DNA, 210 bp, Staphylococcus epidermidis
aagttaatgaataaagttttaggttacaggaaaatgttaggcaagacacaacaacagatggctaaagaattaaatatttcggaacaatcttatagaaacagagagaaaggaaaaatcaattttaagaaaaatgaaatgattaaatttaaaattatgttattggaaaaaggtttaaaagatattacattagatgatattttttttagttaa

SEQ ID NO: 1054 - DNA, 1950 bp, Staphylococcus epidermidis
aaaggtgagaatcgaatgatacttttacaacttaatgacatctccaaatcgttcgatggtgaagatatcttcacagatgttaattttgaggtgaaaactggcgaaagaataggcgtagtaggccgtaatggagctggtaaatcgacattaatgaaaatcatagcaggtgtggaaaattacgatagtggtcatatatcaaaaatcaaaaatttaacaatgagttatttaactcaacaaatgacactcaattcagaagctactgtctttgaagaaatgtctaagccttttgaacatataaagaaaattgaaaatttaattaaggatgaaaccgattggcttgcacgaaatggacaagattataaatctgatgaatatcaatcacatattgaaaaatatgaaactttaacgaatcgttatgagcaattagatggttatcaatatgaaagtaaaattaaaacagtcctgcacggacttaactttacagaaagcgattttaacaaaccaattaatgattttagtggtggtcaaaaaacacgtctttctcttgctcaaatgttacttaaagaacccgatttactacttcttgatgaaccaactaaccatctagacatggaaacaaccaagtggttagaggattacttaaagtactttaaaggggcaattgtaattatcagtcatgatagatattttttagataaaattgtcactcaagtatatgatgttgctctaggaaatgtaaaacactatgtaggaaactatgagcaatttataaagcaacgtaatcagtattacgaaaaacgcatgcaagaatttgaaaagcaacaagaagaaatcaagcgtttagaaacctttgtagaaaaaaatattactcgtgcatctacaagtggcatggctaagagtagacgtaaaacattggaaaaaatggaacgtattgataaacctatgatagatgctagaagtgcaaatatacaatttggcttcgaccgtaatactggtaatgatgtgatgcacattcatgatttaaaaattggttacgactcacctattacactacctataaacctcgaagtctttaaaggggatcatatagctatcattggtccaaatggtgttggtaaaacaacattgataaaaacaattgctgaaaaacaaaataaactaggtggtcaaattatctttggtgctaatttacaaattggttactatgatcaaaaacaagctgaatttaaatcaaataaaaccattctcgattatgtttgggatcaatatccacacatgaatgaaaaagatgtacgtgcagtattaggacgtttcttgttcgttcaagaagacgtaaaaaaaattatcaatgacttatccggcggtgaaaaagcacgattacaattagcacttttaatgttgcaacgtgataatgttcttatcttagatgaaccgactaaccatttagatattgattctaaagaaatgcttgaacaagcattgaaagattttgaaggcacaattatttttgtatcacatgatcgttattttattaaccaacttgcaaataaagtttttgatttaaatattaatggtggccaaatgtttttgggagattatcagtattatattgagaaaactgaagaagctgcagctatcaaagcacatgaaacagtaactcaaaataattttgaaaataaagagattaatcaagacgcaaatacttcaacctacatcagtcaaaagcaacaaaaaagacaacaacgtaaattagaaagacaaattgaacattgtgaaagacaaatcgaagaattagaagcacaaatatcacatatcgaagaacagttaacacaacctgaagtatttaacgaccctctaaaagctagtaaatttgccaatcaaaaatccgatatcgaacaaaaattagaacaaataatgttggagtgggaaaaattacaagaaaagctctaa

SEQ ID NO: 1055 - DNA, 1386 bp, Staphylococcus epidermidis
gaggaggagaaaattatgggtcaaacactgtttgataaagtatggaaaaaacatgtgcttcatggaaaagaaggtgaaccacaattattatacattgatttacatctcattcatgaagtcacttctcctcaagcatttgaaggacttagaatacaaaatcgtaaactcagaagacctgatctaacctttgcaactttagatcataacgttcccacaattgatatttttaatataaaagatgaaattgcccataaacaaattacaactttacaacaaaatgctaaggactttggtgtacatatttttgatatgggttctgacgaacaaggtattgtacatatggttggaccagaaactggattaactcaaccaggaaaaactattgtatgtggagattcacatactgctacacatggcgcatttggtgctatcgcatttgggataggaacaagcgaggttgaacatgtatttgctacacaaacattatggcaaacaaaacctaaaaatttgaaaattaatataaatggttctttaccaactggagtttatgctaaagacattattttatatttaatcaatcaatatggtgtagatttcggtactggttatgctcttgaatttacaggggaaactataaaaaatttatccatggaagcacgtatgacgatttgtaatatggctattgaagccggagcaaagtatggtttaatgcaaccagatgaaacaacctttgattacgtaaaaggtcgtccttatgctactgattttgatagttctatggcgtggtggaaaaaactttattctgatgatgatgcctattttgataaagttattgaacttgatgtaacaaatttagaacctcaagtaacttggggaactaacccagaaatgggagttagttttagtaatccattcccagaaattaaaaatgcaaatgaccaacgtgcttatgactatatgggacttcacccaggtcaaaaagccgaagatataaaattaggttatgtttttttaggttcatgcacgaatgcaagattatctgatcttattgaagcaagtcatataattaaaggacaacaagtacatccaaatattactgctattgtggttccgggttcaagaactgttaagaaggaagctgaagctctgggactagataaattatttaaagatgctggatttgagtggcgtgaaccaggatgttctatgtgcttaggtatgaatccagatcaagttcctgaaggagtacattgtgcatccacgagtaatcgcaattttgaaggaagacaaggcaaaggcgctcgtacacatttggtatcccctgctatggctgctgctgctgcgattaatggtaaattcattgatgttagaaaggtggtagtataa

SEQ ID NO: 1056 - DNA, 876 bp, Staphylococcus epidermidis
aaattgagtgaaattaaattagaatatgatactcaagtttctgtaatttggtatggaactttggattcaagatcgtttaaacagttttcgcagcctaaatggagcgagttagttaatagattatctataccacaaaacaatactaacaaatatgctcgaggtgttgctgtttatggtgatatgaaagacgatactgacgaaaatggtaatgagtataaaaaatatcgtaaagacggaaacgtgatttatcgtgatgtcctagtgctggactacgacgacattcctaagttgagactactacacgatgcaattacggagactttaaaaggtgtttcctggatgtaccacactacatttaaccatcggacagaaagccctagaatacgtttgtatatcgctttgagtgagcgaataagtgcagatgattatcgcaaatatacaaaagtgttagcaaataagataggtcatctagtagatgaggggagttttcaacctagtagagcgatggctttgccagtttatataaaaggtaaacatccgttcttacatcaatataatgatgctcccattttgaatgttgaaatgcttgaaaaatggtcaaaagaaacaaatatacaaacagatcaaccaagtaaaactaactttaataagcgtgatgatacttattggcgtgatattagtttttcagttactaagggcaatcgtaataattctttagcaagtctaataggacatttgttcagccgacatgttaatgaatatattgtatactcgtatgctttgctatggggacaaaatgcgtgtaatccaccattaaacgaacgggaaataaacgctacatttcaatccattttaaagaagcatcgtaataagtag

SEQ ID NO: 1057 - DNA, 312 bp, Staphylococcus epidermidis
ttaatgaccgacgcaaaactacgcgaaaggagtgtttgtatgccatatgttaatttacaaaatctaccaactaaagcaaatgtagtgactgaacctaatcaagtagtagtaaagccaatcatggcaaaacctaatgttattgctaaactatttggtatttcatacagttcagttaatcgtatattgaaagaatgggagaaagattctaagggtattgatgatttatattactctctatcatcaacgatgacagttatcagtatttctcgatttgaacagtatatgaaaaaacgtcataaagattggatgtaa

SEQ ID NO: 1058 - DNA, 1479 bp, Staphylococcus epidermidis
aacatagtggagtggactcgtgaagagagataccaacgtattgaagatgttgatgaaacatatcttgagcaactgaaacaccaagtggatacatctttatatagacaaacatttcatattcaacctgaaatgggtttattgaatgatccaaacggactcatttattataatggacactactatatttcacatcaatggtttccgttaggtgctgtgcacggtttaaaatattggtttaattataaaagcaaagatttattacattttgaaccacaaggaacacttcttaaacctgatactaagtatgatagtcacggcgtatacagtggaagtgcttttgaatatcaaaatcatctttattatatgtatacaggcaatcatcgtgaccaacattggaatagaatttccagtcaaatgattgccagaatgaacaaagacggaaaaatagagaagtttcctaaacctgtgattcatggacaacctgaagggtatacaagtcatttcagggatccaaaggtatttgaaaaaaatagtcaactgtacgctattctaggtgctcaaaatgaaaatgagatggggcgtttacttttatatcgtagtcaagatgttgttgattggcattttgaaggtgagattaaaaccaatctgacacaatttggttatatgtgggagtgtcctgattattttagactaagcaataaagatgtcatactcatgtgtccacaaggcgttgaagctgaaggagataaatttagaaatatctatcaatcagggtatatgataggagatttaaactttaataatctattttttgaccatgaaagttttcaagaattggataatggttttgatttctacgcgccacaaacgtttgttgatgcagacgggcaacgcattttaattggatggatgggactaccagatacagagtatcctacagataaagaggggtgggcacattgccttactattcctcgagtgcttaccattgaaaatggaaaacttaagcagcgaccttttaagcagttagaagatttaagaacaaataaagaaacagctttgggatatgctaataaatttaaacgtaaattacatccatatgaaggtaaacagtatgagatgattatagatatattagaaaatgatgcttcagaaatatattttgaattgcgtagctctcgatctgaatctacactgattacttataataaacacgaaaataaactcactttagatcgtaccgatagtgggacactaccatcaaatgtcgatggaacaacacgttctaccattttagattcaccattaaaacagttacaaatttttgtggatacatctagcatcgaaatattttgtaatgatggtgagcgtgttttaacctcacgtattttcccaaatgaggatgctactggtataaaagcttcgactgaatctggtcaagtatatttaaaattcactaaatatgaattaaaagggtga

SEQ ID NO: 1059 - DNA, 1254 bp, Staphylococcus epidermidis
tgggtagcacttctaccctttttatttaggagagataaaatgtggcatgagaaatttactaacaaacatggtgatgtacaatatcgctattatgagaagtataaagatccactcacaaacaaatggcgacgtgttagcgtggtacttaataagaatggtaagcaatcacaaaaagaggctcagaaactcttaaataagcgtatagaggcgaagataaacgacaagacgccaattgacttaaaaacacttactttccatcaagcatgtgacgaatggctagatagatacataaaaacatcaggttcaaaacaatctacaattaaaactaaaaaatacaaaatcaagcatatcaaacgcaatataaattcagatattctagtcaaaaatatgaatagcgatgttgttcaaaagtcagtagacaatgctgttaaagataatctaagtcataaagttgttaaagatgctatgagcatcataagaaacattatgaagtacattcagcgcaaatataaacttacagatattagttatttagatgatattgttattcccaaaaaggctactacaagagaagaagtaaaagctaagcgtgaaaattatcttgaaatggatgaagtaaaagcaattgtagacaatttacatgaaatagctaattcaaagcgtgctgattatatgaaacgttctttcatcatgactgcttatattatggaatttcaagcacttaacggtatgcgtataggtgaattactagccatacaacctaataacattgatttcgacaaaaagacactagaaatagatggcactattcattggcgtaatgaaggtaacgcagtaggttttaaagatacaactaaaactgaatcatcttatagaacaatctctttaactacacgtagttgcgatatattaagaaaagttatgttagaaaacaaaaaggctattcaatgggaatctatgtatcaagatagaggcttcatattcactaactatcgtggcaatcctatgtcacttagcaccattaatagaaatatgcaacaatctgcaaacaatgtaggaattacaaagcacataacaagccatactatgcgtcatagccatatatctttattatcacaattaggcatatcacttaaagccattatgcaacgtgtaggacatacagaccataaaacgaccttgcagatatacagtcatgtaactgatcaaatggataaagatatgatgaataaattagaaaaggtaggtaactaa

SEQ ID NO: 1060 - DNA, 546 bp, Staphylococcus epidermidis
aggagaatccgtatgaaaagattattaggaacattatttgcagctacacttgtattaagtgcttgtagccaagatgacactaaagaagatgaacataaaaaatcagaaaacactgctgaaaggaaagctgacgataaaaaagataagaaaactaaagaagataaaaaatctaaaaaagaaaagaaatctcaagaaaatgaagataataagtctacacaagaagataattctactgataatcaagaaacacaagatcctgcaactcaagggcaaaaacaaactcaacaagataatcaacaaaactatgatgaccaacaatcttaccacgaaccaacaaaagatgaggtatatgagtgggataaacaaaatatacctggaggtacagattatggtttgattgatccagaagatgtaaatacagaatcagaagataatgctcgacaaaatagaatagatgaaattaacgaagaaatggaagatcctaatatttccgtcagtgattataacaaattagtagacgaatataatgaattaaataacgaataa

SEQ ID NO: 1061 - DNA, 207 bp, Staphylococcus epidermidis; identical to SEQ ID NO: 239

SEQ ID NO: 1062 - DNA, 1065 bp, Staphylococcus epidermidis
gttgaaagaaggtatacgtacatgagttataaaatagttgccttacctggagatggtataggaccagagattctatctggtacattagaacttttaaaattaataagtgaaaaatatcattttgaataccatttagaaagtcatcattttggaggcgtttcaatagattattatggtacacctttaactaatgaaacattacaatcatgtaaaaatgcagatgctattttattaggtgcgattggagggcctaaatggacagacccaaataatcgtccagaacacggtttgttaaaactgagaaaatccttaaatttatttgctaatattcgacgtacatttgtaactaaaggggctagtcatctttcaccactaaaacaagatattgtagaaggcacagatttagttatagtaagagaattaacgagcgggatttattttggtgaaccaagctatgttaaaaaaaccgaagctttagactcattaaaatattcaagtcaagaaattgaacgtattgtgagaatcgcttttaatcttgcaaatcgtagacgtaaaaaattaacttctgttgataaggaaaacgttctatcctccagtaagttatggcgacagatagtaaatgatgtaaaaaaggattatccagaagtagaagttaatcatatgctagttgatgcttgtagcatgcatctgattacccaacctacgcaatttgatgtgattgtaacagagaatcttttcggagatatcttaagtgatgaagcatctgttataccaggctctctaggtctttctccatcagctagttttggtcaaacaggtacacgtctttatgaaccaattcatggttcagcacctgatatagctaatgaagataaagcgaatccatttggtatggttctatctttagcactttgcttaagagaaagtttaaatcaaaatgatgctgctaacgaacttgagtcaattgtttactcatttattcaatctaataagacaactgcagatttaggtggacaatatcgaacttcagaaatttttaaattgcttaaagaaaaatatctataa

SEQ ID NO: 1063 - DNA, 966 bp, Staphylococcus epidermidis
tttataatgagacgtctatttgctattggagaggcattaattgatttcataccaaacgtaacacattcaaaattaaaagatgttgaacaatttagtcgacaagttggtggcgcaccgtgtaacgtagcggctacagtaagtaaattaggtggaaaatcagaaatgataacacaactaggaaatgatgcgtttggtgatatcattgtagaaacaattgaacaacttggcgtaggtacgcaatatattaagcgaactaataaagcaaatactgcattggcatttgtcagccttcaagatgatggtcaaagagatttctcattttatcgtaaaccttctacagatatgttatatcaacctgaaaatattgatgatattcaaatattccaagacgatattttacatttttgttctgtagatttaattgagagtgacatgaaaaatgcccatgagaaaatgattgaaaaattcgagtcagtaggtggtactattgtttttgaccctaatgtacgcttacctttatgggaagataaactcgaatgtcaacgtacaataaatgcgttcatacctaaagcacatattgttaaaatatctgatgaagaattattgtttattactggtaagaagaatgaagatgaagcgattcaatctttatttaggggtcaagttaatgtagtgatttatacacaaggagcgcaaggtgcaactatttataccaaagatgattatcgtattcatcatgaggggtatcaagtacaagcaattgatacaactggtgctggtgacgcatttataggtgctattatttattgcatactcgagtctcggcattctgaatgtaaagatttatttaaggaaaaggggaaagatatactagcgtttagtaatcgtgtcgcagcacttacaacaacgaaacatggtgctattgaaagtttgccgacaaaagaagatataaaagactattattga

SEQ ID NO: 1064 - DNA, 438 bp, Staphylococcus epidermidis
aaattaagtggggactcactggggactagtacccactttgaaaaaatattaaaaaagttttggaggttacacatggataaagagcaacttaaacagcatatgtacgattatgtaaaagaacataaggaaattcctatttatcagttagaagatttatttaaagagttagatcatgactataaaggtaaagcgagtgttacaaatgagcatgataaaaatatcgttttttggagtggttggaataagctcacaatgtatgcgttgattgagttagttaagggagaacatcttgatctaatttatagagctagctatgtcatgcgctatttgttagatggtagagttccaagtttaccattagctattacttacccagaatatggacaacaaactgaagtaccttcatgggtacctatgttactgagagtgactaaataa

SEQ ID NO: 1065 - DNA, 849 bp, Staphylococcus epidermidis
ttttgcgtcggtttacgtaagttttttgtgcattataatcattttaggaggaaaatgatggatatcgataagttagaagtaggaaaaaggattaaaaatattcgtttaaataaaagtaaaaatctaagagaatttggagaattaatatctaaaaatcttaaagaagataaaaatatatcagatagtatagttagtagatgggaaaaaggtgtatctattcctagtgcaaaacgcttaaaagaaatagctgatataggtaatgtgtctgtaaattatttattatatggagttaaagtaacttataaagatattcataataatattaatactgtaagtatgaaaaatgaaattatggacaacctcgaaaaatttttaaagtattatttactgtattctgaatacaataattactctataaaaaccgctgaattattagatttgttatttgaaaatgctggttacgatatcactactttaacaaaagatttatgcgccttagtgtctgataaaagattttcattttatcaacatggagtgtatttgttacttaatgaagatttttctaagttacatgttcaactttatctttctgagtttatttataatttattagtacaaatcactttagattatcctaatatttatattaagaatttggtattacaaattacagaaactaaagaaagaattaaagatatatcccataaaaaagacgcatatactgaatttgaaatagagacccatttagcagattttataaatcataaagaatacaaaaaactcctagataacttaagtcaattagagaaaaaaattacaaatgataattcattgatcgataataattag

SEQ ID NO: 1066 - DNA, 1641 bp, Staphylococcus epidermidis
aaagaaaaaggagaactaaacttcatgacgaacaatcaaaccttagtactaattatattaactttcatcatcctaattacacttgtaaatgtaattatctctattatagagagacgtaaacagattgctaaaataaatactttatgggataacaaattaaaattagaaagttttatacgtcctaattcacgattcgatgcccaatatcacgcttaccgtgatcattacaatgagcagtcatttatcgacgataagacttggtcagacctaaatatggatacgttatttcataaaattaattttaatttcactgcaattggtgaaatgcgactatatgcaactttaagaggtatgtttaaggtaaatcaaacctcattgataaacaagtttaaagataataaagtatttcgtttaaatgtatcttacattctttctaaaattggtaaaaatgtataccctttatttccagatcaaatgttacccactaagcgaaatattttattaatgttttgtccgttgttaccatttatcggggtcgcattcatttttttaattccttcaaaaggtatattaatatgtcttacttttatgattttaaatgcaatattatctttcaaactaaaaaaatcttatgaccaagatttaaaatcaattttttatactgctaatgttataaagcaaagtcaagctttaagtaagattgagagcacgcccgcgataagtgttgattttactcattttaaagcttcacgccgttttagtggtttattagttagagtagaatcacaagatatggcgagtagcataatcatgtttattaaattagtattcatgatagattattttttatttcatttaatacaacgcagctactttaagtatcaagaagaagttatggcatgttatgactatataagcatattagataatcattactctatagctatgtatcaacatactttgacacattattgttatcctaaaatcaatcacaatattaatgggcttcaaatgaaatcaatcattcatcctctactagatgaagaaaatgcgattgctaacacaattgacatttcaaatcatatattactcacaggctctaatgcatcaggaaaatctacatttatgaaagcagttgcactaaatttgattttagctcaatcgatacaaactgcaacagctcactcatttatttatcaacctggctatgtaatgacatcaatggcaaatgcggatgacgttttaagtggtgacagttatttcatgtcagaacttaagtctattcgtagattatttaacactcatcagtgcaataagatatattgttttatagatgaaatttttaaaggaacgaatacaactgaacgtattgcggcttctgaatcagttttatcgtatttagataatcaaaaagcatatcaggttatcgctgcgacacatgatgttgaattatcaacattattagaaaatacatataataattatcattttaatgaatctattcaagaaaatagcatatttttcgattacaaaattaaacctggtaaagccaatacacgtaatgcaattgaattactacgcattacgcagtttcctatcgatatttatcagcgtgctcaacaaaatattcgaaacctctag

SEQ ID NO: 1067 - DNA, 483 bp, Staphylococcus epidermidis
attatcagaggcggaacgaaattggttaaaccaacaagagaacaattgaatattaggaaaatgagtgtggaagatgttcctaaagtttttgatatagaaagaaatagtttctcacacagttcgtggtcaattgatgcattttatcatgaaatagaaaacaacgaatttgctacatattttgttatagaatttagtgacaaaataattggatatgttggtttatggttagtcgttgatcaagcacaaattacaacgatagctatatcaaaggcatttagaggctatggtcttggtcaacttttacttaaatatgcaatgaactatgcacgtttttcttgtgatgtgatgagtttagaggtaagaatagataatgatgttgcacaacatgtttataggaatttgggattccaaaatggtggcaaaagaaagaattattatggagaaggcgaggacgcattagtcatgtgggtgaatttgaaatga

SEQ ID NO: 1068 - DNA, 210 bp, Staphylococcus epidermidis
  unsure (160),(174),(192),(195): Identity of nucleotide at the above locations are unknown.
agctccacggggtctttccgtcctgtcgcgggtaacctgcatcttcacaggtactatgatttcaccgatctctcgttgagacagtgcccaaatcgttacgcctttcgtgcgggttcgaactttaccgacaaggaatttcgctaccttaggaccgttatanttacggccgccgtntactggggcttccattcntancttcccaaaagctaa

SEQ ID NO: 1069 - DNA, 1728 bp, Staphylococcus epidermidis
gtagaaagggggaagtatatggaattaactaaagatgatattcttcacgaaattgagaaaactaagcaagaaaaagatgctattcatgaagttattcccaaaggttatgaaattgagcaacatcaaaatggtgtggcactctatcaaattattcctagtaaaaaagatggagagccagataaaaagatattcattactaatacgattccccaaattactgaacgttttgaagatattgagagtaatgaagtaagttacaacatgcttttttatgataatcaaataccggtgaatctaggagtaagcgctgaagagatagctgatagtcgtcaattactgaagttggttaatagaaagtttgatgtaacttctaccacttcaactaggttggttgattatataaataaatctaaaaggcacaatccaccagtaaacattaaagtagctactcgattaggtcatgttaaagggtacttcatttatccttataaagaagaaatgaaaaatagaaatattaagttgtttaataatgacaaaggctttcaaaagttaattgattcttttcagagtaaaggaacactagaaagctattccgagcatgtattttcaaaaattaaaagtttgccaatggttatggtcatgttatatgcatcattaggttccgtactattgcgtgaatttgaattgcagccttttattgtagagatatcaggcagtacatctacgggaaaaacgttcacacttaatttagtttcaagtgtgtgggggacaagtaatcttattactacttggagttcaactaataatagtattgaggcaatggcatcattcttaaattcgtttccaatgtttaaagatgatacacgcaatacacaccccaaattcgtagctaatgcaacttacaatttctcgagtggtgaaagtaaatcaagaagtaatatcaatttaacacttaatgccaaaaaggaatggcggaacatcttactttctacaggcgaggcatctatttctaatatggcagatgaaaaagctggtgtttctgcccgtgtcgtaacgttacaggatcaaccatacccagataattttgatttcactacattagataaggcatttcgagataattatggaacgctaggaaaagtattcatcaaacaatatcaatctaagcaagaatcatataaaaatgcatttgaaagttatcaacgttactttaatcaaaaagggagtaacgaaatcatgcaacgactaggacatgcattcgcgttgttacaggttagtggtgaaatactaaatgatattgagggatttgaacacgatcattttaaaatcattgaacaagcttataatagcatggttagaaataataaaacgattgataaacctaagcaactgttagaggaattacttcaatatttagatgcgaatagaaataatattgccggtgaaggttatagttcagtcaaaaacggtgatatcaaagctatatataaacgtgattatttatgtatcttgggtgaaacagtaaaagagaagttgagatatgaaatgcagactattacagggcagtgggataaaaaaggttatttaataaaaggtgaaaaagatagattacaaaagcaggttaaacatgaaacagtgaagtataggggttttgctataagacaagaagtactagaagaattgggctttgatttttctaattcatataatcctaattctgattattga

SEQ ID NO: 1070 - DNA, 1314 bp, Staphylococcus epidermidis
ccttacctaattttgctttttaaaaaaacactcattatgatgtttttaaaggaagtggtaagtatgaatatgaatgatacaatatttctatttttatgtactctattagtatggttaatgacaccaggtttaagccttttttatgggggactcgtacaatcaaaaaatgctttaaatactgtaatgcaaagtatggttgccattgtcattgtcacatttgtatggataataattggtttctctttaagttttgatggaggtaatcaatggataggtggtttgaagtttttgggtcttcatcatgttggttttgaaacttcaaaaactttgagtcctcatatcccgctctcattatttatgttgtttcaaatgatgttttgtacaattgcggtatctattttatcaggttcgattgccgagaaaatgagattcattccttatctgatttttgtgagtttatgggttctattaatttatagccctgttgcccattgggtttggggtggtggttggattagtaaaattggagcaatagattatgcgggtggaacagtagttcatataacatcaggcgtatctggtttggttcttgggataatgataggtataggaaagaagaaagaaaaacatactccccataatctattaattacgcttattggtggtatattagtatggttaggatggtatggatttaatgtaggcagtgcatttacattcgatcacatagccatgatatcgtttgtgaacacagttattggtgcaagtgcaggtgctttcggttggttaatctttgaatatatcttgaaaaagactacaagtttactaggtcttttatctggagcactctctggtcttgtcgctattacaccagcagcaggatacgtcagctatatgagtgctatgattattgcaataattggtggcatatgttgctatatcgttataaatttaattaaagtaaaactccaatataatgatgcacttgatgcatttggtattcatggtgtaggtggtatcttaggagctgtgcttacaggagtttttcaatcacatcaaattaatagtgcggtgcagaatggttttatctatacagctgattttaaagtagtagtgattcaacttggcgcggcaattgcgactgtcgtttttagcgcaatagttacatttttgattgctagatttattaaaatttttactcctttagctacaactcaagaagaagataaaacaggtcttgatgctatagtacacggtgagaaagcatatttctatggagagctaaataagtttaatcgtcatatcaagttttaa

SEQ ID NO: 1071 - DNA, 537 bp, Staphylococcus epidermidis
aatagcagaattcttacagaaagtaaaataaataaaacagaaataactgatatcgtggtagcgaaaggtccaggttcatataccggtcttagaataggggttactgttgctaaaacattagcgtatgcattaaacactaacttatatggtgtctcatcacttaaagcacttgctagcacagtaaaagacagtacgaagttgttagtacccatttttgatgctagaagagaagcagtttatgcaggtgtttatcaatatcaggacaatgaattaataaccattattgatgacacttatatacctatttttgaacttattgaaaaacttcatcaattaaaccaaccatatgtgtttgtaggatatcataccgaaaaaataaaacatttattagacagtgacatcgtagaacagttaccacaagcttcaagtatgaagcaattaattcaaaaaccagaaaatatacattcatttactcctaaatatcataaattatcagaggcggaacgaaattggttaaaccaacaagagaacaattga

SEQ ID NO: 1072 - DNA, 1107 bp, Staphylococcus epidermidis
gaatttgggattccaaaatggtggcaaaagaaagaattattatggagaaggcgaggacgcattagtcatgtgggtgaatttgaaatgacaaataataaattaatcttagcaatagaaacaagttgtgatgaaacgagtgtaagtgtaataaagaatggcactgaactattatctaatactgttttaagtcaaatagatagtcacaaacgttttggtggtgttgtacctgaagttgctagtagacatcatgttgaaggaataacagcaactatagatgaatcgttagtgagtgcaaaagtgaaaatggaagacattgacgctattgcagtaacacaaggcccaggattaataggagctttattaattggtattaatgcggctaaagctttggcatttgcttatgataagcctattattccagtacatcatattgctggtcatatttatgctaatcacttagaacaaccattaacatttccacttatgtcattgattgtatctggtggtcatactgaactggtatatatgaaaaatcatttagatttcgaagtgattggtgaaacgagagatgatgcagtaggagaagcttatgataaagttgctcgaacaatcaatcttccttatcctggtggaccacatattgatcgattagcagctaaaggtaaagatgtatatgattttccaagagtttggctcgaaaaagatagttatgattttagttttagtggtcttaaaagtgctgtaataaataaactgcataatttaagacagaaaaatattgaaattgtagctgaagatgttgcaacgagtttccaaaatagtgttgtagaagttttaacctataaagctattcatgcttgtaaaacctatcatgttaatcgcttaattgttgctggtggtgttgctagtaataaaggattaagaactgcactaagtgaagcatgtaaaaaagagggcatacaccttactattccaagtcctgttctttgcactgataatgcagcgatgattggtgctgctggatattatttatatcaagctggtttgcgtggcgatttagctttaaatggacaaaataatattgatattgaaactttttctgtttaa

SEQ ID NO: 1073 - DNA, 750 bp, Staphylococcus epidermidis
gtattcgttgtagacaattatttgtattatgagatgacattcaacatatgttttaactcatttactgattttaatgatacatgcataatatacgcgaaaaagggggttagatatatgccagatgattttaaaattcctcgcgctacgttaaaacgtctacctttatattaccgatttgtcagtattttgaaaggtaaaggtatagatcgtgttaattctaaaacaataagtgaagcactacaaattgattcagctacaataagaagagacttttcatactttggtgaattaggaaaaaaaggatatggatataatatagatagtatgcttgaattctttaaatcggaattaagtgagagcgatcaaattaaaattgccattataggtatcggtaatttagggcgtgcattacttacatataacttttcaatacatgatgagatgacaattactgaagcttttgatattagaccagatattataggtgagaatatcggtgacgttgtggtaaaacatagcgatgatatcaaaatgacattagaatcagaagatattgatgtagtcattttaacaacaccagataatgtggcacaacaagtagctgatgaacttgttaaagccggtgttaaaggtatactaaactttacgccacgtcgaattaaaacgccccaagatgtccaagtacatcatattgattttggtatagagttacaatcattattgttcttcatgaaaaattatagtaaataa

SEQ ID NO: 1074 - DNA, 1593 bp, Staphylococcus epidermidis
tgccattcattaaatctaaaagtattgaaaaataacaacattagaggggtgtttttaatggaagaacatattcaaatttttgatacaacacttagagatggtgaacaaacgccaggagtcaattttacctttgatgaaagattgaaaattgccaagcaactagaaaaatggggagtagatgtactagaagcaggttttcctgcttctagtactggtagctttaaatcagtagaagctatagctaaaactttgactacaacagcagtgtgtggattagctagatgtaaaaaatctgatattgatgctgtatatgaagctactaaagaagctataaaacctcaagtacatgtattcattgcaacctcccctattcatttagaacataaattaaaaatgactcaagatgaagttttaacatcgataaaagaacacgtttcttatgcaaaacaattttttgaagtcgtacaattctctccagaggatgcaacaagaactgaaattccatttttaattgaatgtgttcaaactgcgataaacgcaggagccacaattattaacatccctgatacagttggatttagttatcctactgagtatggcgaaatttttaagcaattaacacaggccgttaagtcaaattctaaaattatctttagtgcacattgtcatgatgatcttggtatggcagttgctaatagtttagcagctattgaaggtggagctagacgtattgaaggtaccgtgaacggtattggtgaaagagcaggaaatgcctcacttgaagaagtcgctttggctttatatgtaagaaaggaccactatggtcttgaatctcaaattaaccttaaagaaactaagaaaacatctgacttaatttcaagatatgctggtatccgtgtacctagaaataaagctatagtcggtcaaaatgcatttagtcacgaatccggaattcaccaagacggtgtccttaaacatcgtgaaacctatgaaatcatgacacctcaacttgtaggtgtaaatacaacagaattgccactaggtaaattgtctggtaaacatgcatttgccgaaaagcttaaagctctagggtatgaaattaaattggaagatcaagttacattatttaaacaatttaaagaaattgctgataagaaaaaaaatgtatccgatagagatattcatgcgattatacatggctctgaacatgaacacaatgctatttttcaacttgataacttacaacttcaatacgtatctaaaggtctacaaagtgcagtagtagttataaaggaaagaaacggacaagttaaacaagattcaagtattggaacgggttcaattgttgcaatttataatgctgttgaccgaattttcaagaaagacgcagaattaattgattatcgtattgattctgtaacagaaggtactgatgctcaagcagaagtacatgtacgaatcattattaatcatattgaagtgacaggcataggtatagaccacgatatattaaaagcttcatgtaaagcatatatcgatgctcatgctaaatatatttcagaatatgagttgaaagaaggtatacgtacatga

SEQ ID NO: 1075 - DNA, 192 bp, Staphylococcus epidermidis
ttattttcttctattattttagttattttttctttcgttgctggactcacagatccattatttaaaaagcgtgaaacagtacttttcgatactccagctaattttgctatatctgatatatttttcataaaaaatcacctatcacgtcatcaatcattcttttttattttaccatatgaaccaacgctttaa

SEQ ID NO: 1076 - DNA, 1020 bp, Staphylococcus epidermidis
ctggaggaatttattatgacaaaagtatattacgacgaaacagtaactcaagatgcattacaaggtaaaaaaattgctgtcattggttatggctcacaaggacatgcacatgcacaaaatttaaaggacaatggttatgatgtagtcattggcctgcgtccaggacgatcatttaataaagctaaagaagatggatttgatgtttatacggtaagtgaagcaacacaacaagcagatgtagtgatggtactattgcctgatgaaattcaaggtgaagtatataacaaggaaatcaaaccatatttagaaaaaggaaatgctttagcattcgcacacggttttaatatccacttcagtgttatcgaaccacctagtgatgtcgatgtctttttagtagcacctaaaggacctggtcatttagttagacgtacatttgttgaaggaagtgccgtaccagcattatttggtgttcaacaagatgctacaggccaagctagaaacattgctttaagctacgcaaaaggcattggtgctactcgtgccggggtcattgaaacgacatttaaagaagaaactgaaacagatttattcggtgaacaagctgtactttgtggaggagtttccaaattaattcagagtggattcgaaacacttgtggaagcaggttaccaacctgaattagcttattttgaagtcttacacgaaatgaaattaattgttgatttaatgtatgaaggcggaatggaaaacgtccgttattctatctctaacactgctgaatttggcgactatgtttctggaccaagaataattacacctaatgttaaagaaaatatgaaaaaagtacttgaagatattcaaaatggtaactttagccgtagatttgttgaagataacaaaaatggctttaaagaattctatcaattacgtgaagatcaacatggtcatcaaattgaacaagttggacgtgaattaagagaaatgatgccattcattaaatctaaaagtattgaaaaataa

SEQ ID NO: 1077 - DNA, 330 bp, Staphylococcus epidermidis
  unsure (21),(23),(52),(53): Identity of nucleotide at the above locations are unknown.
gattaccgctccgtctataananactattggaggggcgggtacgaaaacctnnggtatctgtgagtattaaatcacagcgtattaatatcgatgatagacaagtaaatgaaccatatatgaaagacaggcatattaaagacattacattaagagaaattaaaaattctgatggtgatacgattccaccgggagcattttttgttttaaatgataataataacaaacattctgattcaagaacctatggtttaatagataagaaagatatcattggagatgtcagtttaaaatattatccatttaaagaatttaactatcaatttaaataa

SEQ ID NO: 1078 - DNA, 1221 bp, Staphylococcus epidermidis
ttgttaccatctttccagatggaagcgatcgatacatgtccaaacaaatattcaactataaggagagttttaataatgaataaaaaaacgcaaatgatacatgggggacatacgacagacaactatactggagcagtgacaacacctatttatcaaacaagtacttatttacaagatgatattggtgatttaagacaagggtacgaatattcacgtactgcaaatcctacacgtgcgtctcttgaaagtgttattgctaatttagaacatggtaagcatggttttgcttttggttcaggaatggcagcaattagtgcagttatcatgttattagataaaggagatcacttagttcttaattctgatgtttatggtggcacatatcgtgcattaactaaagtatttactcgctttggtatagacgtagattttgttgatacaactaaaattgaaaacattgaacaatatattaaacctgaaactaaaatgttatatgtagaaacaccttcaaatccattattgcgtgtgactgatattaaagcatcagcaaaaattgcaaaaaaatatgatttgatatctgtagtcgataatacatttatgacaccttactaccaaaaccctttagactttggtattgatatcgtattgcattcggctactaaatatattggaggccatagtgatgttgtagctggtcttgttgctactgctgatgatgatttagcagaacgtctaggctttatttcaaattctacaggtggtgtacttggacctcaagatagctatttattaatcagaggtattaaaacgctaggtctaagaatggagcaaataaaccgaaacgttgaaggtattgtgcaaatgttacaaaagcaccctaaagttcaacaagtattccatcctagtattaaggaacatatgaactatactatccatcaaaatcaagcaactgggcatacaggggtagtatcttttgaagttaaagatacagaagcggctaaacaagtgattcacgcaacaaactactttacactggcagagagtttaggggcagttgaaagtctaatttctgtaccggcacttatgacgcatgcgtccatcccatcagatgtaagagccaaggaaggtattacggatggtctcattcgtttatctattggtattgaagacacagaagacttagttaatgatttagaacaagccttaaatactttgagataa

SEQ ID NO: 1079 - DNA, 210 bp, Staphylococcus epidermidis
gttgcggaatcatggtactgttactttgttgttcaaatgtttgaattaggggaagaatcatttgagaggcatcactttcttcatatccaatataaattgtctgttggttatgtgatacgtgttgttgaaatgagtgaatggttttatccattaattctagtatttgagttgcctgtgagagtaactgtctaccttcaacagttaatatga

SEQ ID NO: 1080 - DNA, 822 bp, Staphylococcus epidermidis
aaggagttgtccacaatggatccgagtttgattttaccttatttatgggtacttttagtacttgtatttttagaaggattattagcagctgataatgcaattgtaatggcggtaatggttaaacatctaccacctaaacaacgtaaaaaagcacttttttatggcctattaggtgcattcatttttagatttattgctttatttttaataagtattattgcaaacttctggtggatacaagcagcaggtgctgtttacttaatctatatgtctattaaaaatttatggcaatttttccatcaatcaaatgaaaaacatcataaagaaacaggagacgaacatcatttcgatgaaacaggcaacgaaaaagaagtaggccctaaatctttttggggaacagtatttaaagttgaattcgctgatatcgcgtttgcaattgattcgatgcttgccgcattagccatagccgttacattaccaaaagttggcatacattttggtggtatggacttaggccaatttattgttatgttccttggtggaatgataggtgtcatcttgatgagatttgcagcaacttggtttgtagaattgttgaataaatatccaggacttgaaggtgctgcgtttgcaattgtaggttgggtaggtattaaacttattataatggtacttgcacatcctgatattggcgttttaccagaagcatttccacatagtgctttatggcaaacaatcttctgggtagtattagttggcttagttttaataggatggttaacttcagcaattggcaacaagaaaaaaggtaatcaaaaataa

SEQ ID NO: 1081 - DNA, 1128 bp, Staphylococcus epidermidis
aaagagtttttcatccaaaataataaaaatggttacaattatttactcaagtatttgaatgacttagaccacccacaactcatttttgaatctacaggtatctattcaagaggtatggaacgattttgttgtgtaaatcaaattaactatattcaaatgaatccgttagaagccaaatttaaaacgagcgctctaagatcatggaaaactgatcaggcagatgctcataagcttgcttgtttaggaccgacgcttaaacaaacagacaacttacctatacatgagttaatattctttgaattaagagaacgcgtccgttttcatctagaaatcgagaatgaacaaaatcgacttaaatttcagatccttgaattactccatcaaacattccctggtttagaaagattgtttagtagtcgatattcaatcattgcactcaacatcgcagaaatctttactcatccagacatggttcttgatatcgacaaggatgtactgattacacatatattcaattctacagataagggaatgtcaatggataaagctacaaaatatgcacttcaattaagagtgattgctcaagaaagctatcctaatgtcgatagacattcctttctagtcgaaaaattacgcttacttattcaacaattaaaacaatctattcatcatctcaaacaattagatgatgccatgattcaattagcacaacaactcgattattttgaaaatattcattcgatacctggtattggtaagctaagcacagctatgattattggggagattggtgatattaagcgatttaaatcaaataaacaactcaatgcttttgttggcattgatatcaaacgatatcaatcaggtcatacacactgtagagataccatcaacaagcgtggtaataaaaaagcgagaaaacttttattttgggtgattatgaatataataagagggcagcatcattatgacaatcatgtcgtcgattattactacaaactaagaaagcagcctaatgagaaacctcataagactgccatcattgcttgtataaatcgattattaaaaacaattcattatcttgtaatgaatcataaattgtacgattatcaaatgtcaccacattag

SEQ ID NO: 1082 - DNA, 261 bp, Staphylococcus epidermidis
agttttttgtttataacttttatcatcacgttgttgatgtatttcttcttgtgtcagcttctctattcttgcttttctcaaattatctttaacacgttcctcattgactttagtttgatgttgttctcttttagcttgattttccttctctattttctcacgtcttatgcgctcttctcgctctacgttatgaaagtattcacgtcttttacgtcgatattgactgcgtggtatgacttgttttttattgttatccactag

SEQ ID NO: 1083 - DNA, 939 bp, Staphylococcus epidermidis
tactcattgttgtcatctgaaccaaaaataatgattgcatacgatttgataggacaaactccattagttttattagaaagctttagtgacgagaatgttaaaatatacgccaaacttgagcaatttaatcctggtggtagcatcaaagaccgtctagggaagtacttaattgaaaaagcaatagatgaaggacgacttaaagaaggggatacaatagttgaagcgactgctggtaatacaggcattggacttgctattgcttctaatcggcacaaagtaaaatgtatcatctttgctccagaaggatttgcagaagaaaaaatttcaattatgaaagcattgggtgcagatgttagacgtacccccaaagctgagggaatgactggcgcacagcaagaggcgttggcatacgcaacacgatatggatatttatatatgaatcaattcgaaactaaagataatcctggggcatatacacaaacacttgccaaacaactcacagatgaactttcacatattgattattttgtggcaggtgttgggtccggtggtacgtttacaggagttgcacaacacttaaaaacgtatgatgtaaaaaattatattgtagaaccagaaggctctgtcttaaatggtggtgtcagtcatcctcatgcaactgaagggattggttctgaaaagtggccatcatttttagaaaaagaattagtagatggtatttttactgttgccgataaagatgcttttaataatgttaaacttgtcgcgaataaagaaggattgttagttggtagttcttcgggagcggcattacaaggagcgttggaattaaaaaaaagcattcaaaatggtgtgattgttaccatctttccagatggaagcgatcgatacatgtccaaacaaatattcaactataaggagagttttaataatgaataa

SEQ ID NO: 1084 - DNA, 825 bp, Staphylococcus epidermidis
tgcatggatccgtataaggtattaattgaagtaatgaaaacagaaagttttactagagcagcagaaaatttatatacttcgcagccttctgtgagtcgtgatattaaacgtttagaattaaaatataatgttaaaatatttgaatttaaatctccatatttaaaactaactagagatggcgaaaagctattacaatacgcattgcaacgggaaagtattgaacaagaattatggcaaaacttaacatcggaatctgaaatcatctcaggcaccttaacaattggaagcagttatacatatggtgaatatttattatcagaacagcttaccagtcttatgcaacaataccctaagttacatattcatttacgtgttaataattcagattctgttataaatgatattaaacacaacagagtagatataggtattgtagaaaaggaaattcaagacaatgcaataaaatgtaaggaaataatggaagacgaaatggtgtatatttacaaaaaatcgattcaacctagaatggatatatgtttcgttagagaaaaagggtctggaacaaggttttatcaggaagtaggtctttctgagttgaaattaaatccatatttgatagaaattaacaatattaagattattaaacaaatggtagaggctggaaatgggtttgcaattatttcaaaatcagcacttcatccagaagattatgaaaaattaatgataacaactttaaatgtgaaacgtcactattaccttgctcaacatgttgataaatatataggtgaaaatattagagctgtcattgaaatgattatgaagtag

SEQ ID NO: 1085 - DNA, 303 bp, Staphylococcus epidermidis; identical to SEQ ID NO: 234

SEQ ID NO: 1086 - DNA, 555 bp, Staphylococcus epidermidis
ggagctgctttaattatgacgaaacaagatttatctttatctgtatttaccaatgaaaattataagaatcttcattacacatcatctagttttagaaattctatgtatgatgaattagaggttaataaaagtcgctttaaaaactgtaattttaatgaaggtatttttaagaatatagaagcaatttgtaattgtaaatttacaacgtgcgggtttaataattgtattttcgaagatgttcatttttacaaaaaccaatttaaagattcaacatttgtgaatacaccatttgatcaatccgtatttaatagcactttattccaaaatgcaatgttcgatagcaatctcattcgtagcgtaaaatggactgatatcatttttaaaaacgtttctttcaaaaatgtagaaattgaaggaacaacatttaaagatgtaaaattcaaaaattgtgagttcaaaaatgtaattattactaattcaactatgtcgcaaaagttaatgaatgaattacaaaaacaagatgttactttagaaaatatagacacttctatttaa

SEQ ID NO: 1087 - DNA, 825 bp, Staphylococcus epidermidis
tatatgcaaccttatttaatttgtctagatctagatggtacattattaaatgacaataaagaaatctcaccttacactaaacaagtattaaccgaattacaacaatgtggacactacgttatgattgctactggaagaccttatcgcgcaagccagatgtattatcatgaactaaatatgagcacacctgttgttaactttaatggagcatttgtacatcatccaaaagcaaacgatttcaaagtgatacatgaagtacttgatgtagaaatttctaaaaatattattacagcacttcaacaatctcatattacaaatatcattgctgaagtaaaagactacgtctttataaatagttatgatccaagacttttcgaaggtttttcaatgggaaatcctaaaattcaaacgggtaatttacttgaaaatcttaatgaagcacctacgtcattacttgttgaagcagaagaagaaaatattcctgaaattaaagatatgttaacacatttttatgcagaaaatattgaacatcgtcgttggggcgcaccgtttccagtaatagaaattgtgaaacgtgggattaacaaagcacgtggaatcaagcatgttcaaaactatttaaacatcgccgacgatcatatcattgcgtttggtgatgaggacaatgatatagaaatgataaagtttgcgacccatggcattgcaatggccaatggcttgaaagatttaaaagaaatagcaaatgagactaagtttagtaataatgaagacggaataggtcgttatttaaatgacttttttaatttgaaaatgcgttattattaa

SEQ ID NO: 1088 - DNA, 1122 bp, Staphylococcus epidermidis
tgcattcgacccaaaaatgcgaaaataaaggaggtaaaagtaatgacagaaacggtattagaagtaaatgatttgcacgtttcctttgatattgctgcaggagaagtgcaagctgtcagaggcgtggattttcatttaaataaaggggaaacgttagccattgttggagaatctggatctggaaaatctgtaacaactaaggcaattacaaaactttttcaaaaggatacaggaagaataaaaaagggagaaatcttatttttaggtgaggacttagctcagaaaagtgaaaaagaactgatacagctaagaggtcgagatatttcaatgatatttcaggatcctatgacttctttaaatccaacaatgcaaatcggaaagcaagtcatggaacctttgattaaacataagaaattaagtaaagcaaaggccaagcaaagagcattggaaattttgaatttagttgggttacctcgtgctgaaaaacgatttaaagcttatccacatcaattttcaggaggacaacgtcagagaatagttattgcaatagcattggcatgtgagcctaaaatattaattgctgatgagcctacaactgctttagatgtgacaatgcaggctcaaattttagatcttatgaaagaactacaaaataagattgaaacttcaattatctttattacgcatgatttaggcgttgtagcaaatattgcggacaaagtagccgtaatgtatgggggacagatggttgaaacaggggatgtgaatgaaatattttatgatcctaaacatccctatacctggggattgctttcttcaatgcctgatttaacaaccagtaatgacacggacttaattgcaattccaggtacaccaccagatttacttcatccaccaattggtgatgctttcgcacgtagaagtcgatatgctttagatattgattttaaagaagaaccaccttggttcaaaatttcacccacacattttgttaaatcttggttattagatgcaagagctccaaaagttacgccaccttcaatggttcaaaaacgattaagaacaatgccaagtaattatgaacaaccacatagagtagagagggtggcttttaatgagtaa

SEQ ID NO: 1089 - DNA, 240 bp, Staphylococcus epidermidis
ataaagaagccagtaaatgaatttatgaaaactcatttactgtctattttgataggaattatgtcccaggctcatcgcagtgtggagaaaccttcagtattatcgttaatacttttacgtggtgataataataaacatacacatttgtttgtagaatttgaggagttcgacagagcaaatgaagaaaaacacgcaaaagttgaatatcatagttctaaaaataaaacagatacattataa

SEQ ID NO: 1090 - DNA, 1233 bp, Staphylococcus epidermidis
ttactatttacaaaagagagggttcttgaaatggcgaaaatacctgtaactgtattaagtggatatttagggtcgggcaaaacgacattgcttaatcatatattaaaaaatagagaagggcgtcgcattgctgtcatagtcaatgatatgagtgaagttaatattgataaggatttagtagcacaaggtggcggcttatctagaacagatgagaaattagtagaactttctaatggatgcatatgttgtactttaagagacgatttgttacgagaagtcgagcgcttagttcacaaaggaggaatcgatcaaattgtaattgaatcaactgggatatctgagcctgtgccggtagctcaaacgttctcatacatagatgaagaattaggtattgatttaacctctatatgtcgattagatacaatggtgacggttgtagatgcgaatcgctttgttaatgatatacgtagtgaagatttattggcagaccgtgatgaaagtgttgatgatgaagatgagcgtactattgctgacttactcattgatcaagtagaattttgtgatgtgatgattatcaataaaatcgatttgattagcgacgaagctctagaaaaattagaaaatgtattacgtgcattgcaacccgaagctaaaattattaaaacagtaaatgctaaagtggaattatcagatgtacttaatacgcaattatttgattttgagaaggcaagtgaatcagctggatggatcaaagaattaacagctggaggacatgcgacacatacgccggaaacagaagagtatgggattacatcatttgcttatactagacgattaccatttcatgcaaaaagatttcatcaatggctagaacaaatgccagaaaatattgtaagaacaaaagggattgtatggttagcgcagtataatgatgtagcgtgtttgttatcacaggctggttcatcttgtaatattcaccccgttacatactgggttgcaacaatgagtgaaagtcaacagcaagctattttggaggcacgtcaagatgtagtagaagattgggatatcgaatatggagatcgtcaaacgcaatttgtaattattggtacggatttagatcaagaaaaaatttcccgggaattagatgcatgcttaattcatagtagtgagattgatgaagattggcgattactagatagtccgtaccaatggacttatgatcgacgaatgtaa

SEQ ID NO: 1091 - DNA, 261 bp, Staphylococcus epidermidis
ggaggcgacacattgtttactaaaaaaatattgatttatattgcgctccttattaccttaattcgtttttttattccattacatccagactttgatacgttgttagtatggttgtttattctttacataattccaattattttatgtatcattggctttaaatcagataaactcatcgctactatgattatgattccaaatttaatgggtataggttatcgtatattcatcttctttaatgactttttgcatttaaaataa

SEQ ID NO: 1092 - DNA, 621 bp, Staphylococcus epidermidis
tcaagaaggttaattaaaatgaaaaatgtttctaaagctttgatttggtttgttataagcttcatcatctttcacgcaatattatttgtgatgtggggagaacatcaagaatactggtatttatatactggcattatgttaatagctggaataagttatgttttttaccaaagagacattgcatctaaacgattattaacttccataggcatgggtataataacgagtgtcgcacttattattatacaattaattttttcacttatttcatcagaattatcatacgcatctttaatcaaagaattatcacgaacgggtgtctactttaaatggcaaatgctcgttactttattatttgtgataccttgtcatgaattatatatgagaactgttttacaaaaggaattaataaaatataacttaccgaaatgggctagcattttaattgttgcaatatgttcaagttcattatttatatacttagataattggtggattgtattctttatttttgtagctcaattcattctatctcttagctatgaatatacgagacgtattgctacgactacaattggtcaaattgtggctatcattttattattgatattccacggataa

SEQ ID NO: 1093 - DNA, 1695 bp, Staphylococcus epidermidis
actaaattaacgaggtgccttatgtataaagattataacatgactcaacttactctaccaatggaaacttcagttcttatccccacaaatgatatttcacgacatgtaaatgatattgtagaaacaattcccgagactgaattcgatgaattcagacatcatcgaggtgcaacatcataccatccaaaaatgatgttaaaagtagttttatatgcctacacccaatctgtgttttcaggacgtaagatagaaaaattactcaatgatagtatccgaatgatgtggctatcacaaaatcaaaagccttcttataaaacgattaatcgatttagagtaaatcccaaagtagacgctttattagaatcattatttattcaatttcatagtcagtgtttgaaacaaaatcttattgatgatcaggccatttttattgatggtacgaaagttgaggcaaatgccaatcgatatacatttgtatggaaaaagagtattcaaaaccatgagtcaagaatgaatgaaaactctaaagcactctatcatgaattggtgataaataaaatcatacctgagattaaaaaagatcatgataatgacttaacaaaagaagaaatagatttgattggtagtcatttagataaagaaatcgaagatttaaaccaacatatcgataatgaaaaatgtactaaaataagaaaacaaatacggctcaaaagaactaaaattaaaaaatacaaaaagcaaattaatgattactctcagcgaaagcataaatacgaagtccaaaaatctattttaaaggatagaaatagttattctaaaacagatcacgatgccacatttatgagaatgaaagaagatcatatgaaaaatggacaacttaaaccggggtataatttacaaatagcgacaaattctcaatttgttttattttatgatgtgtatcaaaatccgactgatacaagaacaatgataccttttttaaatacaatacaagagacctacggtcatttacctgaatatattgtagctgacgcaggttatggtagcgaagccaattatatggcaattatagataattttaatcgaacgccactcataacttatggaatgtttataaaagataaaactaaaaaatataaaagtgacatctttaatactcaaaattgggattatgacgaaattaacgatgaattcatttgtccgaataataaaagactaggatttaaaagatatgcctatcgtcatgataaatatggttttaaacgagactttaaattatatgaatgtgatgattgttcagaatgccctctgaaacaacaatgtatgaacttcaattcaaaaacaaataaaaaaataatgaaaaattataattgggaatattttaaagcccaaattaataaaaagctttcagaaccaaaaacaaaaaccatctacagtcaaagaaaaattgatgtggagcctgtttttggatttatgaaggctattttgggtttcactagaatgtccgttcgagggatagataaagccaaaagagaattaggatttgtgctaatggcacttaatataagaaaagtaacagctcaacgagctgaaaataatcaaaaaaataataaaaaagacaatttctatattatttcaatagaaattgtctttttttacttatcctgggactttatgtcccacactcatttttga

SEQ ID NO: 1094 - DNA, 189 bp, Staphylococcus epidermidis
gtcatacagaccataaaactatcctacaaatatataggcatgttactgaataaattagaaaagatacataataacttattaataaagataggatttttaaataaattttgttatatatcctttattatgtggtttattttgtgctttactagaagtaatcgatttatggtatgcaaagaaaataactaa

SEQ ID NO: 1095 - DNA, 789 bp, Staphylococcus epidermidis
tcaatgagtgcaattactattttaggtttcttattattgttgataatggttattttcggaggtaaaaaaggactcatttcttttttcactttgtttttaaattttatcattcttgtaataagtattcttttaattatatatggtgtgtcaatctatcttgtcacatttatattttgctttatcatagccgcaattaatttatttgtattaaatagttacaatgtaaaaacacaagcggcttttctaggtactttagtaacaatacttatattaatactcatgatatacttttcagttgagatgggtcacttacaaggttttgccaccgaacagcaggatgaaacatatgtgtattcaatgaatattggtattaatatggtacaatttatggtatttacaattgttcttgcagtgatagctgcagtcattgatttagcaataacaattagttcccctatgtatgaactaaatgagactaatccaaatttaaatcagcatcaattatttcagtctggtatgcgtgtgggtagagagatattagcaacttctgccaacaccatttatttagcatttttcggaggacaattaactttattcttctggttctttaaattaaaatattcatttggacacatcattaattcgaagatattcacacaggaatttatagctattttacttggtggtatcgccgttgcaattagcattcccattactgcatggattacagcatttatgattaaacatttcagtcagaagaagactcttacgaatcaacaaaataaataa

SEQ ID NO: 1096 - DNA, 192 bp, Staphylococcus epidermidis
gagttgcacgcatacatattaacaaaaatattttctccaactttgaatagaaaatattctgttcattttatgtattcacataatcgtgaaatcatttatgactttgatcaattttcaaatcgcctagtcctagcgctcatcattgtatactcagttatgtcgttgtgtcccgttctaacatttgctttttag

SEQ ID NO: 1097 - DNA, 192 bp, Staphylococcus epidermidis
tgccaatgcgctaagggcagttgttccaataatggcagtaatatattttttttgcacttgaaatcctcctctactttaggttttgtttattcgcgttttaacaatacaaagatattatactctttaattatgtatagcatgtttgctttagatgacattctgattacaaatattattttaaataaaaaatag

SEQ ID NO: 1098 - DNA, 1359 bp, Staphylococcus epidermidis
cactttagcgctttaaagggagttggtaatttgagtggtcattcacaatggaagacgtctaccggttttatattagctagcgcaggttctgcaataggattgggtgcaatgtggaagttcccatatatggcaggtatatacggcggtggcgcttttctattaatgtttttaatttttactatatttgtaggactaccactgttaattatggaatttacggtaggtaaaatgggtcgtacatatacaacgcaaatatataagaaattaacgggaaagaaatggcttaatattatcggatggaatggtaatttagccgtatttatactatttggtttttatagtgttattggtggttggattattatatatataggttatgtcatagcacaaatcatggtttttaaatcaagtacgctgacaaatattcaatttgaaacaatcattagtaatccatggttgactgttttaggtcaaggcatatttattttgataacaatggtaattgttatgttaggtgttgaaaaaggtttagaaaaagcttctaaaataatgatgcctctattatttatctttttaattatcgttgtagcacaatctttaactttagaaggtgctttagaaggtgtacgttatatactgcaacctcgagttgaagatatgtctattcaaggtgtactatttgcgttagggcaatcgttttttacgctgtccctaggtacaaccggaatgattacttatgcaagctatgcacctaaaaatatgacgataaagtcttcagcactttcaattgtcgtaatgaatattttaatttctgtcttggctggattagctatatttcctgcgcttaaaacatttggttaccaaccccaagaaggccctggcttattatttaaggtcttaccactagtatttagcgaaatgacttttggtacattcttttactttatatttttactattattcttatttgcggcattaacgtcttctatatcattattagagttaaatgtatctaattttactaaaaatgataatagtaaaagacaaaaagtggcaatcataggtagtatacttgtatttatcattagtatcccagcaacattatcttttagtagtctaagtcatttgcgttttggcgctggtacgatatttgataatatggattttattgtatctaatattcttatgccattaggggcactaggaacaacattagtggttggccaattactagataaaaaattattaaaagaaagctttgggaaagacaaattcaacctatttttaccgtggtattatttaattaagttcatcatgcctattgttattattttagtatttatagttcaattattttaa

SEQ ID NO: 1099 - DNA, 804 bp, Staphylococcus epidermidis
aaatacatggctgaagaattaagaatcatggagaataagagtcgtgaagatactaatctatcacctgttagcaaaatagaaatctattctttttttgatccttttagcaaagattgttttaaattatctgcaatcttatcaaaattaagaattgaatataataaatatataaagataagacatattttaaacccttctttaaaggtattaactaagtgtcaagctcaaagtacttcagattttgacaatattgcacttgcctataaagccgctgaacttcaaggtcgtatcagagcagaaagatttatacatttaatgcaaaatgaaatcattccaaaacgtgatattattaccgaagatatgatttctgattgtattaataatgccggcattgactatcaagtttttaaagaagacttgcaaaaggacaagttgactgacagcttgaaagttgatcttcacattgcaagagaaatggaaatagaacaagctccctcacttgtttttttcagcgaaaatgttcatgaagaaggtttaaaagtcgaaggattatatccttatcatatttatacttacattattaatgagttaatgggacaacctatagagaaaaatcttcctccaaaattagaatactacattcaaaagaaacaactagtaacaatggaagaacttttaacgatctatgaatggcctgaaaaattgctaaataaagaattaaagaaactcacacttcaacaaaaagttgaaaagttgcaatatccagagggagaattttggaaatctaaaatgcctcagtgttaa

SEQ ID NO: 1100 - DNA, 228 bp, Staphylococcus epidermidis
gcacttaattttgtgagaaagggagatagatttgttgtagagtctattgaccgtttgggacggaattatgatgaagtgattcataccgttaattatttaaaagacaaagaggttcaattgatgattaccagcttccctaggatggatgaagtcattggcaagccattactgtatatagaaagccatgcgctatgtgtatggttcagaaaaggttttaccgttatctaa

SEQ ID NO: 1101 - DNA, 372 bp, Staphylococcus epidermidis
gaagctctttattttggagcaacaggtgttttaagctatcgaaaatttttcccatttatttataatttgtttcaaaaaggatactttgaaaattcactaacaattattggcagtggtttaaatgagttaactactgatgaatttagagaaaaagtcaaaaatgctattcaaaataatattgaaaactcaaaggaaattggtgcgtttttaaaacgtttattttataaacaacaggacgctaatagtaaagatagctaccaaaaatttttggaaatgagtttagaactagatgataagtttgacctaaaagaaaatcgattgttctatcttgcaatgtcccctaaatttttggagttgcaacaaaccacttga

SEQ ID NO: 1102 - DNA, 906 bp, Staphylococcus epidermidis
atgaaatttctatcattcaaacataatgacagaacttcatatggtgttaaagtaaaacgtgaagatgctgtttgggatttaccaatggtttttgctgagtttggggacaaagactttaatcctaaaactttaattgcaggtttacagcaaaatcaaactttagactttcaagagcaagttcgaaaagcagttgtcgcagcagaagaaagtggaagagatgaggaatttaaacttttattcactgatattgattttctaccaccagtgacacctcctaataatgtgattgcatttggtagaaattatgaagatcatgctagtgaattaaatcatgaagttgatagtttatacgtatttactaaagcggcttcatctttaactggtgatgaagcaacaattcctaatcataaagatattacagaacaattggactatgaaggcgaacttggaattgtaattggaaaatcaggcgaaaagattcctagaggattagctttagattatatttatgggtacacaattatcaatgatattacagatcgtactgcgcaaagttcacatgatcaagcattcttatcaaaaagtttaactggggcatgcccaatgggcccttatatagtaaccaaagacgaattacctgcgccagagaatgtaaatatcgtaacaaaagtgaataacgaaattcgacaagatggcaacactggtgagatgattttaaaaatagatgaactcatcgaaaagatttcaaaatatgtagctttacatccaggcgatatcattgcaactggtacacccgctggtgtgggtgctggtttacaaccaccacaatttttacaaccaggtgatgaagtcaaagtaactatagataatattggcactttaacaacatatatatctaaaaattaa

SEQ ID NO: 1103 - DNA, 246 bp, Staphylococcus epidermidis
agagcttcttattcagtagaaacaaagtataaagccgttgaaatgaaagcagcagaattttcaacaaaagaaattatgaaagaattaaatattagaaatagaacacaagtaaaaagttggtggctatggtatcaaaatgaggaaagtatgtttgttttatatctttatcctcagtcattaattatttgtctatctttgcatttctctactaaccagtgttataatctagataatgaaaatgattag

SEQ ID NO: 1104 - DNA, 600 bp, Staphylococcus epidermidis
aatatgcattatccagaacctatatcaaagcttatcgatagttttatgaaactgccaggcattggaccaaagacggctcaacgtctggcttttcatactttagatatgaaagaagacgatgttgttaagtttgctaaagcactagttgatgttaaaagagaacttacctattgtagtgtttgtgggcatattacagaaaatgatccttgttatatatgtgaagataaacagcgagatcgttctgtcatatgtgtagttgaagatgacaaggatgtcatagcaatggaaaaaatgcgtgaatataaaggtttatatcacgtgcttcatggttcgatttcaccaatggatggtattgggcctgaagacatcaatatacctgcattagttgaacgcctcaaaaacgatgaggtgaaagagcttatattagctatgaatcctaacctagaaggcgagtctactgcaatgtatatatctaggttggttaaaccaattgggattaaagtcacaagactggcacaaggtttatctgtaggcggcgatttagaatatgctgatgaagtgactttatctaaagcaattgcaggtagaacggaaatgtaa

SEQ ID NO: 1105 - DNA, 813 bp, Staphylococcus epidermidis
atcatgcgttatacaatccttactaaaggtgattcaaaatcgaatgcattaaagcataaaatgatcaatcatatgaaagattttcaaatggtagaagatagcgaaaatcctgaaattgtcatttcagttgggggagatggaacgttactacaagctttccatcaatatagtcatatgttatccaaagttgcttttgtcgggatacacaccggtcatttaggattttatgcagattggttacctcatgaagttgaaaagcttattattgaaattaataattcggagtttcaagttattgaatatccacttttagaattaatagtcaggtataacgataatggttatgaaacgagataccttgctttaaatgaagcaacaatgaaaactgaaaatggctcaacattggttgtagacgtcaatataagaggtaaacatttcgaacgatttagaggagatgggttgtgtatatctacaccttcgggttcgacagcttataataaagctttaggtggtgcgctcatacatccatcacttgaagcgatgcaaattgctgaaattgcatctattaataatagagtgtttagaacagtaggctcgccattagtacttcctaaacatcatacgtgtttaattacgccggtaaatcacgatacgattagaaccacaatcgatcatgttagcattaagcacaaaaacgtcaatgcaatacagtatagagttgctaatgagaaagtgcgttttgccagatttcgtccatttccgttttggaaaagggtacatgactcatttatttctagtgatgatgaacgatga

SEQ ID NO: 1106 - DNA, 2631 bp, Staphylococcus epidermidis
aacccaatctatagaaagtcatccatcatatttaaaacgattttagtaaaggaggatagaattatgcttcaatcagatatcaatgaattagtcaatcaggctaaacgtgtaattacacctttatcaccgatttcaacatttgctgcccgtaatccgtgggaggggctagaagatgcttcgtttgatcaagtggcacgttggttaaaaagtgtgagggatattgacatttatcctaatgcgtctactattcacagagcgattagtaataaagaaatagatttaaaagtatttgaagaacggttggatgaaaatcgtgcgcattataataataggtcactatctgacagtgatatcaacacatatattcaaagagcgaaaaatttaaaaacgattgaagaaggttactttaatacaaaagataacgagaaactggaaaaatgggtacaaactaattttaaggattataagaaaaaagaagatgtgatagcgcaaagtgctagtgttttcacaaaggaaggtacacgacttattgatattttaaatgctcatatgattaagtggtctaaattatatgttgatgactttcaatcaagttggactatgccaaaaagagaaaaaggattctatcatgcctggcaacgtttagttaaacatgatccattattcacaaaaaaacaacgacttactttaacacatttgccaaatcaagcaaccgaagcaatagagtacgcctttcaagaattaggagtaaaagaagaacatcgacaatcatatattgagagtcatttattatctttaccaggttgggcaggaatcatgtatcatcggtcacagacacaaagtaatgatgcgtacttattaacagactatgttgcgattcgtctatcaattgagatggtacttttaaatgaccaccatacaacattattaaaaaaatctatatatcttcaaaaaaagttagagcaaatacgttatttgctatttaacatacaaatgaatgttgagcagtggttaaatctatcatctaaaaagcaacaagcatacattgaattggggacacgattcagcccgttttattttaaaaagttatggttagatgcatgggaagaaacgcatgaacgtcgattggttgatgaaatttatcgtgttccaaccgaagatactgatcaagcaaaagcaaaagtacaacttgcgttttgtattgatgtacgatccgaaccgtttagaagacatttagaaagtgaagggccttttgaaacaatagggattgctgggttctttggtctgccaattcaaaaagaagtacttgatgaacaatttgcacatccatctttaccagtgatggtagaacctgcatatcgtattaaagaatatgctgatcaacatgaaatgaaaatttataatcaacaacaacatacacttacatctatgttttacaactttaaattaatgaaaaacaacgtgttgccaagtttgcttttaccagaattaagtggtccttttttaagtattgcgactatagctaacacaattttccctaaaaaagcaaaacgtattgttcatcgattctcacaaaaatggctacgtaaaccaacaggtaaattaactattcagcgtgagcaagatgcgtattcaaaactaccaatcggctttactttagaagaacagattcaattttccaaaaaagcattacaattaatggacttaacagatgattttgcaccacttattgttctatgcggacacggtagtgaatcacataataatccctatcatgcttcattagagtgtggggcttgcggcggtgcctcgagtgggttcaatgcgaaattattagcagtaatgtgtaatcaagaaaatgttagacgtggattattgatggaaggaatcgacattccaagacatacagtgtttatagctgctgaacatcaaacgtcagttgatgagttagagtatatttatgttccacctttaactacagaagctcaaaatgcctttgacgaacttaagcatgtgatgccaaaagtatgttataaaaccaatttagaacgtttggcatcgttgccaaatataaataacactgaccataatcctaatgctgaagcgcatcgtcacgctagcgattggagtgaagttcgtccagaatggggtctagcacgaaatgctgaattcattattgggaaacgtcaaatcacccaaaatagtaatctagagggacgggcatttcttcataattatgattggacaaaggatgaagacggtgagattttaaatacaattatttctgggccagcactagtagcacaatggattaatttacaatactacgcctcaaccgtggcacctcactattatggaagcggtagtaaaacaacgcaaactgtaacaagtggtgtaggtgtcatgcaaggaaatgctagtgatttaatgtatggcttaccatggcagtcagtaatgatgaatgacaaagaggcgtatcacgcacctattaggcttttaattgttattcaagcgccagatgcatatattcaacgtttgttaaaacatcataatcactttagacaaaaggttgatcatcaatggataagacttgccagtattgatgaaaataatagttggaaagactggtag

SEQ ID NO: 1107 - DNA, 306 bp, Staphylococcus epidermidis
gggtacctttttgtgtataaccgaacccaatgtggtttcgttaaatgtgtccgtaagtggacgtattatctacttagcttaatatcctcaaatttggggatattgatttatacacagccccaatgtgggttcagtaatagactgaataactctatatatttactcagctcaaatgtgagcgtattaattaataatacaaatgctgacgcactaagtcagtgcattagaaaacgaaaatattcgttctctaaaattaagctgaatacagccgaaatgtcggcactagtagatatatcacaacggtaa

SEQ ID NO: 1108 - DNA, 4590 bp, Staphylococcus epidermidis
tctaatttatatattgaacagataaataaattacattatagtaattactatcaaacaaaattgtcagaaaattctaataagggagtgtgcatcatgtacaatgagaaattaaaaaagggactatacgattatcgtgaagagcatgatgcgtgtggtattggattttatgccaatatggataataaaagatctcacgatattatagaaaaatctttagaaatgttaagacggttagatcatcgtggtggagtaggtgccgatggtattactggtgatggtgcaggaattatgacggagataccataccaattgttcgaacaattaacagaattcaaagttcccggcgaaggatattatgccgtgggattatttttttctaaagagaaagttagagattcaattcacgaagagatgtttaatcaatattttgaaagtgaaggttttaaagtcattggatatagagatgtgccagtagatactcgcgctattgctcaacatgttgcagatactatgccttatattcaacaagtatttgttgacatcacaggtgtaaaagaagttgaaaaacgattgtttttagcaagaaagcaaattgaaaaatatagtgaaacacaatccatagatttatattttacaagtctctctcatagaacgattgtttataaaggttggttacgttcggatcaaattaaaggcttatatttagacctacaaaatgaggcatatcaatcaaaattaggacttgtacactcccgctttagtactaatacatttccaagttggaaacgtgcacatcccaatcgcatgcttatgcacaatggtgaaattaataccattaagggtaacgtaaactggatgcgagcacgccaaaataaactagttgaaacattatttgaagatgagaaagataaggtgcattttattgttgatgaagatggtagtgactcatcaatagttgataatgcgttagagttcttatcattagcaatggagcctgaaaaagcagcgatgttattaattccagagccatggttatacaatgaatctaacgataaaaaagttcgctctttctatgaattttatagttatttaatggagccatgggatggaccaactatgatttccttttgcaatggagataagataggtgcattgactgatagaaatggattaagacctgggcgttatacaataactaaagacaattttattgttttttcttccgaagtaggtgtcattgatgttccagaagaaaatgtagcatttaaaggacaacttaatcctggaaagttattacttgtagactttttgcaaaataaggttgtagaaaataatgagctaaaaactaatattgctaatgagttgccctacgaacaatggctaaaagattataaaaataaaaatgatttagataatatttattaccaatcttccgactgggatgatcaaacactcttccgcttacagaaacaatttgcttacactaaagaagatatcaataaatatatgacagatttagtcatcaataaaaaagatcccatcggagcgatgggatatgatgcacctattgcagttcttaatgataagcctgagtcactatttaattattttaaacaattatttgcacaagttaccaatccacccatcgatgcttatcgagaaaagattgtaactagtgaactttcatatttaggttcagaagggaacctcttatgtcctgatgaatcagttttagaaagaattcaattaaaaaaaccagttttaaatgaagcgcaattatcatcaatcgatcattcgtattttaatgtaacgtatttatctacactttatacaggtgatttggaaagtagcttaaatgaactagggaaccgagcaatacaggctgtacatgaaggtgcgaaaattttggtgttagacgatacgtctttaactcacgaaaatagttatgcaatgccaattttattagcgttaagtcacgtgcatcaattattaattcgagaaggattaagaatggagaccagcctcattgcgcagtccggtgaaacacgagaagttcatcacgttgcatgtttacttggttatggtgcaaacgctgtagttccatatttagcgcaacgaacgattgaacaattaacgcgtcaaggtcaactttcaggaactgtcgctgaaaatgttgctacgtataccaatgtattgtcagaaggcgttattaaagtgatggctaaaatgggcatttctactgtacaaagttatcaaggagcacagatatttgaagcggtaggtttatcgaatagcgtcattgaaaaatattttacaggtacacagtcaaaattatctggtataagtattgaacaaatagacaaagagaataaagcgagacaaagtgatgattctgattatcttgaatccggaagtgtattccaatggagacagcaaggtcagcatcatgcatttaatcctcgtacgatttttttattgcagcatgcatgtagagaaaatgattacgagttatttaaaaaattctccaaaactgtaaatttaaaacgtacggatcatattagacatttattagaattcaagacacgccaatctattgatattagtcgtgttgaaccagcaagtgaaatcgtaaaacgttttaatacaggagcaatgagttacggctctatctcagcagaggcacatgagacgttggctcaagctatgaatcaaattggaggtaaaagtaatagtggagaaggtggtgaagattcttcacgttacgaaattcaaaaggatggaagtaataagataagtgcgattaagcaagttgcatcaggtcgttttggggtgacgagtgattacttgcaacatgcaaaagaaattcaaattaaagtcgcacaaggcgctaaaccaggggaaggtggacaactaccaggttcaaaagtatatccatggattgctgagactagaggttcgacaccaggtataggattaatttcaccaccaccacaccatgatatttattcaattgaggacttagcacagctcattcatgatttaaaaaatgcaaatagaagagctgatattgcagttaagcttgtatcaaaaactggcgttggaactatagcttcaggggtagctaaagctttcgccgataaaattgttataagtggttatgatggaggtacaggtgcatcgcctaaaacaagtattcaacatgcaggtttgccatgggagataggccttgccgaaacacatcaaacacttaaattaaatgatttgcgtagtcgcgtaaaattagaaacggatggtaagttactgacgggtaaagatgtagcttatgcttgtgcgcttggtgcagaagaatttggtttcgcaacagcaccacttgttgttttggggtgtattatgatgagggtttgtcataacgatacgtgtccagtaggggttgcaacacaaaacaaagatttaagagctttgtttagaggtaaggcacagcatgtagttaactttatgtattttatagctgaagaattacgtgaaattttggcttcacttggtttagaaacagtagaagagttagtaggaagaacagatcttcttcaacgttcgacgcaattgaaaccaaatagtaaagcagcttcgcttcaaatagaacgtttaatagaacaatttgacggggttaatacgaaagagatatcacaaaaccatcatcttgatgaaggattcgatttgaattatctgtacccagacgcacgctatagtattgaaaacgggcactcttttaccggaaattatgttgttaataatgaacagcgagatgtaggtgtaattacaggtagtgcgatagctaaacaatatggagaagaaggattacctgaagatacgatacttgcttacactgaaggtcatgcaggtcaaagcttagctgcatatgcaccacgcggattaacaatccatcataccggtgatgctaatgactacgtaggtaaaggattgtccggtggaactgtcatcgtaaatgctccaaatagtcaacgtgaaaatgaaattatagcaggaaatgtaaacttttacggggcttctagaggtaaagcgtttatcaatggtaaagctggtgagcgtttctgtatcagaaatagtggtgcagatgttgtagtagaaggtattggtgatcatggacttgaatatatgacagggggacatgtcattatcttaggagatgttggaaagaactttggccaaggcatgagcgggggcgtaagttatattttcccttctgacgtggagaaatttaaaaaggttaatgcgcttgaaactttagaattcagtagcatacgttttgatgaggaaaaatctcttatcaaagacatgcttgaagcacattttaagcatacacgtagtaacaaagcacgccaattacttgaccaatttgacaatattgaaaagttagcaattaaagttattccgaaagattacaaattaatgatgcaaaaaattgatttgaaaaaacgtcaaatggaacgtgaagatgaagcaacactggcagcgttttatgatgacagagaaacaattgaacaagagctacagccagcagtcatttattaa

SEQ ID NO: 1109 - DNA, 1002 bp, Staphylococcus epidermidis
aaacatgaatatgttaaattaatacctggtattaaaaattttttaagaaggtgtacaaccatgaatgtgggtattaaaggttttggtgcatatgcacctaaaaatattatagacaatgcctattttgagcagtttttagaaacttcagatgaatggatttctaaaatgactggtattaaagaaagacattgggcagacgaagatcaagacacatctgatttagcatacaatgcaagtattaaagcgatagaggatgccggcattcagccagtagatatagacatgattatcgttgctacagctactggggatatgcctttcccaagcgtggctaacatcttacaagaaagactaggaacaggtaaggttgctactatggatcaacttgctgcatgttctggctttatgtattcaatgattactgctaaacaatatatacaatctggtgattacaaacatattttagttgtgggtgctgataaattatctaagattaccgatatgactgaccgttctactgctgtattatttggagacggtgctggagctgttgtcatgggagaagttgctgaaggtcgtggtatcattagctatgaaatgggttcagacggtagtggtggtaaatacttgtacttagatagagaaactggcaaactcaaaatgaatggtagagaagtatttaaatttgctgtgagaattatgggtgatgcatctacgcgtgtagttgagaaagctggtttatcgtctgaagacatagacttatttgttccacatcaggctaatattagaattatggaatctgcgagagagagattaggaatagaaagagaaaaaatgagtgtctcagtaaataaatatggtaatacttcggctgcctcaataccattaagtattaatcaagaattgcaaaatggaaaaatcaaagatgacgatactttagtcttagttggcttcggtggaggtctaacttggggcgcaatcgttattaaatggggaaaatag

SEQ ID NO: 1110 - DNA, 543 bp, Staphylococcus epidermidis
aatggaggatacatgcatatttatttaagtactttaacagaggtcgattatgaaacgtcactaaatagtatagaaaataattataatctaaatccagaatccagttggcaagatcgagcgcgcgttaaaaatctaagaaaacttgaaagctacaattatgaattagaagttatagctaagaatgaattgaatgaagttataggtcacgttgtgttagcagaggttaagttgtcgtctaaaaacaaaaaagcgatagcgttagccattggtgcactgtcagtagataaatctattcgaaaccaaggtttaggtcaagccctgttaaaagctgtagaagaacgtgctaaagaacaaggctattgtgctatttttgtaaataatcatcctcagtactttgagaaatctgattatgaagcagcccatttatataatatacatatagaagaaaaacgaaatcatcaatcattattagtaaaatttctaaaaccagttcaaaatgaatggtctggaatgacggtgtattatccggaagtactggattga

SEQ ID NO: 1111 - DNA, 1512 bp, Staphylococcus epidermidis
gatggaggatacgcaatgttaagttcagagttaattttgtttatgttttttattacacttgtcattgctatactgagtggattaatatttttgaatcatcgagttcccattcaatatattaaatttcatatatatttacttgttttacctatcattacgggattaagtggattaatatttttcggtgaaagggcgaatgttggaccttttgtagttgatcatcttacttggttaatgatgacatttattttgactttaggctttatcattcaaaagttttctatgcgttatttaattggcgacatgcattaccgtaaatattttccgttttttacattaattactgcatttgcttcattggcatggttaagtggagacttaaggttaatgaccatgttttggggtgcaacattatttgtgttaacacggctcattaaagttaacaaattatggaaggtgcctagggaagcagcaagaatttcagcttggtcatttatattggcatggttgtcgttattgattgctgtcattttattgtatatcgctacaggagattggtatatttattcgaatatgtcagatgataatgcaatcaattatggaatgcgtctctgtatcaatttacttattgttttagctgtgattattccggcggcacaatttccatttcaaggctggcttattgaatctgtagctgcgcctacgccagtttcagctattatgcacgctggtattgttaatgctggtggcgttattcttacacgcttttctccggtatttaatgacgaaatagccatttcactgttattaattattgcaagtatttcagtattgtcgggttctggaatcactcttgtgcatgtagattacaagagacaacttgtacgttctacgataagtcaaatgggttttatgttagtacaatgtgcgcttggggcatattctgcggcgatagtacatttaatattgcatggtgtgtttaaagcgacattatttctacaatcgggttctgttgttaaaagatttaacattcctacgtctccatctgttaaaaaatcatatggctggcttgtatttggtcgtctactagctattcttatagcgataatattttggttgaatagtgatagacatgcatatgatgtattaagcgctcttatattagcttggtcgttaatggtgtcatggaatcaattagttgcttttagtcatggactcatcggaagagtcatcggagtatgtatgattattgttgtagcaattgtttatattattacgcatcattatttcttcacgacattaagtaacgttgatattcatattgtttcaccaccactcataagtattattctatcgattgctattatagttttcggcagtatgttaagcatatgggtatcacggcgaagagaatcaaaggcatttgcgaagttatacttgtggcttattaaagtaggagaggctaaaacccaatctatagaaagtcatccatcatatttaaaacgattttag

SEQ ID NO: 1112 - DNA, 1239 bp, Staphylococcus epidermidis
gtcactcatctcaaccggatgaaatctatggaaaggttcctttgtatgcaagattcttcgtcaagtaattactcaagtaacagaaactttgttatgatgttggtaattctgtttctgatggaatttgcaagaggtatgtacatactaagttatataaactttttacctacagtgacctctatcgcaatagcaatcacatcatttgctttttccattcactttatcgcagatgctgcaacaaattttgtcatcggctttttacttaaaaaatttggttcaaaattagtacttacatctggattcttacttgcttttataagcttgtttttagtgatatggttcccggcatcaccattcataattattttcagtgctattatgttaggaattgctgtgagtccgatttgggttatcatgttatctagtgtagatgaaagaaatcgcggcaaacaaatgggttatgtctacttttcatggttgctaggtttattggtgggtatggttatcatgaacttgcttattaaattccatcctactcgttttgcatttttaatggccttggttgtgcttattgcctgggtactatactattttgttaatatcaacttaacaaattacaatactaaacctgtgaaagcacaattaaagcaaattgtagatgttacacaacgtcatcttattctatttccgggtatcttgttacaaggagcagctatagcagcacttgtacctattcttccaaaatatgcaacgcaagttgtgaaagtatcaaccgttggatatacagtagcaatcattattggtggcataggctgtgctttctctatgttatttttatcaaaaatcatcgacaataatagcaaagggtttatgtatggagttatttttagtggctttatactatatacaattcttatattcgggctatctacaattacaaatatatatatagtttgggccataggactttttattgggctaatgtacggtatcctcttaccggcttggaatacctttatggctgggcatattaatcctaacgaacaggaagaaacatggggcgtgttcaacagtgttcaaggcttcggttcaatgataggcccactagtcggaggtctaattactcaatttactaataatttaaataataccttttacttttcagcgatgatttttcttgcacttgcagtattttacggatattactttattaaaacaaacagaagggttaaaccttaa

SEQ ID NO: 1113 - DNA, 213 bp, Staphylococcus epidermidis
cgagataatctatatggttatctctattttttgcgttcaaataaaaacaaacttcacacaccgtcttttccaacttcagaagtacaaaaacaaccccttaagcctatgcctaagggttttcattattctatgctattattcccactcgatgatatgtatttttcacatgtgttttcgactattgatatacgttgtcatattagagttttatag

SEQ ID NO: 1114 - DNA, 309 bp, Staphylococcus epidermidis
ctattgattcatttgataaataacgacatcgaaaggaaggacaaaatgaagaagtgttcaatttccagtttatcatcaattattgtcacactcattagcatttttatatgttttacaaccatgtttacgaacatctataacaacactgactttaacttttggtatttcccaggagcaattatctttgttatctcaattattattaatattatagcaatgtttaaaggtaataagacgttaaacatcatcctattttttattaacttttttgccttacttatctttaccacaccatttgcaatcgtttaa

SEQ ID NO: 1115 - DNA, 1176 bp, Staphylococcus epidermidis
atggttactcaaaataaaaagatattgattattactggatcatttggtaacggtcatatgcaagtcacgcaaagtattgtcaaccaattgaatgagatgaatctcaatcatttatcagtcattcaacatgatttgtttatggaagctcatccaattatgacttctatatgtaagaaatggtatatcaatagctttaaatattttagaaatacatataaacgattttattatagtcgccctaatgagctcgataaatgtttttataaatattatggattaaataaactcatcaacttacttattaaagaaaagcctgatctcatattattaacatttccaacacctgtgatgtcagtattgaccgaacaatttaatataaatatccctattgcgacagttatgacagattatcgcatgcataaaaattggattacaccatattcacaaagatattatgtagcaacaaaagatactaaagatgatttcattgaagctggtgttcctgcttcatatattaaagtgacgggcattcctattgctgataaatttgaagaatctattgataaagaagaatggttatcgcaacaacatttagacccttcaaaacctactatattaatgtcagcaggtgcatttggtgtttcaaaaggctttgactatatgattaataatattttagaaaaaagtccaaattcgcaagtggtcatgatttgtggacgtagtaaggaacttaaacgttcattaaaagctaagttcaaagataatccaagtgtaataatattaggatatacaaatcacatgaatgagtggatggcatcaagccaactaatgattacaaaacctggtggtatcacaatttccgaaggacttagtcgttgtattcctatgatttttttaaaccctgcacccggtcaagaacttgaaaatgcatattactttgaaagtaaaggatttggaaaaatagcagacactccaaatgaggcaattgatattgtttctgacttaacaaataacgaagagactttaaaggttatgtcatctaaaatgctagaatcaaaggtaggatattctactagaaagatttgtaaagatttattagatttaataggtcactcatctcaaccggatgaaatctatggaaaggttcctttgtatgcaagattcttcgtcaagtaa

SEQ ID NO: 1116 - DNA, 1194 bp, Staphylococcus epidermidis
tttttcagtcatcatggctacaacgatattattcagtactttatttattgtttcgatctttattgtagacattttatatggtgttatcgatccaagaattcgtgtacaagggggcaagaaataatgagtaataaagaagatgttacaaacattaatggcgatatttctaatgcaacgatgtcacatacaagtaatgatatttcgaatacagattttattattagagatttagacttgaatcaagagccagaaatgccacgtcaaagtaagaatttttggcaagatgcttggtcacaattgaaacgtaataaattagcagtaatcggaatgataggtttgttgcttatagttattatggcatttataggaccattaatgaataaacacgattttgctgagcagaatgttgatcatcgtaatctcccagcaaaaataccattattagatcatgtttcatttttaccttttgacggtaaaggtacggacggtaaaaatgcttacaaagaagcaggtgcgaaagaaaactattggtttggtactgatcaacttggacgtgatttatggacacgtacttggaaaggtgctcaaatttcactttatattggtgtagttgctgcattattagatatttgtattggcgttgtatatggagccgtttctggtttctttggaggcagggtagatgatgtgatgcaaaggattttagaaattattgcttctatacccaatttaattgtcgttattttattcgtacttatttttgaaccatcaatttggactattatattagctatgtcaattactggctggctggggatgagtagagtggtacgtggagaatttttaaaattgaaaaatcaagaatttgttttggcatctcaaacattgggtgcttctaaattcaagttaatctttaaacatatattacctaacacattaggagcaattgtcgttacatcaatgtttactgttccaagtgcaatatttttcgaagcatttttaagctttattggaataggggtgcctgcgcctaagacgtcattaggatctcttgtcaatgatgggcgtgcaatgttgttgatacatcctcatgaattatttattccagcaatcattttaagtttattgattttattcttctatctatttagtgatggactacgtgatgcattcgacccaaaaatgcgaaaataa

SEQ ID NO: 1117 - DNA, 543 bp, Staphylococcus epidermidis
aggagaatacatatgaaaaaattattatgtacattatttgctgctgcactagtgttaagtgcttgtggccaagacgacactaaggaagatgaaaataaaaagtcagaaattactactgaaaagaaatctgacgataaaaaagacaaaaaaactaatgaggataaaaagtctggagaacaaaagaaatctcaagaaaaaaagaataacaagtcaatgcaagaatctgctacaaatgaacaggttcaatctcaacaacaaacgcaacaagctaatcaacaagcacaacagtctgataatcatgaacctacaaaagaagagatatatgaatgggataaacaaaacattcccggaggtacagattttggtttgattgatccagaagatgtaaatgaagcttcggaatctcaaaacgaagaaccagatgaatggattaaaggacaagaggaatggaataacgctactcaatcagaaaaagaggagctacgtaaacagaacgcgcaaaagtatggttatgagtatgatcctaaagattatgaagaataa

SEQ ID NO: 1118 - DNA, 1731 bp, Staphylococcus epidermidis
gtaattgttaatggaggtgctacggtggattaccaagctttgtatcgtatgtatagaccgcaaagttttgatgatgtggttggacaaacgcatgtaactaaaacgctgcgtaatgcaatttcaaaaggtaaacaatcccatgcatatatttttagtggtccgagaggtacgggtaaaactagtattgcaaaggtttttgccaaagctattaattgtcttaatagtgacgatggtgaaccttgtaatgaatgtgcgatttgtaaaggaatcacacaaggtacgaataacgatgtaattgaaattgatgctgcaagtaataacggtgtagatgaaataaggaatattagagataaagttaagtacgcacctagtgaatctaagtataaagtatatattattgatgaggttcatatgttaactactggtgctttcaatgctttgcttaaaacattagaagaaccaccagcgcatgctatatttatcttggcaacaacagaaccacataaaattccacccactattatttcgagagcgcaacgatttgactttaaagcaattagcagtgaccaaattatagatagacttaagtatgtagctaattctcaatctttggattacgatgacgcagcattagaatttattgctaaagcatcagaaggtggtatgcgagatgcattaagcattatggatcaagcaatagcgtttggagacgaacgacttactttacaagatgctttaaatgttacaggtagtgttgatgaagcggcattaaatgagttatttaatgacattgtaaaaagtgatgttaaagccgcatttaatagatatcatcattttatttcagaaggtaaagaagtcaacagactcattaatgatatgatttactttgttagagatacaattatgaataaaacgtctaacgaatccgttcattttgaatcacttattcatttcgacttagatatgttatacaggatgatagatatcatcaatgatacactagtatccattaggttcagtgtaaatcaaagtgttcattttgaagtgttgctagttaaacttgcagaaatgattaagacacagcctcaaactgtacaaaatgtagcaacagcatcggtagctaatgaaccagataatgagatgttattacaacgtttagaacaacttgaaaatgagcttaaaaccttaaaagaacaagggatcaaaactaataaagttagtcaacaacctaagaaaccaacacgtacgattcaacgatctaaaaatacgttttctatgcaacaaatagcgaaagtattagacaaagcaaacaaagatgatatcaaattgttgaagaaccattggcaagaagtgattgatcatgcaaaaagtaatgataaaaagtctttagtaagtttgctactgaattcagaaccagtagcagctagtgaagatcatgtgttagttaaatttgatgaagaaattcattgtgaaatagtaaataaagatgatgaaaagagaaacaatattgaaagtgtagtttgtaatatagttaataaaactgtcaaagtagttggagtgccggctgaccaatggctgagagtgagagcagagtacttacaaaatcgtaacaccaatgaaacacatcaaagcgaaaaacaaagcacacaacagtctcaacaaatagatattgctcaaaaagctaaagacttatttggtgaggaaactgtacacttagttgatgaagactga

SEQ ID NO: 1119 - DNA, 282 bp, Staphylococcus epidermidis
tttatgactaaacaagcaaacgcttcacgtttatcaagattattcaatgtagcaggattcattgtagatggttataacggaattcgctataatgctaagaataaacaacttgtctatttatcattaggtctaagcgcacttggaacaatcattgatttttacatttctattaaatctgcatctaaacttcgtaagttaagtgcacttggatcatttgcaatcaatggggtacgcttattcacaagttttaaaaaagttagagatgaatatgactatcactaa

SEQ ID NO: 1120 - DNA, 1248 bp, Staphylococcus epidermidis
cgtatgaataaaaataatagagttgttataacgggtatcggagccttatctccaattggtaacgatgctaaaacaacatgggacaatgcactaaaaggtgttaacggtatagataaaatcacaagaatagatactgatgattataatgtacatcttgctggtgaattgaaagattttaatatagaagaccacattgatagaaaagaagctcgccgtatggatcggtttacacaatacgcggtggttgctgcaagagaagcggttaaagatgcacaattaaatattaatgaaaaaaatgccgaccgtattggtgtatggattggttctggtatcggtggtatggaaactttcgaagttgcacatacaacacttgtagaaagaggaccacgtcgagtaagtccatttttcgttccaatgttaattcctgatatggctactggtcaagtttctattgatttaggtgccaaagggcccaatggttctacagtaacagcttgtgctacggggactaattcaataggtgaggcatttaaaattattcaacgtggtgatgcagatgcaatggtgactggtggaacagaggcacctattacacatatggcaatcgcagggtttagtgcaagtcgtgcattatctacaaacaatgaccctgaaacagcttgtcgaccattccaagaaggccgtgatggctttgttatgggtgaaggggcaggtattgttgtacttgaatcattagattcagctaaagagagaggcgctgaaatttacgctgaagttgtaggttatggttcctctggcgatgcacatcatattacagcacctgcgcctgaaggtgaaggtggctcacgagctatgcaagctgctttagatgatgctggaatcaaagctcaagatgtacagtatttaaatgcacatggcacaagtacacctgttggagatttatatgaggttcaagcgattaaaaatacattcggtgatgctgcgaagtcattaaaagtaagttcaactaaatcaatgactggacatttattaggtgctacaggtggaattgaagctattttttctgcgctatcaattcgtgattcaaaggtagcccctacaatacatgcaatcacaccagacgaagaatgtgatttggacattgttctgaatgtagcccaagacttagacattacctatgcaatgagtaatagtttaggatttggtggacataatgcagtgttagtatttaaaaaatttgaagactaa

SEQ ID NO: 1121 - DNA, 399 bp, Staphylococcus epidermidis
ttatcatgtaacagtatcatagcattttattggcgttttgtcggatatttgatatattggtgtaaagaaaattttaaagaggtgatactgatggaagaagcactaaaagatagtatcttaggcgctcttgaaatggtaatagatcctgagttagggatagatatcgttaatttaggtttagtatataaagttgatgttgatgatgaaggtttatgtacagttgaaatgacattgacttcgatgggatgtccattaggaccacaaattattgaacaagttaagagtgttttggctgagattcctgaaatttctgatacagaagtgatgattgtatggagtccaccttggaataaagatatgatgtcacgatatgccaaaatagctttaggcatcggataa

SEQ ID NO: 1122 - DNA, 210 bp, Staphylococcus epidermidis
ggatgtatcaacaacattgcacgcccatcattgacaagagatcctaatgacgtcttaggcgcaggcacccctattccaataaagcttaaaaatgcttcgaaaaatattgcacttggaacagtaaacattgatgtaacgacaattgctcctaatgtgttaggtaatatatgtttaaagattaacttgaatttagaagcacccaatgtttga

SEQ ID NO: 1123 - DNA, 1044 bp, Staphylococcus epidermidis
cgctataacaataacgtgctaagatttcatatcgaggtgaaagtacatatgaaatcaataacgcaggcttcatttatgaaaggtattatgtttacatttacgattgcaataatcagttatatattagctaaatttcctattttacatacgattggggcgttagctattgccatcatttttgcgatgatataccgccaagtcataggttatcctgagcatattcgtccaggtattacgtttgcatcgaaacgtttattaaaatttgcgattatcttatatgggttaaaattaaatatgggagatattctaggtaaaggttggaaattactacttattgatattatcgtaattatcttttcaataagtttaactttacttttgaatcaaattattaaaggaaataaagatatctctatactacttggtattggtacaggagtatgtggagctgcagctattgcagctacagcaccaatcttaaaatctaaagaaaaagacattgcaataagtgtaggtattattgcactagttggaactatatttgcacttatttatacagctatcgaggctatttttaacatacctactataacttatggtgcttggacaggtatcagtctacatgaaatcgctcaagtcgttttagcagcaggtattggcgggtcggaggcaatgacatttgctttacttggaaaattaggccgtgtgtttttacttattccattaagtattgtcttaattttgtatatgcgttataagtcacactcaagtcaagtacaacaaaaaatcgatattccttactttctaattggatttattataatggcttgtatcaatacatttgttcctattccttcattacttatgaatattataaatgttattacaacgttatgtatgttaatggcgatggttgctctaggattgaatatcgttttaaaagaagttatttcaaaagcacttaaaccattcattgtgatctgtataacttcaatttgtctgtctggtgtgactctcttagttacgtctataatgtttaaataa

SEQ ID NO: 1124 - DNA, 222 bp, Staphylococcus epidermidis
cgaataaacaagtggaggttatataatatgagatacctcatgacattcatttgggcagtattgttacttcaaatggttaatttcgtattgaatagcttaaatagtggaccagaactaaatgtaattaatccaattattattgctgtcatcttcactattgttgtagctattttagatccaattcttaagccgtctaaaggttcaaatcaatacgaatcttaa

SEQ ID NO: 1125 - DNA, 315 bp, Staphylococcus epidermidis
agtggaaacaataggagtatcatatatttaaaagaaggttcccaaaagttaatgattatcaatcgaggacctattgtagatatagataatcaaaaatatatatttgattattcagcatgtaattatcctgtcggtgtcgtagaagatcaaatatactattttaacgaagacaatatcgataaagtcgtttttgaaggttattctgatcaagatgagatgagatttcaagaattatttaaagaaatgaaaaataatttagatgatgatattcaacaaggtattgttcaaaagcaagataatttaggtttaatttaa

SEQ ID NO: 1126 - DNA, 432 bp, Staphylococcus epidermidis
aaggtagtaaaaaaaggagttacttataaaatgaaaaagttttttatatttttattaagtagtttattagtgctagctgcatgtggtaagaattatgaaatcagtgatattacaagcaaatttaaaaaagaaggtttaagtgtcgaaaacttacgaaaaatggaccgtgaagattttggtatggcaccaatgaaaactgaaaatgctaaaatatttactgtttcagaagataagaatgcacgtattttaaaatttaaaaatgaagatgacctaaaagaaatgaaaaagtattatgaagaattgggtaaatccagtgctacgttctattcacatgtatacactaaagataaatttttaattcaaatgaatggcgacattgacgatcatgtatttgaaaagtataaaaaagctatgaatgaggcattaaattaa

SEQ ID NO: 1127 - DNA, 183 bp, Staphylococcus epidermidis
tattatcaaaacttcacatcaatagaaattgagttgcgtaatatgatgttaatatttaaaccctatctattaatcattgataaattccttaatccacgtattcactgcaggcgctatattttcactgtcattgatatcgaaccatttcatgtcagtaatttcatgatcggtttcaacttttga

SEQ ID NO: 1128 - DNA, 258 bp, Staphylococcus epidermidis
gtattcaaaaatcatgttcaaagagaaaatattaattatgaaaatgaagatatagaccattcaaaaaaacatctaaattatgatttgataaatgacggaaaacaaaattttaatgatttgattgatgaaaaaattgagcggaactatacaggcaaaagaaaaattagaaaagacgcagtaaaacatatagacggaatgattacatcagataatgaattttttagtaatcagacaccagtaaatacaaaatttttttga

SEQ ID NO: 1129 - DNA, 393 bp, Staphylococcus epidermidis
agtttaaaaaatccaatgcaattttattatagtaattgtgaacagaatgcatcaaacttattagtcatcaacgtacaacctaatgaaggattttctttatgtgtgaatggtaagaaaagtaatcaaaataatgaaatgcaaaaagtgaagctttcttatactatgccgattaaagataaaatgaacacagttgatgcatatgaaaatcttatttacgatacattaattggagaacaaacaaactttactcattgggaagaattaaaaattcttggaaatttattgatgatattgaaaatgtatggaaacaagaatagccacagtttcctaattatgcctttggatgctatgggcctaaagaaagtgaaaaattacttagtgaagacggattga

SEQ ID NO: 1130 - DNA, 579 bp, Staphylococcus epidermidis
actttgaaaaaagaaattttagagtggattgttgccatagccgttgccattgcacttattgccataatcactaaatttgtcggaaaatcatattctattaaaggtgattcaatggatcctacattaaaagatggggagcgtgtagtggtaaatattattggctataaattaggtggcgttgaaaaaggaaatgtcattgtatttcatgctaataaaaaagatgattatgttaaaagagttattggaactccaggagatagtgttgaatataaaaatgatacactctatgttaatggtaaaaagcaatcagaaccatacttgaactataatgaaaaacgtaagcaaactgagtatatcacaggtagtttcaaaacaaaaaatttaccaaatgctaatcctcaatctaatgttattcctaaaggtaaatatttagttttgggggataaccgtgaggtaagtaaagatagtcgttcattcggtttaattgacaaagaccaaattgttggaaaggtatcgctcagatattggcctttcagtgaatttaaatctaactttaatccaaataacactaaaaattaa

SEQ ID NO: 1131 - DNA, 1557 bp, Staphylococcus epidermidis
catttaatgaatggtacatgttacactaaattcaaggagaggagtggctctatggaaaaaaatgaaaataaaatagttgatgtgattgcaacttctgatatgcatagtcacttcttaaatggtgattatggctcaaacatttatcgggctggtacttatgttaatgaagctcgaaaaaataatgaaaatgtcatattactagatagtgggggaagtttggcgggatcacttgcagcattttattacgccgttgtagcaccatataaacgtcatcctatgattaagttgatgaatgcaatgcagtatgatgctagtggaattagccctaatgaatttaaatttggattatcttttttgacacgttcagttgcactctcaaggtttccttggctatcagcaaatatagagtatactgttactagagagccatatttttctacgccttatacaatcaaaatgtattcagatttgaaaattgctatcgtaggtttaacatcagatggattaatgaagaacgagtacgcagaaatggaagaagatgtctgtattgagaagactttggtttcagctaaacgttggattagatacatacatgaagttgaagaaccagacttccttattgttatttatcatggtgggttaaataaaattagtagtgccaataaaagaaatgaaaaaaatgcaaacgaagctgaaaaaattatggaagaacttggtgttattgatgtaattattaccgctcatcaacatcaaacagtagttggaaaagatcatggaactatatatgttcaagcaggtcaaaatgctgaggaattagtacatctttcaattaaatttaagaaacgtacaacttcttatgagattgagcacatcgactcaaaagttattgacttaaatgattaccatgaagatgagcaattattaaaagaaacatattatgatcgtaaggcagtcaaacactgggcaaattcagtagtttcaaacaaaaacaatggcttaacagttcaatgtattgaagatattatttgtaagccgcatccttttactcaattattacatgatgcaattagattagcctataattatgatatttcttgtgtgcatatacctaagaatggtgaggaagggttaaaaggaactataagaaatagagatatatacgatgcataccctcatccagataaacctatagatatcactgtcaaaggtaaaaatatcaaagatatacttgaatacagttatgcgcatattgattttaataagcgacaattaagtatgacaatgatagatgaaacgttatttacagtttggcaagggtttgattattgtatagacatgtcacaatcaccgtttaatagagttaaattaaatggtctaaatgaagaagattcgtatagaataacaatgacagattattgttatagaaactacaaaatgtatttacaagaagctatcgttcacgacacatattcggaaacgatgggtggattgattagaaaaaatttaaaatgtgacatgtattctgtgaaattaaatcataattttaaagtttattaa

SEQ ID NO: 1132 - DNA, 642 bp, Staphylococcus epidermidis
aacaaaatgaaccagtgggatcaatttttaacgccatataagcaagctgttgatgagttaaaagtaaaacttaaaggattaagaaaacaatatgaagtgggagaacataattcaccaattgaatttgtgactggaagggtaaaacctatttcaagcgttatagacaaagcgaacaaaaggggtatcccttttgattgtttacatgaagaaatgtacgatatagctggtcttagaattatgtgtcaattcgtggatgatattgacatagttgttgatatattaagacaacgtcaagatttcaaggttatagaagaaagagattacattcgaaatacaaaagcaagtggctatcgttcttatcacgtgattattaaatatcctattgaaacactaagtggacaaaagcacatcttggctgaaattcaaatcagaaccttagcaatgaacttctgggctacaatcgaacatacattaaggtataaatatgatggggcatacccagatgagattcaacatcgtttagaaagagcagcagaagcggcatatttattagatgaagaaatgtccgaaattaaagatgaaattcaagaagctcaaaagtattacacgcaaaaacgtgctaagaaacatgaaaatgattaa

SEQ ID NO: 1133 - DNA, 747 bp, Staphylococcus epidermidis
ataggagtgaatgtaaaaatgaaagttaaatcaccacaatcaatctacttaaaaggacatcgtcaacaagctgtattgttattacattcttttacgggaactgtacgtgatgtaaaacatttagcacaacagttgaatgaagagggatttacttgttacgtgcctagttatccaggccacggtttgccgcttaaggaatttacccaacacaatatcaatgattggtgggaacaagttaccgcagcatatcaatttttaagaaatgaaggatacagtagaattaatgtgacaggcgtatcattaggcggattatttactttaaggttagctgaacattttgatttagaacgtatagctgtgatgtcagccccacataaaaagcgtgaaagcgagattgcgtggcgtcttgaaaggtatgggcatcgaatgaatgaaattttgagtttaagcgaagaagagcgtcgtcaccaaatggaaaccatcttgtcctatgataaagaaattgaagtgtttcaaggtgtaattgatgaaattatggcttatcttgcaaatattacagtaccagtgaatattatgtatggcgaagaagatgacccattatatgctcaaagtgcgcaatacatttatgataatgtaaatagtcaagataaagaactgctcaaatttgaaaaaagcggtcatcttatgacgtatggcgatcatgcatacagagtagaacaatctattattcaatttttcagtaaataa

SEQ ID NO: 1134 - DNA, 366 bp, Staphylococcus epidermidis
ataaaaaagaacatttataataacgtgattgcgttattatttgattggtttgttatttttagtagtattttaatttctgtaacttttaataacattttgatctatcttgtagctattatattaattggtagtagaatgagagcatttgataatttaatgcatgaagcttgtcatcgatctttatttacaaataagttttggaataaatggataacttgtttatttgttgcatttccagtatttactagttatacagcatatcgaaatgctcatcattgtactggattttttaaaactacattgcctggcttttatagtgtagttaaagatatttttacaccgaactatgaaaggaaagagagttag

SEQ ID NO: 1135 - DNA, 1146 bp, Staphylococcus epidermidis
ctgagttttgatatatacttattgagtatgaaaaagaataaaataggaggatcacaatctatgttcaataaggtttggtttagaacaggaatattttttattatgctgttcatactcatcaaactatttatggaagtgcatgaagtatttgctccaatagctactatcattggttcagtcttccttccatttttaattagtggatttctcttttacatatgtttaccttttcaaaacatattagaaaagtggggctttccacgttgggctagtataacaacaatattcataggattaatagctatcatcgctattgtggtatcatttatagcacctatcattatttccaatattaataacttaattaaacaaacaccatcattacaaaaagaagccgaacaattaattaatttctcgttaagacaaatggataaattaccagatgatgtcacacatcgtattaataaagcggttaaatccatgggagatggcgcaacgtctattttatctaattcagtgtcatatattacgtctttcatctcaactgtatttttattaataatggtgcctttcttcctgatatatatgctaaaagatcatgaaaaatttatcccagcaatcggtaaatttttcaaaggagaacgtaaagtttttgttgtagatttattaaaagacttaaacttcactttaaaatcatatattcaaggtcaagtgacagttagtatcatcttaggtattattttatatataggttatacgattataggattaccatatacacctttattagtattattcgccggcgtagctaacttaataccatttttaggtccatggttatcttttgcaccggcagcgatactaggtattattgatggcccttcaacttttatttgggtatgtgtcgtaacattaatcgcacaacaacttgaaggtaacgtgataactcctaacgtaatgggtaaatcattaagcattcatccattaactattattgttgtcatacttgcagctggagatttgggtggtttcacactcattcttgttgcagttccattatacgctgtaatcaaaacattagtgagcaacatttttaaatatcgtcaacgtattgtcgataaagcaaacagtaatgttaaagattaa

SEQ ID NO: 1136 - DNA, 1392 bp, Staphylococcus epidermidis
aatcaaattgaaataaatgttgaggtgaaaatcatgtcagttttaagtcagctgcttaaaaaatctagccctcaacaagggattatactctattatctatttgccatcgtcgttgcatttttattattaaatttgccatatgttcataaacaaggggttgaggttaatccaattgatacactttttgtagctgtatcaggtattagtgttacaggattatcaccaattactatagtcgacacatactcaacctttggtcaaattatcatacttattattttgaacatcggtggtataggtgttatggctattggaaccatgctttgggttgttttaggcaaacatattggaattagagaacgacaactcattatgttagataataatagagatactatgagtggaacggttaaactgattttagaaattgtaagaacaatttttattattgagtttataggtgcactcttactcgcgttctatttttatcgggataatcctgatttaaaaaacgcattaatgcaaggcatttttgtgtcagtatctgctacgactaacggtggtcttgatattactggtgaatctttagttccctatgcaaaagactattttgtacaaacaatagtaatgttcttaattgtgttaggatctataggctttccagttttgttggagttaaaagcatatataaagaatcgagtaactaattttaggttctcattattcacaaaaataacgacaacaacgtatttattcttatttttattcggcgttattgttgtattaatattagaacatagcaatgcatttaaaggattgagttggcatcaatcattattttatgcattgttccaatcatcaacgaccagaagtgcaggtttgcaaacgatagatgtgtcacatttcagcgacgcaacaaatattgtaatgggattattgatgtttataggatcatctcccagttctgtaggaggtggaatcagaacaacaacatttgctattttaattttgtttgttattaattttaataatactggtgacaaaacaggtattaaaattttcaacagagaagtacatattatggatgtacaaagatcatttgccgtatttactatggcgtcattaattacatttattagcatgattattatatctgccactgaacaaggcaagttgtcctttttacaaattttctttgaagtaatgtctgcgtttggtacatgtggtttaagcttaggtgtgacaagcgatgtcaacgacattaccaaggctgtattaatgatattaatgtttataggtcgtgtaggacttatttcattcattattatgttagctggacgtaaagaacccgaaaaatatagctatcctaaagaacgtatacaaattggatag

SEQ ID NO: 1137 - DNA, 333 bp, Staphylococcus epidermidis
ggaggaaatgaaattatgcgcggtggcggaaatatgcaacaaatgatgaaacaaatgcagaaaatgcaaaagaaaatggctcaagaacaagagaaattaaaagaagaacgcgttgctggaacagcaggcggaggtatggtgactgttactgtaacaggtcataaagaagttgtggatgtagaaattaaagaagaagctgttgatccagaagatattgagatgcttcaagatttagtattggcggctacaaatgaagcgatgaataaagcagatgagttaacacaacaacgtttaggtaagcatactcaaggcttaaacatccctggaatgtga

SEQ ID NO: 1138 - DNA, 330 bp, Staphylococcus epidermidis
gggctacgttttaaaatttcgtacatcccacttgcaatagtaatagaaacatccatcactgctccaagtgtacctattagtacggaagctagaaagacatccttaggagggagagtaaggaaagtgattgtttcgtattttattccatttcccccggtaaatttgatgatgacttcggtaattccaacacataagaacgtaccaatcagcgtacttacaatagtaattaaggttcggctatgccaacctgttacaagtagtaaagtgaaagaagtggaaatgataatagcacaagtcatcaaaaagaataaacttatagccccatattga

SEQ ID NO: 1139 - DNA, 612 bp, Staphylococcus epidermidis
aacatgatagaggtgacttttatgtctacgaataatgagattgaatttaaacaaatactaaatcaagatacttactcaaaaatctatgaactctatttcaaaaatcaatcaccttttaagcaaactaatttctatatcgacacagagaattttaaattaaaacagcatcaggctgctttgcgtataagggtcaaagattatatgtatgaaatgactttaaaagttcctgctgaagttggattgacagaatataatcactcagtaaatatagaacctaaacttgatatgtcacttcaactttcccaattacccaatgatattagaaatattttagaacaggactttaatattttagaaaatgagcttaaagtgctaggaaacttaactacctatcgtttagaaaccgaatatcaaaatgaattactagtattagataagagtgaatatctcggcaaaactgattatgaattagagtttgaagttcattcttatgatgaagggtattcaaaatttaaaagtttacttcaacattttaatcttcaacatcaaaaacccttgaataaagtgcaacgtttttttcaagaaaaacaaaatgcaagtgataaagattaa

SEQ ID NO: 1140 - DNA, 999 bp, Staphylococcus epidermidis
tggggtgaagagatgttaatggcaatcaatcagcaaggtcagaaaattttagcgcaacatgcaaacaaatttgataaatatcaatgtcctcactgtaagtctgaggtgatactcaaacaagggatgactttaatagctcactttgcgcataaaacacgttttaatcaccgctgttcaaagtcagaatcagttgaacattatgaagcaaagttatatttagcaagaatttataaagcattgaattttaacgtggaaattgaaccttattacaaagaagttttgcaatatccagatattgtgatcaatcaagaaaatgcaattgaagttcaattttctaaaataagtatcagtaaaattattcgccgaacaactggtttaaagcgaataggtttgaatgtgatttggattattaaagatgttcctttgaaatataaatacgttaaattatcaccatttcaaagtgcttttattcatccaattaatagaacattagtaacatgggattccaaaaagtttgtattaatattatatagtcaacttcaacatgtaggcggtaaaaattttgttgctcaaagaaaagttttaaaatttgaggatataataaatatgacttttcaatcaaataatgttcccaattttaggttatctgcttctaatatacaacgttatataaactattgtagaaagcgccacagtgttttagaacctacactcagtgccatgtatcaattaaatatgtatgattctgatgtaatttgtaaattaggatatgttgtaccacatcaaatatatttaataacgcatccaatagaatggcaattaaaatatttgttgctaagaagaacattaaatgacaacgaattatgtaaacaacttcttagtcaagtgaagtttagggtgtttgcaacgtttcaatacgacaaacgtcaaatattaagtactattttgcgtgaatttgattatttatatgaacacgaaagcttaaacgtgcaaaagtag

SEQ ID NO: 1141 - DNA, 1524 bp, Staphylococcus epidermidis
aataaaggagaattaattatgatatacacagtaacaaccacccttccattatcccatggtggtagaactcaagctttactcagacgaattaaactgttagatgaagaatttaaaattccaagtaaaattctcaccactaattatcatggtaattatcctagtatttataaaaaatacagacaagaaaacaaagttacagaaaatatacaattcgagaatatgtatgaatggttatcaaatttcaaactttttaaagtcccaaaaacattgattactaggaatccaaaatacattaaaacacctagaaagattaaaggacttattgataagcaaggaaaaaagagtggtcttattcattattataataatgaatgtcatgtgagatctcgaaagtattatggacagtctaatgttcttgaatatgaggacttcatttctcccacatcaggattgaaatatgagcgccatcaatataacttatacggccaacttcatagaaaagaatattattatgatgactcttctttaaaacatagcgacgaattatttgatactgagggctctatgtactgcaagagatatttcaaaactaaaccaaacagcaaaattaatggcgtagaaatatatagaaataaaaaactttataagacctttaaaaatgataaattattagctcagttttattttcagaatagattcaaaaatcaagatatcgtctttaatgatgctcgatttttagataaaccattacttaaacaaacgcaccaaacaaaaaatattcttgttttacatagctcgcatttatcaggggaccaaataaaaaaatcatatcgatttgctttaaatcaatcaaaaaatgtttataagtatattgttctcactcaccaacaaaagcacgatatacagcaacatttccatataagtgacgaccaattccaactagtaccacattttatcgaattagatacggaggtagaacaagattcctcaaacaatcaaaatcgctttatatatataggccgttttagcacagagaaacagattgatcatattattagagcttatcacaagtttttgcaaagtggttaccaaacagaattacatttatttggtagagatgaagataatcaaattccattgatgaatactttgatttcagaattaaaattatcggataaagttaaaatatttaaatataccaatcaacctttacaaaaatttaagaattctaaagcctctctacttacaagtcaatatgagggatttggcttaacacttatggaaagtatagaaatggggtgtccagtcctatcttataacgttcgttacggtccaagtgaaattattcaaaacgggataaatggctatctcattgaaaaaaatgatattgatagtttatcaaaacatatgattaacatcattgagcacccactacaaaaagtgaaaaataaagacactttaaaatataacgccgcagtgaataattacaaacaacttatgcaaagcttagacttattaaaatag

SEQ ID NO: 1142 - DNA, 2616 bp, Staphylococcus epidermidis
aataatttggatattaatcaaatgacatatgctgtacaaggtgccttacaaaaagcagtcgcgtacagtaaagaatatgaattacaaaacattgaagttgaagcattgttaaaagctgcaatgaatgaaaatgatagtttatttaaaagtatattagaacgagcaaatattgatgttgatcaattaataaaagcatacgataatcaattaagtcattatccaactgtacaaggtgacaatgttcagtatggacagtatattagtgctaaaacaaatgaattattagacaaagccgagaaatatatgaagtcctatgaagatgagtttatttctatggagcatatattacgtgcagccatagatactgatgaaactactcaaaaatgggtcggcaataaagtagaagtgataaaagaaattataactaaagttagagggggaaatcatgtgacatctcaaaatccagaagtaaactatgaagctttagaaaaatatggtcgtgatcttgtagaagaagtacgtcaaggtaaaatggaccctgtcatcggtagagatgaagaaatacgtaatacaattcgtatattaagtcgaaaaacaaaaaataatccggttttaatcggtgaaccaggtgtaggtaaaactgcaattgttgaaggtttagcacaacgaattgtacgtaaagacgttccagaatcattactcgataaaacgattttcgagcttgatttaagtgccttagttgcaggtgcaaaatatagaggtgaatttgaagaacgtttaaaagcagtattgaaagaagtaaaagaatctgaaggtcgaatcatcttattcattgatgaaattcatatgttagtaggcgctggtaaaactgatggtgctatggacgcaggaaacatgttgaaaccaatgcttgcgcgtggtgaattgcattgtataggtgctacgacattaaatgaatatcgtgaatatattgaaaaagattcagcattagaacgtcgtttccaaaaagttggggtcagtgaacctgatgttgagaatacaatatcaattttacgtggtctaaaagaacgttatgaggtctaccatggtgtacgtatacaagaccgtgcacttgttgcagcggctgagctatctgatagatatattaccgatagatttttgccagataaagctatagatttagtcgaccaagcttgtgcgacaatacgtacagaaatgggatcaaatccaacagagttagaccaagtaaatcgtcgagtaatgcaattagaaattgaagaaagcgccttgaaaaatgaatctgataacgcaagtaaacatcgtttagaagagcttcaagaggaattatctaatgaaaaagaaaaacaatcctctttaaaatcacgtgttgaacaagaaaaagaaaaaattgctaaagtacaagaaaaacgtgctgaacttgatagtagtcgtcaagctcttgaagatgcacaaacagaaggtaatcttgaaaaagcagcagaattacaatatggtacaattccgcaattagaaaaagaattgcaagaatttgaggaagcctttcaagatgaaactggcgaagatagtgaaagaatgattcgtgaagtcgtttcagatgaagaaataggcgacatagttagtcaatggacaggtatacctgtatctaaacttgtggaaacagaaagagaaaagctattaagtttaagtgacatcttacacaaacgtgtagtaggtcaagataaagcagttgatttagtatcagacgcagtagttagagcacgtgctggaattaaagatccgaatagaccaatcggaagtttcttattcttaggacctactggagtaggtaaaactgaattagcaaaatcgcttgcttcatcacttttcgattctgaaaaacatatgattagaattgatatgagcgaatatatggaaaaacatgctgtatcacgtttaattggtgcacctccaggttatgtaggtcacgatgaaggtggtcaattaactgaagcagttagacgtaatccatactcagttattttgttagacgaagttgaaaaagcacatagcgatgtttttaatgtattacttcaaatactagatgaaggtcgtcttacggattctaaaggtagaagtgttgactttaaaaataccattatcatcatgactagtaatattggttcacaagtattacttgaaaatgtaaaagatgctggtgaaattagtgatgatacagagaaagcagttatggacagtctacatgcatacttcaaacctgaaatattaaatcgtatggatgacatcgtgttatttaaaccattatcagttgatgatatgagtatgattgtagataaaattttaacacaattaaatatgagattattagatcaacatatctcaattgaagtgacagaagaagcgaaaaaatggctaggtgaagaagcgtatgaaccacaatttggtgcaagaccattaaaacgctttgttcaacgacaaatagaaactccaattgcacgtatgatgattaaagaaagtctacctgaaggtacaataattaaagtagatttaaatgacaataaagaacttgattttaaggttgttaaacctacgtcttaa

SEQ ID NO: 1143 - DNA, 630 bp, Staphylococcus epidermidis
aacaagatggattatgtatacacaatttataaaaatcctagatataacatcattcaaaaagataatcgctatttaatggtcgatttagaacaaaattggtattcatatttatgtccaatgctgaattggtttatacctattaaattcacagaattaacttatcaagaattcaataatataaacatatttcataatggaggacaaaagagtcatggtatgatggctgctggcgttggcgtcactatcagtgtgctattaagaagtcttgtgggttatatagatattaatattagtcgaatttggatagtttttatgtttttaattggatttgttgctgtgatcacacttcgtttatctataagaaagaagttaaatcatccagcatttaataaaaagagtaaacaaaaagtaatattgataccatcatttaaaaatatgatattggtggtgttttgctattttatgatgctgtttttctcaattgcaccttttcaaatgatttttgaggaaaagaaaaacatcttaggatatatactttgggtaggtgtattatttatatttactactttgaatatggcttcaatttctgatagaaaagtacatgccaaaattaaaaatataagaagatag

SEQ ID NO: 1144 - DNA, 399 bp, Staphylococcus epidermidis
aaaaaggaggaaattatgaagaatgtaagcccgtttatttacgttaaggacgtagataaatctttatgttattacaaagatgtatttaatgctcaaacagaaatacttatgggtaaagatggtcgaacttatcatgcccaacttattattggtgatgaaacgttcgtacatttctccgatacgtttcataagcatcccgtttctaaaaatcctcatcttattattgaatgtgattcattagaagagttggagcgtgtctataaaaggttaattgatgatggtggtcatgctaaagtaaaactcaataaaactttttttaatgcctatcatgcagaggtaaaagaccgtctcaatggtatcatttgggtatttaattactttttagatgaacatatataa

SEQ ID NO: 1145 - DNA, 189 bp, Staphylococcus epidermidis
ataggaggtttcattaatgtccataaattcttatttgatttcgtcattatttacgccagttttatcaataattatatggttattttattcaaatcactttataaatttaatcaatatcttattttatacatcattcattatttttatagttgctttccttattttactcattcaagaaggaatatttga

SEQ ID NO: 1146 - DNA, 384 bp, Staphylococcus epidermidis
tatgttaaactagtatggaataaggaggaaacaagcatgcgtatttacataaatgaaattaaattaaaagatgatggcgtttattgcttctcagaagaatctacagagggactagaagaggtaggtcaaatgcttgttgatagtgataattatggttttgcttatcttttagatgatggacaatcatattcatatttgatttttgttcaggaaacatggtcgatgttgcatgagaatagagataaacgaatcattattaataatcatttagaactaaagcatttccaagaagaattagattatgttttgaataacatagaaggaaacaataactatggtaaggagtttgtttcagctgttgaaaaaactttcgaactagagtga

SEQ ID NO: 1147 - DNA, 387 bp, Staphylococcus epidermidis
atgattaaatgtgtttgcttggttgaagaaaagaatcatcagttactacttgtacaagttcgacatagagataagtattatttcccgggtggtaaaattgatgagggtgagagccttgtggaagctttacagagagaattgaaggaagaattgcgcttagaattagctaaagatgaattagaatttattggaactattgtcggagaagcctatccacaacctaatatgttgactgaacttaatggatttaaagttaatcgagctatagattggtcaaaagttgaaaccgatcatgaaattactgacatgaaatggttcgatatcaatgacagtgaaaatatagcgcctgcagtgaatacgtggattaaggaatttatcaatgattaa

SEQ ID NO: 1148 - DNA, 258 bp, Staphylococcus epidermidis
tctgaaaagtgcttgatttctaaatcaatatcatcttttttagctaattctttaactttttcccaagccttcgtgtcgttggatgcaacacctatggttacctttttaccattattaccgccacatgctgataaaactaaaattgcaacgattaaaaaacttaaaatctttttcataaatgaattccccctaaatatttataaaacacttactagtattttaatttctacggataaccctagcgataaagttacctaa

SEQ ID NO: 1149 - DNA, 261 bp, Staphylococcus epidermidis
ataaaggagtgtagaaatatgaaacgtacatttttattaacttatacaaccgtatcaggaaaaacatatacggaatttaaaacatttgaaaatggtcccgattacgatacatgtgtatcacgaattatagatgaatttgatgaattggcatacttatatattaaaaaagatgttgtacattatattaatgttgatcacattgaaagtctagacattgaagaagtgacagagggacaacacattacttatgattttgaataa

SEQ ID NO: 1150 - DNA, 291 bp, Staphylococcus epidermidis
tttgttatacgcaaagcttcatatggacaaacgcctcacgtgcactttgaaattgtaccaattacagaagatggacgattaagtgctaaagatgttgtaggtaataaaaaagcattagcaagctttcaagataaatttaatgagtatgtaaatgaacgtggttatgaattagaacaaggaacttcaagagaattaacaaatagacaacacgatcaagttaatagttataaacaaaaaacagaatatcataagaaagaatatgaacgtaggtataaaattcagcccatataa

SEQ ID NO: 1151 - DNA, 1365 bp, Staphylococcus epidermidis
aaaggcatacgtgtttcaatatcatacatatataaaggagagacagctatgaataaaattataatagtcggtgcagttgctggtggtgcgacttgtgcaagtcaaattcgaagattagataaagagagtgaaatcattgtttttgaaaaagatagagacatgagctttgctaattgtgcattaccttattatattggcaacgttatcgaggaccgtcgtaaagttttagcatacacgcccaatcaattttatgacaaaaagcaaatcactgtaaaaacataccatgaagttatacaaatcaatgatgagagacaaaaagttactgtcttaaatcatcaaactaatcaaacttttgaagaaagctacgatacattgattttaagtcctggcgcatctgcaaatcgattaaacactcatagtgatatctcatttactgtgcgaaatctcgaagatactgaaacaattgatacctttattacgaataccaaagcacaacgtgcacttgttgttggcgcgggttacatctctttagaagtccttgaaaatttacatcatagaggtttggatgtcacatggattcatcgctctacaaatattaataaactgatggatcaagatatgaatcaacccatcatcgacgaaatagaaaaaagaaatatcacttatagatttaacgaagaaattagtcacgtcaatggacatgaagttacattcacatctggtaaagttgaaaactttgatcttattatcgaaggtgtaggtactcatccaaattcacaatttattaaatcatctaacgtcatactgaatgataaaggatatatcccagtaaatcataatttccaaacaaatataccaaatatttatgcattaggtgatgttattacttcacattatcgtcatgtgaatttaccggcacaggttccacttgcttggggagcacaccgtggtgcaagtattatagctgaacaactttctggaaattcgtctattcactttaaaggttatctaggaaataatatagtgaaattttttgactatacattagcaagtgttggcatcaaaccaaatgaacttaaaaatttcgattatgatatggttgaagttaagcaaggagctcatgcaggatattacccaggaaattcaccactacatttacgtgtttattttgaaaaagactcgagaaaacttatacgcgcagcagcagttggtaaacaaggtgccgataaaagaatagacgtattatcaatggcaatgatgaataatgctactgtggatgatttaacagaatttgaagtagcatatgcacctccttatagtcatccaaaagatttaattaatttaattgggtataaagcgcaataa

SEQ ID NO: 1152 - DNA, 495 bp, Staphylococcus epidermidis
aaagccatgcgctatgtgtatggttcagaaaaggttttaccgttatctaaaaaaacatctcatcatgctagaatatatattggccagccaaccaaaatattcaacacgaggagatgctttttaatgtcatctgacacaaacggtttagcacatacaaaatggaattgtaagtatcacatagtctttgcaccaaaatatagaagacaagtgatatatggaaaaatcaaaagagatattggagtgattttacgtcaactatgtgaaagaaaaggcgtagaaataatagaagcagaagcatgtaaatacccagttggtgttgttgaagatcaaatatactatttcaatgaagataatattgataacgttatatttgagggctattctgatcaagatgaaacaagatttcaagaattatttaaagagatgatgggtaatttggatgaagatattaaacgtgggactgttcaacaaaaagatagttacggattgatttaa

SEQ ID NO: 1153 - DNA, 1503 bp, Staphylococcus epidermidis
aaaaaggagcgatacattttgaatgcaagtgcgttgttcaaaaaaattagagtaaaaaatgtaattggtacattagatatacaggtggacgatattaccactgactcacgtacagctaaagagggaagtctatttgtagcatctaaaggatatacggtagatagtcataagttttgtcaaaatgtagtagatcaaggttgtggtattgttgttgtcaatagagaactcgaacttaaaggtaatgtgacgcaagtcgttgttcccgatactttacgtgttgcaagtctattggcacatgaattatacgagtttcctagtcatcaactgacgacatatggtgttacggggacgaacggtaagacatcgattgcaactatgattcatttaatttatagaaaattgaataaaaatagtgcatatctaggtacgaatggatttcaagttaatgaaacaaaaacaaaaggtgcgaatacaacaccagaaacagtagcattaacaaaaaagatcaaagaagcagttgatgccaatgcagaagcaatgacgatggaagtttctagtcatggattggccttaggtcgacttagaggcgtagagtttgacgttgctatcttttcaaacttgactcaagatcatttagactttcatggaactatggaagcatatggacatgctaaatcgttattatttagccagttaggtgaagatttgtctaaagaaaaatatgttgtattaaataatgatgatgacttctccgattatttagcaagtgtgacaccctatgaagtatttacatatggtattactcacgaagcacaatttatggctaaaaacattaaagaatcattgcaaggtgtagaatttgaattttgtactccatttggaagttttccagttaaatctccttatgtaggtaggtttaacatttcaaatattatggctgctatgattgcggtttggagtaagggaacaaatttaaatgaaattattaatgctgttactgagcttgaacctgtagaggggcgcttagaagtacttgatccatcacttcctatagatttgattatagattatgcacatacagctgatggtatgaataaactgattgatgctgtacaaccatttgttaaacaaaagctaatctttttagtaggtatggctggggaaagagatttaacgaaaacacctgagatggggagagtagcatgtcgagcagattatgttatttttactccagataatcctgctaacgatgatcctaaaatgttgacagctgaattagctaaaggtgcaacgcataacaattatatagagtttgatgaccgtgcagaaggtattagacacgcgattgatattgctgaaccaggtgatacagttgttttggcctcaaaaggtcgagagccttatcaaattatgcctggtcatgttaaagtcccacatcgcgatgacttaattggcttaaaagcagcatatcaaaaatttggtggtggacctcttgaggattaa

SEQ ID NO: 1154 - DNA, 1782 bp, Staphylococcus epidermidis
agaaactataggagtggtcttctagtggataacaataaaaaacaagtcataccacgcagtcaatatcgacgtaaaagacgtgaatactttcataacgtagagcgagaagagcgcataagacgtgagaaaatagagaaggaaaatcaagctaaaagagaacaacatcaaactaaagtcaatgaggaacgtgttaaagataatttgagaaaagcaagaatagagaagctgacacaagaagaaatacatcaacaacgtgatgataaaagttataaacaaaaaactttaaatcaaaataatcaaatgaataaatctaaagacgacgataataaaattggagaagaaagtctacatgatgtgcgagtttcaagtgatacctccactttaccgcatcaaaataagtcaataaaagactatgatgattctggaaacgaaagtaaacaacatactaaattgacttcaaaggaatctatgctaggcgtaaattctaatcatactgagcaagattcaagaagtacacaaccatattcttcaaaacatagctattcacaaccaaaagataaagacaacgataatactcaacaagcgcaatttcttaaaaaagaagacaaacaacgtaacagagccgaaaatataaaaaaagttaatgaatttaaacaattggtggtagctttctttaaagaacactggcctaaaatgttaattattatcggtattatagtattacttttaatattaaatgccatattcactacagttaataaaaatgatcatacaaatgatagtgcatttaacggtacagctaaagatgaaacaacagcgatgaaaattgctgaaaactctgttaagtcagttgtaactgtcgagaatgatttgtctaatgacacgactgtgtctgataacaaaaatgaatctgataatgagataggatcaggtgtcgtctacaaaaaagtgggcgactctatttatatttttactaatgcacacgttgtcggtgatcaagaaaaacaaaaagtaacatatggtaatgataaatctgtgacaggtaaggtaattggtaaagataaatggtctgatttagcagttgtaaaagctaaagttgctgacgaaaatattaaaccaatgactatgggggattctaataatattaaattggctgaacctattttagttataggcaatcctctaggcacagactttaaaggaagtgtttctcaaggtattgtgtctggactcaatcgtcatgtacctgtggacattgataaaaatgataattatgatgctttgatgaaagcttttcaaattgatgcgcctgtgaacccaggaaattcaggtggtgctgtggtcgatagagacggtagactcataggtatagtttctttaaaaattgatatgcataatgtagaaggaatggcttttgcgatacctattaatgatgtacgtaagattgcgaaagaattagagcataaaggtaaagtgaactaccccaatactgaaatcaaaatcaaaaatgttggtgaccttgacgattctgaacgtaatgcaatcaacttaccagctaaagtgaatcatggtgtattaatcggtgaagtgaaagaaaatggtttaggagacaaagcaggtttaaaaaaaggtgatgtaatagtagaattagatggtaagaagattgaagataacttacgatatagacaagtcatatatagtcattatgatgatcaaaaaacaattactgctaaaatttatcgaaatggtgcggagaaaaatattaaaatcaaattgaaataa

SEQ ID NO: 1155 - DNA, 393 bp, Staphylococcus epidermidis
tcaagaaataggagtcgtccagttatgaaaaagacgaaaggtatttatgaatctgaaattagtaaagccattacacaatgggagaaagattttttaggaagaggttctttgtctgtaaaaacagatattcttcgtgatatggttattgttagtttacaaggtattttgacacctgctgaatatcgcgtgtgtaaaacgaatgaagggcttttaaatattaaacgtacacgttctgaacttgtagagtctggtgaagaggacttgagtcgcattattaaagatttgactggacttaatgtgaaaagttttcatagtgatttaagtactattaccggtgaacgcgtaatgatttttaagttggaagatcgttttgataaagcattacatgagtaa

SEQ ID NO: 1156 - DNA, 954 bp, Staphylococcus epidermidis
agagggtggcttttaatgagtaatgaaaatgtattattacaagttaaaaatttaaaacagtattttaatcaaggtaaacataatgaagttaaagcgattgataatataagttttgatgtttataaaggggaaactttaggcctagtaggagagtctggatgtggtaaatcaacgactggaaaagccattatcaaattaaatgatattactgatggcgcaatcgagtatgatggtaaagatattcatcaaattagaaaacgtaaagagcgattgaagtttaataagaaaattcaaatgatatttcaagatccttatgcatctctaaatcctcggttaaaggtaatggatatcgtagctgaaggaatagatattcacaaacttgctagtagtcagcgtgatcgaaagaaacgtgtatacgaccttttagaaacagttggtttaggtaaagaacacgcgaatcgttacccacatgagttttcaggcggacaaagacaacgtattggtatcgcacgtgcattagctgtagagccagaatttattattgcagatgaaccgatatcagcattagatgtatcgattcaagctcaagtcgttaatcttttattaaagctacaacgtgaacgtgatattactttattgtttattgctcatgatttatcaatggtgaaatatatttccgatagaattgcagtgatgcacttcggtaaaattgtagaaattggaccggctgatgatatttataattatccattacatgattatactaagtcattattaagtgccattccacagcctgatcctgatgttgagagaaatcgtcaacgtgttttatatcatgaagatgcaacgcttaatgaagaacgtcaattaaatgaaattagaccacaacattatgtattttctactcaaaacgaagcagttaaattgaaacaaaagtatggtttgtctgtttaa

SEQ ID NO: 1157 - DNA, 273 bp, Staphylococcus epidermidis
tcagtttcaagagtaataaaaatagcacaaagaattatggaggattacgaatgtataaaatctgttagcgccttagaagataaagagaaggaaatacgagagaaagatgatttattaaataaagcagttgggcgtattgaaaatacatacgataatttcaatcgactttacgaaatggcaaagccatttaaagagaatgtagaaatagctttaaagcttttaaaaattttactaaaagagctaatgaagaaacacatttgcggaaagagttaa

SEQ ID NO: 1158 - DNA, 1545 bp, Staphylococcus epidermidis
atagagtcaagaaagacatttgccatcatttcacaccccgatgctggtaaaacaactttaactgaaaaattgttgtatttcagtggagcgattcgtgaagctgggacagttaaagggaaaaagacgggtaaatttgcaacaagtgattggatgaaggtaaaacaagaacgtggtatctcagttacaagctctgtaatgcaatttgattatgatgattataagataaatattttagatacgcccgggcatgaagatttttcagaggatacgtatcgtacattaatggcagtagatagtgcagttatggttattgactgtgcaaaaggtatagaaccacaaacattaaaattatttaaagtttgtaaaatgcgaggtatccctatttttacattcatcaataaattggatagagtagggaaagagccatttgaattacttgatgaaatagaagaaacacttaatattgacacttatccaatgaattggcctgttggtatgggacaaaatttctttggtattattgatagacactctaaaacgattgaaccatttagagatgaagaaaatttattacatttaaacgaagattacgaacttaaagaagaacacgcgataaaaaatgatagtgcatttgaacaagcaattgaagaaatgatgcttgtcgatgaagcgggtgaagcatttgataatgaagcgttactgaacggtgaattaacacctgttttctttggatcggcattagcaaacttcggcgtacaaaatttcttaaatgcatacgttgatcatgcgccaatgcctaatgcgagacaaactaaagaagaggttgatgttagtccattcgacatagatttttctgggtttatctttaaaattcaagccaatatggatccaaagcatcgtgacagaattgcatttatgcgcgtggtaagtggtgcgtttgaaagaggaatggatgtaaccttacaaagaactaataaaaaacaaaaaataactcgttccacatcatttatggctgatgataaagaaactgttaatcatgctgtagcaggcgatattattggtttgtatgatacaggtaactatcaaataggcgatactttagttggtggtaagcagaaatatagtttccaagagttaccacaatttactccagaaatatttatgaaggtttctgccaaaaatgtaatgaaacaaaagcattttcataaagggattgaacagcttgttcaagaaggtgcaattcaatattataaaacgttgcacacaaatcaaattatcttaggtgctgtgggtcaattacaatttgaggtgtttgaacaccgcatgaataatgaatataatgtagatgtggttatggaaccagttggacgtaaaattgcgcgttggattgaaaatgaagaagatattaaagataatatgaatacttctagatcaattttagtaaaagatagatacgacaattatgtattcctatttgaaaatgaatttgcaacgcgttggtttgaagaaaaattctctgatattaaactgtatagtttattataa

SEQ ID NO: 1159 - DNA, 486 bp, Staphylococcus epidermidis
aaagcacaaaggtttgcaaaattaaaaagtgccagacgtgtcattgccattgatcatgttgagcatagattagctcataccgagaaatataacggtgctgaggtttataattttttaaaagaagatgacgtaggaaaactattacatgaaacaacacgcggtggtgcagatgttgttatagattgtgtcggaatagatgaacaagtagttcaagatgacttagaagttagctcaaattcaatacagagaggaaatatcagcccaattgttacggcaacagaatcagtgagaaaatatggaacaatccaattgataggtgtctatggaactgcagctgataactcccaattagacttaatatttaatagaaatgttcaagtgaaaagtggacaagcgccagttattcatatgatgccaaaactttatgacatgattaaaataaagtctttgatccaacagaaattatcactcatactatgcctttaa

SEQ ID NO: 1160 - DNA, 354 bp, Staphylococcus epidermidis
tttcatatgagttatgaaaatgcttgtgatgtgatctgtgtacatgaggataaagttaacaatgctttaagttttttagaagatgataaatctaagaaattacttaacattttagaaaaaatttgtgatgagaagaaattgaaaattatattatctttgattaaagaagatgagttgtgtgtttgtgatatttctttgatattgaaaatgagtgttgcttcaacttcacatcatttaagacttttatataaaaatgaggtacttgatttttataaagagggaaagatggcatattattttattaaagacgatgaaataagagaatttttctctaaaaatcaggagggtttttga

SEQ ID NO: 1161 - DNA, 729 bp, Staphylococcus epidermidis
gatgatatgagaatagaacgtgttgatgatacaacagtaaaattgtttataacatatagtgacattgaagcacgtggttttagtcgtgaagacctatggagtaaccgtaaacgtggtgaagaatttttctggtcaatgatggatgaaattaatgaagaagaggattttgtagttgaaggtccactttggattcaagtacacgcttttgaaaagggcgtggaagtaacaatttctaaatcaaaaaatgaagatgctatgaatatgtcagatgatgatacaaatcatcaatttgatgatcaggtaaatgaattattggctcaaacacttgaaggtgaagaaagtttagaagatttatttgaacaacgtaaacaacaaaagaaaaaccatcaagataaacaacaaagacgtgcgcataagccatcaaatgtgagaaatattatagtgaagtttgacgatttagagcaagttatcgactatgcttatcataataatcaaaacactgatgaatttgaagatttattatatatgattgataataaatattattactcaattcattttgatgattcagtttcacaagagatgattaacgatagttatagtcagttattggagtttgcatatccaactgataaaacaaatatttatttaaacgactacgctaagattattatgagtcacaatgttacttctcaagtacgtaaatactttactgatacaaacgaataa

SEQ ID NO: 1162 - DNA, 1407 bp, Staphylococcus epidermidis
atatgttttggaggtgttaacatgtctaacgaaactgaaatgaaagacaacgttcgtgaagacgtatatgataaagaattatttgatcgattattagatcaaaatgatatagatgaattcagaaaagaatttttagaattacataactatgaacaaagtgaatactttgaagatacggatgatgaaaatagacaaaaaatatttgagtttttatcacccaaagaagtagcaaatttctttgatcaattagactttgatgacgatgattatgagagcctttttgataatatggacgctacctatgctagtcatgtcttagaggaaatgtcttacgataatgcagtagatattttaaatgagttatctaaacctaaagtggcgagtttgctaacattaatgaacaaagataaagctaatgaaatcaaagctttattacattatgaagaagatactgccggcggtataatgactacggagtttatctctttaaaatcaactacacctgttaaagaagcgttaattcacgtaaaagaacaagcgcctgatgctgaaacaatatatgtcatattcgcagtaaatgaagatgaacaacttgttggtgttctatcacttagagatcttattgtagctgagaatgatgcatacattgaagatgttatgagtgaacgtgtcatcagtgctaatgtcggtgatgaccaagaagatattgctcaattaatgagagactatgattttatagctgttccagttgtagattatcaaaatcatttactaggtattattactattgatgatatcctggatgttatggatgaagaagcaagtgaagactactcacgattagctggggtatctgacatagattctacaagtgactcagtgtttaaaacggcgagtaaaaggttaccatggctcattgtattaacatttttgggtatgattactgctacaatattaggtagttttgaagatactttatctcaagtggcattacttgcagcatttattccaattataagtggtatgtcaggaaattctggtacacaatcattagccgtttctgtccgtaatatatctactggggaaataaatgaacagagtaaatttaagattgcattgcgagaagcgggaagtggtttattatctggtattgtatgtgcagttatccttttcctaattattgtcgtcatattcagacaaccgttattagctttaatagtaggtggaagtttgacatgcgcaatgacagtaggtacattagttggttcaatgattcctttagtaatgaacaaatgtaaaattgatcctgctgttgcaagtggtccttttattacaacaattaatgacattgtgagtatgcttatttatttcggattagctacatcattcatgtcatacctaacataa

SEQ ID NO: 1163 - DNA, 510 bp, Staphylococcus epidermidis
atgattttaggattagcattggttccgtcaaagtcatttcaagatgaggtgaatgcttatcgcaagcgatatgacaatcattatgctcaaataatgcctcatatcacgattaaacctcaatttgaaatcgatgatcatgattttaatttatttaaaaatgaagtgaaaaatcgaatttctagtattaaaccagtagaagtgcatgctacaaaggcatctaatttcgctccagtcagtaatgttatatacttcaaagttgctaaaacagagtcattagagcaattatttaatcaatttaatacagaagatttttacggtatagctgaacatccttttgtacctcattttacaattgcccaaggtctaacaagtcaagaatttgaagatatatatggtcaagtaaaattagcaggggtagaccatagagaaataattgaagaactatcgttacttcaatatagtgaagaagaggacaaatggactattattgaaacttttacattagggtaa

SEQ ID NO: 1164 - DNA, 1647 bp, Staphylococcus epidermidis
aggatgaaaggttttaaagtcttaattattttattaagtgtatgcataattttatctgcttgtagtaataagcagagtttatattcagaccaggggcaagtttttaggaaggtaatcacacaagatatgactacactagatacagctttaattacagatgctgtttctggtgatatagcagctcaagcttttgaaggattatatactttaaataaagaagacaaagctgaaccagctattgctaaatcttttccaaagaaaagtaatggtggcaaaacacttacgattaatttaagaaaaaatgcaaaatggtccaatggagattcggtaactgcatatgacttcgtatatgcgtggagaaaggtagttaatcctaagacggcttctgagtttgcatacataatgagcgatataaaaaatgcagatgaagttaatgcaggtaaaaaatcagtcaaggatttgggtatcacggctataggtaaatataaattacaagtagatttagaaagacctgtaccttatattaatgaactattagcacttaatacatttaatcctcaaaatgagaaagttgctaaaaagtttggagaacaatatggtacaactgctgaaaaagcagtgtacaatggaccatttgaagtaacaaattggaaagtggaagataaaattcaattagttaaaaatgaacaatattgggataagaagaatgtaaaattagataaagtgaactataaagtattaaaagatcaacaagcaggtgcatcgttatatgatactggctcggtcgatgatactattataacttctgaacaagttgataaatatagaggagaatctgctttgaattatcgtttaacagcagcaacattctttattaaaatgaatcaaaaaacagttcctgaatttaaaaataagcatttaagattggctatatctcaagcaataaataaaaaagggtatgtcaattctgttttaaatgatggttcgctaccatcaaataattttactggagtaggaactgccgatacaccggatggcaaagattttgcaagaaccatcaaatcaccattaaaattcaaccctgatttagcgaaaaagaattggagagaagcacaaaaagaattaggaaaaaataaatttacttttacgatgaacacacaggatacacctgcttcaaaaattgctgccgaatatataaaatctcaaattgaaagtcatttgccaggtgtgacactcaaaattaaacaaatgccatttaaacaaaaaactactttagaattagcaaataactatgaagcaagttattcagggtggagtcctgattatcctgacccaacagcatttcttcaaacaatgacaaaaaataatgcacagaataatacagattggagtaataaagaatacgatcaattactcaaagatgctaacagcaagtttttacgaaagccaggtgaacgtaatacctcattacaaaaagcggaatatatcttattacatgaagcgccagtcgctcctgtttatcaaaaaggagaagcacacttaacgaatccgcaagtaaaaggattacaatatcacaaagtagggcctgaaacgacgcttaaacatgtctatattgataaatcaatcaatagggagacaggtaaatag

SEQ ID NO: 1165 - DNA, 993 bp, Staphylococcus epidermidis
agtagaggaggatttcaagtgcaaaaaaaatatattactgccattattggaacaactgcccttagcgcattggcatcaactcatgcacaagctgcaacaacgcatacagtaaaaagtggagaatctgtatggtcaatttctcacaaatatgggattagtattgctaaattaaaatcacttaatggattgacttccaatttaatattccctaatcaagtattgaaagtatcaggctcatcttcaagagcaacgtcaacaaatagtggcacagtttatacagttaaagctggagattcattatcttctattgctgcaaaatacggtacaacttatcaaaaaatcatgcaacttaatgggttaaataactatcttattttccctggacaaaagttgaaagtttctggtaaagcgacgagttccagtcgtgcaaaagctagtgggtctagtggtcgtactgcaatatatactgttaagtatggagactcactatctgcaattgctagtaaatatgggacaacgtatcaaaaaattatgcaattaaatggattaactaatttctttatctatcctggacagaagttaaaagtgcctggaggtagttctagtagctcatcttctaataatactagatcaaacggtggctattattcaccaacttttaaccatcaaaacttgtatacttggggacaatgcacatggcacgtatttaatagacgtgctgaaataggaaaaggtatcagtacatactggtggaatgcaaataattgggacaatgcatcagctgctgatggatatactattgattatcgtcctacagtaggctcaattgcacaaactgacgctggttactatggtcacgtagcgtttgtagagcgcgtgaatagcgatggaagtattttagtttcagaaatgaactggagtgcagctcctggaaatatgacatatagaacaattccagcttatcaagtgagaaattacaaatttattcattaa

SEQ ID NO: 1166 - DNA, 204 bp, Staphylococcus epidermidis
tttaagggaggactcgtaatgactgttgcagaagtaggtaatatagtagaattttatgacggtttaagaggccgtgtcgagaagattaatgataactctgttattgtagatttaactattatggataattttaatgaattagatttaccggaaaagacagttatcaatcataagcgatacaaaatcgttgatcaagaaggttaa

SEQ ID NO: 1167 - DNA, 1050 bp, Staphylococcus epidermidis
gtgttatggggagtgtttgatatggatttgcttataggtactttatttttaattttagttttagttatttttactctatttacatacaaagcacctagtgggatgagggcgatgggagctttagcgaatgcggcgattgcatcgtttttagttgaagctttcaataaatatgtgggtggtcaagtatttgggattaaattcttagaagaactgggagatgctgctggaggtttaggtggtgtggctgcggctggattaactgcattagcgattggggtatctccagtttatgcactagttattggggcagcttgtggaggtatggacttgttaccaggatttttcgctgggtatattgtaggctacatgatgaagtataccgagaaatatgtgccagacggtattgatttaattggttcaatcattcttctcgcacctatagctaggttaattgctactggattgacgccagtggttaataacacgttaattaaaattggggatattatacaaagtagtacagatgctaacccgttgattatgggaattgtattgggaggtattattacagtagtaggtactgctccattaagttcaatggctctcactgcattgcttggtttaacgggtgcgcctatggctataggtgccatggccgcatttagttccgcgtttatgaatagtgcattgttccatcgtttgaaattgggagaccgtaaatcaaccatttcagtcggaatcgaaccgctttctcaagctgatattgtttccgctaatcctattcctatttatgtcactaatttctttggtggggcaattgccggtattataattgcttggtcaggtatgattaataatgcaactggcactgctacacctattgcaggttttttagtgatgtttggttttaatagtttaacgaaagtgattatctatggtgtggttatggcgattataggaactattgctggtattgtagggtctattgttttcaaaaagtaccccattattactaaaaagcaaatgttagaacgggacacaacgacataa

SEQ ID NO: 1168 - DNA, 867 bp, Staphylococcus epidermidis
atatttagggggaattcatttatgaaaaagattttaagttttttaatcgttgcaattttagttttatcagcatgtggcggtaataatggtaaaaaggtaaccataggtgttgcatccaacgacacgaaggcttgggaaaaagttaaagaattagctaaaaaagatgatattgatttagaaatcaagcacttttcagattacaatgttccaaacaaagcacttagtgacggggatattgatttaaatgccttccaacactttgcttttttagatcaatataaaaaagctcataaagataccaatattgaagcacttagcactacagtattagctccattaggtatttattcagataaagttaagaacattaaagatgttaaaaaaggtgcgcaagttgctattccgaatgatgtatctaaccaagctcgagcacttaagttattagaatctgcaggtttaattaagcttaagaagaactttggattaaacggaacaacaaaagatattgaaagtaatcctaaagatttaaaaattaaagctgttgatgcacaacaaacagcgcgtgcactttctgatgtggatatatcagttatcaataacggtgttgcaacaaaagcaggaaaagacgctaaaaaggatcctatttatttagaaaaagcaagttcagatgcagtaaaaccatatattaatgttgtagctgtcaactctaaagacaaagataataaaacctacaaaaaaattatagaactttatcattcaaaagaagctcaaaaagcattaaaagaagacactaaagacggtgaaaaaccagtagatctttctaaaaaggaaatcgaagaaatcgaaaatgagttggcaaaaaaataa

SEQ ID NO: 1169 - DNA, 420 bp, Staphylococcus epidermidis
aaagatggggggacaaacatgttacatgtccatattttaagttgggtattagcaattattttatttatcgcaacttatttaaattattcacaaacgcaaggtgcatcaccttattataagcctttgcatatggcattaagattattcatgctattaacattaatttctggtttttgggaattaatcgaagagtttatggctgcctctaatggtgaaggtggaaatcatatgctacttactttaaaaatgttatgtggtttagctgttatcgcatttatggaaatttctattgctaaaagaaaaaaacaacagactagccataaattcttttggattactattattttaatcataattacaatggctattggtgttattttaccttggggcccaatttctaaaatatttggaataagttaa

SEQ ID NO: 1170 - DNA, 627 bp, Staphylococcus epidermidis
ggtgtaattatgattcagactattgtaactgctgctattctgtatattgcgacagcagtagatttattagtgattttgttaatattttttgctaaagcaaagactaaaaaggaatatcgagatatttatattggtcaatatgtaggatctgtgacattgattgtcgtaagtttattctttgcctttgtcttaaattatgttcctgaaaaatggatattaggattattagggttaataccgatttatttaggaattaaagtggctatttatgatgattgtgaaggagaaaagagagctaaaaaagaattgaatgaaaaaggattgtctaaattagttggtacggttgcaattgttacgatagcaagttgtggtgctgataatattggtttatttgttccgtattttgtgacattaagtgttactaatttattcattactttgtttgtctttttaattttaattttcttcttggtatttactgcacaaaaattagctaatattccaggagttggagaaattgttgagaaatttagccgttggattatggctgttatttatatagctttaggtttatttattattatagaaaatgacactattcaaacaattttaggatttatattttaa

SEQ ID NO: 1171 - DNA, 3489 bp, Staphylococcus epidermidis
gggaatgttatggaatttaatacatatattggtcgagcaggtacaggaaagtcaacagccatgcttaatcaaataaaaaataaaatgaagcaagacccgctgggtgatcctatagtattaattgcacctactcagagtacttttcaattagagcaagcatttgtaaatgattccgaacttcatggtagtttgagaactgaagtacttcactttgaaagattgagtcatcgtgtatttcaagaagttggtggtttgacagagcaacgattatctaaggacgctttagaaatgatgattttccatattgttcaacaacatgagtctgatttgaaattgtatggttcacaagctcaatactatggtttaagcgaaaagttagctgagcaaattcaagattttaaaaaatataatgtcactcctgaacacttaaatcaattgatagaaaatcattcaatacaaacgagaacaaaacataaattagaagatatttctcttatttataaacaattagaatcacgaatgaatggtgaatttataacaacagaggatagtttgcaacaattcattgaaatactatctcaatctcagtggataaaaaaggctgaagtatttattgatggattccataatttttctacattggaatatagaattatagaagcacttgttcaacacgccaaacaggtgactgtattattaacgaccgatggcagccatcatccatttagtttatttagaaagccatctgaagttttatcacatttggaggatatcgctaatcgtttaaatataaatctaaataaaacatattttaatacattttatcgctataacaatgatgatttaaagaatcttgaaaatgggtttgatgcattacaatttacgcctaaacatcatcaaaatcatgttaaaatatttgaatcttcaagcatgagagaagaaataaatgaagtagctcgacgtattttaaaagatgtcagagaagcagattataaattcagggacattgctatattataccgtgatgaatcgtatgcatatctattcgagtcaatacttccttcatatgatataccatttaacattgatactaaaaagtctatgacacatcatcctatcatggaaatgttacgttctttattggaagttatacgttcaaattggcatattaatgcaatgttacgattatttaaaacgaatgttttaacgtctcaatttaaaagaagtagctatttaattgatttactggagaatttcgttttagaacgtggtatttatggtaaacgttggttagatgaagatatctttagtattgatcagtttagtagaatgggacgtaaatcacatcaactaactgaaggacatcaagcattatacaaagaagtaattaaacttaaaaagaatgttataaataaagtgttatatttcgagcaagctatgaatgaagcgcatactgttaaagattatgctacgtcattttatgaaagtttggagtattttgaactaccgagtcagttaatgactcaacgtgatgaattagagttagcgggtctaacagaaaaagccgaagaaattgaccaagtatggaatggtttaatacaaattttagatgatttagttactgtatttgatgatcaggaaatgacacttcaacaatttttagatgtttttgatataggtttagagcaattagagtttgttatgatacctcaaactttggatcaagttagtatcggtacaatggatttagcgaaagttgataataaaaaacatatttatatggttgggatgaatgatggtatattaccacagactgtatcttcatcaagtttgattacagatgaagagaagaaatatgttgaggacaatgcacatgttgagttaagtccaacttcagatatactgcaaatggatgaagcgtttgtatgttacatcgctatgacaaggagtcaacaaagcgttactttttcatatagtttaatggggaattctggagatgagaaggaaattagtccttttttaacgcaaattaaagaattattttatgatttagaaatcatcaatctacaagatttacataaagcgcaaccattattaatgatgcaacattcacatcaaactaaaattcagctttttgaatatttaagaggttggttagaccatgaagacatcgattatcgttggttggatgcatatttagctattcgagacgatgatcaattaaatcaaggtttagattatcttactacgtcattgacatatgataacgagactgtccaattaaatgaaattttatcacaacaactttatggtaaaactatcaacgctagtgtgtctcgttttgaaggttatcaacaatgtccttttaaacattatgcctcgcatggtttaagattaaatgaacgcactaaatatgaattacaaaattttgacttaggagatatttttcattcagttttaaaatacatttccgatcgaatttatggtgacttcaagaatttagatacaaagaatattcaatcacttactaaagaagcattagagcttattttacctaaagtacagtttaatttgttaaattcgtctgcgtattataaatatttatctaaaaagattggatcaatcgttgaaacaactttaaaggcacttaaatatcaaggggagtactctaaatttgtacctcaacgatttgaaacaggatttagaaaatcacctaaaaacaaaggtgaacttgttgcacaaccactgattaccaatcagggaattccgattaatataagaggtcaaatcgatcgtattgatacatatacaaaaggtgatcatagttatgtcaatatcattgattataaatcttcagaaagtagtgcaacactcgatttaacaaaagtttattatggtttgcaaatgcaaatgatgacctacatggatattgtattacaaaacaaggagcgtttaggtcttacagatattgtgaaaccagggggtctactttatttccatgtccatgaaccgcgtattaaatttaaaagttgggcagatatagatgaagaccaatttcaaaaagactatatcaaaaactttaaaatgagtggtttgcttaatcgtgaccaagaagtgttagacgctttagatattagacttgaaccaaagtataattcggatattgttccaatagcattaacagctaaaggcgctataaatcaacgtagtagtaaagtagctgatgaaaacatcatttatcaattaatagaacataataagaagaattttatcgagacagccagccacattatggatggacatacggaagtggcacccttgaagtacaaacaagtattaccttgtcaattttgtaattataaatcagtttgtcatgtagacggattaatagatagtaagcgttatagaacagtagatgaatcgataaaaccattagatttaattcaacaattaagaaatgaaggtggtgaaagacatgattccaactaa

SEQ ID NO: 1172 - DNA, 783 bp, Staphylococcus epidermidis
ggagtcactatcatgttaaatctagaaaataaaacctacgtcattatgggtattgcgaataaacgtagtatcgcatttggcgtcgctaaagtattagatcgattaggtgctaaactggtatttacatatcgtaaagaacgcagtcgtaaagaattagagaaattattagaacaattaaatcaatctgaacatcatctctatgaaattgatgtgcagaatgatgaggatatcattaatggtttttctcaaatcggaaaagatgtaggccagattgatggtgtttatcactcaatcgcatttgccaatatggaagatttacgaggtcgattttcagaaacatctcgcgaaggtttcttacttgcacaagaaattagttcatattcacttactctcgtagctcatgaagccaaaaaacttatgcctgaaggtggaagtattgttgcgacgacttatattggtggtgaggcagcagttcaaaactataatgttatgggtgtagctaaagcaagtttagaggcgaatgttaaatatttagctttagacttaggtgaagataatattcgtgtcaatgctatttctgcagggccaattcgtactttaagtgctaaaggtgtaggtggatttaatacaattcttaaagaaattgaagcgagagcgccgttaaaacgcaacgttgatcaagaagaagtaggtaagacggctgcgtatttattaagtgatctttcaagtggtgtaactggagagaacatccacgttgatggtggattccacgcaattaaataa

SEQ ID NO: 1173 - DNA, 675 bp, Staphylococcus epidermidis
ggaggttatataaatatgtttggttcaagtttagattcatctcaattattacaagctctatacgaaacattgtatatggtgactgtatcacttgtaatcggtgctttaataggtatacctcttggcatcttgttagtggtaactagaaaaaacggtatatggtcgaatacaatattgcatcaagtattaaatcctatcattaatattttaagatcaattccgttcattattttattaatagccatagtgccttttactaaattgctagttggcacatctatcggcacaacagcagccatagtaccactcacggtttatgtagcaccttatatcgcacgcttagtagaaaactcattactggaagtcgatgacgggattattgaggcagctaaagcaatgggtgcatcacctcttcaaattatacgttattttttattgccagaagcacttggttcattaattctagctataactacagctattattggtctcataggtagtacagcaatggctggtgctgttggtggtggcggtataggtgatttggctttagtgtatggttatcaacgattcgatacaattgtaattgtgattacagtcattgtacttattattattgttcaaattatacaaacgttaggtaactttatcgctagggttatccgtagaaattaa

SEQ ID NO: 1174 - DNA, 447 bp, Staphylococcus epidermidis
ctccaatatatcgatggattgattgacaaacaactgattgatgaagatgcaaaagaggatgtgagaagagatgagattatgcatttcattgatggccctctctatatggaaatagctcaagctgacaatgtttatactgaattaccttttgtggtaaatcaaattaaagttgatggacttacaagtgaagatgaagatgtatccattattcaaggtatgattgatttaatatatgaaagtgacggacaattttactttgttgattacaaaacagatgcttttaatagaagaaaaggtatgagtgatgaagaaatagggaatcagctcaaagaaaaatatcagatacaaatgacgtattatcgaaatactttagaaaccatacttaaacgacctgtaaagggttacttatattttttcaaatttggtacattagaaatagatgattaa

SEQ ID NO: 1175 - DNA, 1854 bp, Staphylococcus epidermidis
ggaggtcatatggaattcttatctttagttatagtcgtcgtagctgcatttatgactccgatcattgtgcatcgttttaatataaactttcttcctgttgttgtagctgaaatattgatggggatagtgataggtcactcttttctcaatttagtggaaagagatgcattccttaatattttatctacgcttgggtttatctttttaatgtttttaagtggtctagaaattgactttaatgcatttaaaaaggattcacgtccaagacaaggagaagataaacatgaaaaggatgtacctgggcatcttaaactggcactgacagtatttgcatttattatgatgatttcggttgttttagcttttgcatttaaatggttaggattagttaatgatgtccttttaatggtgatcatcatttcaacaatttctttaggagttgtagtaccaacccttaaagaaatgaacattatgcgtacaacgataggacaatttattttactagtagctgtattagcagatttatttaccatgattttactaactgtttatggtgctatttatggtgaaggtggtagtacaatatggcttacaggtattttagtcgtatttacagttgtcttttatgtaatcggtgtgttatttaaacgtatgtccttcttacaaaagttaatggatggtacaacgcaaataggtataagagcagtatttgcacttattattttattagtagcacttgctgaaggtgttggtgctgaatacatattaggtgcatttcttgccggtgtcgttgtttctttacttaaacctaatgaagagatggtcgaaaaattagattcctttggttatggtttctttattccaattttctttatcatggtaggtgtcgatttagatatcccaagtttaattaaagaaccatcgttgttacttattatacctgtactcattttttcatttattatttcaaaattgataccagtattttacattagacgctggtttgacactaaaactaccattgcatctgctttcttacttacatcaactttatcacttgttatagctgcggctaaaattgctgaaaaattaaaagcgatttctccggaaacttcaggcattttaattcttagtgctgtgattacatgtgtcttcgtacccgtgatattcaagaagatgttcccaattcctaatgaagtgggacgccgcatagaagtaagtatgattggaaagaatcaattaactattccaatagcacaaaatttaacttctcaattatatgatatttctttatactatcgaaaagatttgagtgatagtagaaagctctctgacgatattactatgatagaaatagcagattacgaagaagatttattagaacgcttgggacttttcgagcgagatattgttgtatgttctacaaatgatgaccatataaataaaagcgttgcgttaatggctaaaaaacatggtgttaaacgtgttatatgtcgactcgaaagcacaaacgaagatccgacattgaaacatcaaggtatagaggtgtttagtaattatttaagtaataaaatcttactaaaaagtttaatagaaacacctaatatgctgaatttattaagtaatgtagaaacatctctatatgaaattcaaatgttaaattatcagtatgaaaatattcaattacgtaatttcccatttggtggcgatattatttttgttcgtattataagagataacgattcaatcgtacctcatggtgatacacagttacgatataaagatcgtttgattgtgacgggaactaaagaatatgtagatgaattaaagcaagaattggaattttattattaa

SEQ ID NO: 1176 - DNA, 702 bp, Staphylococcus epidermidis
gtgaaccatattaaagaaataggtgttgatatgaattttaaatatatgaatatagcaaaagggataattccaattttaataagcatgattattcttttaagctttatctctactcatgtgttagcgcaaaatcagtggttgagaatggttgatcttagcgtacaagagtggtttagtaatcaatttggggatcccaatagagtgtttggacatggtttcatcaacaatataatgacgttttgcgctacctttggtgatgttaagaccattttaattgtggctaccattattgcagtgctactcatgttttacaagaaggttccacaagcaatatggctaatcataacgatgactagtggcgcattgattaattatttaattaagcaaacgattgaaaggtcaaggcccgagaatcatttaattgttgatacaggatggtcttttcctagtgggcattctaatattaatacattattctttttaatgattatgatcattattatcccgttaatccgacagcgtgcttttaaatttataatcacaattttaagtattgtattttggattagcgttttaataagtagactgtattttcatgcacactacttttctgacgttgtaggaggcgtaagtttagctattatttgggtgtcgttatttatattagtgtcacctttattaaatttttggggagaaaagtaa

SEQ ID NO: 1177 - DNA, 279 bp, Staphylococcus epidermidis
aagcagcatatcaaaaatttggtggtggacctcttgaggattaaatcacttcagtttcatggaatgatgataaacgtatatcattatcattctaatgatttaatcatgttagctattccagaacttttttggtccattgagttatccaaagagttagatgcaaatcagctatatgaggaattagtgatgcaattattcaatttgttgactgaagttgaagcagatacattggcaagtaatataactgatttgattagaaatgaatccaaaggagaatga

SEQ ID NO: 1178 - DNA, 999 bp, Staphylococcus epidermidis
gcatctaatatggaaactttattctcaggaattcagccaagtggtattccaacaattggtaactacattggtgcattaaaacaatttgtagatgttcaagatgactatgaatgttttttctgtatcgtagaccaacatgcaataacggtaccacaagaccgcttaaaattacgcaaacaaatacgtcaactcgcagcaatttatttggcaacaggtattgatccagataaatcgactttatttattcaatctgaagtccctgcacacgtgcaagctggttggatgcttacaacaatagcttctattggtgaattggaacgtatgactcagtttaaagacaaagctcagaaacgcgcagatggagtgcctgctggtctactcacttatccaccattgatggcggctgatatcgtgatttacaacactaacattgtccctgttggtgatgatcaaaaacagcatatggaactgacacgtaatttagtagatcgtttcaatagtagatataacgatgtattagtaaaaccagaggtacgaatgcctaaagttggtgggcgtgtgatgagtttacaagatcctactaaaaaaatgagtaaaagtgatgataatcagaagaatttcatttctttattggatgaacctcatgtagctgccaaaaaaattaaaagcgctgtaacagactctgacggtataataaaatttgatcgtgagaataaaccaggcatttcaaatttactttcaatatattctggtctaactaatgaatctattaagaatattgaatctaaatatgaaggtgaaggttacggtaaatttaaaggtgatttatcggaaatcgttaaagattttcttattaatttccaagaaaaatatgcaagcttttataattctgatgacctagatgatattctagataaaggtaaagaaaaagctcaaaaagcttcatttaaaacattgaaaaaaatggaaaaagcaatgggcttaggtcgaaaaagataa

SEQ ID NO: 1179 - DNA, 858 bp, Staphylococcus epidermidis
acgatgattttaacatatcaaattgtacagtcagaaccagtgaaaacttttttgaaaaatcaagattattctaaacgcacgttgagcgccattaaattaaatggcgctttactattaaacggttcacctgtaactgtcagacatgttatgaacaaaggtgatagattagaagttcattttccatgtgaaacaccaagtgagaatttgattccatacgataaggaattagaagtcatttatgaggatgcgtatttgataattgtaaacaagccacaaatgcaaaattgtgcaccttctagagaacatccccatggcagtttagtagaacaagtgcttgcttattatacaaaaaaaggcgaaaaaataaatcctcatattgtgactcgacttgatcgaaatacttcaggtttagttgtatttgctaaatttgggcatgtacatcatttgttttcaaaggtgaaatttaaaaaagaatatgtcgccttagcctatggccatacacaatcttcaggtgttattgaagcgccaattgcaaggcggagtgatagtatcattaaacgagaagttaatgataaggggaagtatgcaaaaacagtctatcaaaggcttatgcaaaatgagactgctagtttatgtaaggttaaattgcttactggaagaacgcatcaaattcgagttcactttgagtatattggacatccattaattggtgatgatttgtacggtggaaatcatccttgcgttcatggacaagcgttacattgctgttcagttgaatttatccaccccatatatagatctcattacctaataaatgttgactacaaacaattaattaaattattcaacatggtataa

SEQ ID NO: 1180 - DNA, 792 bp, Staphylococcus epidermidis
tacaatagtattaacattacaagggagcatcggtttatgtcggagtttaaagtaggtaagattaataaaaaaataatacatagtgatattttaaatagagatgtaacattatcggtttatttacctgaggattatacaaacttatttaaatatcagttgattttttgctttgatggtttagatttttttagatttggtagaatacaacgcatatatgaacagttacgtgaagaacaatcaatacaacgtgcaattatagtaggattccattacgaagatgttgaaaaacgtagggaagaatttcatccttcaggaagtcgttctaatttaaccattaaagcaatgggaaaagaaattcttccttatatcgatgcgacatttccaacttataaagtaggtaatacaaggttacttattggagatagtttagcaggaagtatcgctttaatgactgcaatgacttacccaactatttttagtcgagttgcgttattgagcccaatgtataatgaaaatattaagaaaaaaattgatacatgtatgaataaaggtcaattgacgatatggcatgccattggtttagaagaagcagattttattttaccaactaatggtaaaagagctaactttttaacacctaaccgcgaattaaatcaactgattaaagaagataatattgaatatttctataaagaatttaacggtggacatcattggaaatcatggaaaccattgctaggagatattctcttacaatttttaggtgatccaataaatggaaaatatgtttaa

SEQ ID NO: 1181 - DNA, 207 bp, Staphylococcus epidermidis
attacgctcatttcatgtgtaatcatcataatcgtcacaccaaatgttcgattcacattacttaataaatttaaaattgagcttgtagtagctggatccagagcacttgtcgcttcatcacataataatattttaggatgcgttactaatgctcttgcgatggcaacacgttgtttttgtccacctgataattcatctggaaattga

SEQ ID NO: 1182 - DNA, 1473 bp, Staphylococcus epidermidis
gggattatcatgggcgaatttaaaggatttatgaaatatgataaacagtcgctatcagaattgtctttggtagaccgtctttcgaatcatgaagcgtttcaacaacgcttcactaaagaagatgcttcgattcagggtgcgcgctgtatggattgtggaacacctttttgtcaaactgggcaatcttatggaagagaaacaataggatgccctattggtaattatatacctgagtggaacgacttagtctatcatcaagattttaaagctgcttacgaaagattgagagagacgaataattttcctgaatttacaggaagagtttgtcctgcaccatgtgagcaatcatgtgttatgaaaattaatagagaatccgtggcgattaaaggtattgaacgtacaattattgatgaagcatatgagaatgagtgggttcatcccgcatatcctgaagatcataaagaccaacgagttgctatcgtaggtagtggtccagcgggacttacagcagctgaagaattaaactttaaaggctataaagttactgtttatgaaaaggcgcatgaaccaggcggcttgctaatgtatggtataccaaatatgaaactagataaagacgtaatacgtcgacgtgtatcacttatgaaagatgctggggttttatttaaaacaggtgttgaaattggcgtcgatgtgagccgtgaaacacttgaagaaaattatgatgctattattttatgcacaggtgctcaaaatgcgagagatttaccattggaaggacgaatgggctctggtattcattttgcaatggactatcttactgaacaaacacagtatctaaatggtgagattgaaagtttgagcattactgctaaagataagaatgtaattattataggtgctggtgatactggtgcagactgtgtagcgacagcattacgtgaaaactgtaaatctattgttcaatttaataaatatacgaaacagcctgaagagattacttttgaaagtaatacttcctggccattagcaatgcctgttttcaaaatggattatgcgcataaggaatatgaagctaaatttggtcaagaaccaagagcctatggtgtacaaacaatgcgctatgatgttgacgagttaggaaatgttaaaggcttatatacacaaatattaaaagaaacgcctgatggcatggtgatggaagatggaccagaacgattttggccggctgatttagtcttattatctatagggtttgttggtactgaaaccactgttccgcatgcgtttgatatacacaccgagcgtaataaaattgtagctaatgatacaaattatcaaactaatcacgctaaaatatttgctgcaggagatgcaagacgaggtcagagtttggttgtttgggcaataaaagaaggtcgtgaagtagcacattctgttgatcaatacttaagtaaagaagttctagtgtaa

SEQ ID NO: 1183 - DNA, 252 bp, Staphylococcus epidermidis
catattgtcattcagttttcaatgttcattttcttaccgacaagaattaattatactcttcatggttgtttaagtcaacaactttttgaaattaattttagtcgtttgtttaatgattcgttaagttgtttcgctcaacaaataaacactatacagacttattctcgttttaacaacagtaaaaattacactatcaaaaacaattcaaattactccggaggaaaaaccgaactttttttgtatgaaatttaa

SEQ ID NO: 1184 - DNA, 585 bp, Staphylococcus epidermidis
ggttttttaatgacacatttacccgaaacgatttatgttatacgaaaaggtgatatggtaatacgacctaaatatgatgaatatcagcaaacaaatggtactgaaattatcagatttgatcaaactcgcaaagaaagtccatttaaagtacagagaattatcgaaagatcatgtaaattttatggtaataattatattagtaaaaaagcagaaacgaatcgtattactggaatctctagtaaaccacctattttacttacgcctctttttcctacttacttttttccaactcactcagaccgtcaagaagaaaatatatggattaatatgcattatattgaaaatgttaaagaacttaaaaatcgtaagagtaaaataatttttgcgaatggtgattcgttaacgctcaatgtatcatttcatagcttgtggcatcaatatacgaatgcaatcatctattattacatggtagataagcaatcacgaatgaaatctaacaaccctgaacaacccattgactataatcagtcttctctaaatattttcgaggcgctctcacgctactccctttttgaagaaaattag

SEQ ID NO: 1185 - DNA, 486 bp, Staphylococcus epidermidis
aatgttctaattgatggaaagtttataaatttataccaaagtaacattgaaaaggttaatgataatcgtcatagcaatgaaactagcattcataatgatgattataaaaaaattttaaataaagttttaaaatcagatattataattttctcaacgcctctctattggtattccatgagtgcgtctttaaaactctttattgatagatggactgaatcattgcgagatacgcaaatagataacttcaaagaaattatgtcacaaaaaaagtacttaattttaatcataggcggtgacagtccacgtattaaagcacaacctttagtccaccaatttaaattaatatttgaatttatgaatattactcattttagatttttaataggcgaaggtaataaaccattcgatgttttaaatgactcacaatttatggaagaactcgcaaatacaaatcttgctttgaaaaaaggtgatatttatgattga

SEQ ID NO: 1186 - DNA, 2304 bp, Staphylococcus epidermidis
tatgcaataatcaatgttataaagtttataaagggaggacaattaatggattttattaatattacaggtgcttcacaaaataacttgaaaaacatagatgtaaatatcccaaaacacttagtaacggtatttacaggtcgttctggttcagggaaatcatctttagtgtttaatactgttgctgcggagtctgaacagctactaaatgaaagttattctagttatattcaatttcatttaaatcaacaacccagaccgaaagtaaagaaaattaaaaatcttcctgtagcaatgacgattaatcagaaaagattcaatgggaattctcgctccacggtaggaacagtttcagatatatatgcttctgttagattactgtggtctagaataggcgaaccgtttgttggttattcagatgcatattccttcaatagtcctaagggcatgtgtaaaacttgtgagggattaggatatattgaagacattaacttagatgaattgctagattgggataagtctttaaatgaaggtgcaatagactttccttcttttggaccagacaaagagcgtggtaaagcctatcgagatagtggtttatttgataataataaaaaattgaaagattatacaaaagatgaattagaattgtttttatatcaagagccaatgacattaaaaaatcctcctaaagaatggagaaagtcagctaaatatgtaggactaatacctagattcagtagaatatttttaggtgataaagaatttaataagaaacgctacgccaaacatcttaaaaatgtagtaaataataaaatctgttcaacatgtaaaggtcaacgtctaaactcgaaaatattaagttctaaaattatgagtaaaaatatttctgatttcacacaaatgacaattaaggaaaatttagagtttcttaataaattagaggatccaacagccaaatatattattgatcctctcaaaaagcagttagaagcactagaatatattggattaagttatttaacgcttaaccgtgtaacaacgacattatcaggcggtgaagcgcaacggcttaaattaatacgtcatttaaatagttctttatcggatttagtttacattatagatgaaccaagtgttggcttgcatccggaagatatagctaaaatcaatgaaattttaaaatcattaaaagaaaaaggtaatactgtgttaattgttgaacatgatcccgatgtcattaaagaaggagactatatcatagatatggggccaggttcaggaaaaaacggcggtgaaatcacatttgaaggaacatataatgaattactatcttcaaatacttcgacaggtaacgcattacgtaacaaacataatttaaaagagaatattcgtgaagctaaccacttttataatatcggtcctgtgacacaaaacaatttaaataacgtaaaaacgtctatacctaaacacgtattaacagtcttaacaggtgttgctggttcaggtaagagtacccttgttaaagcaggttttgaaaataatgaccataccatctttattgatcaaaaagcagttcaaggatctaatagatctaatctattaacgtatttaggtgtttttgatagtgtaagaagctatttcagtaaagaaacaggcttaaataaagctatgtttagttataattcaaaaggtgcctgtccaaattgtggtggaaagggctatattaaaacggaacttgcttttatgggtgatttttcacagacatgtgaagtttgtcatggcaaacgttataaacaagaagtattagatgctaccatagacgggtattcaattgccgatgttctcaatttgacggttgacgaaggtatcattttctttgataaaaagaatgatattaagtcaaaattacaatctgtaagtaagacaggtttgaattatatgtcactaggacaacctttgtccactttgtctggtggagagattcaacgcgtgaaactaggacaacatttagatgaagagataaagaatagtatttttatttttgacgaaccaactacaggcctacatgaatcggatatccctatattgatggagtgttttgatgatttaattgatcaaaacaatactgttattttgattgaacataatttatcgattatgtgtgaagcagattggatcatcgatgtcggcccaggcccagggttggatggcggaaaggtccaatttagtggaacacctaaaaacttcattgatagttcagaaacattgacatctaaacacttgaaacgctatatcaaacagtaa

SEQ ID NO: 1187 - DNA, 249 bp, Staphylococcus epidermidis
ttctttccaatcatacttacttctatgcggcgtcccacttcattaggaattgggaacatcttcttgaatatcacgggtacgaagacacatgtaatcacagcactaagaattaaaatgcctgaagtttccggagaaatcgcttttaatttttcagcaattttagccgcagctataacaagtgataaagttgatgtaagtaagaaagcagatgcaatggtagttttagtgtcaaaccagcgtctaatgtaa

SEQ ID NO: 1188 - DNA, 321 bp, Staphylococcus epidermidis
ttacttgcaatagaacctccaattagtagaaaaagtagtgatataagaaaagaaaaagttcaagtcttaagatccttgaaatgttttaatccaaatgaaattaaagaaagtttcgtacgtggtcaatatgatgggggaatgatgaataatgagttcgttcctgcatatagaaatgaacctaatgtaaattcacaatctaatactgaaacttttgtagcaggtaaaatagaaattgaaaactctaaatgggctagtgttacattttatattcgtacagaaaaaagaatgaaaaaaatctatccaaatcgttatagagtttaa

SEQ ID NO: 1189 - DNA, 522 bp, Staphylococcus epidermidis
ccaaaaaaaattagtaaagcattacctgtaattataacagctggactgtgtgatacttttttaattgtaatagctattttaggagtatctttaatactaatatctatgccaactttacaactttttatttacatcatcgggtttttgtttttgatgtatatggcatggtctttatggacggaaaagccttcaaatatcgaagaaatagaacctatgtcagctaaaaagcagattttatttgctttatctgtttctttattaaatcctcatgcaataatggatactgttggtgttatcggaacgagtgcttcagtttatgatggttatgacaaagttgttttttcattggctacaatttctgtatcttggatttggtttgtctttttagctattttaggaagaattacaggaaaaattgataaaagtggtaagtatatcgttattttaaataaagtttctagcgttattgttattattgtaggattaattatattaaaaaatattgttggaattttaagttag

SEQ ID NO: 1190 - DNA, 447 bp, Staphylococcus epidermidis
cagttgtcgataaggcaaattacttttaaatgtaaaaattcatgttatattagatatatattaatggaacacggtgatattatgtctaaaacaccatatgagttgattggtcaaaaagccttgtatcaaatgattgatcatttctatcaacttgtcgagaaagattctcgtatcaatcatttattcccaggcgatttcaaggaaaccagtcgaaagcagaaacaatttttgacacagtttcttggaggtcctgacttatatacacaagaacatggtcatcccatgttaaaacgaagacatatggaatttacaattagcgagtatgaacgtgatgcatggcttgagaacatgcatactgctattcaacacgcccaacttcctgcgggtgtaggcgattacttgtttgagcgattaagacttactgcaaatcacatggtaaattcctaa

SEQ ID NO: 1191 - DNA, 1839 bp, Staphylococcus epidermidis
gctattcagattattaaggaggtttacattatgagtcaacaattaacaagagaagaacaggaacgtaaatatcctgaatatacatgggatttaacaactatttttaaaagtgatgaagcatttgaagaagcttttaaaagtattgaagctaaaataggtgaagaagaaaaatttaaaggtcatcttggagaaagtgctgaaacattatatgaagcgctaagtcttgaagacgagttaggtacaaaattagaaaaggtatatgtatacgcacatttaaaacaagatcaagatactgcaaatgataaatataccggtttagaagcgcgtgcacatcaacttgttattaaatatagctctgcatggagttttttagtacctgaaattttacaactagatgaagctactattcaatcttttatcgattctaataatgatttaaaacgatatgaatttgatttgaaattgattaatgagaaacgtccacatatattagatgcgaatacagaaaagttattaacagaagcacaagacgcactttcaacgccttctaatgtatatggaatgttcagcaatgcagatttagaatttgaagatgctatagataaagatggtcaagcttatcctttaacacaaggtacatttatcaagtatttagagtctgatgatcgtgagttaagagcttctgcttttagaaatgtttataaagcatacggtgcgcataataacacgctaggtgctactttagctggtgaggttaagaaaaatgtatttaatgctagaactcatcattatcgttcagcacgtgaaagagctttaagtaataatcatattccagaagctgtttacgataacttaatcaaaacggtccataaatacttacctttattacacagatacacgaagcttagacaagagttactaggtttagacgatttaaaaatgtatgatctttatacacctcttgttaaagatgtcaaatttgaaatgccatatgaagaggcaaaatcctggatgttaaaagcacttgaaccaatgggagaagaatacttaaacgtggttaagaaaggtctagataaccgttgggtcgatgtatatgaaaataaaggtaaacgttcaggtggatattcatccggtggacatttaactaatcctttcattttacttaactggtcagacactgtttctgatttatatactttagtacatgaatttggtcactctgcacatagttactttagtagacagaatcaaccatcaaatttaagcgattatacaatctttgtcgctgaggtagcatcaacttgtaatgaggctttacttagtgactacatggacaaacatttagatgatgaacgacgtctattgttacttaaccaagaattagaacgatttagagcaacactattccgtcaaacaatgtttgctgaatttgaacataaaatacatcaaatagaagaagctggggagccgttaacgccaaatcgtatgaatgaagaatatgctaaactgaacaaactatattttggtgaagcagtagaaactgacgatgatattagtaaagaatggtcacgtattcctcatttctatatgaattattatgtatatcaatacgcaactggttatagtgcagcacaaagtttaagtcatcaaattttaactgagggtcaacctgctgttgaacgatatatcaatgaattcttaaaaaagggtagctcaaactatccgattgaaatattaaaaaatgcaggtgttgacatgacaacacctcaaccaatagaggaagcttgtgaagtattcgaacaaaaattagatgcttttgaaaagttaatgaaagcttag

SEQ ID NO: 1192 - DNA, 1122 bp, Staphylococcus epidermidis
ggttttaagatgcaatccaagaatttttttaaaacaccttttacttggatgatgataatctttagttgcctgtttttaggtacgttaatattcacgttttttaacgatagattttataatatgcctataggacaaatcactcaaattactgatatccaatcacaaaaggtaacagacgagcacaaaaataaagatattaagtacaaagagaagataacattcaagattctaaatggtgaattcaaggggcaaacaacgacgattccccaccaatatgtgaaatctcaagctgattcagaatcattttccaaaaatgacaaggttcttttacatatttctaaaaatcctaaagacgcaactattatagagaaaaaacgagatactattgttgtcataataaccggcttatttttacttactgttttagttgtaggaaaaaaagtaggacttcaatctatattatctcttatcgttaataccattgccgttatgggagctattttaatacatgatcaatatggggctataagtttattctttttgatgacttgtgctattatcatttccacttctttcactttactacttgtaacaggttggcatagccgaaccttaattactattgtaagtacgctgattggtacgttcttatgtgttggaattaccgaagtcatcatcaaatttaccgggggaaatggaataaaatacgaaacaatcactttccttactctccctcctaaggatgtctttctagcttccgtactaataggtacacttggagcagtgatggatgtttctattactattgcaagtgggatgtacgaaattttaaaacgtagccctcaaatttccatgaaacgttgggctcttgccggaagacatatcggtcaggatataatgggaacaatgactaatatacttctcttttcatatctatctggtagcttacctatgtttctaatttatttaaaaaatgctaacactattacttatactatttcgatgaattggtcattagaagttgctcgagcattaactggtgggataggtatcgttttaactattcctataacaattgctttaatggaactatggtttaaactgcgaggtgttaatcaatga

SEQ ID NO: 1193 - DNA, 267 bp, Staphylococcus epidermidis
tattttaggattcaatatttaagcgggcaagcgtctctgaattcagaggcacttgcctattttatttttcacgtgaaacagcacagtatattcattcatattacattttcatttaaagtactgaatcaaacaattacattcgtcgatcataagtccattggtacggactatctagtaatcgccaatcttcatcaatctcactactatgaattaagcatgcatctaattcccgggaaattttttcttgatctaaatccgtaccaataa

SEQ ID NO: 1194 - DNA, 189 bp, Staphylococcus epidermidis
ataaattttgttatatatcctttattatgtggtttattttgtgctttactagaagtaatcgatttatggtatgcaaagaaaataactaaaactcattcaaaagattggagatttaatccacatttaatttggatgatgtttatattcagtgcagttatggggattatctatgttttattatttaaatga

SEQ ID NO: 1195 - DNA, 999 bp, Staphylococcus epidermidis
ggagagaatgttatgaaatttattagcaacaataatattaatgatccttccctcaatttagcaatggaagagtatgttcttaagaatttaccttctgaagaaagttattttttattttatattaacagaccttcaattattgttggaaagaatcagaatacaattgaagaagttaatcaagcgtatattgataaacatcaaatagatgtagtgagacgtatttctggtggtggggctgtttatcatgatactggaaacttaaattttagctttatcacagatgatgatggccatagctttcataattttaaaaagtttacgatgcccattgtacaggccttacaatcaatgggagttaatgctgaaatgactggaaggaatgatatacaagtagggcaagctaaaatatctggaaatgctatggttaaagtaaaaaatagaatgtttagtcatggtacattaatgctgaattgtgatttaaatgaagttcaaaaggcattaaaagtgaatccagctaaaattaaatctaaaggcgttaaatctgttagaaaaagagttgccaatattgaggaatttctagaacagccaatagatatagaagaattcaaaaaaattattcttaaaactatttttggtgaaaatgaagttgaagaatatatattaacagaagaagattggaaaaatattaagcaattaagtgatgaaaagtatcgtacgtgggaatggaactatggcagcaatccaaaatataatattgagcgtgaagagaaatttgaaaaaggttttattcaaataaaattagatgtaaaaaaaggaagaattgaacgggcaaaactatttggagatttcttcggcgaaggagatgtaaccgaacttgaacatgcgttagtaggttgcttacatgattttgaacatatagaagaggcacttcaaaattatgatttctatcactactttggggatatagataagtatgaaattataagattgatgtcctaa

SEQ ID NO: 1196 - DNA, 924 bp, Staphylococcus epidermidis
aataagacagtatttattttattgaatggagggaaatcaactatggatataaaacaacttagatactttgtagaggttgcacgtcgagagcatatttcagatgcggcattagaactaaacattgcacagtctgcgattagtcgtcaaatcactcaacttgaaaaagaattgggggtgacattatttaaaagaagtgggagaaatatcatattaactgttgaaggtagacagttactctcacaggcaactcaaatactagaattaatggataaaaccattcactcatttcaacaacacgtatcacataaccaacagacaatttatattggatatgaagaaagtgatgcctctcaaatgattcttcccctaattcaaacatttgaacaacaaagtaacagtaccatgattccgcaacttacaaaacatgataaattattagatcaaatcctttccaatcaattggatcttgcaatcactgaatttactcctgtgttagaacgggaaacacatttacgcgtcatgcctttatttgaagaaaattattatatgtatgtgcccaaatcacatccactagctatgactgtacatcccccgctatctcaatttacaaatcaatcactatactgtctcgaaccaatgacaagctcaataaaaagtaaattgattgaaaagactaaggcacaagtacgaatgatttcagatatgaaactcgctcaacatattttgagtcataataagggatttattatttctagtcaaaattctttactatatgatcacgtaaattggactaaaatccctttaaatcatacagaattaaaacgaatgctatgtgtagttatgcgaaaagataacaagaaaaacgacattaatatagcatggaatttaatttgcacattattaaataaatcgactatatattaa

SEQ ID NO: 1197 - DNA, 219 bp, Staphylococcus epidermidis
atttttggagttgcaacaaaccacttgaaagagtctggattaacgaacgtaaaagggttaatgcgaataattatagaaaaaccatttggtgatgatttaaaatctgcaaaaaaattaaataatcaaataagtaagtcttttaaagaagaagaaatatttggaattggtcactatttaagtaaagaaatgattcaaaatattgaacgtctacgattttga

SEQ ID NO: 1198 - DNA, 234 bp, Staphylococcus epidermidis
aaggtcgtggtctttatgaatcacaatactgaggtcaagtacactacattagaagattttgtaatgacagtgaacgatttaggcgttgaactcgtcattgaagaagcactcagaaatgcaagaaaagctaaacttaaactcttaattgacgaagcgctcatcaataaaaacgagaacgattttattcaatatactaacgaatttaaacaattggaggcatttttaagtgaataa

SEQ ID NO: 1199 - DNA, 243 bp, Staphylococcus epidermidis
tataacacggtaaaatatccttttcaacccttgtttattcataaaaccaaattgtcacaatctgttcatattgtaagcgaattcaattctactaagctttcattaacttttcaaaagcatctaatttttgttcgaatacttcacaagcttcctctattggttgaggtgttgtcatgtcaacacctgcattttttaatatttcaatcggatagtttgagctacccttttttaagaattcattga

SEQ ID NO: 1200 - DNA, 3231 bp, Staphylococcus epidermidis
gaaatgaaggtggtgaaagacatgattccaactaaacctcatgatgtgatttggacagatgcacaatggcaaagtatttatgcgaaaggacaggacatacttgttgctgctgcagcaggttccggaaaaacagccgttctagttgagcgtattatacaacgtatactaagagatgaggtagatgtagatcggttactagttgtaacatttacgaatttaagcgcacgtgagatgaagcatcgagttgataaacgtatacaagaagcatcttttaaggatcctaacaatgaacatttaaagaatcagcgaatcaaaattcatcaagcacagatttctactttacacagtttctgtttgaaattgattcagcagcattatgacgtattagatatcgatcctcattttagaacaagtagtgaagcggaaaatatattattattagaacaaactattgatgatgttttagaacaacactatgataaattagatcctcactttatagaattaaccgaacaactatcatcagataggaatgatgatcaatttagaagtattattaagcagttatattttttcagtattgctaatcctcaaccatttgaatggctcaatcaattagcgcaaccatacaaagaagaaaataaacagcgagaattaatgcagcttatcaatgatttagcaatgatttttatgaaagcaggatatgaggaattacaaaaaagttatgacttattctcaatgatggaaagtgttgataagcagcttgaagttattgaaaccgaacgcatgtttattactaaagccattgaaggtaaagtattaaatacagatgttatcacacaacatgaatttatgagtcgttttccggcaataaatagcaagataaaagaagcaaatgaaggcatggaagatgctttaaatgaagcaaaacaacattatgataaatataaatctttagttatgaaagtaaaaaatgattatttttctagaaatgcagaagatttgcaaagagatatgcaacaactcgcacatcgagtggcttatttagctcaaatagttcaagacgtgattcaatcatttggtgttcaaaaacgaagtcgtaatattttggatttctcagattatgaacattttgcattacgcattcttactaacgaagatggctcgccttcgcgtatcgctgaaacgtatcgtgaacattttaaagaaatcctagttgatgagtatcaagatactaatagagtgcaagaaaaaatattatcttgtattaaaactggtgaagaacacgatggtaatttgttcatggttggggatgtgaagcagtctatttataaatttagacaagctgatcccagtttatttattgaaaaatataatcgcttttctagtagtggaactgaaagtggcttacgcattgacttatcgcaaaactttcgttcgagacaggaagtgttatctacaaccaattatttgttcaaacatatgatggatgaacaagtaggagaaatttcatatgatgatgcagcgcaattgtattttggtgcaccatatgacgaagtttcacatcctgttcaattacgggcacttattgaggcaagttcagaaaatagtgacttaactggaagtgaacaagaagcgaattacattgttgagcaagttaaagatattattaatcatcaaaacgtatacgatatgaaaacaggtcaatacagaaaagcaacatataaagatatcgtaattttagagcgaagttttggtcaagctcgtaatcttcaacaagcttttaaaaataatgatatcccttttcacgtaaatagtaaggaaggatattttgagcaaactgaagtacgtcttgttctttcatttttaagaacaatagataatccacttcaagacatttatttagtgggtttgatgcgttctgtaatatatcaatttactgaagaagaattagctaaaataagagttgtaagccctcatgatgattacttttatcaatctataaaaaattatatgattgatgaaaaagctgattctagattggttgacaagttaaatcgttttattcaggatatacaaaaatatcaaaattatagtcaaagtcaaccggtttaccaattaattgataaattttataatgatcattttgtaattcagtactttagcggtcttattggaggtaaaggtagaagagcgaatctgtatgggctatttaataaagctgttgaatttgaaaattcaagtttcagaggtttattccaatttattcgttttattgatgagcttattgatcgtaaaaaagattttggtgaagaaaatgtcgtaggtcctaacgataatgtggttagaatgatgacgattcacagtagtaaaggattagaatttccatttgtaatttactcaggattatctaaaaaattcaacaaaggtgacctgaatgcaccagttattctaaatcaacaatatggtttaggtatggattattttgatgtaaataaagatatggcttttccttcgcttgcctctgtggcatatagagcaataaatgaaaaagaacttatatcagaagagatgcgtttaatctatgttgcgttgacacgagcaaaagagcaacttattttagttggaagagtcaaagatgaaaaatcgttaattaaatatgaaaaattagctgtttcagacacacatatagcagttaatgaacgccttactgccacaaatccatttgttctaatttatggtattttggctaagcatcaatcgccttcattgccaaatgatcaaagatttgaaagagatattgatcaattaaattctgaagtgaagccacgcgtatcaatagtgattgatcattacgaggatgtttcaactgaagaagtggtcaatgataatgaaataagaacaatcgaagaattaaaggccataaatactggtaatgaagatgtgaaaattaaaattcatcaacagctttcttatgactatccttttaaagttaacacgatgaaaccatctaaacagtcggtatcagagttaaaacgccaattagaaactgaagaaagtaatacaaattatgatagagtacgtcaatatcgtattggtgttgcatcatatgaaagacccaagtttcttacccaaacaaaaaaaagaaaagcaaatgaaatagggactttaatgcatacagtcatgcaacacttaccttttagagaacaacgtttaacaaaagacgaatga

SEQ ID NO: 1201 - DNA, 942 bp, Staphylococcus epidermidis
tttaggagggtgtatatgactaaatatgtgttgaaacgattgtgttatatgtttgtgtcgttatttattgttataacaattacatttttcttaatgaaattaatgccaggatctccgtttaatgacacaaaacttaatgcgcaacaaaaagaaatattaaatgaaaagtacggtttgaatgatccagtagcattacaatatgttaattatttgaaaaatgtagtaacaggtgattttggcaactcatttcaatatcataatatgccagtgtgggatttagttaaaccacgattgataccttcaatggagatgggaataacagctatggttattggtgttgttttaggtttagtattaggtgttgctgctgctactaaacaaaatacatgggtagactatacaacaacaattatctctgttatcgcagtatcagtgccgtcatttgtcttagcagttttattgcagtatgtatttgcagttaagttagaatggtttccagttgcaggatgggaaggtttttctacagctattttaccttctctagcactatcagctacagttttagcaactgttgcaagatatattagagctgaaatgattgaagtactcagttcagattacatacttttagctcgagctaaaggaaattctactttaaaagtgctctttggacatgcattacgaaatgcattaattcctattattacaatcattgtacctatgttagcaggtatattaacaggaacattaacaattgaaaatatctttggtgttccaggattaggtgatcaatttgttcgttctataactacaaatgatttttcagtcatcatggctacaacgatattattcagtactttatttattgtttcgatctttattgtagacattttatatggtgttatcgatccaagaattcgtgtacaagggggcaagaaataa

SEQ ID NO: 1202 - DNA, 1857 bp, Staphylococcus epidermidis
cgaaatttattattaatagggaagaatgtaacaatgagaaaaaaattaaataatgaatatcgctctgctaaaaaaatacgatatatgcctggattagatggtttgcgagcaattgcagtcattggtattattatttatcacttgaataaacaatggttaacaggtggttttttaggcgtagatactttttttgttatttcaggttatttgattacgagcttattacttaaagagtatgaagatactggaacaataaatcttaaaaatttttggattcgtcgtattaaaaggttattaccagcggtatttgcattaatagtagtagttggaattgcaactttattattgcaccccgagcatattgtaagagttaaacatgatatgatagcagcaatattttacgtatctaattggtggtatattgctaaagatgtcaattatttcgagcaattttcttttatgcctttaaagcacctatggtcactagccattgaagagcagttttacctttttttcccagcagtactcttattatttatggcaatagttaagaaaaagaaaaatgtcatactgatgttttggatcatatccctggtttcattattaatgatggttgttatttctcaacctcacttgaaccattctagagtatattttggaactgatacaagattgcagacactgcttttaggtgtacttctagcatttatctggccaccttttaaattaaatcccaatccacctaaaggattaaaaactgtgattaatagtgcgggtatcataggacttacatttgtaattctattattctttaatgttagtgatgaaagtgattggatttataacggtggattttatcttatttcaacaatgactttgctaattattgcaagtgttgttcatccaacgacaattttagctaagttattaggaaatcctttatttgtctacattggaaagcgttcatacagtttatacttatggcattttcctgtaattagctttattcatagttattttattgatggtcaattaccaacttatgtttatattatggatatcgtaattactgtattattagccgaattatcatttagatatgttgaaacgccattaagaaaggaaggtctaaaggcttttacatttaaaaaaacttacaaacctcagtttattagaacaattgtaacgttaattatgttgttaccttttatttttatactagttggagctttcgataaattcggaaaagatacaatttcaaataaagcacaaacatttaatacaaacgaggctgatcaatatcttattcatatgataccgattgataatatttcgttaactagcgatggtaaaaccaaagagaataagaaagacaatgatgtatatacacaaattaagccattattaattggtgattcagttatggtagatataggggaacaatttaaaacgaaagtacccaaagctaaaatcgatggcaaagtcggtcgtcaactctatcaggccgagagcctcgttaaaaatcaatatagacattataataaaccatcagaccaaatcatacttgagttaggtacaaatggtgattttacaaaagaacaattagataatttaattgacaaatttggcaaagcacaagtgtatcttgtgaatacaagagtgccaagatcatatgaaagtcatgttaatgagttgatggcaaaagcagctaaaaataaaaagaatgtaaccctaattgattggtatagtcgctcaaaagggcatacagagtattttgctccagacggaatccatcttgaaaatgatggcgtagaggcattgacagatgagatattaaaaaatataaagaagaaataa

SEQ ID NO: 1203 - DNA, 189 bp, Staphylococcus epidermidis
ccaataatatttaccactacacgctccccatcttttaatgtaggatccattgaatcacctttaatagaatatgattttccgacaaatttagtgattatggcaataagtgcaatggcaacggctatggcaacaatccactctaaaatttcttttttcaaagtctacacctcttctggttatttaaattga

SEQ ID NO: 1204 - DNA, 384 bp, Staphylococcus epidermidis
gaggtttcattaatgtccataaattcttatttgatttcgtcattatttacgccagttttatcaataattatatggttattttattcaaatcactttataaatttaatcaatatcttattttatacatcattcattatttttatagttgctttccttattttactcattcaagaaggaatatttgatgctacaagttttggatttcgtcgtttaaagtatcaactttcctcaactaagagaaaacgtatgatgaaaaatgaccactttttcaatccacaaaaagttaaaaaagaaagttatattatttccccatgggtagttccaacattgattattaacctcacttatataattgtgagtatcggagtatctttattaatataa

SEQ ID NO: 1205 - DNA, 1026 bp, Staphylococcus epidermidis
gtgattgaattcaaaaatgttaacaaagtttttcgcaaaaaaagagaaactattcaagctttgaaaaatgtatcatttaagattgaccaacatgatatttttggtgttattggttatagtggtgctggtaaaagtacattagttcggttagtcaatcaacttgagacagtatcagatggtcaagttattgttgatggtcatgagattgatacatataaagaaaaagatttacgtgatattaaaaaagatatcggtatgatctttcaacatttcaatttgcttaattctaaatcagtctataaaaatgttgcaatgccacttattttaagtaagacaaataagaaagaaattaaggaaaaagttgacgaaatgttagaatttgtggggcttgctgataaaaaagatcaatttccagatgaattatcaggtggacaaaaacaacgtgttgccatcgcaagagcattagtaacgcatcctaaaatattattatgtgatgaagcgacaagtgctctggatccagctactacaagctcaattttaaatttattaagtaatgtgaatcgaacatttggtgtgacgattatgatgattacacatgaaatgagcgtaattcaaaaaatttgtcatcgtgtagctgtcatggaaaatggcgaagtgatagaaatggggacagttaaagatgtctttagtcatccacaaacgaacactgcaaaaaatttcgtttcgacggtgattaacactgagccttcaaaagagttacgggcctcttttaactcgagaaaagattcaaatttcacagattataaactgtttttagactctgaacaaattcaattgccaatattgaacgagcttatcaacgagcatcatcttaacgttaacgtattattttcttctatgtcagaaattcaagatgaaacggtttgttatttgtggttgagatttgagcatgatgagtcatttaatgattttaaacttactgattacctttcaaaacgacatattcggtatgaggaggttatataa

SEQ ID NO: 1206 - DNA, 435 bp, Staphylococcus epidermidis
aataatgaattaaattcattctataggagagtgagatgtatggtaacattatttacttcaccaagttgcacatcttgccgtaaagcgaaagcatggttacaagaacatgatattccgtatacggagcgtaacattttttctgaacatttaacaattgatgaaattaaacaaattttaaaaatgactgaagatggaactgacgaaattatttcaacacgttctaagacatatcaaaaattgaatgtagatatagattcattaccattacaagatttatactcaatcattcaagataatcctggcttgttacgtcgtccaattattttagatgataaacgtttacaagttggatacaacgaagatgaaattcgtcgtttcctaccacgaaaagtacgtacgttccaattacaagaagcgcaacgtttagttgattaa

SEQ ID NO: 1207 - DNA, 873 bp, Staphylococcus epidermidis
catatgaaacctttcaaattaatctttattagcgcattgatgatattaataatgacgaatgcaacaccaatatcacacctgaatgctcaagctaatgaagaaaacaagaagttaaagtacgaaaaaaatagcgcactcgcgttaaactatcacagagtaagaaaaaaggatcctttgaatgactttatatcattactatctgggagtaaggaaattaaaaattatagtgtcactgatcaagaatttaaatcacaaattcaatggcttaaagcacacgacgcaaagtttttaactttgaaagaatttattaaatataaagaaaaaggtaaatttcctaaaagaagtgtttggattaactttgatgatatggatcaaacgatttatgacaatgcctttcctgttttgaaaaaatatcatattccagcaacaggttttcttattacgaaccacattggttctaccaattttcataatttaaatttactttcaaaaaagcaattagatgaaatgtatgaaacaggcttatgggactttgaatctcatactcatgatttacacgctcttaagaaaggcaataaatcgaagtttttagattcgtctcaatctgttgctagtaaagatattaaaaaaagcgaacactatttaaataaaaactacccaaaaaatgaacgcgcacttgcttacccatacggattaattaatgacgacaaaataaaagctatgaaaaaaaatggaattcaatatgggtttacacttcaggaaaaagctgtcacaccagatgccgataactatagaattccacgtattttagtaagtaatgatgcatttgaaacgctaataaaggaatgggacggattcgatgaagaaaaataa

SEQ ID NO: 1208 - DNA, 1086 bp, Staphylococcus epidermidis
aggaatgggacggattcgatgaagaaaaataaacttgaattagtgtatttacgtgcgtttatttgtgtcataatcatcgtgacacacttactaacgcaaatcactttagaaaatgaacagatgtctgatagttcactcatattgcaatattatatacgcaatatttttattttcggcacccctagttttataatattgtctcaattattaacaacattaaattacgaatcagtaactataaattatcttttttcaagatttaagtatatttttattccatatcttttaatcggcttgttctatagttatagtgaatcacttatcaccgcttcttcttttaaaaagcagtttatcgaaaatgttgttttaggacaatggtatggctatttcattatcataattatgcagttctttgttctatcttatatcatttacaaaattaattttagattgttcaatagtaaaattttgctgcttttagcatttatagtccaacaatcttatctacattattttttgaataatgacacttttcatcaattcatgactcattattatccattaagcgaaaatacaatgatattaggatggatattctactttttcttaggtggttacattggctataattatgaaaaaatattatctttcttagaaaaatatttaattatagttattatgttaactttaggcgcatatgttttatttatcgctgtttccggtagtgattattggaatgtcacaagctttacttatacgttaacattatataatagtgtcatgttcttcttattactaggagtctgtatgcactttaaaactatgttattaaatactattaaagctattagtgcattttcctttttcatttatttgttgcacccaattatcttagattctctttttgcttacaccaacatatttgaagataatacaattgttttcttggcgatttcacttttaatgattctaggaatttgtataggcgtcggaatgatgttaagagagttttatatattcagatttgtaattggaaaacaaccgtacaagttacaatttgaccaataccagcctaactggaattaa

SEQ ID NO: 1209 - DNA, 195 bp, Staphylococcus epidermidis
aatgaatttaaagataattattgtcgagttattaaaaaatcatttaattatgatcaaacagggaaaagaagacgtattataagagagttcgtcaaaaaattgacattatttcatgaatattcaattttatttatcaaaattaaatcaattcaatcagacatatttaaacatatgctttatatcaagtcatcataa

SEQ ID NO: 1210 - DNA, 339 bp, Staphylococcus epidermidis
agcattaaaaagaaagaaaggtggctatgctacatggtcaagcccagacagaggcaatatccaacggtaacctcttatttaaatatagttagggagagcttatttattactatatccggagtattttggatgtattgtatcgttgtgatgattgtttatataggaactcttatcaattctcaaatggaaagtgttataacaatacgtattgcattaaatgttgaaaacacggaaatttacaaattattcggatggatgagtttgtttgtacttattatatttatcttttttacatttagtctcgcgtttcaaaaatataagaaaggtcgtgacatatga

SEQ ID NO: 1211 - DNA, 1269 bp, Staphylococcus epidermidis
aaatttgaaaacttactcttcacattgagacgatttttttataatatatcactcatattgatttttgatattaagaaaagggaggaaacactcatgaaagataataaaatgttgttcattatttttatgataggaacatttacagtaggaatggctgaatatgtagtgacaggattacttacacaaatcgctgacgatatgaaggtttctatttcgagtgcaggtttattaattagtgtttatgctattagtgttgcattgatagggcctttaatgcgaatcataacattgaaagttcacgcccaccgtctgttaccaattttagtagcgatttttataataagtaatttagtgggaatgttagcaccgaattttaatgtattgttattatcaagactcatgtctgcggcaatgcatgcgccattcttcggtgtgtgtatgagtgttgctgcgacagtcgcacctcctgctaaaaaaacacaggccattgcacttgttcaggcaggtttaactattgctgtaatgttaggtgtaccattcggatcatttttaggtggctttgcaaattggagagttgtttttggatttatgattgtgttggcaatcattactatgttaggaatgattaaatttgttccaaatgtttctttaagtgcagaagcaaatattagcaaagaattaacagtgtttaagaatccacacattttaattgtgattgcaattattgtgtttggttactctggtgtgtttactacttatacatttatggagccaatgatacgagatttttctccatttaaaattgtaggtttaactgtttgtttatttatgtttggtctaggcggtgtgatagggaatttaattactggtaatgtaccggaagataaattaacaaaaaatttatacctcacatttcttttactatttgtaacaatcatactatttgttactgttattcaaaattcaatattagcattaatcatttgcttcttattcggttttggtacatttggtacaacaccgttacttaatagcaaaattatcttaagtgcaaaagaagcaccacttcttgcaagtacgttagcagcttctattttcaatgttgctaattttcttggtgcaatcattggatctatattattatcaatagggttaccttacattcaaattactttgatatctggtggaattatagtgttgggtatgcttcttaatcttgttaatcaactttatgaaaagaaacatatcacatttaatgaatattcatga

SEQ ID NO: 1212 - DNA, 1521 bp, Staphylococcus epidermidis
tccctcggtgaggcaccgtctgtgactgtgattcccgcaacatttgcatcaacagaatctactgctacaaatcagacacaacaaacagtactttttgataattctcatgctcaaactgcgggcgctgccgattgggtgattgatggcgctttctcagattatgcagattcaatgagaaagcaaggttaccaagttaaagaactacaaggagaatcaaacatttctgatcaatctttacagcaggcgcatgtattagttattcccgaaactaacaatccatttaaagaaaatgagcagaaagcaatcattaattttgttaaaaatggtggtagcgtcattttcatctcagaccactataatgccgatcgtaatttaaatcgtattgattcttcagaatcaatgaatggttatcgacgtggcgcatacgaaaatataactaaagatatgaataatgaagaaaagaattctaacgttatgcataacgttaagagttctgattggctctcacaaaacttcggtgttcgctttagatataatgcacttggagatatcaatactcaaaatatcgtttcaagcaaagatagttttggtattactaaaggtgtacaatcagtttcgatgcacgcaggttcaacattagcaataactgatcctaataaagctaaaggtattatttatatgccggaacatttaacgcatagtcaaaaatggtctcacgcagttgatcaaggtatttacaatgggggtggcatcaacgaaggaccttatgtagccatttcaaaaatcggtaaaggtaaagctgcatttattggcgatagctctctcgtagaagatcgttcacctaaatatcttcgtgaagataatgggaaacctaaaaaaacgtacgatggttttaaagaacaagataatggaaaattattaaataatttaacaacgtggctaggcaaaaaagaatctcaaccttctatgaaagatatgggtattaaacttgataataaaacaccgctacttaactttgagcaacctgagaattcaattgaacctcaaaaagaaccttggactaccccaatagaaggttacaaatggtatgatcgttcaacatttaaaaaaggtagttatggaagtaatcaacggggtgctgacgatggagtagatgacaaaagctcttctcatcaaaatcaaaatgccaaagttgaattaactttacctcaaaatatccaaccgcatcatccatttcaatttacaatcaaactcacgggatatgagcctaatagcacaattaacgatgtaagagttggactttataaagatggaggtaagcaaatcggtagcttttcttctaaccgtaaccaattcaatactcccggctatagtcctagccaatcaattaaaacaaatggagcgggtgaagcctcattcacactcacagctaaagtgacagatgaaattaaagatgctaatattcgtgttaaacaagggaaaaaaattctattaactcaaaaaatgaatgaaaatttttaa

SEQ ID NO: 1213 - DNA, 597 bp, Staphylococcus epidermidis
tatatttttagaaaattgaataagggggagattttagaattgaaagataagattattgataacgcaataaccttattttccgaaaaggggtacgatggtactacacttgatgatatttctaaaagtgtaaatataaaaaaggctagtctatattatcattacgataataaggaagaaatatatcgaaaaagtgttgagaattgtttcaattactttatagattttttgcttaggaaccatgatgataattattccattgacggactttaccagtttttattcaaatttatattcgacgttgatgagagatatattaaattatatgttcaattatctagtgctccagaagcactgaattcagaaatcaaacaccatcttcaagaaattaatactaccttacatgatgaattgataaagtattatgatcctacgcacatcgctttggataaagaggactttataaacttaattcttctttttcttgagacttggtattttagagcctccttttcacaaaaattcgggattattgaggacagtaaaaaccgttttaaagaccaagtatattcactgttaaatgtatttttaaaaaaataa

SEQ ID NO: 1214 - DNA, 1257 bp, Staphylococcus epidermidis
cgaaaggtaggtgaaaaaatgcatgtatttaactttttacttttctatccaatttttatgtcaatttactggatagtaggatcgatttactatttttttattaaagaaaaaccctttaatcgatcattgttagtaaaatctgaacatcaacaagttgaaggcatctcctttttattagcttgctacaatgaaagtgaaacagttcaagacacgctttctagtgttttatctctagaatatcctgaaaaagaaattatcattatcaatgatggaagttctgataatactgctgaaatcatctatgacttcaagaaaaatcatgattttaaatttgttgacctcgaagtcaatagaggtaaagctaatgcactcaatgagggaatcaaacaagcatcttacgaatatgttatgtgtttagatgctgacactgtcattgatgacgatgcgcctttttatatgattgaagactttaaaaagaatccaaaattaggcgcagttacaggtaatccacgtattcgtaataaaagttctattttaggaaaaatacagaccattgaatatgcaagtattattggttgtatcaagcgaagtcaatctcttgcaggagcaatcaatactatttcaggtgttttcacactatttaaaaaaagtgcactcaaagatgtaggttattgggatactgacatgattactgaggatattgctgtttcatggaaactccatctttttgattacgaaattaagtacgaaccacgtgctctatgctggatgttagtgcctgaaactataggtggtttatggaaacaaagggttcgatgggctcaaggcgggcatgaagtacttttaagagacttttggccaacaattaaaactaagaaattatcactatatattttaatgtttgaacaaatcgcatcgattacatgggtctacatcgtactatgttatttatcttttttagtaatcacagccaacatcttagattacacatatttaaaatatagtttttcaatctttttcttttcatcctttacgatgacctttatcaatatcatccaatttacagttgccttatttattgacagtcgctacgaaaagaaaaatatagttggcctgatatttttaagttggtatccaacgttatactgggttatcaatgccgcagttgtcattatggcatttcctaaagcattaaaaagaaagaaaggtggctatgctacatggtcaagcccagacagaggcaatatccaacggtaa

SEQ ID NO: 1215 - DNA, 201 bp, Staphylococcus epidermidis
ggtaaccctattgataataatatagatccaatgattgcaccaagaaaattagcaacattgaaaatagaagctgctaacgtacttgcaagaagtggtgcttcttttgcacttaagataattttgctattaagtaacggtgttgtaccaaatgtaccaaaaccgaataagaagcaaatgattaatgctaatattgaattttga

SEQ ID NO: 1216 - DNA, 1602 bp, Staphylococcus epidermidis
gacatagtttttaatttatatatcataaaactatgtctcttccccgtacttgaggaggttaattcaatgtcccaaattgctttctatatccttagtgatgtccacggttttatattcccaacagatttttcatcaagagaaaaagatttacctatgggtttgttaaaagctaatcatctaatcgaacaagactgcgtgcactatgacggcagtgtaaagattgataatggagacttcttacaaggttctccattatgtaactacttagtatccaaattaaagagtagtctcccattaacatcaatatataatcgtttagggtttgattttggaactgttggcaatcatgaatttaattatgatttaccttatctaaagcaggccatcaatcaacttcattaccctgttttgtgtgcaaatataattgaaaatacacaaccattcactggccaaggtattcattattttaaagtaaatggtttaactataggaactattggattaaccactcagtatatccctcactgggaacaacctgattacattaaaacactcaattttaacagtgctatccacacattaaaatctgagttacctacacttagggaaaagagtgatattgtagtagtaagttatcatggtggttttgaacgtgatttagatagtggcctcccgactgaggcgcttactggggaaaacgaagggtatgatattctaagacagtttagcgatagtatcgatgtgttgataaccggccatcaacatcgtgatattgcgacaatcaagaaccaaacagccatcattcaaccaggttcaaaaggtacaaaagttggaaaaatagttattgaatatacacatgataaaaaagtattaattaaagaatgtaacttaatgaatgttcataacagtacctcctttaagccgaatgacgaagatatcgctttacgtaatcaattggaagattggcttgatactcaaatcgcagaactcccctacgctatgagaataaacaattcatttgaggcaagaaaatcaccgcatgcatttgttaaccttcttaattatattttattagaaaaaagtggtgcagatattgcatgtacagcactatttgattccgcaaatggctttgatgagaaagtaaccatgcgcgatatcatcaataattatccttttcctaatacttttaaagtgatagaacttagtggaaaagatattaaacttgcaattgaacgaagcgcaagttattttgacattgttaatcataaaatcacagttaataaagagtttctagaacctaaacctcagcatttcaactatgacatatttgcaggtatccaatatacaattcatgttagtcatccttacggtgaacgtgttagtgatttactaattaatgatgcaccactacaaagtgatcaaatatatacaatatgcgtaaataattatagagctgttggtggcgggaattatgatatgtacgttaacaaacctgtgataaaagatattcaaatcgaaggtgctcaattgttaatagattacttgtctcacaatgatttatctcaaatcccacaagtgattgatttcaatgttgttaagtaa

SEQ ID NO: 1217 - DNA, 2100 bp, Staphylococcus epidermidis
cccttacccgtggtgtgcacagatgtgctgactgtgaagacaagacaaaataaatacagtattcgtaaatttagcgtaggtgcatcatccattctgattgcagcattattatttatgggtggaggatcagctcaggcagctgagcaacaacaggataagggaactgttgaaaatagcacaacacaatctattggggatgaaaatgaaaagttaagtgaacaacaatcaacgcaaaataagaatgttaatgagaaaagtaatgttgattctattactgaaaatgaaagcttacataacgaaacaccaaaaaatgaggatttgattcagcaacaaaaagattctcaaaacgacaataaatctgaatctgtagttgaacaaaataaagagaatgaagcatttgttaaaaaacattccgaagagaaaccacaacaagaacaagttgaactggaaaagcatgctagtgaaaacaatcaaactttacactcaaaagcagcacagtccaatgaagatgtgaaaactaaaccttcacaacttgataatacaactgcccaacaagaagactctcaaaaagagaatttgagtaaacaagatacacaatcatctaaaactactgatttactacgagcaacaggtcaaaatcaatcaaaagatagccaatcaacagaagaggtaaacaaagaagtaaaaaacgacactcaacaagtgactgctaagaacgatgacgacaaagttgaaacatttaatttaaatagtaaagaggaacctcttaaagttgacaagcaagcgaatccaactacagataaagataaatcttctaaaaatgataaagggtctcatgatggtctcgctaatttagaaagtaatgctgttgctacaactaataaacagtctaagcaacaagtaagtgaaaaaaatgaggatcaaacaaataaatcagcaaaacaaaaacaatataaaaataatgatccaattattttagtacatggtttcaatggatttacagacgatatcaacccatcagtgctaacgcattattgggggggcgataaaatgaatattcgccaagatttagaagaaaatggatatgaggcttatgaagcaagtataagtgcatttggtagtaactatgaccgtgctgttgagttatactactacatcaaaggtggacgtgttgactatggtgcagcacacgcagctaaatatggtcatgagcgttacggtaaaacctatgaaggtgtgtataaagattggaaaccaggtcaaaaaatacatttagttggtcatagtatgggtggtcaaacaattcgccaattagaagagctattgagacatggtaatccagaagaagttgaatatcaaaaacaacatggtggggaaatttctccattattccaaggtggccacgacaatatggtgtcatctattacaacactcggtacaccacataatggtacgcatgcgtcagacttattaggtaacgaagcaattgtacgtcaacttgcatatgatgtaggtaaaatgtatggtaataaagattcacgtgtagactttgggttagaacactggggattaaaacaaaaaccaaacgaatcatatattcaatatgttaaacgtgttcaaaattcaaaactatggaaatcaaaagatagtggtttacacgatttaacacgcgatggcgcaacagatttaaaccgaaaaacatcattaaatcctaatattgtatataaaacttatactggcgagtcaacgcataaaacattggcaggaaaacaaaaagctgatcttaacatgttcttaccatttacaattactggtaatttaattggaaaagctaaagagaaagaatggagagaaaatgatggacttgtttcagtcatttcttcacaacatccatttaatcaaaaatatgttgaagctacagataaaaatcaaaaaggtgtatggcaagtaactccaacaaaacatgactgggatcatgtagactttgtaggacaagacagtacagatacaaaacgtactagagatgaattgcaacagttttggcatggtcttgctgatgatttagtacaaagtgaacaattaacatcaacaaataaataa

SEQ ID NO: 1218 - DNA, 267 bp, Staphylococcus epidermidis
acagactactcatcaattatttttgatgctttaaccgtagataaaaaaggttgcttatacacacccaatcactctcaatatgtcgaagaacgtggcgtctatcaagacgtaatggacaccttaaaacctatttggtataccgatgctgaactattaataaatgatttaattactgatagcatcccacaattaaacaataaatatacaaataaaaataatcagtcatttgaatatattagtaaacttatttcaaatcaattgaaataa

SEQ ID NO: 1219 - DNA, 1023 bp, Staphylococcus epidermidis
ttcaattcatcattagaggagtgtagaaatatggtagaaaaattcaaagcttttgtagtcgatcaagatgacaacggtattgtttcaaatagttataaagaactaactaaagatgacttacctgagggtgacgttttaataaaagtacattattctggcataaattataaagacgcactagccactcaggaccataacaaaatagtaaaacaatatccgatggtccctggtatagatttagcaggtaccattgaggaaacaaatgctccaggctttgaggttggagataaagtcatcgtaacaagctatgatttaggtgtaagtcattacggaggcttcagtgaatacgcacgtgttaaatcagaatgggtgattgaattacctgaagatttaacattggaagaagctatgatttacggtactgctggctatacagcaggtttagctatagaacaacttgaaaaatcaggtatgtctattgaaggtaaagaagtgcttgtacgaggtgccactggaggcgtcggaacgatttcattactcatgttaaataacttagggtatgatgttattgcaagtacgggtagagatgacgccgaagaaaaacttaaaaagcttggtgctaaagaagtaattggccgtttaccagaagataatagtaaaccattagagaagagaacatggcaggcagccattgatccagttggtggtgaaaacttaccgtacatcgtcaaacgattggataacaacggaagtgttgcattaattggcatgactggtggtaacaattttgaaacaaccgtctttcctttcattttaagaggagcaagtataattggtatcgattcagtatttactccaattaaactaagaaaacgtgtttggagaagacttgcaaaagacttaaaaccacaacaattacatgacatcaaacatgttatttcattcgatgaaatcccaaaagccatcgatcaagtcatcaatcataataatactggacgtattgtcattgatttcaatgtttaa

SEQ ID NO: 1220 - DNA, 1089 bp, Staphylococcus epidermidis
gatataacatcaatggaaggaggctataaattgaatataacaaaagcaattgttgtagcaatctatatcattgttggtgcagcacttggtgttataattatacccgaagttgttacagatcttggcattcatcaccatgcggttatcactaattattatgtagatggtttcatagggatcattatattttttataatatttggattgttcattaataaagtaacatatacttttaaacaatttgaacaattaatcatgagacgtagtgcggtagaaatattatttgctacaattggtttaattattggtttatttatttcagtgatggtttcttttatcttagaaatgataggtaattccatattaaatcactttgtacctatgataatcactattattttatgttatttagggtttcaatttggtctgaaaaaaagagatgaaatgcttatgtttttaccagagaatatggcacgttccatgtctaataatatacgaagagcgacacctaagattgtagatacaagtgccattatcgatggaaggatattagatattatacgttgcggatttatcgatggtgatatattgataccacaaggcgttataaatgaattacaggttatagcggatgctaaagatagcgtgaaacgtgaaaaaggtcaaagaggattagatattttgaatcaactttatgatttagattatcctacacgcgttatacatccaactcaatcccatagtgatatagatacattattaattaaattagcacaacagtatcatgcacatgtgattacgactgattttaatttaaataaagtatgtcacgttcaaggaattacagcactcaacgttaatgatttatcggaagcaatcaaacctaatgtacatcaaggcgaccagttaagtattttattaacgaagataggtaaagagccaggacaaggcgtaggatatttagatgatggtacaatggtggttgttgataacgcgaagagttacattggtcaacaagttaatttagaggttgtaagtttgttacaaacatcatcaggaagaattgtttttgcgaaatttgttgactga

SEQ ID NO: 1221 - DNA, 1242 bp, Staphylococcus epidermidis
gtaaagtttttagcttctcaattattcaaaggaggtttttttatcgattacttaggtgttgatattagtaaaagaagtagtgtagttgcacattataaaaatgaaaaattccaaaaagagtttttcatccaaaataataaaaatggttacaactatttactcaagtatttgaatgacttagaccacccacaactcatttttgaatctacaggtatctattcaagaagtatggaacgattttgttgtgtaaatcaaattaactatattcaaatgaatccgttagaagccaaatttaaaacgagcgctctaagatcatggaaaactgatcaggcagatgctcataagcttgcttgtttaggaccgacgcttaaacaaacagacaacttacctatacatgagttaatattctttgaattaagagaacgcgtccgttttcatctagaaatcgagaatgaacaaaatcgacttaaatttcagatccttgaattactccatcaaacattccctggtttagaaagattatttagtagtcgatattcaatcattgcactcaacatagcagaaatctttactcatccagacatggttcttgatatcgacaaggaggtactgattacacatatattcaattctacagataagggaatgtcaatggataaagctacaaaatatgcacttcaattaagggtgattgctcaagaaagctatcctaatgtcgatagacattcctttctagtcgaaaaattacgcttacttattcaacaattaaaacaatctattcatcatctcaaacaattagatgatgccatgattcaattagcacaacaactcgattattttgaaaatattcattcgatacctggtattggtaagctaagcacagctatgattattggggggattggtgatattaagcgatttaaatcaaataaacaactcaatgcttttgttggcattgatatcaaacgatatcaatcaggtcatacacactgtagagataccatcaacaagcgtggtaataaaaaagcgagaaaacttttattttgggtgattatgaatataataagagggcagcatcattatgacaatcatgtcgtcgattattactacaaactaagaaagcagcctaatgagaaacctcataagactgccatcattgcttgtataaatcgattattaaaaacaattcattatcttgtaatgaatcataaattgtacgattatcaaatgtcaccacattag

SEQ ID NO: 1222 - DNA, 888 bp, Staphylococcus epidermidis
tttgaaatgtcagctcaagatccgcgcaataaatttaaaactgataattatgaaaaacaagaacaagaagttccaggtatacaagctaaaatgtcaccacaaccagattgtggggaagattcttatcatggccaccatcgattagatggctttaaaatactagtgactggtggcgattcagcaattggacgtgcggcagcaattgcttatgctaaagaaggtgcagatgtagcgattaattatttaccaagtgaacaacaagatgccgatgatgtaaaacagattattgaaaatgttgggcaaaaagctatcttaattcctggtgatattagagatgaacaattcaactatgacatggttgaaaaggcttatcagcaattaggtggtttagacaatgtaacgttggttgctggtcatcaactttatcaagatgaattatcggagtttaaaactcaagattttaccgaaacgtttgaaacgaatgtctatccggtattttggacagtccaaaaagcgcttgagtatttacaaccaggaggctcgattacaacaacatcttcagttcaaggttataatcctagtccaattcttcatgattatgctgcaacgaaagctgcaattatatctttaacaaagagtttttcagccgaacttggccctaaaggtattcgtgttaactgtgttgcacctggaccgttttggtcaccacttcaaattgtcggtggacaaccacaaagcgctatacctacttttggacaaaacacaccgttaggacgtgccggccagccagttgaatgtgctgggacatatgtgttattagcctctgatgatgcaagttatattaccggtcaagtatatggtgtgactggtgggactcaaatagattaa

SEQ ID NO: 1223 - DNA, 204 bp, Staphylococcus epidermidis
ataagccagtccagtgattacgttcgacaccttaatcattggactggctttttcatatctatcaatttaaataataatcaatataaattcgctatattgattaaaaataatttattgcgtttcattagaactattgagatgataactgcttttgcatttaaaatcttaatttacttattagggtttgcattaacaggatattaa

SEQ ID NO: 1224 - DNA, 216 bp, Staphylococcus epidermidis
gtcctacttcctttctctaaatttattcaaattaaaatctgcaaaaaagtgcatattaaaatacaccattcattatttattgaaaatacttctttcctcaattttaagctaatgttagaaaaatacctttattttactttaatatctccattttcattgattaatttcactttattatttccattttcaactttactattatataacacacgatga

SEQ ID NO: 1225 - DNA, 480 bp, Staphylococcus epidermidis
tttgccatgttatggcatttaatttttatgattcctacaattattggttactcttttggaatgttctgtttaatatcaagtgaaacttttaaaagtaaaggatttctcttgttgggggtaggaatttttatcttttctttaatttatattttgatttatagtttagttacattaatacctaatgttgcgatattatcaagaagattccatgatcgctcaatgacgatgactcttccgattattttttatgttttcactgtcattgtatcaggttttaattatttaccaaatatagataattcagcggtattaatatttatgggaattatctgcttaatctactggattgggtcgatattaatattagtattgacttgcttagatagtaaaacagagtctaataaatatggaccaagtccaaagtacaatcgtaacgagacaaatttccatggtgataatgctaatccagttgataaataa

SEQ ID NO: 1226 - DNA, 603 bp, Staphylococcus epidermidis
tttcaacttactcgaaaggttagatatatgaatctgaataaacagcaacatgaatatacagcactgtgtctatcgcaaacagaaaataaatcttctgaagaactatttgagtctttaatagaagagctaaagccactgatttacaataaaataaggtatatctcccataataagtatgacattgaagacatgtatcaagagattgttattaaattctaccgtgccttgcaaaaattcgactatcaacaaggtgtaccaatagaacactatatttactttttaattcgttcggttaaatatgactatcttagaaaagtaaaagcgaattataaacgtcaacctctacttgttaatgaatacattgttgaatataacgctactttggcattaaacgatatagaaagatcgataattagaaaagaattaacattagcttttaaaagaagcgaagtcaaactcagtcgaatggaaagacgtatcattcgattactacttaatgattacaagccaaaggagattgctatggttttaaatttggaatccaaagttgtttataatgcgattcaacgtagtaaatgtaaacttaaaagaagttttgaataa

SEQ ID NO: 1227 - DNA, 969 bp, Staphylococcus epidermidis
ggtatcaaaacaatgttactttttttatgttttctaatcgaattattacttattgttttattatatacgaagcaatcgtttactcttaatttatttagtttcatcttatataacatcattggttttgttatgatgacttatcatatggtaactgtatcaataccatatgatatgtttatcattgtaattgtagcaatgatactgttgttgattaaacatcgttatattttcaagttgcaaacaggacgtttttttattttacaacttagtcatcatttttatactgtggggctatttgctgtgagttgtttatatataagtactattcccctaattatcattaatagcttagctttatgggccgctaccattgcatttagtacaatttattcatttatcggatacttatcttggtctacagcttttgaaaatcatcaatattataaacacgtaaagttaattatggtgcttggagctggaattttctctgaagaagtgactacgcttcttgctgcaagacttgataaagctttatctgtttatcattcacaacggactaaacctatcatcattgtaagtggtggccaaggtcctgacgaaccaatttcagaagcacttgcgatgaaaagataccttatagctcacaacgttccggaaaaccatatatttatggagaatcaatccacgaatacacgaaccaatttcttatactctaaatctatcattcattcgatgatgcctacttcaagtcagatgttgtgtgtaacaagtcaatttcatgttttaagagcgcttaaatttgctaaaaaagctcatctttctttcgatggtattggaagtcgtacaccataccactttttggcacaatctatgattatagactttttgggtttaatgtatcaatataaaacaatacttactatttatttcgctatgttgttttggcttgcaatactacaaaccatataa

SEQ ID NO: 1228 - DNA, 633 bp, Staphylococcus epidermidis
atgtctgaaacattacaaaaccaaagacaattcaactctcaatttgaacatcaagagatccatcgtggaaaaagatatggtaaaaagaaacgctcatgggtaagtctcattattcaagttttcgttttagtattaactgctattactggctatagtatgcttaaacaacctatatttaaaatttcatttgtaaatgaaactataaatttccatcaattaagaaattttcaagatacagttacgcaaatcggtaatttgaatttaggtaatattgatcaattacaacagtctgtcgataatctcatcattatatttaatattttctttgtcctatgtctgattagtttgtttataaccgtaattacaattatttttaatcgcacagcactcaaagtagtcaatatattacttttagctattatgctagtcattacattgtatttcagttatatcatacatacaattgctcagaaaatttccgaatctctaaaacaatattatttaacagtatcaccagaacaagtattaactgaagcagatgcgattcacaatgcactgatactcattggatgtagtattgcgttattgattgtaagtttgtttttccgtaatcgtttaccacgtattaaataa

SEQ ID NO: 1229 - DNA, 477 bp, Staphylococcus epidermidis
atgaacaagacatttaccgtaacccgaactgtgacagaagatgctatagataataataatcatatgcatgacgcatattataatattatttttagcgaggtcattaataaattcaatgaggttcatggtttatcatggtcagagagagaccgtctacaatatacagtttttactgttgaaacacacactacttttttacatgaattaacacttggtcaagaattcaatatagagctattcctttataattacgatgacaaacgaactcatttctttctgagaatgttaattgataatcaagaagttgttgcaaccaatgaggtcatgatgttaggaatagataggacacaacgtcgtgctgcaccatttccaaaacattatctgaatgctatacaagattatgctcataagcaagaaaaaattgaatggccaccacaattaggccactcaattggaataccatataaaggagaataa

SEQ ID NO: 1230 - DNA, 2184 bp, Staphylococcus epidermidis
agagaaaggacgtatagtatgaataaactgacaattattgtcacgtattataatgcggaggaatacatcacaggttgcttagagagtattaagcaacaacgtacacaagattttaatttgattattgtgaatgatgggtcgacagaccaaagtaaaaaattaatggatgaagctattaaagactatgataaaaacattcgatttatcgatttagatgaaaatagtggtcatgcacatgcgcgtaatattgcattagaagaagtagaaacaccttactttatgtttttagatgcagatgatgaattagcttcttatgcaatcacgttttacttagaaaagtttaataatactgatggtttaattgctccaatacattcttttactacacaacgtccgcaatttgttgatttagatcgagtaagggttgaatactttaatgccaaagagaatattaattcatttttaagaaaacagtcagcttgtaacattatttttagaacagctattgtcagggcgcatcatattcgatttaatgaaaatttaaatacatatgtggattggtcatttgttcttgaatatatgaagtatgtaaataagtttgtacgtatttttaacttcccattttatttccgtggggaagtctatgatccatttgaaacacttacattaagtgaacaaaattttgatattttatttaaagattacgtcaacagcttttatgatgccattaaacgagcaacaaatccaaaagttagagaatttattgtcactaaaatgggaaataaaattgctaatgaatttgaaccaactcgatatgatattaatgaacgctatcaaacacataaggatacgcttgttgaattatcgaaatttttacatgtacatttagttaaaaaccaaaagctaataaataaaattgaaacaattttgttaatgaataatgaaactgataaagcttttaaagttaatcaatttagaaaaacgttgcgacatgttaaaaatattgttctaagaagaaaaaataaagaacgttcattgtatgatttaacagataaagaagataatgttaaaccgaaaacgattgtctttgaatcgttcggtggtaagaattacagtgatagtccaaagtatatttatgaatatatgcaaaagtattatcctaattatcgctatatatggtcatttaagaatcccgataaaaatgtcgtaccgggtagtgctgaaaaggttaagcgtaattcagcagagtattatcaagcatactcggaagcaagtcattgggtatcaaatgcgcgtacaccactttatttaaataaaaaagaaaatcaaacgtacattcaaacttggcacggtacaccattaaaacgtttagcgaatgatatgaaagtggtacgtatgccgggtactacgacaccaaagtataagcgtaattttaatcgtgaaacatcacgttgggattatttaatttcgccaaatagatattcaactgaaatatttagaagtgctttttggatggatgaagaaagaatattagagataggttatccaagaaatgatgtattagttaatagagccaatgatcaagagtatttagatgaaattagaactcacttaaatttacctagtgataaaaaggttattatgtatgctccgacatggagagacgatgaatttgtgagtaaaggaaaatatttgtttgaattaaaaattgatttagacaacctttataaagaactcggagatgattatgtgattttattacgcatgcattatctcatttctaacgcacttgatttatctggttatgaaaattttgcaattgatgtttcaaactataatgacgtctctgaattatttttaataagtgattgtttaattacagactattcatcagtaatgtttgattatggtattttaaaacgccctcaatttttctttgcatatgatatagacaaatatgataagggattacgaggattctatatgaattatatggaagatttaccaggacctatttatacagaaccatatggcctagctaaagaactaaagaatttagataaagtgcaacagcaatatcaagaaaaaatagatgcattttatgatagattttgctctgtagataatggtaaggcatctcaatatattggggatttaattcataaggatatcaaggaacaatga

SEQ ID NO: 1231 - DNA, 1500 bp, Staphylococcus epidermidis
aaaagggggactgtgtttgttatgaatactcaacatagcaaaacagatgtcatcttaataggtggcggaattatgagcgcaacattaggaactttactaaaagaattaacaccagaaaaagatatccaattgttcgaaagattgagtcaacccggcgaagaaagttcaaatgtttggaataatgcgggaacaggtcattcagcattgtgtgaattgaactatacgaaagaaggtaaagatggttcagtagatattactaaagcaattcatattaacgagcaatttcaaatatctaaacagttttgggcttatttaatacgtgaaggtcatattgaaagtccagataaatttattcaatcagtgccacatatgagctttgttaaaggggaagaaaatgttaaatttttaaaaagtcgagtggcgagtttacagaaaaatgtattatttgaaaaaatgaaaatttctcaagatccagaaaaaattaactcatgggttcctttaatgatggaaggacgccaatcagatgaagcaattgccatcacgtatgacgagacaggtacagatgttaactttggtgctttgactaaaaagttaatagctaatttacaacaaaaaaatgttggcattaattataaacatgaagttttagatataaaaaaattaaataatggtaactggcaagttgtggttaaagatttaaatacatcaaatgtaatgaattatgaatctaagttcgtcttcatcggagctggtggtgcaagtttacctttattacaaaaaacaaagattaaggaatctaaacacattggtggtttcccagtaagtggattatttttacgatgtaaaaatccagatgtcatacatagacatcatgcaaaagtctacggtaaagccgaggttggtgcacctccaatgtcagttccacatttagatacacgatttgttaatggtgaaaaatcattactatttggaccttttgcagggttttcgccaaaattcttaaaaaacggttcatatttagatttagttaaatctgtgaaacccaataatatgataacaatgttaagtgctggcgtaaaagaatttaatttgacgaaatatttagtttctcaattaatgctttcaaatgaagaacggatcaatgatttgcgtgtattcttaccagaagcgaaagatgaagattgggaagtaattactgcaggtcaacgtgttcaagtaattaaagatacagataagtctaaaggtcaattacaatttggtacggaagtaataacatcagaagatggttcacttgctgcattattaggtgcttcacctggtgcttcgactgctgttgatatcatgtttgatgtcttgcaacgttgttacaaatcagagtttaagtcatgggaaccaaaaattaaagaaatggtcccatcatttggtttaaaattgtcagagcatgaagatatgtaccattcaataaacgaagaagtaaaaaaatacttgaatgtaaagtag

SEQ ID NO: 1232 - DNA, 1557 bp, Staphylococcus epidermidis
  unsure (16): Identity of nucleotide at the above locations are unknown.
ctgacacatgccggcngacatatcatatcaagatatgaggaagactatgcgaacggaacttatatgaactcattatatgataaaccgttacctggaaactacttcttacaaaatgctgacgactatttacaaattcttgaacaaggcgttcaatttgtattagaagatagtaaagttaataaaaacgatgtggttggaattggagtcgactttacaagcagtacaattatctttctcgatgaacaatttgaaccgcttcatcgtcatgaagatttaaagacaaatccacacgcgtacgtaaaattatggaaacatcatggagctcaagatgaggcaaactatatgattcagatgagtaagaataaaaattggttagattattatggctcaagcgtaaatagcgaatggatgataccgaaaatcctggaagttaaacatgaagcaccagaaatacttagaagagcacggtatataatggaagctggagattacatcactagtatactaacaaattcaaatatacgatcaaattgtggtattggttttaaaggtttttgggacaatgaagctggatttaattacgacttcttccatagcgtggatcctgatttacctaaaatcgtcaaagaaaaatgtgaagcgccaatcatatcaattggagaaagtgcaggtcgtttatgtaaagactatcaacaaatatgggggctttctcaagatgtccaggtttcaccttttatcatagatgcacattctggcgtcttaggtgttggggcaatagaagctggagaattcactgcagtcattggtacaagtacttgtcatctcatgctagattcaagacaagtacccatttcttcaataactggctcagttaaaaatgctattatacctggattatatgcctatgaagctggtcaaccagctgtcggtgatttgtttgaatactcaaagaaccaagcacctaaacatattgtagatcaagcaaatgaacatcatatgcctgtgcttaactatttagaggaattagcaagtcacattagaatagaagaacaacatgttgttgttttagattggttgaatggaaatcgtagtatacttagtaatagtcatctaactggaagtatctttggtcttacacttcaaacaccgtatgaaatgattcatcgagcatatattgaagctacagcatttggaacaaaattaattatgaaacaatttgaagataatcatattcctgttcatacagtgtatgcgtctggtggtatcccacaaaagagtaaattactcgttgaaatttatgcaaatgttttaaataaaagggttgtcgtcatagattcatctaatgcttcagcattaggtgcagcgatgttaggtgcaaatgttgggaatgcatatagtacattaaaagaggcggcattatctatgaagcaacctatagcttatatacaagaacctgaaatccaaaaagttcaagcttataaaccactctaccataaatattgtgaactacatgatttattaggtcgtcaatatcctgaattatcatatttgatttaa

SEQ ID NO: 1233 - DNA, 204 bp, Staphylococcus epidermidis
tatgctgatgcacatgtcacacttaatcctaatgaaagtgaacctgaatcatatgataagtatgatgtaagggtgcctgttgagcaaaatgatcatacaatgaaagtagaattagatgtgccaaagggattaaacgttgagagtgttaaaactattgaaggttttaaacatcattttttaaagataaaaagggaacattactaa

SEQ ID NO: 1234 - DNA, 1029 bp, Staphylococcus epidermidis
aaagtgagagcgaggtgtctcatgatgagtaatatccatactaatattagtgagtggatgaagatgtctgaggagacacctgttattatttcttccagaattcgattagctagaaatcttgaaaaccatgtccacccacttatgttcccttcagagcaagaaggatatcgagtgataaatgaagttcaagatgcgctttccaacttaactttaaatcgattagatacgatggatcaacaaagtaaaatgaaattggttgcgaaacatcttgtgagtcctgaactagtgaaacaacctgcttcagcagtaatgttaaatgatgatgaatcggtaagtgttatgataaacgaagaagatcatatacgaatacaggctctaggaactgatttatcgctaaaggatttatatcaacgcgcttctaaaattgatgatgaattagataaagcgttagacattagttatgatgagcatttaggatatttaactacctgtcctactaatattggtacaggaatgcgtgcaagtgtgatgttacatttacctggactctccattatgaaaagaatgaacagaattgcacaaacaattaatcgttttggatttacaattcgaggtatatacggagaagggtcacaagtatatggtcacatttatcaggtttcaaaccaacttacactagggaaaacagaagaagacattatcgataacttaactgaagttgtaaatcaaattataaatgaagaaaagcaaataagagaaagacttgataaacacaattctgtagagacactggatagagtttatcgatcattaggtgtactacaaaacagtagaattatttctatggaagaagcctcatatcgtttgagcgaagtgaaactaggtattgatttgaattatattttgcttgaaaattttaaatttaatgaattaatggtagcaatacagtcaccatttttaatagatgacgatgataatagaacagtaaatgaaaaaagagctgatttattaagagaacatataaaatag

SEQ ID NO: 1235 - DNA, 519 bp, Staphylococcus epidermidis
aatgaaatggcaaaatataatgtggaaaatgaatatgtagaaatcgacattgagagattactcaaatatacaccagaggtcgtttatgaggcatggacaaaaacagatatcttaaaaaaatggtttatgaccactcaacgcacgaataaatcatttgatgcagatattcaagagggaggaaagtatcgcatcattgatagtagaaacggtaaacaaaacatcattgaaggtacatatgaagagttagttttagatgaatatatcaagatgacgattggaatgccaggactaagtgaggaagaggatgtcattgaagtagagttctttgaaagagagaatggcggaactcaaatgttcttttactatcgctcttttgttgaaaaggaaagacgtttaacaacattagaatataagcaaaagaaaaaagaatatcatgattcaacagcacatggatttgaattgatgattgatcaaatgcaaaatgtgatagatgaaattgaggaacagcgtcataactaa

SEQ ID NO: 1236 - DNA, 186 bp, Staphylococcus epidermidis
ttgtcccaggcattttatttattggcaattgacaaccgagttgaacttgggctaatctcaattttcaactctagtcctcattaccaagtgagacagcgaattacttacgctttctatctcactcttcttaatttaatatttaacgttataattgtagtaactcaatatgcgaaattaaagttataa

SEQ ID NO: 1237 - DNA, 1989 bp, Staphylococcus epidermidis
gggggtcattttatgacagcgaccttcattattatatatattgtagtagcgctcatactcattggttttattaatttctttttaattaagcgtaaaagaaaaaataaagacaaaagagtggaacaacgttcgacaatagattctaagagagaaagcaatcaatctaaatttaaagcaagcgatttagaacaaacaactaagtcaaatactgatccaacgcaatcaaacgatattgaagatgaaaaacgaaaaaatcactttgactcagaaatagataatgcatctcaatttatcaatacagatagtaaagaggatagaaacgcgttaagccataagaaccaagaggaagatgacgcatcgaacgatgtgttgaaccctatcgatccaaattctactgaaggtagagttaatgaaagaattaaaaatcaagagtctaactttatttttggtaaaggtataactagaggtaaaattttagcggcaatgttatttggtatgtttatcgcgattctaaaccaaactctattaaatgtggcattgcctaaaataaatacagagtttaatatttctgcttcaactggtcaatggttaatgactggttttatgttagtgaacggtatattaatacctattagtgcttttttatttaataaatattcttatagaaaattatttattataggtttagcactatttacattaggttccttagtttgtgcaatctcatttaatttcccaattatgatgagtggacgtgtattacaagccataggcgcaggtatattgatgccgttaggttctaacgttattgttaccattttcccacctgaaaaacgcggtgtggcaatggggacaatgggtattgcaatgatattagcacctgcaatcggtccaacactttcaggttatattgtgcaaaattatgattggaatgtaatgttttacggtatgttctttataggtattattgctatcgtaattggtctattttggtttaagttgtatcaaagtacaacaaatccgaaagcagatattcctggaattatttatagtacgattggattcggttccttattatatggtttctcagaagctggtaataaaggatggggctcaactgagattgtaacaatgtttattgttggtacggttttcattattttctttattttaagagaactaagaatgaaagcgccaatgttgagcttggaagtattaaaatatccaacttatacacttacaactattatcaatatgattgtgatgatgagtttatacggaggaatgattttacttccattatatttacaaaatcttagaggattttcagcattagactctggattattactattgccaggtgcattagtcatgggagcattaggtccggtggcaggtaaattgttagatacaatcggtattaaaccattagcaatatttggtattggcattatgacatatgcgacatgggaattaagtaaattaaacatggatacaacatatctccatattatgtggatatatattgtgcgttcatttggtatggcatttgtaatgatgccgattataactgcaggtatgaacgctttaccaccacgtttaatttctcatggtaatgcgtttgttaatacaatgagacaattagctggttcaattggtacagctattttggttacggtcatgacgacacaacaaacaaatcatctttctgcttttggtgaagagttagataaaacgaatcctgtcattcaagaccatatgcgtgaacttgcccaacagtatggtggtgagtcagcagcaatgaaattattactcgaacatgtcaataaacttgcatctgtagaaggtgtaaatgatgcatttattgttgctacaattattagtgcgattgcactgatattaagcttgttcttacagggcaagaaaaaggctcaattatcagctgaaaaagcaaatgctgaagattatccttcgcaacaagataaataa

SEQ ID NO: 1238 - DNA, 666 bp, Staphylococcus epidermidis
gtcaaacatttacggttaatcggcctacctcataaaaataaaaatacatatgtaaatctcattttaagggtgtcattgatgaaagcatatctatataaattcatgccattgctcattttcgtcataggactgattatcttttacgtttttaatgattatcccacattgatacatgtcatagtgattattgcttttataacgaatggattgaaaaatgtatattttgttaataataatattagaaatcatatgatatgggtgagccctaaactcgatcgtatccttggtatgatttcgggcatactatattttggtatttacgtggttggctttataaagcaacagcctttatggatagtgatgcttattctagtatcaacagtgggtactgcggttttattagaaacaaaattacatattacatcacttcaattagaggagacgttatcatctgaacggataaaacgtaaagtaatatcaagacataaagcacaacgtcttaagtgtatattttttactgtgattgttgtagtaatcatttcaatgctcatatcattatatttaaagttgatggttatttttggacttgcagtaacgatttttatcttagcatcaataagtgtggctattttcgaaaaatactttactattattgaaaatatgtaa

SEQ ID NO: 1239 - DNA, 219 bp, Staphylococcus epidermidis
gtacatcttctaaggtcatcaattttagctcttttgcatctttcatgtgtcgttgctctcctcttcataaaagtatctaattatattctacatgagattcaaatttttaacatacctcattttttatttcatattaatcatttcattttattgttaaactatttatatcaacacttgataataacttataaattaaaaggtcgtgatatacatgattaa

SEQ ID NO: 1240 - DNA, 1026 bp, Staphylococcus epidermidis
aagggagattatgtaatgatatctaaagttgaacatcaaagacacggtttagatttaattaaaattgataatgacgatacgaaaattgtatttacaaactatggtgcaagaattgtttcttggaaataccatgataacaatatcgttttagggaatgtagtagaagcggatgaattttattttgaagaaccttttaattttggtgctacgataggtcgctatgcgggtagaattgaaaatgcatcatttaaattagatgatgatacttttcaattagaatcaaatgatggtcaacatcatttgcatgggggcagtcatggattaaatagacgtatttttgattatgaaatagttgatgatattggacaagtaaagattatattcacaacaacgattaaagaagaagaggacaattatcctggagatatgatggtaaaggttattcacacttatgatgccaatcatcgatggtccgtacaatatgaggcaaaatcaacaaaaaaaacagtatttaatccttcaaatcatgtttattttaatttgaatcgtgataacaatgttgtctataaccactgtataaatagttcagcattaaaaatgtatatgttaaataataaacatattgttaaagaggggcaatctcttgatttacatcgattattggatacaaataaagtctatttaaaagatatttttgaaagtgacaatgaaactttgcaacaacaaattaatcattataatggcattgatcatcctttcgaatttggaggaaatgagcttaccattgataattctgaatttgaacttaatattaagactgatatgcctcattttgtaatgtttacgtttaatgatccacaagtttggaacaatgattttaatatttataaggcgcattctggattttccatcgaaactcaatatatgcctaatgatataaatatgtacggcgccaaagctcagtctattttagaggcagatacattatttacatctaaaacaagttttcaaattcatgaaaagtag

SEQ ID NO: 1241 - DNA, 228 bp, Staphylococcus epidermidis
gaaactaaatatttcgtcaaattaaattcttttacgccagcacttaacattgttatcatattattgggtttcacagatttaactaaatctaaatatgaaccgttttttaagaattttggcgaaaaccctgcaaaaggtccaaatagtaatgatttttcaccattaacaaatcgtgtatctaaatgtggaactgacattggaggtgcaccaacctcggctttaccgtag

SEQ ID NO: 1242 - DNA, 333 bp, Staphylococcus epidermidis
ggaggtagatatatgaatgtacagtttaagaaaggtgctttagaattaattgttctgctaattattaaaaaagaagatcagtatggttattcacttgtacaaaatatctccagatatatgaccatagctgaaggtacagtttatcctctgctaaggcgtttggttaaaagtggggaactgagtacgtattatcaaccttcaactgaaggtccgtctcgaaagtattatcaattaactcaacagggggctgcgagagttaatcaattagaggaggattggaaattgtttacggaagctgtagaacatttcattgaggagagtgagaatgaatga

SEQ ID NO: 1243 - DNA, 975 bp, Staphylococcus epidermidis
tttataaagtatgagggggtaagaaagatgacggtgaccgttagatttcaatctttatcgcaacctcttacattagtttcaaatgtgaaagagattcctaaagatgcaacgattatatggtatgattttgaaaatgccactgatgaagaaaatgagtatttaaaaaatcattttgatttcaattacttagaaatagatgatgctatcaatggtgacccacgagttaaatatatagaatatgacgcgtatcaatatatgatatttcatagtattattaatgatgattactcaccaatctcactaagtgtatttttagaaggtaatgttttagtgacataccatcacaaacattttccatcattaaagcgtgtggctcaatacaatgcagaaaatcatgatagtgaattagattgtgcagacatcgtcattcatattctggattgtatggtggataaatattttaactttgtttatggtattgaagataaagtgtataattttgaagctaagcatgtcgatgaccgctatagtaagagcgttatggaaaatgtctttcaattacgttcggatttaattaaaatcaaacgcgtattatttccgatgcaagaagttgtagatacaatgaaacaagaaggaaatataattaaagatgccaaacatagaatgtatattcaacatattgatgatcatcttattaaacaaagaagtgttattcggacttctcaagaaatgacgaatgagattcgtgaaaattatgaatcattcacctcatttaggatgaatagtataatgcagatacttacgcttgtatctgttatattctcaccactcacttttattgctggtgtatatggaatgaactttgaatttatgcctgagttgaaatggcattatgcttatttcgtgtgcttaactttaatgctaattataacaataatattaatcatattctttaaaaagaaaaaatggttttaa

SEQ ID NO: 1244 - DNA, 2472 bp, Staphylococcus epidermidis
aataggaggtatttatacatgttatttggtagattgacagagcgtgcacaacgtgtgttggcacatgcacaagaggaagcaattcgtttgaaccattctaatattggaacagaacatcttttgcttggtttaatgaaagagccagaaggtatagcagcaaaggtattagaaagttttaatattactgaagataaagtcatcgaagaagttgaaaaacttatcggtcacggtcaagagcaaatgggcacactacattatacaccgagagcaaaaaaagtaattgaactgtctatggatgaagctcgaaagctacatcataactttgtaggaacagagcatatactattaggtttaattagagaaaatgaaggtgttgcagcacgtgtatttgcaaacctagatttaaatattactaaagcacgtgcccaagttgtaaaagctttaggaagtccagaaatgagtaataaaaatgcgcaagctaataagtctaataacacgcctactttagatggattagctagagatttaactgttattgctaaagatggaacgttagatccagtcgtaggacgagataaagaaattactcgtgtaattgaagttttaagtcgtcgtactaaaaataatcctgtgctaattggtgaacccggtgttggtaaaacagcaattgctgaagggcttgcgcaagcaattgttaaaaatgaagtaccagaaactttaaaagacaaacgtgtaatgtcattagatatgggtacagtcgtagctggcactaaatatcgtggtgaatttgaagaaagattgaaaaaagttatggaggaaatccatcaagctggtaatgttattctatttatcgatgaacttcatactttagttggcgctggtggcgcagaaggagcaattgatgcatctaatattttaaaacctgctttagctcgtggagaattgcaatgtataggtgccacaacattagatgaatatcgtaaaaatatagaaaaagacgctgcattagaacgtcgttttcaaccaattcaagtggatgaacctacagttgaagacacgattgaaatcttaaaaggattacgtgaccgttatgaggctcatcacagaattaatatctcagatgaagctttagaagcggctgctaaattgagtgatcgctatgtttcagatcgtttcttgccagataaagccattgacttaattgatgaggcaagttcaaaagttagacttaaaagtcatacaacgccaagtaatttaaaagagattgaacaagaaattgataaagtaaaaaatgaaaaagatgctgcagttcatgctcaagaatttgaaaatgccgctaatttaagagataagcaatctaaacttgaaaagcaatatgaagatgctaaaaatgaatggaaaaatgcacaaggtggtttagatactgccttatctgaagaaaatatcgctgaagtaatagctggttggacaggtattcctttaactaaaattaatgaaactgaatcagatcgtttattgaatcttgaagatacacttcataaacgtgtcattggacaaaacgatgctgtcaattcaattagtaaagctgttagaagagctcgtgctggtcttaaagatccaaaacgtccaatcggtagttttattttcttaggacctacaggtgtgggtaaaactgaattggctcgtgctttagctgaatctatgtttggtgaagacgatgcaatgattcgcgtagatatgagtgaatttatggagaaacatgctgtcagtcgattagttggtgcacctccaggatatgtaggacatgatgacggcggtcaattgactgaaaaagttagacgtaaaccatactctgtgattttatttgatgaaattgagaaagcacatcctgacgtatttaatattcttctacaagttttagatgatggtcatttaacagatactaaaggtcgtactgtggacttccgtaatactgtgattattatgacttctaatgtgggagctcaagaattacaggaccaacgctttgctggttttggaggtgcttcagaaggtagtgactacgaaactgtcagaaaaacaatgatgaaagaattaaaaaattcattccgaccagaattcttaaaccgtgttgatgacattattgtcttccacaaacttacaaaagatgaattaaaagaaattgttacaatgatggtaaataaacttactcaccgtctttcagagcaaaatattaatattgttgttactgataaagcgaaagaaaaaattgcagaagaaggatatgatcctgaatatggtgctagaccactcattagagcaattcaaaaaacggttgaagataatttaagcgaattgattttagatggaaataaaattgaaggtaaagaagtaacaattgatcatgatggtaaagaatttaagtatgatattcatgaaattacagctaaaaaagaaacaacagaatcataa

SEQ ID NO: 1245 - DNA, 1164 bp, Staphylococcus epidermidis
tggaggttacatacaatgaaaaactctagattttctgggttccaatgggctatgatggtctttgtatttttcgttatcacaatggcattgtccgtgatactcagagattttcaagcgactatcggagtgaaacgttttgtctttagtattaaagatttagctcctttcatagctgcaattgtgtgcatattagtatttaagcacagaaaagaacaattagcaggattgaaattttctatcagtttaaaagtgattgagcgtctacttttagcactcattctaccacttatcattttaatgattggcttgtttagctttaatacttatgctgatagtttcatcctattacaaacttcagatttatcagtatcattattaactatattaattggtcatattttaatggcttttgtagtggagtttggtttccgttcttacttacaaaatattcttgaaacaagaatgaacacattttttgcgagtattgtcgttggtcttatttattcagtatttacagctaacacgacatatggtgtagaatacgccggataccatttcttatatacattcatgttttcaatgattattggtgaattaattagagctactaatggtcgtacaatttatattgcaactgcttttcacgcatccatgacttttgctctcgtctttttatttagtgaagaaacaggcgaccttttctcaatgaaagtcatcgcactttctacaacaattgtgggtgtttcatttattattattagtctaatcattcgtgctattgtttataaaacgacgaaacaaagtttagacgaagttgatcctaataattatttatctcatattcaagatgaagaaccaagtcaagaagacgcctcttcaacttcaaatcatgatgtatcatctaaagatgaaacaaagcaacaagatattgataatgacaaacatcaatcaaagaaacctaataagagtgacgatgcacttactacttctaattataaagaagacgcctcttcagttaataaagaaacggatacaactcacaatgataacattaaagatcattcaacttataccgaagatagacactcatctgttgtcaacgatgttaaagatgaaattcacgaagttgaagatcataaagccgacacagataaatcacattaa

SEQ ID NO: 1246 - DNA, 687 bp, Staphylococcus epidermidis
gagcgtaaacatatgattaattgcttaatcgtagacgatgataaaaagttattgcaatatgtttcaagtcatttagaaagagaaagtattcaaacacatactttcacaagtggagaagcatcactagattttcttgaaaataaaaatgttgatattgcgatagtagatattatgatgagtggaatggatggttttgagctttgtcagactttgaaagatgattatcatattcctgtcataatgttaacagctagagatgcattaagtgataaagaacgtgcatttctaagtgggactgacgattatgtcactaaaccttttgaggttaaagaattattatttagaattaaagctgtcttaagacgatatcaaattaatgctgataacgagttacaacttggcaacttaatattaaatcagtcttacatggaaattactgtgggttcaaaaacgatgaatcttccaaacaaagaatttcagttgttatttttattagcctctaatcctaaacatattttcactcgagatgatattattgaaaaaatttggggcttcgattatgaaggagatgatcgtactgttgatgttcatattaaaagattacgtcaacgtttatctaaattgaaatcatcagtatcaattcaaactgtaagaggtcaaggatatagggtggaccaaaatgtttaa

SEQ ID NO: 1247 - DNA, 1221 bp, Staphylococcus epidermidis
agaaatatgcatattgtgattgggatattaggaatcattttctttttagcactcgcagttttatttagttcagacagaaaaaatattcgctggcgatatgttggattgctattagtaattcaactaatatttgcatttatattacttaaaactaatttgggaatttcagttattgggagtatttcagatggttttaattatttattagctaaagcagcggtcggtgtcaattttgtatttggtggctttaaatttattgatcctaaacaaccaccattcttctttagcgttttgttacctattgtttttatttcagcattgattggtatattacaatatacacgaatacttccactaattattaacttactgggatttttaatttcaaaaattaatggaatgggccgtttagaatcttacaatgcggtcgcggcagcaattctaggacaatctgaagtctttatctcattaaaaaaacaattaccttacatacctaaacaacgcttatatacattaactgcttcagcgatgtcaacggtatcagcatcaattataggcgcttattttacacttattgaaccaaaatatgttgttactgcagtagtgcttaacttgtttggtggttttatcattgcatctatcattaatccttataaagtcaatgaggaagacgacaaattattaattgatgagaacgaaacaaaaaaacaatctttctttgaaatgcttggggagtatatactagatggatttaaagtagcagttattgtaggcgctatgctgataggttatattgcaattattgctttattaaatggaatggtgagtggaatcttaagctttatgtctggcggtgctattcaatggaacttccaaacgcttattggatttatttttgcacctttcgctttcctaactggaataccgtggcaagatgcagttcaatctggttcagtaatggctacaaaattactatctaatgaatttgtagcaatgcaagatttaggtaaagcgactggattatcggaacatgctaaaggaattacctctgtcttcttagtatcattcgcaaactttagttcaattggtattatttcaggagctattaaatcattgaatgatgaaaaaggtgacgttgttgctcgtttcggaataaaattattatttggtgcaacacttgtttcgtttatatcagcggctattgcaggattctttatctaa

SEQ ID NO: 1248 - DNA, 711 bp, Staphylococcus epidermidis
agaggagagcaacgacacatgaaagatgcaaaagagctaaaattgatgaccttagaagatgtacttagtcaaattgaaaatggtatgacaatcggaataggaacagggagcacaattgaattattaattccccaaattgctgaattaattcagcaaaagaattatacaattaccggcgtctgtacttctaataaaacagcatttttagctaaagaattagctatgaatatagttgatgtaaatgatgttgagaaaatcgacttagcaatagatggcgctgatgaagtagacagtgcgcttaaccttattaaaggcggtggtggagccttatttagggaaaaggtcatagatgaaatggctgaccgatttgtcgttgttgtagatgaaagtaaactcgtcaactatttaggagaaacatttgcattaccagttgaagtcgataaatttaattggtaccaagttgccaaaaaaattgagcgtacttatgatattcatgtaagcagaagagttaatgaagatgtaccgtttataaccgacaatggtaattacatattagattgttcattgcaaaatagaattcctgcttatgagctacacgaatttttaattcatttaactggcgttcttgaaacaggatatttcctcgatattgccgatcaagtaatagtaggaacacaagaaggcgtaaaaatattaaataaagaaacttag

SEQ ID NO: 1249 - DNA, 438 bp, Staphylococcus epidermidis
aaaacggagcaaaatttttatatgaaaggaggggtgttggttttaaaaataatgtctaaacatagtgctacgttagttattatgtttttaataactttattgcctatttttcaatatcaagcttctgcacatgcgactttagaaaaatcaacaccacaacagcaaggggttattaaagacaaaccagaagcaatcaagttagagtttaatgaacctgtgaacaccaaatactcgagtgtgaccttatttgatgataaaggtaaaaagattaaagaccttaaaccaataacaactggatggtctcagacagttgtattttcatctgagcaaattgttaatggcacgaatactattgaatggcatacggtatctgcggatggacatgaagtcggagatacgtttgaattttcagttggaaaagtgaggctaaagatgtag

SEQ ID NO: 1250 - DNA, 405 bp, Staphylococcus epidermidis
ataatgactaagattcactttgaagcacccagtcccgaagattactgtaatttaagagctaatgctggaatgagtagtaaatcgattgaagcggcaataaaggggcttcctcatgcatgttttaatgtgaccctttatgagaatgatatgttgattggtatggggcgagtgattggggatggtggtacagttttccaaatcgtcgatattgctgtgaaagatatatatcaaggtttgggtcatggaatgacaattatgcatgaaataatgaagtatattgagagtgttgctgaagaaggtacatatgtgagcttgatagcagattatccggcagatcaattatacgagaagtttgggtttaaaagtactgagccttattcaaaaggtatgtatatcaaatattaa

SEQ ID NO: 1251 - DNA, 201 bp, Staphylococcus epidermidis
acaaaatataaatgcttgcctcaatcaataacacagaaaacaaaaattaacatacaatcttacattttcggagttcagcacaaatcagttattgaactaactttattacaaattggaggactcaatgaatatgataagattgtatgtcattcatgtctttacaactctaatatgtattgtttgtgtaacttaatcacttaa

SEQ ID NO: 1252 - DNA, 186 bp, Staphylococcus epidermidis
atgaaatataaaacaactttcaaaataaaacctccttttaccccagctaaagacctagctattttttcaaaaattattactaaaacactaagtaaacttttgcttaaaaaattagttaatgtcttacatcaattagataaattgatattaacgtttataacaaaattgaatttaaacaaaatataa

SEQ ID NO: 1253 - DNA, 216 bp, Staphylococcus epidermidis
gtaaatagtaatacaaatgacaccccttgtatcaacatgggtaatacaaaacggggtgttttaaaaagttctttgaaattaattagcatcgtacctatgttactactttcccttaggctcttttcaagcgactcaggaactttaaataaagttcctattaacatgacaatcccaaacattgttagtattacaaatacaattcgccatggcccataa

SEQ ID NO: 1254 - DNA, 1614 bp, Staphylococcus epidermidis
ggagagttcaatatgttagtagaatcttttaatccatttggtaatttactattatcatctttaattgcggcaatccctatcattttatttttactgtgtcttacagtatttaaaatgaaaggaatttatgctgctatcacaacccttgtggttacattattaattgcaattccattctttaaattaccagtaggaattgcctctggagcagttgttgaaggtttcttccaaggtatcttcccaatcggatatattgttattatggcagtattattatataagattactttgaaatcggggcaattcgcaactattcaagacagtattacaagtatttcacaagaccaaagaattcagcttcttttaattggtttttcatttaatgcattcttagaaggcgctgcaggatttggtgttccaattgcaatttgtgcacttttattagcgcaacttggctttagaccattacaagcagctatgttatgtttagtagctaacgctgcatctggtgcatttggtgcaattggtattccggttggtgttgtaaatacacttaacttacctggtcatgtagaagcgatgggagtttcacaaacatcaacattaactttagcaattattaacttctttattcctttcttacttatctttatcgtagatggtttcaaaggaattaaagaaactttaccttcaattcttgttgtttctgtcacttatacagttttacaaggattacttacagtgtttaatggtccagaattagctgatatcattccatcacttgcttctatgttagcattagctttattctctaagaaattccaacctaagaatatctttagagttcaaaaagatgttaaaccagaagcaccgaaaaaacttaaaggtaaagaaatcttatttgcttggagtccattcattatcttaactgtcattgttatgatttggagtgcaccttcatttaaagcattatttgcaccaaaaggtaaattatctgctttagttgcaaactttgacttacctggtactttcagtaatatttcacacaaaccaattactttatcattaaacttaattggtcaaacaggtacagcaattctaattacaattattattactgttttaatggctaaaaaagtcaactttggtgatgctggtcgcttatttgttgaagcatttaaagaattatggttaccaatcataacaatttgtttcatcttagcaatttcaaaaatcacaacatatggtggtttaagtaatgctatgggacaaggcatctcaaaagcaggaagcgtattcccaatattatcaccaatccttggttggatcggcgtatttatgactggttcagttgttaataacaactctttattcgcgccaattcaagcttctgtagcacaacaaattggtacaagtggttcactacttgtagcttcaaatacagcaggtggggttgcggcgaaacttatttctccacaatctattgccattgcaacagcagctgttaaagaagtaggtaaagaatctgaactacttaaaatgacattacgttatagtattggattacttgtatttatctgtatctggacatttatcttgtcattcattctgtaa

SEQ ID NO: 1255 - DNA, 225 bp, Staphylococcus epidermidis
aacaatcccaacaaacttgaagaactacctttggcccctttactctcatccattgctatcgaaaatcctaacgttgcaatccctgtaactggtgccactaaaatcacaaagccacaagaaagtatccaaaaagtccaatggttgagtaaagttagtgatacgattataacaccaataacttgtatagtagacatgattctcagcaacagtaatctatctatatag

SEQ ID NO: 1256 - DNA, 645 bp, Staphylococcus epidermidis
agatgtgtaaataaaaaatacaccaacatttttaataattgtgttggtttacagtttatttatttaaattttctttttgatttaggtgaatatatgaaacaacgtgcgaaatataaaataataaaaagtttaatcgaacttttagaatactatccttttgatgaaataaccattaaaatgatatgtgcatatagtggcgtgaatcgctctactttttatgatcattttcaagataaatatcaattactagataagatccaaaattatcatttaaacaaatatatatctttactacaatctttctataacgattttcatcatattaaaacagatcaaaaaaaattatataaatttttcttattgatagccaaatatattaaacgtaaagaagcgttctacagagcaacacttgtaacatatcctaataaagatattgcattagattacattaacgccactaaaacatgttatgaaaaagtcatgaatagatatgaaacctcaataaataataaacgtatgtttatcatttattcagtcggtggtcaagcaggtgtatttatcgattggttacgtaatggatgcatcgaatctcctcaagaggtcgctcaagttcttttagctaatacaattaaattacaacgataa

SEQ ID NO: 1257 - DNA, 696 bp, Staphylococcus epidermidis
atggctaaaaaaggtaaaaagtatcaagaagcagctagtaaagttgaccgcactcaatactatagtgttgaagaagcaatcaaattagctaaagaaactagcgttgctaatttcgacgcttctgttgaagttgcattccgtttaggaattgatacacgtaaaaatgaccaacaaatccgtggtgcagtagtattaccacacggtactggtaaatcacaacgtgtactcgttttcgctaaaggcgataaaatcactgaagctgaagaagcaggtgcagattatgtaggtgaagcagattacgtacaaaaaatccaacaaggttggtttgatttcgacgtagttgtagctacacctgatatgatgggtgaagttggtaaacttggtcgagtattaggacctaaaggtttaatgcctaaccctaaaactggcactgtaacaatggatgttaaaaaagcagttgaagaaatcaaagctggtaaggtagaataccgtgctgaaaaagcaggtattgtacatgcgtcaattggtaaagtgtcattcgatgaagaaaaattagttgataacttcagaactttacaagatgtattagcgaaagctaaaccagcttctgctaagggtacttacttcaaatctgttgctgttacaacaacaatgggtcctggagtaaaagttgatacttcatctttcaaactataa

SEQ ID NO: 1258 - DNA, 561 bp, Staphylococcus epidermidis
atgaataaaaatgattatttaaaagaacttaaaaagcatttgaaacatatgaataaagaagaaaaagaagatattttgaatgaatacgatacgcatttttatagcggacagcaagagggaaagtctgaatcagacgtgtgtaaagaattaggtaatccaaaattaataggtaaggaacttacagctacttccagtgtagaaaatgcacatcaaaaagtgtcgttaatgaatatttcatccgcaattgtagcagtaatggggctaagtttgcttaacttttttattgttataataccagcttttttatgcattttgctcgtattaaccttcatcatttttactctagcttcactagctgcaccattgatgttgctcattaaaggaattatggatggttttcattccattatcttatatgacgcatttatgactggtttaatgtttggtgttggactcgtacttgcagtggtgacttactatctcattaagtggctatttgatgtgactatgaaatatctaaaatggaatatctctattgtcaaaggaagtgtacaatcatga

SEQ ID NO: 1259 - DNA, 963 bp, Staphylococcus epidermidis
ctgataaaaaatcaagggggatatatcatgtatcaacttgcacaatctaatctatggacaggtcgtttagatagtgaaactgatcctacacaatttagacacttccaaactgttaaattcggtgatttaagtcaattagatttttcggatgaacacaaaggcgtgggcttattaggatatgcaattgataaaggagtagaattaaacaaaggacgtgtaggtgcaaaagaaggtcccaatgccattaagcgagcttttgctggattgccagatttgaatcaatgtgaagagattatagattatggtaatgtagaacacaatcatgagttgctaatagatacacagcgcgaattcgcagatcttgctgctaagtctatcaaacgacataaacaaacatttttacttggtggcggtcatgatatagcatatgcacaatatttagctactcgtaaagtttatcctgagtcgtcaataggtgtgattaatatagatgcgcactttgacacacgcgatgagggttattcaacctctggtactagttttagacagattctagaagaagatgataatgcagattatttagtgttaggtatatctcaaggtggtaatacacaagctttatttaattatgctaaagaaaaagatattcaatttgtatatgcagatgaattactacatcaggtatctccccccattaaagatatgatagaacgttttatccataatcatgatacggttatgttcacaatttgcatggatgtagtagatagtgcatttgcaccaggagtcagtgcaccagctgtcctaggaatatatccacatacagttttcgaacttgctaaacgggtcattccaagtgaaaaagtaaaatctataagtatagctgaaatgaatccgacgtatgattcagatcaaagaactgctaaattagttgctaatttagtacatcattgtttaatttaa

SEQ ID NO: 1260 - DNA, 903 bp, Staphylococcus epidermidis
ttaatgaaaaatagaatgatgaatcgcgtggttaataaatatatacttcacaatagatcgatattttttagtaatgatgatgaagttaaacattttttagaaaagagaagtatcgaaaatagtaaaaaacatcagcaacctgcgacacttaatgtaaagtcaaatttagataaacttactcttaatgatatgcaagtgtttagatttaattttagacatgagaaaaatcaaaagatactctatctgcatggtggatataatactttgcaaccttctccatttcattggagacttttagataaactaactttaaatacattgcatgaggtcgttttacctatctatccaaagtcaccagattatcactacttagaaacgttcaaagcgattcgtgacgtttataatcaattagttgaagaagttggtgcgaacaacattgttatgatgggggatggttctggtggaggactagcattaagttttgttcaatcacttatcaatgataatcaagaagtgcctagaaagttatttttactttcaccgcttttagatgccactttgactaatcctaatattacgaaaacgttggaagaaaatgatatcttagttagtcgatttggtgttcatcaactcatgaaatcttggacgaatgatttacctttatcagacgcgcgtatatcaccattatacggtactctaaaagggttgccacctatatatatgtatggaggtggcagagaaatattaagcccagacatgcatgcatttactcatgctctagaggaatgtgggaacgatgttgagtttaaagagtatcctaaaatggtgcatgattttcctatctatcccatacgccaatctcacaaggtgttaaaacacatcactaaatcaatcttagagtaa

SEQ ID NO: 1261 - DNA, 579 bp, Staphylococcus epidermidis
gtgaggtgtttaaaattgctttgtgaaaattgccattttaatgaagcggaagttaaacttactgttaaaggtatagatagtacgcatgaaaaatgggtatgttcagtatgtgcccaaggagaaaacccctggttacattctaacgatgataatacgtatcatacacaccaagacgatatagaagaagcatttgtagtgaaacagatacttcaacaccttgctgcaaaacatggtattaattttcatgagatggcatttaaagaagaaaaaaaatgcccaacgtgtcagatgacacttaaggatattgcacatgttggtaagcttgggtgtgctgattgttatgctacgtttaaagaagacatcattgatatagttcaacgtgttcaaggtggtcaatttgaacatgtaggaaaaacaccacaatcatcgtataagaaacttgcaataaaaaagcaaattgaagaaaaatcaaaatatctaaataaattgatagatggtcaagagtttgaagaggcagcgattgttcgtgatgaaattaaagctttaaaaagtgagagcgaggtgtctcatgatgagtaa

SEQ ID NO: 1262 - DNA, 618 bp, Staphylococcus epidermidis
ttgatagtgaaaaaaataaaagctgaaacactttcagatatgcaaaattataaattacttagtggaagtattatacctaggccgatagcatttgtaactactcaaaatttaaaaggggatatcaacgcagccccgtttagtttttttaatgtagttaatcatacaccacctatgattgcaattgctgttcaacgtacaaagggaaatagaaaagacacctcaataaatatagaacaatcaggtgagtttgtagtgcatattactgatgaggctattgttaatgatgtgaatgaaactgctgccccgttagaatatggtgttaatgaacttaaaagaacctctctaagtatgattgattcagatttaattaaagttccagcaatcaaagaagcaaaagtaaggtttgagtgtaagcttcatcaaatagtacaattgggcaacaaagataacgggagtgatttgataattggtgaaattgtcgtgtaccatatcgatgaagaagtttattttgaagatagtaaaattgatgcaaatcaattaaatccggtagctaggttagctggaaatgattactctttgttaggtcaaacatttacggttaatcggcctacctcataa

SEQ ID NO: 1263 - DNA, 723 bp, Staphylococcus epidermidis
tattatgccctttttaatattttaattgaaattcaattcaacatgataaagagacaaagtaggaggcggtttcaaatgaaaaaagtattagcaagtgcaacgattttatcattaatgttagtaggttgttccaatggtggaaatgatgaatcaagtcataaagatgatagttctaaaacagaacaaaaggataaatcatcatctcaacatgactcaaaaaaagattcgaaacgtaatgatacaaataataagcaagacaatcaggaaaataacactaataaagaacaaacaaataatcaaaatccaaatgatggagaacaacgaacaagcgaaagaccaacaacaaattcaaacggaaattcatcggataatcaaaataaacaacagcaatcagtacaagataaccagaataaatatgtagcaccataccaaagtgaaaatgcgacacgtgttgctcgatgtctttctccatttgagggcgaccgcagtcaagctttgcaacaattaccaaattttgaaactgcactttccattgctaaaaacgaagctaatatgtatggaagcgaaaataaatcatataatgattattcaatagaacaaacagaagatggatttagatatgtgtttagctttaaagatccatcaaaaagtaatacttactcaattgtaacgcttaatcgacaaggtcaacctactgttgtagatcctaacttccaaccttaa

SEQ ID NO: 1264 - DNA, 1080 bp, Staphylococcus epidermidis
catataaagaaatgggagaggatatcaatgaatctagcttggaaagagattaaattttataagttcagatttatattaatcatgttcattatttttctaatggcgattatggttttatttatcagtggacttgctcaaggcctagcacgagaaaatatatcaatatttgatcaaattaaaggtaatcaatttgttgttcaaaaaatgaaagaaccacaattagaaaaatctattctatcacgaagtaaacaagacaatatttcaaaaattattgatgaaaaaccttttaaaatggcaggtaaaactttcaaaatcaatggaaacgaagaaaacgtgatggctataaatagcgtgaaaaatcatcagccaaatttgaaatctggtcattatcctaaaaatggaaatcagatagcaataaatgaaaaactaactgcagaaggtctttatttagacgataaagttaaagtcaaaggtgacgatacaacttataaagttgtaggtatattaaaaaacacgatgtattctcatagtaacattgttatgatggaccaatccaaaatagaacaaagtagtaatgtcgcaacattttatgttacgaaccaattatctaaatcggataaaaataaaataaatcacatcaaaggcgttcaaacagcaactacagacaatataacaagtaatatcgcaagttataaagcagagcaaacaccattggatatgatgattattagtttatatattataactgcaattgtattgagtgcattcttttatgtaatgacgatacaaaagacatctgaaatcggtattttaaaagcaattggtataactacaaagcacttattgacatcattgattttacaaatttcaatgattacatttataggtgtagctatagcagaagtagttattttgctcatcagtcaaattttacctgtatctatgccattccatatagatatgcataatataatcattgtacttgtcatatttatgatagttggattaatcggtacatcattatcatttattaagttaattaaaattgatcctattgaagctattggaggtggccaataa

SEQ ID NO: 1265 - DNA, 1137 bp, Staphylococcus epidermidis
gaaagggctgagcgatatatgacaaattattctacttatgtagattggagaagaacgtttcatcaatatcctgaactttcagatgaagaatatgaaactacagacaagttacgaaaaatactcaaaagttatggtatacgtatactggaggtacctttaaaaacaggtttagtagcagaaattgggcaaggagaggaaatgatagcagtaagaacagatattgatgctttgcctatagaagaacaagtgaagcatgaatttacatcaaagtatcaaggtgcaatgcatgcatgtggtcatgatattcatatggcaagtatattagctactggtattcaactaaaagagattgaagatgaattaaatggacgcgttcgattaatatttcaacctgctgaagaattaggacatggtgcatttgaaatcataaatactggagtacttaaaggagctaaagcagtacttggttttcataattatcccactttaaaagttggtgaatttgctattaaatcgggtgcaattacctctgctgtcgatcgttttgagtttaatgttaaaggtaaaggtgcgcatgctgcaaaacctgagcaaggaaatgatccagtcatcgtcgtaggacaacttatcaatagtttacaaactattgtgagtcgaaatttatcagcttttgatagtgcagttgtaacaatcggtgaaatttcttgtggtaacacatggaatgttatagctgacaaagcttatatacagggcactgttcgttcattcgatgaggatatacgtcattatattgaaaataggatgaaaaatattgctgatggtttaagtcgtgtttttaatgtggatattgatttaacttattcaagactacctggtgcagtagtaaatgatgcacatctaacacaagaagcaatcgaggtcgctaaaaatgttggctatcatgtatcaatgctcgatgaaccggttactattggagaggatttttcaggttatacagaagaataccccggtgttttcgcatttattggctccgacagtaaatatgatttacatcatcctaaatatcatccagatgagcgtattttggaaaaagttcctcaatatttcgttcagctcgttcaacgtttattgacataa

SEQ ID NO: 1266 - DNA, 861 bp, Staphylococcus epidermidis
tgtgactatgaaatatctaaaatggaatatctctattgtcaaaggaagtgtacaatcatgaaaaaaattgcagcgataatatttttaataggcttgtcactaattattatttgtagcgtgggagtttatgcacaaaataaaaaattgagtaaagacaatcaatataataatcaaacaacaaatttaatgaaaaactatgatgataatactgtgaaaagtatttacattgatggaaaagtaagtgatataactgtgaaaaaaggtaaacatttttcggttaagtccaaagggaatgacaaaaatttaaacgtaactagcaaggtgaacaatcaacgttgggtaattacagagcgtcaaacaagtccacatattaattttagaatacaaggtaaagttagtaatcacattacgattacagtacctaaatatattaaaaacatagatattaaaactaatgccggggatttaaatattgttggagtaaatagtggcacaggaagatttgatgctgaatctggagacattaaagttcaaaaaggacgatataaaaaggtgacacttcataatgaggatggggatattcatacgaaagatattcattttaatcaagctaatattcaaaatgacaatggggatattcaaatgaaacaattagaccctgatattcctttacgtattaaaaatgaagaaggggatataaacttgaattataaaaaagaacttcatcacacccaaatcatcactcgtaatgaagaaggggaaacagacatcgatcatcgtgtgttatataatagtaaagttgaaaatggaaataataaagtgaaattaatcaatgaaaatggagatattaaagtaaaataa

SEQ ID NO: 1267 - DNA, 1194 bp, Staphylococcus epidermidis
tgttataatgacttaaatatcatagaaaacaatgaggtgttttacgcaatgaagtcgttcacattttttatgcataatatttatgcaatgggcggaacggtaaagtcggtgacacaacttgcaaatacactggcagaaaaaggacatcctgtaacaattatttcagtttttagaggcgcagactctccatattttgaattacattcagcaataaaagttaaagtcgtagtggactatcgcttaaagcttaaaaatactagagctattacggcaaatcgtatcaaaaagtataccccctttttaaatacaaaagtgatttctcaatttgagccaggtaaaagtcagttttcgagttatgtagagaaaaaaatgattaaagcaatcaggcatactaaaactgatgtactcgttggaacaagagctagctttaatattctcatttctaaatatgctaaagctgaaatagtgaccatcgcaatggaacatatgaattttgatgctcaccctgatcagtatcaaaaggaaattattgctgcgtaccgtaatatcaataagattacaacgttaactgtcgcagaccagcaaaaatatcaatcacaacttaaaactcctgtatacgttatacctaatatggttaccgaaaaaagaattgctgctccaaagaaaaatcgtattattagcgccggacgtttagaatatgaaaaagggtatgatttattattagagagtattcgtttaatacaagaagacttgcgtcaattgaattatgacgttcacatctatggttctggtagtaagaaaacatcacttgttgactttattaatcaatatcatttaaatgatttgattaaaatatatgagccaacgcaagaattaaataataaacttgcacaaagtaaaatcgttgttgtaccttcacgcaatgaaggtttcggaatgattattttagaggcaatggtgcaagataatatagtaataagttttgaaggcaatgtagggccagattcaatcattaacaacggagataatggttatttagtaaactatgaaaatgtgtctgaacttgcaaaacgtatcgatttaacaacacaacattataatgagttagatcacatcattgaaaatagtaaagatacgttgaaacaatttagtccggatcatatatatcaattatttatgtctatgtttaaataa

SEQ ID NO: 1268 - DNA, 564 bp, Staphylococcus epidermidis
gttaggagtgaagacatgtctgaagaagtaggcgctaagcgttggtatgctgtacatacctattctggatatgaaaataaagttaaaaagaatttagaaaaaagagtagaatctatgaatatgactgaacaaattttcagagttgtcataccagaagaggaagaaactcaagttaaggatgggaaagctaaaaagcttgtgaagaaaacatttcctggatatgtattagttgagttaatcatgacagatgagtcgtggtatgtagttagaaatactcctggagtaacaggatttgtcggatctgcaggtgcaggatcaaaacctaaccctctacttcctgaagaagtacgcttcattcttaagcaaatgggtcttaaagagaaaacaatagatgttgaactcgatgttggagaacaagttcgtatccaatcaggtccttttgctaatcaaattggagaagtacaagagattgaagcggataaattcaagcttactgtacttgttgatatgtttggtcgtgaaacacctgtagaagttgaatttgaccaaattgaaaaattataa

SEQ ID NO: 1269 - DNA, 210 bp, Staphylococcus epidermidis
aaagtcatagagtgtggaggtcttatgatggctaaaaaagaaagtttctttaaaggcgttaagtcagaaatggaaaagacgagttggccaactaaggaagaattatttaaatatacaataatagttgtatcaacagtgatattcttcttagtctttttctatgccttagacataggaattaatgcattaaaacaattatttttaggttag

SEQ ID NO: 1270 - DNA, 1383 bp, Staphylococcus epidermidis
gaggtcaaggatatagggtggaccaaaatgtttaaaacattatattcgagaattgctatatatgcaattacagtcattttgtttagtgcattaatgagttttctttttacgaatatttattatcactttcatttgaaagcttctaatgatgcaaaaattatgcgcacactcaaagaagctcgtgaatatgaaagaacacaaaaacctaaacctctagatacgtatttgaaacatttaggtcaaatgaattatcaaattatgactgtcaacgaacatggaaccaaacatttttatggggaaacttttcgtaaaaatactataagtcagtctgcaatcaaaaaagtgctcaacggtgaagattatcatggtattaaaaataaaccttatgcattttttgtaacagggttcttcgataatgaaacggataatacagtaggtattcaatttaaaacagatgatggggcattagcagtttttatgcgcccagatatcggggaaacttttagcgaatttagaattttcttagctgtgttgataacacttttacttattatttcaatttcactagtcattgcatcaacatattctattattaaaccagtgaccgcattaaaaaatgcaacaactcgaattatgaaaggtgatttcagtacgcctatcaaacaaacacgtcacgatgaaatcggaacactgcaatcacgtttcaatacaatgcgtcaaaatttaggacaagtagatcaaatgagacaacattttgtccaaaatgtatctcatgaagttaaaacaccgcttacacatttacaacgattgcttacacaacttgaattgacgcaaaatgaagaagagaaacaactatgtatcaatgaaatgtttgaaatcactaatcaagtaagtgaactaactaaggaattgctacttttatctgaattagataatgcttcccaccttacttttaacgataatgttcatttaaatactttaataaaggatattattagacatgaacaatttcgaactgatgaaaaagatttagttatgtttactgaattagaagatttgtatttccgaggaaatgaaagactattacatcaagctttcaataacctcatcattaatgcaatgaattatgctcctcaaaatagcatgattaatatcactctaactagtacaaatcacttgattatatttaatattgaaaatgatggatcgattgcagaagaagatgcgaaacatatcttcgatcgtttttataaactgagtgacgaatctagtagtaatggtctaggtctagccattacccaatcaatcattcatcttcatcatggtagcattactctcacttcagatgataaaacacaatttattgtaaaactatttatttag

SEQ ID NO: 1271 - DNA, 660 bp, Staphylococcus epidermidis
actgagggggagacgttcgtgttaaaaagaatgagagacgatataaagatggtgtttgaacaggatcctgcagcgcgctcgactttagaagtaataactacttacgctggattacatgcagtttggagtcacttaattgcccataaattatataaaaatagacgctatgtagcagccagaatgatttctcaactatcacgtttttttaccggaattgaaatacatccaggtgcaaaaatcggtaagcgtttatttatcgaccatggcatgggtgtagttattggagaaacatgtacaattggtgataatgttactatttatcaaggagttactttaggtggtacaggcaaagaaaaaggaaaacgccatcctgatattggtgataatgttttgatagcagctggatctaagatattaggtaatataaaaattgaatcaaatgtgaatattggagctaattccgtagtattacagtctgttcctagttatacaactgtagtaggtataccaggtcacattgttaaacaagaaggtagacgtattggtaaaacatttgatcaccgtaacttacctgatccactttacgaacaaattaaacacttagaaagacagcttgaaaaagctaagaatggagagattcaagatgattacattatataa

SEQ ID NO: 1272 - DNA, 879 bp, Staphylococcus epidermidis
attttcagttggaaaagtgaggctaaagatgtagatacatcttcacctttttatgaaaagtctaaattttggtttggattattaagatatgttactgaaggtgcaaactttctacttattggcttgttttggttaaatggtattgctaggaaacgaggattaagacaatttaatgtgttacccaagcaatcaggaattgcatggattatggctatgtcattactcgtgagtcttgtggtttatatgatgacactcacatctgatatattagaagatattctatcatttaaattagaagtgataatgcaatttccgtatatattaagctctatttcactaatcattttgtttatacttttcattttaaaagatatggaaaaaatatggtactggctcatttcaatagttatgattgctgtgataagtatgtctggacacgtgtggtcacaacaagtgccattatggtcaattatcataagaacaattcatcttatagggctaacgttatggttaggttcactcgtttatctcatttgttatgctattaaagtgaaaattaatcagttgacgagtgtaagacgtatgcttttaaaagttaatatcattgctgtgattatgctcgtttttacagggattttaatggctattgatgaaacgaatactttaacactttggaataatgtgagcgcttggtctatttatcttgtcataaaaatcgcaggaattattgctatgatgctattaggtttctatcaaacgatgcgtgctttgagacaacgacaacaggtccatcgttttgcactgatgactgaattgttaattggtatgatattaatttttgcaggtatcatgatgagtcaaataaatatacctagttga

SEQ ID NO: 1273 - DNA, 507 bp, Staphylococcus epidermidis
cgctcatttcgtcacgaaatgtttaagagtgggagggcaaaactaagccctgtgaccacatcacgatatcaaggagtgcacatcgtggctaaaaaagtagaaaaagtagttaaattgcaaattcctgcaggtaaagcgaatccagcaccaccagttggtccagcattaggtcaagcaggtgtgaacattatgggattctgtaaagaattcaatgctcgtacgcaagaacaagcaggtttaatcattccggtagaaatcagtgtttatgaagaccgttcatttacattcattacaaaaactccgccggctccagtactacttaaaaaagcagctggtgttgaaaaaggttctggtgaacctaataaaactaaagttgcaacagtaactaaagatcaagtacgcgaaattgctcaaacaaaaatgcaagacttaaatgctgcagacgaagaagcggcaatgcgtattattgaaggtactgcacgtagcatgggtatcactgtacaataa

SEQ ID NO: 1274 - DNA, 228 bp, Staphylococcus epidermidis
catttgttgctagaggcgctctcgcacggttccactcttcatttaatagcaatactcatatttgatttattactattctcatctcaattatttatttttattaacaaaggtgcattcattaatatttatgatgtgctcacagctaccgcacactctctgacacataaacatttaactactaatcctttgaatcactttatatttataatcatatgttgtcacttgtaa

SEQ ID NO: 1275 - DNA, 540 bp, Staphylococcus epidermidis
atgggggaaaggataagaagtgttcaaataactgaggtagagcaactacaactaattgctaaaagaacattttttacaacgtttagagaatcttatagtgatgaggacttcaagcaattttttagtgatgcatatgatatagatgtgttgagaaaagaattggaacaaagtaattcttttcattatttttatgaagttgatcaaaatatagtaggtttcttgaaattgaacattaatgatgctcagactgaaaacaaaggtcatgcatatttggaaatacaacgcatttactttgatgaagcatttcaagggagtggaagaggacaattatttatcaatctagctattgatcaagctatcaaatttgggaaatcgaaaatatggcttggtgtttgggagcataatcctaaagcgcttagcttttataaaaacagaggatttagagttacagggtcgcatcaattttatactggaagtgtagtagataatgatttgattatggagttggatcttacaacaaactataaacaaagtttatag

SEQ ID NO: 1276 - DNA, 690 bp, Staphylococcus epidermidis
agctattggaggtggccaataatgggtttagttgttaaagatataagtaaaacttttggagaaaaaacctcaaaaacagaggtgttaaaagatattaactttgaagtgaaagatggagaattcatcattttaaatggtgcttcaggatcaggaaaaacaaccttattaactattttaggtggtttgttatctcaaacatcaggtgatgtagtatacgaggggaaatccttatttgaacgacatactaataaagcgcacttaagactaaatgatattggttttatctttcaagcctctcatttagttccatacttaaaagttttagaccaacttaccttaataggtaaagaaactggaatgtctagcaaagaagctcaagcaagagctaaagaattattaaaaaaaattggattagaagagcaacttaatagctacccacatatgctttcaggtggacaacaacaacgtgtagcgattatgagagcacttatgaatcatccgaaaattgttttagcagatgaacccacagcaagtcttgatgctagtcgtgctcaagaggttgttgaaatgatcagaaaacaaataaaagctaaccaaatgataggtatcatgattactcatgatgaaagcttgttcaaatacgctgatcgtattgttcaattgtacgatggtaaaataaaaaacagttaa

SEQ ID NO: 1277 - DNA, 732 bp, Staphylococcus epidermidis
  unsure (20),(22),(32): Identity of nucleotide at the above locations are unknown.
gtcctctttggtcacattananaacaacgagngccaaaggggctacataaagttattctaactgttttagataatttattgacgccattattatcaatttttattacagcatttataacatttttatttgtagggcctgtcactcgtcaattaggttattggttatctgatggattgacttggttatatgaatttggtggagctattggtggacttatatttggtttattatatgcgccaatcgtcattacaggaatgcaccatatctttattgcagttgaaacgacattaattgctgatgcgactaaaacaggtggttcatttatcttcccaatcgcaacgatgtcaaatattgcacaaggtggtgcagctttagctgcattctttatcattaagcaaaataaaaaattaaaaggtgttgcttccgcggcgggtatttcagctttactaggaattacagaaccagcaatgtttggtgtcaatcttaaattgagatatccatttataggtgctgttgcaggatcaggtataggtgcggcttatatttcattcttcaaagtaaaagcgatagcgcttggtacagctggattacctggatttatatctataaatcctacacacgctggttggttacattacttaataggaatgctaattgcatttgttgtttcagttgtcgtcactttagtactttctcgaagaaaaacaaataagacagctgttgaatcatag

SEQ ID NO: 1278 - DNA, 1506 bp, Staphylococcus epidermidis
ttaatatttggctatttattatccacacaattaatagtaggagtgaaaataatgagtgaacgtatcagagtaagatatgcgccaagtccaacaggatatttgcatattggtaatgcaagaacagcattattcaattatttatttgctaaacattataatggtgattttgttgttcgcatcgaagatacagatagtaaacgtaatttagaagatggtgaatcttcacaattcgataatctaaaatggttaggtttggattgggatgaatctgtcgataaagataaaggttttggaccttatcgtcaatctgaacgtgcagaaatctataatccactaattcaacagctattagaggaagacaaagcatataaatgttatatgactgaagaagagttagaagcagagcgtgaagctcaaattgctcgtggagagatgccaagatatggtggacaacatgcgcacttaacagaagaacagcgtcaacagtacgaagcggaggggcgtaaaccatcaattcgtttccgtgtgcctaaagatcaaacatatactttcaatgacatggttaaaggagaaatttcctttgaatctgacaatatcggagactgggtaattgtaaaaaaagatggtgttccgacttataattttgcagttgccgtagatgatcattatatgcaaatatcagatgttatacgtggtgatgaccatgtttcaaatacacctaagcagttaatgatatatgaagcatttggatgggaagcacctcgttttggtcatatgtcactcattgttaatgaagagcgtaaaaaattaagcaagcgagatggtcaaatcctacaatttatcgagcaatatcgtgacttaggatatcttccagaagcattatttaactttattacattgttaggttggtcacctgaaggtgaagaggaaatcttttctaaagaagaatttataaagatttttgatgaaaaacgcttgtctaagtctccagctatgttcgatagacaaaaacttgcttgggttaacaatcagtatatgaaaacaaaagatacagaaacagtattcgaacttgcattacctcatttaatcaaggctaatcttatacctgaaaacccatcagaaaaggatagagaatggggacgtaaattaatagcgttgtatcaaaaagaaatgagttacgctggtgaaattgttccattatcagaaatgttcttccatgaaatgccggaacttggaaaagatgaacaagaggtattacaaggagaacaagtgccagaactaatgaaccatttatatggtaaattagaatctttagaatcgtttgaggcaactgaaattaagaaaatgattaaagaagttcaaaaagaaactggtattaaaggtaaacaattatttatgcctattcgtgttgctgttactggacaaatgcatggtcctgaattacctaacacaattgaagtattaggcaaagataaagtattgtcacgcttaaaaaaccttgtttaa

SEQ ID NO: 1279 - DNA, 771 bp, Staphylococcus epidermidis
tggatgaaaggtagtgtgaatgtggaagatatagtgatagtaggtagacacgcagttaaagaagcaattatatcaggtcacgccataaataagattttgattcaagacggtataaaaaagcaacaaattaacgacattttaaaaaatgcaaaatcacaaaaattaattgtacaaacggtaccaaaatctaaattagattttttagcaaatgcacctcaccagggtgtggctgctttagtagccccatatgaatatgcaaacttcgatgaatttttacaaaaacaaaagaaaaaagcccgttattcaactgttatcattttagatggtttagaagacccgcataatcttggctctatattaagaacagcagatgcttctggtgttgatgcggttattatacctaaaagacgatcagttgcgctaacacagaccgttgcaaaagcttctacaggagcgattcagcatgttccggttataagggttactaatctttcgaaaactatcgacgaattaaaagacaacggcttttggattgcggggacagaagctaataatgcaacggattatagagatttacaagcagatatgtcactaggtattgtaataggtagtgaggggcaaggtatgagtcgtttagtgagtgataagtgtgattttcatattaagattccaatggttggacatgtcaatagcttgaacgcgtctgtggctgcaagtttaatgatgtatgaagtatatcgtaaacgtcatcagttagaggaaaagtcatga

SEQ ID NO: 1280 - DNA, 1431 bp, Staphylococcus epidermidis
gagattgaaggaagatttatgataaagcaaataaatatttcaaatatggacaaattaaaagagcaaatggaacgtgcacttagcgacggctatacgcatgtcatcccctattcaaatgaaattcaaattcatcagtccatgattaaagctatcactttacctaagacttcatttatagttgactatacaattaacaattattatttaaacgattgtaaatacttcgggttggactttgttgattttgaggactgggttaaaaatattaatttatatccaaatgttatttatgaaattaattcaacattagaacttattgataaatttgaagttgaaaatatctttgatttagcattattaacaattcttaaagggcatatcgcagttgaaggtcatgtcgtattagactttaaaggaccattaaaaacgagcaagggattttggcgctcatttgaccgtaatgatttaacttatagagataaattcttcttaaacaccatcgcttatgcacataaacaaagaatcccatttacgcgtgtaccatttaacgatcacgatagtattagatattatgattcagtactacttagtactaaatttaaagctccaagatggttagtgactcctattaagaattattcagttaaaaaacacaaagagattagctatatttataaaaaggattcatcaaaacttaagaaccacgtcgtttttctaggatttgatttcggctatcgaggaaactctaagtatttatttaattactttgttaaacacaatcctatgatagagtcttactttataacagatgagagaacaggaccacattttatttcaactaacgatgaaaatgtgaagaatttgattgaaacagctacttttgtcattacggaaagctatattcctgacgacattcaccctaatggtaaaatcatccaattatggcatgggacacctattaaaaaactatttttagatagtaaagagccacaccaaaatttaaatatatataactaccgagctcgaaaatataataaatggacacaacaagattatttaattgtagattcagaagaatcaaaaacatactttgaatcagcgtttcctagtcaaaaaattgatatattacctgtaggatatcctagaaataattatttattaaatcgtatcaatgatgtaggtttacataaacgtatatttagtgagataaatatagatcctactaagcgagtattattatatgcccccacctggaaaacaaattcatctgatgatgatatatttcctattaatgaacagttattaacacattataatgtgatctataaaggacacgtcgagagtaaaaatgacttggttcctgaaggcgtaataaatccgcctaataatattgaaacgcaagacttaattattatttcagatgttgtttaa

SEQ ID NO: 1281 - DNA, 183 bp, Staphylococcus epidermidis
aaattttatatgttagcacctacgttaataattatctcaatgattcatatcactgtggaacttcatatgcagcgatgtacgattgtatcaacgctgacatgtttattcatttcaactttaatcacggtatcgttgattcaaattaaacgtcttaaaaaggataacaacttaaatcaaatatga

SEQ ID NO: 1282 - DNA, 189 bp, Staphylococcus epidermidis
aaaccatccataattcctttaatgagcaacatcaatggtgcagctagtgaagctagagtaaaaatgatgaaggttaatacgagcaaaatgcataaaaaagctggtattataacaataaaaaagttaagcaaacttagccccattactgctacaattgcggatgaaatattcattaacgacactttttga

SEQ ID NO: 1283 - DNA, 345 bp, Staphylococcus epidermidis
aaagggaacattactaaaataacatggactgctacagataaaggtattggtccccatgagtttattgaatttcctattgtagtggctaatcctaaaaaggaaggcacattcaaatggaacactactcaaacttatgataatggagatgttgttaagtggactgggaaggaagatagtgcgcaccctgcaccaactacaactgtaaaaaaaggtgcaaatccaaatgacactcattctgactcgagtcaaggtgattcaatcgctttatggatagttgctatcgtggcaattgtgatttcgttgattgctctttttaaacaagcgcatccaaaaaaatttaattga

SEQ ID NO: 1284 - DNA, 1059 bp, Staphylococcus epidermidis
ggtgttttaatgagtgactcacaaagagaacagaggaaaaatgaacatgtagaaatcgcaatgtcacaaaaagatgcgctggtttcagattttgataaagtgagatttgttcatcattccatccccagtattgatgttagtcaagtcgatatgacaagtcatactacgaaattcgatttggcatatccaatctatataaatgcaatgactggtggaagtgattggacaaaacaaattaatgaaaaattagcaattgttgctagagaaactggaattgcaatggcggtgggatcaacacatgcagctttgcgcaatcctaatatgattgaaacatttagcattgtgcgtaaaacaaatcccaaaggaacaattttcagcaatgtgggtgccgatgtaccagtggataaagctctacaagcggttgaattattagatgctcaagcgctacaaattcatgtgaactcacctcaagaattagtcatgcctgaagggaaccgtgaatttgcttcatggatgtcaaatattgaatctattgttaaacgcgttgatgttccagttattattaaagaagttggtttcggaatgagtaaagaaacattacaagcgttatatgatattggtgttaactatgttgatgtcagtgggcgcggtggaactaatttcgttgatattgaaaatgaaagacgttcgaataaagatatgaattatttatctcagtggggacaatctaccgtagaatccttacttgagagtactgaatttcaagatcgattaaatatttttgctagcggtggcttacgtacaccactcgatgctgtaaaatgtttagcattaggtgcaaaagcaatagggatgtctcgaccgtttttaaatcaagtagaacaatcaggtatcacaaataccgtagactatgtagagtcttttattcaacatatgaaaaaaattatgacgatgttagatgcgccgaacattgagcgtttacgacaagcagatatcgtaatgagcccggagttaatatcatggatcaatcaacgtggccttcatttaaatagaaaataa

SEQ ID NO: 1285 - DNA, 402 bp, Staphylococcus epidermidis
aggagaataataatgtctataaaagaaaaattagtaatagagctcatgaatttaaaagacactgtaaaatacgaattgtcagaattaaatgaacaacaatatttgtttatgaacggcccagcacctcagttgatgaagcgtgccatgaaaatgagctatattctaggccaaaaagaagcgattgatcactttctattactcatcgacacttgccatgagaatgtcttactagataactgccaagactatcaaaaacaaattcaacataaacaattctctttacaagaagatattattcaccaaataaatcagtcaaaggaattcgaatcatttttatcaacttattatgtaaataaaggtaaatatgatatcaccagcaaaataaaaacattacttgaataa

SEQ ID NO: 1286 - DNA, 465 bp, Staphylococcus epidermidis
gagataaaaatggtaagaagaatagaagatcacatctcatttttagaaaaatttattaatgatgttaatacattaacggcaaagttacttaaagacttgcaaactgagtatggcatatcagctgagcaatctcatgtgttaaatatgcttagtatagaggcgttaactgtggggcaaattacagagaaacaaggtgttaataaagctgctgttagtcgaagagtcaaaaagttgctcaatgctgaattagttaaattagaaaaacctgattccaatactgaccaacgtcttaaaataattaaattatctaataaaggaaaaaaatatattaaagagagaaaagcgattatgagccatattgctagtgatatgacgagtgactttgacagtaaggaaattgaaaaagttagacaggttttagaaattatcgactatcgtatacaatcttatacttctaaactttga

SEQ ID NO: 1287 - DNA, 696 bp, Staphylococcus epidermidis
aaggtcgtgatatacatgattaaagtgaatgccatatctattggcaaaatagaaacattgtcttatggaaactataaaccaatgcaatcagcgttaaacaaaattccttttaaaggtcaaatgtggctcaatcgacttgggttcgtggacgatgaacaagcctatcataaccatggtggtatacataaagcgatatgttgttttagtaaatctaattatcaattatttaaagatgacttagatcaattacctgaatttgcaatgtttggagagaatttgacagttgaacatctagatgaagcagatgtttattttggtaatcagtatcaactaggcgatacaatcatagaagtatcagatatacgagaaccttgttggaaaattcaagctaaatatgcaatacctaatttagttcaaaaaatgtcgcaatctggtaaaactggattttattttagagttataaaagaaggatatgtacatcagagtgataatttaaaactcattaaaaaggcagaatcaaacacacgtctatctgtgaaagacttaaatcatctattctataatgagcgaaataatttaagattaatctatcatgcacttcgaaatccttatctttcacctgatcgaaagaaaaaactacagaaaatgaaaacgcgtgccgaaaatagaaaattcattaaatctgacgataaatag

SEQ ID NO: 1288 - DNA, 1416 bp, Staphylococcus epidermidis
tgtagtgagatgagtagaggtgataaaatgagtcaatgcccaaattgtggtcatcaagtgaaagatgatacatcgcaatgtccaaactgtgggcaactgttaactaagaagaaaaaaagaaagattaaagaccaatcatctcaatcgagtaatgagaattctaccaatatacgtcttcgtaaaattgtgccgataggtattagtgtatttatcttaatacttattatcgtgttatttttccttttaagaaattataattcgcctaatgcacaagctaagatattagttaatgctgtagataataatgattcacaaaaagttgctacattattgagtactaaaaataaaaaagtagacgatgttgaagcgcaacaatatattaattatgtaaaaaaagaagtaggtattaagaagtatattcaagatatcaataatactgtagataaattgaataaaagtaattcaagcgtggcatcttatatacaaacgaaaagtggacaagatgtacttaagataagtaaaaatggtacaaagtatttaatttttgataatatgagtttcacagctccgactaaaaagccaattattaaacctaaagtagaaactaaatatgaatttagaacaagtggtaaaaagaaaactgtcattgctgaagcaaataaaaatacacctttgggtgaatttattcctggtacatatcatttaccagctaagaaaattacagaaaacggtacattcaatgggcatttaaattttgactttagagaaagccactctgaaaccgtagatgtagctgaagattatgatcaatcatttatcaatatcaaatttaagggtgcgaataaattaagtgataaatcagaaaaagttcaaatcaatgaccgtacattcacttattctcattctaaagaatttggtccttatccaaaaacaaaagatataacgatttctgcaactggtaaggcaaaaggtaagacgtttagttctgagacgaaaacaattagtgcagacgatttgaaagataatacgaaagttacattggaatttgatagtgataaaataaatagctatgttgagaagaaagaaaaagaagaaaatagtttgaaaaataaattaactgaattttttactggttatgcaacggctatgaattcagcatttaatatgaatgattttaactttatatcgagttattttaaaaagaattcgtctatatacacatcaatgaaaagtaatttccaaaatcgaacgaacgtgactatgatatctccgcaagtgttaagtgttcatcgaaacggacatactgtaagaacaactattcaacatatcgatcatattggtaattatataaataaagattatgaattagaaatagataatgatgatagtaatatgcagttggttaaagaattataa

SEQ ID NO: 1289 - DNA, 1389 bp, Staphylococcus epidermidis
atcggaggtgtctcaatggccaagaaaaaagtaatattcgaatgtatggcatgtggctatcaatctcctaagtggatgggcaagtgccctaactgcggtgcgtggaatcaaatggaagaaatagtagaaaaggttgctcatcctaaacatggtgtaaaaacaaaagaaacagcaggtaaggtacaaaagttaaatagtgttaagcatgaagctacccctagattacttacagaatcaaaggaatttaaccgtgttttaggtggaggtattgtaagtggttcgttagtactaataggtggagacccaggtattggtaagtcgactttattgctacaaatttgtgctgcgctgtcacaaaataagaatgttttatatattactggtgaggaatctattaatcaaactaagttgcgcgctgatcgtttagaagaagattctagtcatcttaatgttttagctgaaactgatttagaagtgatacatcaaactgtaaaagaagagagacctgacttacttgttgttgattcgattcaaacaatctatcatccggaaattagttccgcacctggatcggtatcacaagtaagagagagtacgcagagtttaatgaacattgctaaacaaatgaatattgccacatttattgtgggacacgtaacaaaagaaggacaaatcgccggaccaagattattggaacatatggttgatacagttctttattttgaaggagatgagcatcacgcatatcgtatccttagagcagtaaaaaatagatttggttctacaaatgagatggggattttcgaaatgaagcaaagtggattaaaaggcgtacttaatccttctgaaatgtttttagaagaacgttctacaaatgttccgggctctacaatcgtccccactatggaaggaacaagaccactactcattgaagtccaagcgcttgttacaccaacaacatttaataatcctagacgaatggctacaggtatagatcataatcgattaagtttacttatggcggttctagaaaaaaaggaaaactatttactccaacaacaagatgcctatattaaagtagcaggtggcgtcaaattaacagaacctgctgttgatttaagcattattgttgcgacagcttcaagttttaaagatcaagctgttgatggattagattgttttgtgggtgaagttggattaacaggtgaagtacgcagagtatctcgcatagagcaacgtgttcaagaagcggccaaactagggtttaaaagagctattattccacagacaaatattggaggttggacattcccagaaggcatccaagtcgttggtgtttcatcagtacatgaagctttgaaatatgcattacattcaaaacagcgataa

SEQ ID NO: 1290 - DNA, 408 bp, Staphylococcus epidermidis
gatttaaacgtggctaaacatatgaacgtaaaacttcttaatcctttaacattggcatatatgggtgatgcagtacttgatcaacatgtgcgtgaatatatcgtgctaaaattacaaagtaaacctcatcgtttgcaccaagtatcgaaaagttacgtttcagcgaaaagtcaagctaagactttagagtatttgttagatattgactggtttacagaggaagagctaagtgttttaaaacgaggacgtaacgctaaaagttatacaaaagctaaaaatactgacattcaaacttatcgtaaaagttcagcgttagaagctgttatcggatttttatatttagaccatcaatcagaacgattagaaaacttattagaaacaattgttaggatagtggatgaaaggtag

SEQ ID NO: 1291 - DNA, 1440 bp, Staphylococcus epidermidis
aaagacagcttgaaaaagctaagaatggagagattcaagatgattacattatataataccttaacacgtcggaaagagacgtttgagcccattgaaccaggtaaggtcaaaatgtatgtatgtgggccaacagtttacaattatattcatattggaaatgcacgaccagctattaattatgatgtagtcagaagatatttcgaatataagggatatgaagtcatctatgtttctaatttcacagacgttgatgataaactcattaatcgctctaaagaacttaatgaaagtgttcctgaaattgctgaaaagtatattaaagctttttatgaggacgttggtgctttgaatgtgaaaaaggctacatctaatccgcgtgtgatgcatcatatgggtgaaattattgattttattaaagaattagtagatgaaggttatgcatatgaaagtgacggtgatgtctattttagaacacgtcaatttgatggatatggtaaattaagtcatcaatcattagatgatttgaaagttggcgctcgtattgaagctggagaacaaaaagaagatgcgctagattttactttatggaagaaagctaaaccaggtgaaattagttggaatagtccatttggtaaaggtagaccaggttggcacattgaatgttcagtaatggcttatcatgaactagggtctacaatagatattcacgcaggtggttcagatttacaatttccgcatcatgaaaatgaaattgctcaatcagaggctcataatcatgcacctttcgcaaattattggatgcataatggttttattaatattgataatgagaaaatgagtaagtctctaggaaatttcattttagttcacgatatcattaaagaagtcgatccagacgtattacgattctttatgattagtgtgcattatcgtagcccaataaactacaatttagaattagtaggtgcggcgcgaagtggtcttgaacgtatacgtaatagctacaagttaattgaggaaagagaacaaattgcctcagatttggaagaacaatcagaatatatacaacaaatagataaaatactaaatcaatttgaaacggtaatggatgatgactttaatactgctaatgcagtaactgcatggtatgacttagctaaacttgcaaataaatatgtattagaaaatacaacttcaacaaaagttttaaatagatttaaagaagtgtacagcatttttagtgacgtccttggtgtaccacttaagagtaaagaaactgaagagttactagatgaagacattgaacaattgattgaggagcgtaatgaagcacgtaaaaataaagatttcgctcgagcagatgaaattagagatatgttaaaagcacgtcatatcattttagaagataccccccaaggtgtaagatttaaacgtggctaa

SEQ ID NO: 1292 - DNA, 552 bp, Staphylococcus epidermidis
acgtcatcagttagaggaaaagtcatgaagaaaagatacttaattatagatggttacaatatgattggccaatcctcaacacttagcactgttgctaaagagaatttagaagaagctagagagcaattattagacacaattgccaactacaatgcattaatagcagatgaaattgtctgtgtatttgatgcctatgaacagtcagggatagaaagggaatacttctatcatggtgtcaaaacaatctttactaaagaaaaagaaactgcagatagttttatagaacgctacgtgtatgaattatataataaacacacgacacacattaccgttgtaacaagtgatatgagtgaacaacatgctatttttggttcaggtgcatatcgtatttcttcaagagaaatgtggcgtgaattaaaagaaaatgaggttgttgttaacaagtcacttgatgattttagcgaaaagaaaccaagaattagaattccgttatctaatgagatacttgaagaatttgaaaagattagacgtggcaatcagaaaaaagactaa

SEQ ID NO: 1293 - DNA, 1227 bp, Staphylococcus epidermidis
aagggaggagtaagcttgaaaagagtgtatcagtcagaaaatcaatcattactttttattgttattttaggttcattaacagcatttggcccattggctattgatatgtttttacctggactacctaatattagtcatgattttgatatttctgcatctacaactcagcttactatctccttttttatgattggattagcgttaggaaattttttggctggccccatatctgatattactggtagaaaaaaaccattaattttctcactgattatttttactattgcgagtttaggtattatattcgtcacaaatatatggattatgattattttacgatttattcaaggattaactggtggtgcaggtgcagtcatctcaagagccattgctagtgatatgtactcaggtaatgcgctaactaaatttttatcattattaatgcttgtcaatggcattgcgccaattatcgcacctgcgcttggcggtatcattttaaattatgggccatggcgaattgtatttgtaatactaacaatgtttgggattgtcatgttaataggaactttatttaaagttcctgagtcgcttgaaaagagcctaagggaaagtagtaacataggtacgatgctaattaatttcaaagaactttttaaaacaccccgttttgtattacccatgttgatacaaggggtgtcatttgtattactatttacttatatttctgcatctccttttatagttcaaacaatttatggtttaacgccattaaacttcagtattatgtttgcttttataggcgttacactcattatttcaagccaattaaccggaaaacttgttgactatatagatagattactgttgctgagaatcatgtctactatacaagttattggtgttataatcgtatcactaactttactcaaccattggactttttggatactttcttgtggctttgtgattttagtggcaccagttacagggattgcaacgttaggattttcgatagcaatggatgagagtaaaggggccaaaggtagttcttcaagtttgttgggattgtttcaaactttacttggtggcgtcatctctccacttgttggtattaagggagacagtaatgcgataccttatataatcgttatcgttattacagcaataattcttatggttttacagttgattaatgtgaagatatttaaaaaagctaaaattcattga

SEQ ID NO: 1294 - DNA, 492 bp, Staphylococcus epidermidis
tcaaagaaggtcaaaaaagaggtgatatctatgcacaatatgtccgacatcatagaacaatacattaagcggttatttgaagaagcagatgaagatgttgtagaaatacaacgcgctcatattgctcaacgtttcgattgtgttccttctcaacttaactatgttattaagacacgttttactaatgaacatggttatgaaatagaaagtaaacgtggtggcggtggttacattcgaatcactaaaattgaaaataaagatgctacaggttatattaatcacttactacaattaataggtccatctatttctcaacaacaagggtattatgtcatagatggtttgttagataaaggtttgatcaatgaaagagaagctaaaatgatacagaccattattgatagagaaactttaaaaatggatgttgttgcacgcgatattattagagctaatatcttaaaacgattactaccagttattaattattactag

SEQ ID NO: 1295 - DNA, 627 bp, Staphylococcus epidermidis
aaaagagaggtgatatatttggactttataaatcagcagacaacccaaactgcaaaagctttattaggtgttaaaattatttaccaagatgactatcaaacatatactggatatattgtagaaactgaagcttatttaggtatacaagataaagctgcacatggttttggtggcaaaataacaccaaaagtgacttctttatataaaaaaggtggcacgatatatgcacatgtgatgcatacccacttattaatcaattttgttacacggactgagggcataccagaaggtgtacttattcgtgctattgaaccagatgaaggtatcggcgctatgaacgtcaatcgtggaaaatctggatacgagctcactaatggtccaggaaagtggactaaagctttcaatattccacgatcaattgatggctcaaccttaaatgactgcaaattatctatagataccaatcatcgcaaatatccaaaaactattatagaaagtggtcgtatcggtattcctaataaaggagaatggacaaataaaccactacgtttcactgttaaaggcaatccatatgtctctagaatgcgcaaatcagattttcaaaatcccgacgatacatggaaataa

SEQ ID NO: 1296 - DNA, 963 bp, Staphylococcus epidermidis
aaggaactattaattatgattacagcttataaacacgcacttcatcatccttcacaaattattgaaactgaaatcaatcatagtgcttcatggataaatgtagtagaaccagatagagaagaaattgaaggtttgatggaattttacaatatacctgaggattttattcgagatccgttagactctgaagagagtgcacgtattgaatatgacgaagatacgggatactcgctaattattattgacttacctatcgtcaattctaccaatcggcgtgtcttgtcgtttgtgaccatcccattaggcattattattggaaatggtatcgttatgactgtttgcgatgctgaaaatgaatttttagaaaactttgctaaacaagaagatattaacttgaaatttcacagtcgatttgcacttgaaatactaacaacaatagcaaatcactacaatagaaatttaagattgcttaataaatctaggattcgtattgaaagagaactcaaaaataacattactaacaagcagctttttaaactaatggaagtagaaaaaagtttagtatacttcttagctgcactaaaaggtaacgacacaattattaaaaaactctttcgtcttcctgcaatcaaacgttttgaagaggatgaagagctacttgaagacttggtgatagaaaacaaccaagctattgaaacgactgaattacatcaacgaatacttgagagtatcacttcttcgtatgcttcattattatctaatgatatgaataacatcatgaaaacattaacgttgtttacggttcttttgacccttcctacactcgtctttagtttctttggtatgaatgtacccttaccaattgatgatcatagttacgtgtcttggattattgttgtgggaatttcacttattctagtagctatcgttagtatctttttatggaaaaaacaaaaattataa

SEQ ID NO: 1297 - DNA, 660 bp, Staphylococcus epidermidis
gagggtatattcatgaaaaaaatgatattaatcaatgtgattactatcattgtcctagttgttattggtgtgttaggcttttggttctggcataacacaacaagttatgtgacaactgacaatgcaaaagttgatggagatcaaataaaaatctcaagtcctgcatctggacaaattaaatctcttaatgttaagcaaggagacaaacttgataaaggtgataaagtagcagaagttttagcacaaggccaagatgggcaatcaaaagatatgaacatcaaaatgccacaaaaaggtactattgttaaaacagatggtatcgaaggttctatgactcaagcagggaacccaattgcatatgcatataatttagatgatctatatataactgctaatgtagatgaaaaagatatttctgacgtggaaaaaggcaacgacgttgatgtagatatcgacggtcaaaaagcatcaatcaaaggtaaggttgaagaagtaggccaagcaactgcagctagcttttcattgatgccttcatcaaatagcgacggtaactatacgaaagtttctcaggtagtacccgtaaaaatctctttagattctaatccatctaaaaatgttgtcccaggtatgaacgctgaagttaaaattcataaaaattaa

SEQ ID NO: 1298 - DNA, 1233 bp, Staphylococcus epidermidis
gtgttggtattattttctggtgattttaccactatgccattaaatgttgctattacaattactgttattgttgccttacttatgaaccgcaaggaaacttttgcaaaaaaagtagaggtatttacaaaaggtgcaggtcactctaatatcattttgatgatgcttatttttatccttgctggagctttttcgacgactgctgaaaaaatgggaggcgtgtcatctacagttaatttaggcttatcacttattcctcaaaatctaataattgttgggctatttattatttgtatgtttgtatcaatttcaatggggacttctgttggcacagttgcagctattgcaccagtaggttttggatttgcacaagcaacagatgtaccagctgcattagccatggcaacagttgttgggggagcgatgtttggtgataatctatctatgatttctgataccactattgcagcagtaagaacacaaaaaacaaaaatgagtgataaatttaaagtcaattttaaaattgtactaccaggtgcgattattacaatcatcattttattctttttaacaaatggtatttctatagatcatactaaaaactatgattataatttaattaaagtcataccatacttattagttttgattcttgcgttagttggtattaatgtaattattgtattaataggaggtactgtattagccggtataattggactgattgatggttcttttggttggaatggccttttaaatgctatttctaaaggtattatcggaatggaagatattgctatgattgcattgcttataggtggtctagtaggaattatccaacataatggtggtattgattggttgcttaattttgtaaggtcaaaagtaaaatcaaagcgtggtgcagaactaggtatagcgagtttagtgagtgcagctgacatttcaacagcaaataatacaatttctattattatggctggaccattagctaaaaatattgctgatgaatatgatgtcgatccaaggaaatcagcaagtatattagatatctttggtgggtgttttcaaggattattaccatacagtccacaagtgatttcagcagcaggtgtagccggaatttccccattcctaatgttacaatatagtatttatccaatattattaggtgtttgtggattagtagcaattattttaagagtacctcgtttaaatcaatcgtcaaagaaataa

SEQ ID NO: 1299 - DNA, 429 bp, Staphylococcus epidermidis
ggaggattttttatgcgtagattattatactcttttttattttatatggtcataggtttattaagtggcttttactacagagaattaactaaagcgcatgactttgtgggtgacacgcaattgtctttagtgcatacacatacacttatcttaggcatgtttatgtttttactcttattaccacttgaaaaagtatttaaattaagtagttattacttatttaattggttctttttcgtgtatcatttaggtgtgttaatcacgatttcaatgatgacagttaaaggtacattccaagttattggtaaaaaattttcacccgaaatgtttgcgggatttgcaggcataggtcatacaggtatgcttgcaggtttactgttactgtttttcttattaagacaggctattcttacagaacccaaaaaataa

SEQ ID NO: 1300 - DNA, 285 bp, Staphylococcus epidermidis
tgtaagacattaactaattttttaagcaaaagtttacttagtgttttagtaataatttttgaaaaaatagctaggtctttagctggggtaaaaggaggttttattttgaaagttgttttatatttcatttactttttcgttgcgttttttgttgtagattctttaattagtttggtatttccaattgaatttgatgtgtatacaaatttaattactgcattcatttttgcagtttttatgacaccactattatttgtattaaaacaagacaaaaacaaaaaataa

SEQ ID NO: 1301 - DNA, 1209 bp, Staphylococcus epidermidis
atgatagaatttgatgcaattaccacattatgtttggcatgtgttttatatttaattggtcaaacaataatcaaccatgtttctattttaaggcgaatctgtattccagcacctgtcattggtggtcttttatttgcaatattagtggctatattagattcatttaatatcgttaaaataaaacttgattcggcgttcattcagaatttctttatgctcgctttctttactacaattggacttggcgcatcattaaaactattcaaaattggcggaaaagtcatgttgatttatttcactttttgtggaatcatggctatttgtcagaatattattggtgtatcactcgctaaactcttaaacattaaacctttattaggtcttacagcaggttcaatgtcaatggaaggtggtcacggtaatgctgcagcttatggtaaaaccttacaagatatgggtgtagattctgcagttgcagctgctttagcagccgctacactaggccttgtattcggtggactcattggcggtcccatcgttaaatatttaataaaacgctatgatcttaagccagagcatcgtgacgattcatttaaaaattatggtgtcgttgaatacaatcaatcattacatacaaaatataaacctattcaagtcttttttatacaattttctatactcgtattttgcatggcattaggaacatatattggcaatacttttaccgatttaaccggagttaatattccaatgtatgttggttcaatgtttgtagcagtaattattagaaatgctacagactttattggttgggatatcgttgatttaaaaatgagcgaacaaataggtgatatttcattaggcatctttttatcattagctttaatgagtatccaattaactcaaatatattctttagctatcccactaatcataattgttcttgtacaagtcgtatttatggtactattctcgattttcatattatttaaaggactcggtaaagattatgacgctgctgttatggtaggaggatttattggccatggtctgggagcaacaccaaatgcgatggctaatttagatgttatcactaaaaagtttggcaactcccctaaagcatatctagtagttcctattgttggtgctttcctcatcgacttaatcggtgtaattattgttatgagttttattcaacttttcagttaa

SEQ ID NO: 1302 - DNA, 216 bp, Staphylococcus epidermidis
tcaagttattcatcaaggtatactttagggtatctttatcgtttgaataacttttttaaaattaaaccacttacaataaactaccgcatttatttgcatattttgatagtggtcatagttatcattttattgatgtataatttgcaaagtattttaattaatatttggctatttattatccacacaattaatagtaggagtgaaaataatgagtga

SEQ ID NO: 1303 - DNA, 189 bp, Staphylococcus epidermidis
actgtacattcatatatctacctcctcagtcgtataaacagtattaaactatacacagtagtgattcaaattaactatagcatccactactatacattgcaaggtactgagtttaatttattaatacacacgtctttattcaaattacaccatcttttattgacaaattataaaaatcaatatttttaa

SEQ ID NO: 1304 - DNA, 948 bp, Staphylococcus epidermidis
ttagatacatcaaaggggcaatctagtatggaggaagttttaaaacttaaaatccctgcatcaaccgcgaatctaggtgtaggttttgactcaattggtatggcattggataaatatttgcatatgtctatacgtaagattgaaagagctaattgggaatttctatattatagttcagaactagaaggtttacctaaagatgagaataattatatttatcaaactgctctaaatgttgcgcgtaaatacaatgttacacttccaagcttgcaaattgaaatgagaagtgatattccattagctagaggactaggttcatctgcttctgcattagtcggtgctctttttattgctaattactttggtaatattcaattatctaaatacgaattgttacaactagcgactgaaattgagggacaccctgataatgtagcacctacaatatatggaggtttgattgcaggtttttataatccaataactaaaataacagatgttgctagaatagaagttccgcacgtagatataattttaactatacctccatatgagcttcgtacagaagactctagaagggtcttacccgatacattttcacataaaggtgctgtgcaaaatagtgccattagtaacactatgatttgtgctctcattcagcataaatataaacttgctggaaagatgatggaacaagatggttttcatgaaccatataggcaacaccttattccagaattcaatcaagtacgtaaactatcacgtcaacatgatgcatatgcaactgttataagtggagctggacctacgatactcactctttgtccaaaagaaaaaagtggtaaattagttagaacactacgtgagaaaattaataattgtgcttcagaactagtaacaattaatgaaataggtgttaaagatgaagtggtgtacctaaagtcctaa

SEQ ID NO: 1305 - DNA, 879 bp, Staphylococcus epidermidis
gtagtaatgtctttaacgattatcttatctataataattattattttgattatggctatggttcttaatcaaaaatttatgaaagatagggttgaaacagaagaatatgctagaaatcaattaatctctaaaaattcaattttaagtgaagaaaatttatcattgaaaaaccaaatgttaagtacaaacaatgacgtcggtcaacacgcttttaaaaacgccaagcgtgaattaagaaaaatattaaatagatttaaagaagagggtcgtttacgatcatatacaattgttcctacgagtaatttggctgttaaacatccccttttcgaatatgcacgttcattcgattttattatcattactgatgttggtttgataaatgtggatgttaaaaattggaaccaaaaaacgttttatcattttgatgtgccagatcaacatcttgaagaaggacaaccacaatataataccgaaaaagttgtcggtcattatattagcaatcgatatcatagtcagtttaaaacaacacgttctggtgtctatacttttattgagattttacaggataatcgtgtaatatatgaattttatgaccacgatccatacgataaagccgcaaacaatgcaaaagcattaaaagataaaattgaaaatgattataattttaaaattcaaagtattggcgtcatatattttagtgatggtagcgttaatattattgaaggatccgacgagagtgataaatacgtcgacaccgtatctacaccgatatcacttgaaaaagtaattgaggaagctatcgatttatctaagcacccccttactgataaacaaatcgaagaaatttctgaaaactttaaacaacatatgaataattaa

SEQ ID NO: 1306 - DNA, 213 bp, Staphylococcus epidermidis
tacatgatgttaggagtgaaagaaatggatacatctaatgaaaataaaataacaatcattgccgttatagtagcaataattgttggtgtcgtactacaaattgtctttaaactacccttaatcgtgagtttagtggggtcagtatttttaggtatgttcgttggttttatcgtctacctaattcaatcatttcgtcgtaaaaaaaagaattaa

SEQ ID NO: 1307 - DNA, 189 bp, Staphylococcus epidermidis
ataccagagttagctgctgataataatgatgttaagataacagcgttgatgactgatgcagcaaaagcgatccctattctatcgaaaacaattgtaaacggactttgtgatacagactcattttcattaagtaaaagtggatccgtatatggaatgatggcagctatcacagctatagacaatacgtaa

SEQ ID NO: 1308 - DNA, 552 bp, Staphylococcus epidermidis
aataaggtgacattattgaaatctaagaaaatgtcatcgcttttagtagtagcgatgataggaatacttgtaattattttccagtttgtaaaccattctggaccgtttagtggttcagaatctcaacatcaatcagataattccaatttaaatggtaaagacaaagtatatgtgaaacgagttgtagatggtgatacatttgttgctcaaaaaaatggagaggaaattaaagtcagattaattggtgtagatacgccagagactgttaaacctaatacgccagttcaaccatatggtaaacaagcatctaattatacgaagaagtatctcacgcatcaaaatgtttatttagaatatgataaagaaaaaactgataggtatggtcgtactttggcgtacgtatggttaaaaaatggagatatgtttaacgaatcgctggtgaaaaaaggtctagccagagaaaagtatttttctccaaacggaaaatatagggataccttcgtacacgctcaagaagaggcaaaaaagagaaaattaaatatttggagctag

SEQ ID NO: 1309 - DNA, 1347 bp, Staphylococcus epidermidis
ccccttatctatattttttcaacagtacaattgtttttctcaaaagcacaaacggaggtaatttacatgaaagagttaaatatcgcattacttggtttgagaacagtcggatcaggtgttgtaaagattattgaagagaatagacaacagattaaagacaccatcaataaggatattgtcattaaacatattctagtccgagataaatctaagaaacgtccgttaaatattagtcaatatcatcttacagaagatattaatgacatcttaaatgacaattctattgatatagtcgttgaagttatgggtggtattgaacctactgttgattggttaagaacagcccttaaaaataaaaaacatgtgattacagcaaataaggatttactagctatccatttaaaattattagaagacttagctgaagaaaatggcgtcgctcttaaatttgaagcaagtgtggcaggtggtatccctattgtcaatgctattaataacggactgaatgcaaataatatttctaaatttatgggaatatttaacggaacttctaactttattctctcaaaaatgactcatgaacaaacaacttttaaagatgcgttagaagaagcacaaagattaggatttgctgaagctgatccaacagatgatgtagaaggtgtagatgctgcaagaaaggtagttattacatcttatttatcttttaaccaagtcattaaactgaatgatgttaaatcggtaggaattagtgacattacattagcagacatcaatgcagcaagcgcattaaattataaaattaaatcaataggtaaaggtacatatgaaaatggatatgtgaatgcttctgtggaaccgacactgatacataagaatcaccaacttgcagctgtagagaacgaatacaatgcaatatatgttataggtgatgctgttggcgatacaatgttttatggtaaaggtgcaggtagtttagcaacaggaagtgcagttgtaagtgatttattaaatgtggcacttttctttgaatcaaacttacacactttaccacctcattttgaattaaagacagaggaaactaaagaaatgatggatggtgcagaaccagtggttattcaagagaaatctaattactatatagtaattagtaacaataataaatctttggagaaagttgaatatgacattaaaaagaaattaccattccataaatcgttgcaacttgttgagagggatcaagatacttatgcaattatcgttactggaatagaaacatctccagaaaaagttctaaatcaatcaggatttaatatcaagaaagtttatcctgtagagggagtttaa

SEQ ID NO: 1310 - DNA, 183 bp, Staphylococcus epidermidis
acggaggtatatctcatggagaacaatcaaagtaatattactgaagaaacgaaacacaatgataatttagaaacaacttatgaacaaacgcaacaaaaagagaaaacattctctcaagaagaagtatctcaaatgattaaggatcgtttagctagaaaaaaaagaaatctgaataacgtatga

SEQ ID NO: 1311 - DNA, 231 bp, Staphylococcus epidermidis
tttaatcaatataatgaaaggggtatgggatttatgcaacaaataaaatttaaaactttaactgaggaaacactggagagcttagagaaaagtgttaattcgtttttaaagtctcaagagggtaatggttacaaattattaaacattactattaaacaaatcgaagaacgtgcatttccgcataatgacgaggactttaatgctattttaacattggtaacggaagcatag

SEQ ID NO: 1312 - DNA, 1257 bp, Staphylococcus epidermidis
aaggagatgtataacgtgacacagcatgcgacttataaaacaaaaaataaacgagaaactgctgtattaatcggtgtacatgctcaaacggatcgtcaatttaattttgaatctactatggaagagctcgatgctttatcacaaacttgccaacttaatgttaaaggacaaatcactcaaaatagagagcaatttgaccataaatattatgttggaaaaggaaaaatcgatgaaataaaatctttcatagaattccatgatatagatgttgtcgtaaccaacgatgaattaacgacggcacagtctaaaacgttaaatgataatttgggcattaaaatcatcgatagaacccaattaattttagagatattcgcgttgcgagcgagaagtagagagggaaagctacaagtagaacttgcacaactcgattatttgttaccaagactacatggtcatggtaaaagcctatctcgtcttggtggtggcataggaacaagaggcccaggtgaaacaaaattagaaatggatcgtcgccatattagaacacgtatgaatgagattaaacatcaattaaaaacggtcgtggatcatcgggaaagatatagaaataaacgtgaacaaaatcaagtttttcaaatcgctttagttggttatacaaatgcaggaaaatcgtcatggtttaatgttttagctaatgaggagacctatgaaaaaaatattttgtttgcaacattagatcccaaaacacgacaaatacaagtgaatgaaggatttaatttaattatttctgatacggtaggatttattcagaaattaccaacgacattggtggctgcgtttaaatctacactagaagaagctaaaggtgcagacgtacttatgcatgtcgtcgatgcaagtcattcggaataccgtactcaaattgacactgtaaatcaaattattaatgatttagatatggaccatattccacaagtagttatttttaataaaaaagacttatgtaacgaacagatggatgtacctgtatctaaatctgcgcatgtttttgtatctagtcgtgatgaaaatgataaacaaaaggtgaaaaatttagtaattcaagaaataaaaaatagtctcagcccatacgaagaaattgtagatagtgctgatgcagatagattatattttcttaaacaacacacgcttgttactgaattaatatttgacgaaacacaagcatcttatcgtatcaaaggatttaaaaaattataa

SEQ ID NO: 1313 - DNA, 708 bp, Staphylococcus epidermidis
gaatgtagtcaggaggactatgctatgcaacaagaacgacaatcgtggtaccaaaaatcttggtttattattctcacattgctatttatttttccattaggtctctttctaatgtggaggtatgcgcattggaagaattggttaaaattgactgtttcatcagtctatattattagtttagttttaacacttttatttcaagttagtctattaaatgagaataaaacaaatcaaatagaacatgcatcaactatgaaagaaaagtctaatataaataatgtaaaaacaactaaaaataaaaatatggaaaaatcaacgcagacagacaaacaaaactctgtgaacttaaagcaaaacacaaaagatcaaaataataacgcaaatgatgaagcagcttctccaactagcgaacaaaatgcagctatagcacaagcaaagtcatatgcaaatacattacctatctctaagaaaagtttatacaaacaattaacttcggaatacggagagaaatatccggcagacatagcacagtatgctgttgaccatatcagtgtagattataaaatgaatgcactgagattagcaaaaagttacgtaaaaaatataaacatttctaatcaagcgttatatgatcaactcgtttcagaaaatggagaaggatttactcctgaagaagcacaatatgcaatgaatcatttagataggtaa

SEQ ID NO: 1314 - DNA, 1254 bp, Staphylococcus epidermidis
aaaggaagacagattatgcaagattttagcaatttagttgaagaagttgaaaacacacttattccttactttagaaaaattgaaaagcgtgcattatttaatcaggaaaaggtcttaaatgcttttcaccatgttaaagctagcgaaagtgatttacaggggtctacgggttatggatatgatgattttgggagagaccatttagaacaaatttatgcgcacacatttaaagcagatgacgcacttgtaagacctcaaattatttcaggtactcatgctattactttagctttacaaagtacgttaaaaaacaatgatgaactactttatattacaggtagtccatatgatacacttctagaagtcattggtataaatggcaatggtgttgaaagtcttaaagaatatggtgttcgctataatgaagtcgaattacgtgacggtcgaattgatattcctaaagtcatcactgcaattaatgacaatacaaaagttgtagcaattcaacgatcaaaaggatatgatcaacgtccatcaattacaattaatgaaattgaacaagcaataacatctattaaagaggtttatcccaatatcattatttttgttgataattgttatggagaatttgtagaagataaagaaccgattgaagtaggtgctgatttaatcgccggatcattaattaaaaatccaggtggaggtttagctaaaattggaggatatattgctggtagacaagacttaattgaacgctgtggttatcgtttaacagcaccaggcattggtaaggaagcaggagcctcacttaattctttacaagaaatgtatcaaggattctttctagcgccacatgtggttagccaaagtttaaaaggtgcactgtttactagtttgttattagaaaaaataaacatgaagacctcccctaaatataatgtttatcgtacagacttaattcaaacggttcaatttgagaccaaagagcaaatgatttcattttgccaaagtatacaacacgcttcaccaattaacgcacattttagtccagaacctagctatatgcctggatacgaagatgatgtcatcatggctgcaggtacatttattcagggctcgtctattgaattatccgcagacggacctatacgtccgccttatgaagcatatgttcaaggtggtttaacttatgaacatgtcaaattagctgttacacgtgcggtgcaacatatgcaagaaaacaatttactataa

SEQ ID NO: 1315 - DNA, 534 bp, Staphylococcus epidermidis
acaaagactaactacacaaattgtgttaaattagatgtatatcgaaagggtgataaaatggaaagtatttatgattttgttgtacaaaaaaacaatggtgaaagttataaattagagcagtataagggtgacgttatgcttattgtcaacactgctagcgaatgtggttttacacctcaattcgaaggtttacagaagttatatgatgagtataaggatcaaggatttattattttaggatttccatgtaaccaatttggcggtcaagaaccaggatcgggagaagaagctgctcaaaattgcaaaattaactatggtgtgactttccctattcatgaaaaagttgatgttaaaggtgataatcaacatccattatttcactttttaacaaacgctgctaaaggtatgataaacgaaaaaatcaaatggaatttcactaaattcctaatcgaccgtgaaggtaatgtgattaaacgtttctcccctcaaaagaaaccggaacaaattaagactgaaattgaaaaattactataa

SEQ ID NO: 1316 - DNA, 405 bp, Staphylococcus epidermidis
attaataacaagttcaaaagtagaggagaggttcaagtaatgtctaatgattcaatcagacgaaacatggccgttttctctatgagtgtggttagtaaattgacagatttatcaccaagacaaattcgttactatgaaacacatgaacttgtgatgcctgaaagaacagatggaaataagagattattttctatgaacgatttagagaggttgttagaaataaagtctcttatcgaaaagggatttaatattagaggtattaaacaaattatattcgatgagcaagggcatttaactactgatgaacaagagacaagaaagagaatgattgttgacgcaacgcagaaaccacgtagtgaaacattaccaataaatcgtggcgatttatctcgatttattaaatga

SEQ ID NO: 1317 - DNA, 450 bp, Staphylococcus epidermidis
gtttctcgcaagaaagtgcaccaatttactgaaaattatgatacattattaatagggattgacatgtcccgtgacacattatatttaagaataaataaacgtgttgatattatgttgggccacggattatttaatgaagtgcaacatctcgttgaacaaggttttgaagcgagtcaaagtatgcaagccattgggtataaagagcttgtacccgttattaagggaaatataagcatggaaaatgctgtagagaaattaaaacagcattctcgacaatatgctaaaagacagttgacttggtttaaaaataaaatgaatgttcattggttaaataaagaaaggatgtcacttcaaatgatgttagatgagattacaacccaaataaataaaaggagttctaaccatgattgcaaacgaaaacatccaagaccaagcactagagaactttaa

SEQ ID NO: 1318 - DNA, 1095 bp, Staphylococcus epidermidis
ttgagagcaaatcaacacttttcatcgaataaattaataaatatcgatttaacattggagggaacgcttgtgatttcatttgaaaatgattatttagaaggtgcacatgaaaaagttttaaatcgattagtagagacaaatcgaatacaagctgctggatatggcttcgatgacttttcggcacaagctgcagataaaattagacaacgtattgactgtccagatgctaccattcgttttttagtaggtggtacgcaaaccaatcaagtagttattaactcaatgcttgatagttatgaaggtgttatatccgctgatacaggacatgtggcagtccatgaaggtggtgcgatagaattcagtggacataaagttctaaccataccctcccaagaaggtaagattactgctcaagacgttgagaattatatagaaacttttgaaagtgattttaaaaaagaacacatggtgtatccagggatggtttatatttcacatccaaccgaatatggaactttatacacgaaagaagaattacaatctttatctagagtttgccgtagacatcagattccactatttatggatggtgcacgtttaggctatggccttatgagcaatcaaactaatgtaactatcgaagatgttgcaaaatactgtgatgtgttttacataggaggtactaagattggagcactttgtggtgaagcaattgtcttcactaaacaaaatgaacctaaaaacttcactacaattataaaacatcatggtgctttattagcaaaaggccgtctaactggtgttcaatttttagaattattcactgatgatttatattttgatataagtcgacatgctattaaaatggctgaaaaggtaaaaaaaggatttatagataaaggatatcaagtctattttgattcaccaaccaatcaacaattttttattttaagcaacgataaaattgaagaactaaaacaaaaggtaaaattcgcagtttgggagaaatacgataatcaacatcgtgtagttcgcttcgcaacaagttgggccacaactgaagaaaatgttaatcaactacttgaactaatataa

SEQ ID NO: 1319 - DNA, 957 bp, Staphylococcus epidermidis
caaataaaaaaaggaataggggcagatgttgtgagtcaaagtcattttaaaataacagttgaagatggaacaatgttagaggtgaaaattgataaagcaaaaaagagtactattggtattgttcatcttttccatggcatggctgaacatatggaccgttatcaagagttagttgaggctttaaatacacaaggttatgacgttgttagacataatcaccgtggacatggtaaagaaatagatgagaatgaacgtggtcattttaatagcatgaatcaaattgtagatgatgcttatgaaattattgagacattatatcttgaagagctcaatgtaccctatattatcataggtcattcaatgggctccattattgctagatcatttgttgaaaagtatcctgacattgctcaaggtttaattcttacaggaacaggtatgttccccaagtggaaaggtgtaccaatacgtttagcaatgaagttagttacatttatttttgggaaacgacgtcgactcaagtgggtgaatcaattattgaataaaactttcaataaaaaaatcactcaacctcgaacagatagtgattggatttctacacgtcaggatgaagttgataaatttgtggaagatgaattttgtggattcaaagtatctaatcagctcatttatcaaactttaaagaccatgatgaagacagtagaacgacaacaactaaaaagaatggacaaagaactacctatactatttatttctgggaaagatgatccttttggtgaatatggtaaaggtataaagcatttagctagattatataaaagagcaggtattaaacatataacagtacaactatataaacataagcgtcatgaaatattatttgaagaagattatttgaaaacatggcaacacatgtttgaatggatggaaaagcaaattttgaaaaaacaaaagtga

SEQ ID NO: 1320 - DNA, 396 bp, Staphylococcus epidermidis
aaagaaaaaaatacaagaaaaagcaaaaaagaaattcctgatgtgatacgtagtggtaaaataaaattagatataaatcctgaaaaacaaaatagacattccttaaatcatagtttatatttgaaaaataaaaattttgcattaaaaaataatgaaagattaccaagttatactacgttatctatcaatgaattaaatagattagtacaacagtactcaacttctggtaaaatcttaataaataaaaacggttttaaccataaaaaagtaataaattttgagaggattataggaaaagcatttatagatggaaaatatattgagactacatttggtaaagtgcattattcaaaaacagactctcatataataccttttataagtaaggagaaataa

SEQ ID NO: 1321 - DNA, 210 bp, Staphylococcus epidermidis
gtaaggagaaataaaatgttaattaaagatgcttatcgtaaaaatgttattgtcacacttaaaaataatgaaaagtttaaaggttttgtgtttgattatgaaaacccattagaaagtgatactggaaactattccctggatttagagacagatttaggaatatattcaattgatgaatcggaaataaaaagtataaaattaatatcttag

SEQ ID NO: 1322 - DNA, 708 bp, Staphylococcus epidermidis
aatgtactgaagaaatcttgtgatgaggcaaacaaagcacttaaactttataatttgtctatgaaagtatctagagaaaagctattaaagcagcaattagatttgatagtcaaagactccgctttagacattcatgatgaaatagaaaataagttggttgatagagaagttgaaagacaagcacatatacttggtgaacatgtgaaaattgatgacactgaagtaaaagcggttgttaacagtaactttaaaggtgtgaactggtctacaagattatgtcaagatatggctgtagttcaaaaagaagtagaaaaaacaacgagtaatgtattacttagagggagacatcctaatgagtacgtagctaagtttaaaaagcaaacaaataccacaacatataatgcaagtagattgttagttactgaatcagcatgtgtgcaggctgaatcacagaagttaacttatcttaaagatttaggtgaagatggcgaatataaatacgtggccaaaatcgacaagaaaacatctaaaatatgtcactctttaaatggcaaagtatttaaagttaaagatatgatgcctggagttaatgctccacctatgcacccttggtgtagaagtactacagtaacacatgtgggcaattggcgagatagattctttactgagcgtaaaggtaagtatcagacagagaataaagaatcataa

SEQ ID NO: 1323 - DNA, 1392 bp, Staphylococcus epidermidis
aaaggtaggaaaattatgaaagttgctaagtttggtggaagttctgtatcaactgcagaacaaattaaaaaggtattaactatagtgaatgaagaccctgaacgtaaaatcattatcgtttcagctccaggcaaaaggcataatgacgacattaaaactactgatttattaattcgtctctatgaaaaagtacttaataaattaaattatgaaagtaaaaaacaagaaattatccaaagatatgctgatatagtagaagaattaggtataggaaatgacattttaataacaattaatgacactttagaggaatacattaaacatctttctgacaaacctaaccgtttatatgatgctttattatcttgtggcgaaaattttaatgctcaattaatagcccagtataataatagtcaaggtattcctactcgttatatttctcctaaagaagctggattaactgtaactgatttaccacagcaagctcaaattttagattccgcatataatgaaatatacaaattgcgtgattatgatgaaaagctaattattcctggttttttcggagtttcaaagcaaaattatatcgttacgtttccacgcggtggttctgacataactggtgctatcatagcacgtggcgtccgagcctcactttatgagaacttcactgatgtatcaggaatatataaagctaatccgaatatcataaataatcctgaactcatagaggaaataacttatagagaaatgcgagagctatcttatgcaggatttggagtttttcacgatgaagctctacaacctttatacaaagatcgaattcccgtagttatcaaaaatactaatcgtccaaatgataaagggacctacattttacatgaccgtgaaatcgattctaaaaatgtcattagtggaattagttgtgataaaggctttactgtgattaatattaaaaaatatttaatgaatagattagttggatttacacgaaagattcttggcgttttagaagaatttaatatatcatttgaccacatgccttctggtattgataacataagtattatcatgcgtacaaatcaaattcaaggtaaagaaagtcaagttcttaatgccatacgcaaacgttgtgaagttgatgaattaagtatcgaccatgatttagcagtactaatgattgttggtgaaggtatgaatcaagttgttggtacagctagtaaaattactcacgccctttcagaatcaaacattaatttaataatgattaaccaaggtgcttctgaaatttcaatgatgtttggaattcatgaagcagatgctgaaaaagcagtattatctacgtacgaattttgttacaacggtgtttgtttaaaaaatttgtgtaaataa

SEQ ID NO: 1324 - DNA, 249 bp, Staphylococcus epidermidis
caaagggttgagaaggaatatagcccttcgctcatgacatcattgtttactgaatcgaatccattaactcataaagaacaagttgttttaagagaaataggcaatgggttaagtagcaaagagattgctagcaaattgtatttatcgaacgggactgtgcgtaactatacgagtactattatagacaaaatgaattcagatcatcgttttgaggcatggaaaaaagcaaatgaaaaggggtggatttaa

SEQ ID NO: 1325 - DNA, 636 bp, Staphylococcus epidermidis
tttgattgtgaaagcgcttgctataggggtggtaacatgtttgttaaagaagaaaaaccagtgaataaaatagtcgaaattttaaggaaaacatcatctcatttattcaaatttcacggcgaggtagcgatgcatctatttctgaatgatgattttatattaccatcgaaaatagatatttgtgttgagcgcaaaaagttattggaaattatcagggtgattcctgaagaatttacgattcactattatgataatcagttatatgaaagattaagagaatctttatctttatcagatgttgaacatgttaaagtctttaaaaacgatacagaagtcatgacaatatttgtttatgatgttgtaaatgatgaatggctatttaggttagatcatcatatacgtttaccaaaaaataatatatattttcattctttaagttggaacgtagattatattaagccagaaatagttcttatgtatgatttaatgagtgaacaaaaatatcatcagtttagtaattataaagctgttattgattctcttagttattatcaattctatattttaaaattggtagtaggtgaacagcgtattaaaaaagctatagtaaatagttccactaaaaagatatcttaa

SEQ ID NO: 1326 - DNA, 336 bp, Staphylococcus epidermidis
aatggtatagaggtggataacatggttggacaaacaaatttattcgatgatgttataaagaaagaggaacgctttgttatagttgttcaagcacttgaagaaaaaaatggtaagctcttaaaacggactttgagagaatatccaagcttagagcacacgcaaatgaatgaccttttctctcatcttaaagaagtatttcttgaagaaccttttggggtcaatcaatcagcatatagcattactgtttatacaaacctagattatgccgcagatcaagtatatgcacatgttaaacgctataaaggaaaacatgactggacacatactgcgaaatag

SEQ ID NO: 1327 - DNA, 387 bp, Staphylococcus epidermidis
cgtatgaaagatgcaattcaagaagctgaaaaactagccaagatgaataaagaccaaaagaatcaatatgagttggaaaagctgttaaaagaaaatgaagaactaaaagcagaaaaagctttatctcaaatgaagaatgagactcgttcaatgcttaatgagtcaggtttagaaaacttcgatgatcaaattgttaatatattagtaaatactgatgctgaaaaaacaaggaaaaatgttgaatcatttactaacttacttaatcaaatggtaaaatcaaatgttgaaaaagcattaagacaagactcaccagtaagcactcaatcaaataaaatgacaaaagatgaagaatcagattatcttgtttcagggagaaaatgtctataa

SEQ ID NO: 1328 - DNA, 720 bp, Staphylococcus epidermidis
agattggattgttattgcatttggttggggtttggcagtaacaatgggcgtttatgctgttggacgttttctggtgcacatttaaatccagctgtaacagttgctttagccatggatggtggatttagctgggcgcaagtaccgggctatattgtttgtcaaatgcttggcggtattgttggtggagtttttgtatggttaatgtatttaccacactggaaagttacagaagatccagcagtcaaattaggtgtattttcaacagcaccagccattaaaaattattttgctaactttttaagtgagattatcgggactatggctttaacattaggaattttatttatcggggttaataaaattgctgatggtttaaatccaattattgttggtagtcttatcatagcaattggtttaagcttaggaggtactactggttacgctattaatccagcccgtgacctagcaccacgtattgcacatgctattttgccaattcatggtaaaggtaaatctaactggtcttacgcaattgtacccgttctgggacccatggcaggtggtatgttaggtgcgattgtttacgaagtgttttataaacaaacattcaattttagttgtttcattggtttaattgtacttatattcacacttatacttggcgtgatactaaataagatatctcaaaataaaaacaacgatattgaatcaatttattaa

SEQ ID NO: 1329 - DNA, 1113 bp, Staphylococcus epidermidis
gaaaggagatgtacactaatggaatcaagaagttggggagtgagaataggggaattaagtactttaatatatttaatatttccgattttagctatatttgttgacaaacgtggtaatttcttaacttatttaattgtttgtactatttttataatcagctatgtgacgatgattatattttataaataccttagtgatagtattttatattcattactggttattcattatttaggaatcttttattttgtctatagtgtcaatcctatgaatagtttgtttttcttctatagtgctttcgccttaccttttatttttaatgttcgtgttgtatcaaaagaatttataacctttttaatagctatgataagttgtttaatactaacttatatatttaatccaacatttgtggttccattaagtgcattttatttggttatattaattgttgctgtaggtaattttaaaaatagagacgaacgaattatgaaagctaaacttgaagaaaagaataagtatattaatgtactaatagctcaacaagagcgtaatagaataagtcaagatcttcatgatacattaggacatgtatttgctagtcttactttgaagtctgaattagctgttaaactcatagatactaatcctaaagaagcaaaaaatgaaatgcaggcaataaatcaactttcaacagaagccttaaataaagtcagactcattattgatgatttgaagatacaatcttttgaagatgaaatttcatcattggaacacttattgcaaaatgctaatctacattttaaatttaacaataaaagtgcggctaaatcattaaatccagcgaaacaatcaatattatctatgatttttagagaagcaattaataatgttattaaacatgcgcatgcgactgaagtaataggtgaattgaaggtacatgagcatcaaatcattttaaaaattaaagataatggtgtgggaatagaaaatgaagatgcttcaaatttgaaaagtattaaagaacgtgtagattatttaaatggtaaattaattgtacaatcaaataatggaacacttattattgttgaaatacctagaggtgatttattatga

SEQ ID NO: 1330 - DNA, 900 bp, Staphylococcus epidermidis
cataaatcaagaggtgtgacgataatgattgaactacgacatatatctaaatctttcaaggaacataaagttttagaagatataagtattgatataaaaaataattgttgtacggcattaataggtaaaaatggagcaggtaagtcaacgttaattgatattatcgttggaaataatcactatgatagtggtcaaatcgctgataaatcaaatttgttaaatagacataagatgggtattctttttcaaaaaacagagtttcctaaatacataaaggtttgcgaattattacatttatatcaatccttttatcaaacgtttatttcttttcatcagtttaaagaaatcacacaatttagtgaccgacaaatgaatcagtttgcatgtaatttatcaggtggacagcagaggattttagattttgctttagcattggtaggtaaacctgaactgttaattttagatgagcctacgtcagctatggatgtagaaatgcgtcaacatttttggaatgttatagataaattaaaaatgaataacactacgatactatatacctctcattacattgaagaagttgaaagaatggcagatcaagtaatgatgttagataaaggtaaaatacaattagatgattcacctgaaaatataaaaaggaatcaaagttattctgtaattcgaattccttgcaaatatcaagaacttatcaatcaactgaaacataaatacgaaattgaattaataaaaaatagatatgaaataaaaacaactgatgtgagtgatgttttacaattattgaaacaatatcatgtcaatttcaataagattgaaattcttaaaaaatctttattagaagtcatgttttctaatgatttgtctaaaggagggaattaccagtga

SEQ ID NO: 1331 - DNA, 1104 bp, Staphylococcus epidermidis
tatcaagaaagtttatcctgtagagggagtttaataattatgaaaagatggcaaggattagttaaagaatttaaagaatatttaccagtcaatcaatctacaccagcactaacactcaatgaaggacatacaccacttatttattgtgaaaatctttctcaaaaattagatattgaattatatgttaaatatgaaggagcaaatccgactggctcatttaaagatcgtggtatggttatggctgtaacaaaggcaaaagaacaagggaaaaaagttgttatttgtgcttcaactggtaatacttcagcatcagcagctgcttatgctgcaagagctggtttaaaagcaattgtcgtaattcctgaaggtaaaatagcattaggtaaattatcacaagcagttatgtatggtgcagaaattgtttctatagaaggaaacttcgatgaagcactagaaattgtaaaagagattgctgaagaaaatgatgaaattgaattagttaattctgttaatccatttaggattgaaggacaaaagacgggtgcctttgaaattgttgaacagttagatggtcaagcccctgacattttagcaataccagtgggaaatgcaggtaatataactgcttattggcaaggatttgttgaatatcataataaaaagaatacacaattaccacaaatgtttggcttccaagcagaaggagcatctccaattgttcaaaataaaataatcaaaaatccagaaacaatagctacagctatccgaatagggaatcctgctagttggcaaaaagctgttaatgcactagatgaatcaaatggtttaattgatagtgtgatagatgaagaaattttagaagcttatcagttaatgacaacaaatgaaggtgtttttagtgaaccagcgagtaatgcttcaattgcaggtctaatcaaacttcatcgctctggtaagttacctaaaggtaaaaagatagttgcaatattaactgggaatggacttaaagatcctgacacagctatttctctcttagataatcctattcaacctttacctaataataaagaaagtataattagatacatcaaaggggcaatctag

SEQ ID NO: 1332 - DNA, 831 bp, Staphylococcus epidermidis
ctcttgaaaggagttctatactatatgactcagtataaaatggtagttttagatatggatgatactttaatgaatagtgataataaattatccattgagacaaaatcttacttattagatattcaaaagcgtggttattatgtggtattggcctcaggtagaccaacagaaggtatgttacctactgcgagagaattagagttaaataaatataacagcttcattattagttataatggaggtaaaactataaatatggctaatgaaaatgtagaggtcgatcagcctgtttcaaaggaagatttcgataatattgtagattattgtagagataagaactttttagtacttacttatgataatggatatatcattcacgatagtagtcatgaatatatgaacatagaatcacaacttaccggattaccaatgaatcgtgttgctgatttgaaggaatatattaatcatagtgtacccaaagttatgggtgtggattatgtaggtcatattaccgaagcacgtattgaattggatggttacttcaataatgatattgatgtgacaacgagtaagccttttttcctagagtttatggcaaagaatgtttcgaaggggaacgcaataaaagcactttgtaaaagattacaaatttctctagaagaagttatagtattcggggacagtttgaatgataagtcaatgtttgaagttgctggatattctgtagcaatgggaaatgctagtgatgaactcaagaaaattgctgacgaggtaactttagataataattctaacggtattccttatgctttaaaagaacttttggtttaa

SEQ ID NO: 1333 - DNA, 1515 bp, Staphylococcus epidermidis
aggagtcatatacctatggaaaaatatattttatcaattgatcaaggaactacgagttcacgtgcgatactttttaataaagaaggagaaattaaaggtgtttctcaaagagaatttaaacaacactttccacatccaggctgggtagaacatgatgctaatgaaatatggacatctgttctatcagttatggctgagttacttaatgaaaacaatattaatgcaaatcaaattgaaggtattggtattacaaaccaacgtgaaacgacagttgtatgggataaaaatacaggtcgtccaatctatcacgctatcgtttggcaatcacgtcagacacaagatatttgtacaaatttaaaggaacagggttatgaagaaacatttagagaaaaaacaggtttacttttagacccgtactttgcgggaactaaagtaaaatggattcttgatcatgttgaaggtgctagagaaaaagctgaaaatggtgatttactcttcggaacaatcgattcatggttagtatggaaattgtcaggacgtactgctcatattacagattacactaatgcaagtcgtacattaatgtttaatatttatgacctaaaatgggatgatgagttgttagaacttttaaatattcctaaacaaatgttacctgaagttaaagaatcaagtgaaatttacgggaaaactatcgactatcacttctttggtcaagaagtacctattgctggtattgccggtgaccaacaagcagcattatttggtcaagcatgttttgaccgtggtgatgtaaaaaatacatacggcacaggtggatttatgctaatgaatactggtgaagaagcagttaagtcagaaagtggcttgttaacaaccattgcatacggtttagatggaaaagttaattatgcacttgaaggttcaattttcgtatctggttctgctatccaatggctacgagatggtttgagaatgattaattctgcgccacaaaccgaaaactatgcttcaagagtagagtcaactgagggtgtttatatggttccagcatttgttggtttaggtacaccttattgggattcagaagcaagaggtgctattttcggattatctcgtggtacggaaaaagaacatttcattcgtgctacattagaatctttgtgctatcaaacaagagatgttatggaagctatgtctaaggactcaggtattgaagttcaaaatttacgcgttgatggtggtgctgtaaaaaataacttcattatgcagttccaagcagatatcgtaaattcatctgttgaaagacctgaaatccaagaaacaacagcacttggtgctgcatatttagctggattagctgttggattctgggatgataaagaggatatccgtgaacgttggaaacttcaaactgagttcaaaccagaaatggatgcagatcaacgtcataaactttatagtggttggaaaaaagctgttaaggcgactcaagtatttaaattagaagattaa

SEQ ID NO: 1334 - DNA, 582 bp, Staphylococcus epidermidis
atgactgaaatgacaaagccttttttaatcgttattgtaggtccaactgcttcaggtaaaactgagttaagtattgaagttgctaaaaaatttaatggagaaattattagcggagattcaatgcaggtctatcaaggaatggatattggtacagcaaaagttacaactgaagaaatggaaggtataccacattatatgatagatattttgcctccagatgcttccttttctgcatatgaatttaaaaaaagggcagaaaaatatattaaagatattactagaagaggcaaggtgcctattatagcaggaggaacaggactatatatacaatctctcttatacaactatgcttttgaagatgaatccatatctgaagataaaatgaaacaagttaaattaaagttaaaagaacttgagcatctaaataataataagctccacgaatatttagcttcattcgacaaagaatcagccaaggatatacatcctaataacagaaaaagagtgttgcgagcaatagaatattatttgaaaacaaaaaaacttttaagtttctcgcaagaaagtgcaccaatttactga

SEQ ID NO: 1335 - DNA, 372 bp, Staphylococcus epidermidis
tttattatgatatcgcttgttataactgaggatcaattgatgttaagaaaagctatggtacaactgatagaaatgcatgaagaaatgaatgtaataaaagattttgaaaatggtgtagaggcactcgaatttattgaaaataatgaacccaatgtagccattttagatattgaaattccgggtttaacaggcttggaaatcttatcttatgtaagaaaaaaacaactcaatacaagaataatcatagtgactacatttaaacgtccaggttattttgaaaaagccgtagcaaatgatgttgatgcttatgtactaaaagagcgttcaattgatgatttaattaaaactatttataaagtgacaaagggttga

SEQ ID NO: 1336 - DNA, 1359 bp, Staphylococcus epidermidis
aattggaggatttataccatgccaaaacgtagttttacaaaagatgatattcgtaaatttgctgaagaagaaaacgtaagatatttaagattacaattcactgatattttagggactattaaaaatgttgaagttccagtaagtcaattagaaaaagtattagataatgaaatgatgtttgatggttcatctattgaaggtttcgttcgtatcgaagaatcagatatgtatttacatcctgatttagatacttgggttatcttcccttggactgctggacaaggaaaagttgcacgactaatctgtgatgtatttaaaacagatggtacaccatttgaaggtgatccacgagctaacttgaagcgtgtattaagaagaatggaagatatgggctttactgattttaatctagggcctgaaccagaatttttcttatttaaattagacgaaaaaggcgaacctacattagaattaaacgatgatggtggttatttcgatttagctcctacagatttaggtgaaaattgtcgccgtgacatcgttttagaattagaagatatgggctttgacattgaagcaagccaccatgaagtagcgccaggtcaacatgaaattgactttaaatatgcagatgccgttacagcatgtgataatatccaaacatttaaactagttgttaaaacaattgcacgtaagcataatttacatgcaacatttatgccaaaaccattatttggtgtaaacggtagtggtatgcacttcaacgtatcactatttaaaggaaaagagaatgcgttctttgatcctgaaggtgatttacaattgactgatactgcatatcaatttacagctggtgtccttaaaaacgctagaggattcactgcagtatgtaatccaattgtcaactcatataaacgtcttgtaccaggttacgaagcaccatgttatattgcatggagtggtaaaaaccgttcacctttagtacgtgttccaacatctagaggtctatcaactcgtattgaagtacgctcagttgaccctgcagctaacccgtacatggcattagcagcaatcttagaagcagggttagatggaattgagaataaacttgaggttccagaacctgtaaaccaaaatatctacgaaatgaatcgtgaagaacgagaagcggttggtatccaagacttaccttcaactttatacactgcgttaaaagcaatgcgtgaaaataaatcaattaaaaacgcattaggtaatcatatttacaatcaatttattaactcaaaatcgattgaatgggattactatagaactcaagtatccgaatgggaaagagaacagtatattaagcaatactaa

SEQ ID NO: 1337 - DNA, 357 bp, Staphylococcus epidermidis
ggactttttgtggcaactggaagtgtcatttttcaagctggcccaggaggagctatattagcttatatactaattggtattatgctttattttttaatgtcatcaataggagaattagcaactttctatccggtttctggttcttttagttcatactctaccagatttgttgattcgtcacttggttttacaatgggttggttgtattggggtatgtggtcacttgtaacaagtgtagatatcattgttgcttccaatgtattacaatattgggatgtatttaaagttttaaatccacttacatggagcttaattttcttcactctgttgtttttaattcatatttttttctgttaa

SEQ ID NO: 1338 - DNA, 1035 bp, Staphylococcus epidermidis
ttcatatttttttctgttaaagcttttggagaaactgagttttggttatcactgatcaaagtcattactataattgtatttattatttttggaattatgatgattttcggtattcttggtggtcatacatatggctttgagaattatactaaaggtcaagcaccttttgtcggtggaatatcaggcatattaagcgttcttttagttgcaggtttttcagttggtggtactgaagtagtcgcagtaacagctggtgaatcaaataatcccgaaaaatcaatgcctaaagctataaaacaggtattttggagaatattactcttttacgtattgtctatagctgtgatagctgccatcattccatatacggatccacttttacttaatgaaaatgagtctgtatcacaaagtccgtttacaattgttttcgatagaatagggatcgcttttgctgcatcagtcatcaacgctgttatcttaacatcattattatcagcagctaactctggtatttatacaacaagtagaatgctattttctttaagtgctgataaacaagcacctaaattctttggaaaactcaatgataaaactaaattacctatgcgtgcattaattacaacatatattattattgtattagtcattgtttatgctaattttaatgctaatgctgtatttaacttattaaatatcataggatctatggttattgtagtttggggatctagtatttggtcacaaattagattaagacaagcaattaaaaaacagggtaaaaatccagataaactgttgccatataaagcacctttttacccagtcggacctattattgtccttttcacattattattcttattattaggtagttcctttggtagtatcgcatctggtgatattttaggtgtcatacgaaactttacaccattatttattctagctatcatctatattgctcataaattaatcaaacggacacattttgtcaaactggaagaaatagatttaactccgcataattacaagaattaa

SEQ ID NO: 1339 - DNA, 1485 bp, Staphylococcus epidermidis
gagtatttagtaatgaattttggatttttgggtactattttaactatattgttagtagttgggtttataactaacgtagtattggcatttgtcatcattttccttgaacgtgatcgacgtactgccagttcaacttgggcgtggttattcgtattattcgttcttcctgtcattggatttattttgtatctatttttaggacgaacggtttccaagaaaaagatggaaaaaaataacggtgatgaattacatgcatttgaagatttagttcaagaccaaatcgacagttttgataaacataattatggttatatcaatgatcaagtcattaaacaccgtgatttaatacgtatgttgttaatgaaacaagatgcctttttaacagaaaataataaaatcgatttatttacagatggtcataagctttatgaaaaagtacttgaggatatttacaatgctcaagactatatacatctagagtactatacctttgaacttgatggattaggtaaaagaatcttagatgcacttgaaactaaacttaaagaaggtttagaagttaaacttttgtatgacgatgttggttctaaaaaggttagattatcaaaatttaaacatttcagagcattaggtggagaagttgaagcatttttcccttcgaaagtacctttaatcaatttcagaatgaataatcgaaatcatagaaagattatcattatagatggacaaattggttacgttggcggttttaatgtcggcgatgattatttaggattaggtaagttaggttactggagagatacacatacacgtgttcaaggtgaatgcatcgatgcactacaattaagatttattttagactggaattcacagtcgcatcgtccacaatttaaatttgatcaaaaatatttccctaaaaaaaatggggacaaaggaaacgcggctattcaaatcgcttctagtggacctgcatttgatttacatcaaatagaatatggttatacaaaaatgataatgagcgctaaaaagtctatctatctacaaagcccttactttattccagaccaatcatacattaatgcattaaaaatggctgctaatagcggcgttgaagtaaaccttatgataccgtgtaaacctgatcatccattcgtttattgggctacattttcaaatgcagctgatttattggatagcggagttaatatttacacttatcaaaatggatttattcattctaaaatattaatgattgatgatgaaatttcttcaattggtagtgcaaacatggactttagaagctttgaactgaatttcgaagtgaatgcatttatatatgatgaagatatagctaaacagttacgtcaagcatttgaaaaagatattgagcaatctaaattacttacaaaagaagtatacgacaagcgtccattatcaattaaatttaaagaaggactagcaaaattaatatctccaattttataa

SEQ ID NO: 1340 - DNA, 258 bp, Staphylococcus epidermidis
ataaaaggagttctaaccatgattgcaaacgaaaacatccaagaccaagcactagagaactttaaatcggaaaaaactgaagtcacaattttctttttaaatggctttcaaatgaaaggtgtcgttgaaaattatgacaaatatgttgtaagtttaaattctcagggtaagcaacatctgatttacaaacatgcgatcagcactttcactgtagataatgaatcgtctgaagcaactgaagtgaatagtgaagaataa

SEQ ID NO: 1341 - DNA, 1677 bp, Staphylococcus epidermidis
ataatgtcattatctacattgaaaagggatcatattaaaaagaatttaagagacactgaatacgatgttgttatcgtaggtggcggtattacaggtgcaggtattgctttagatgcaagtaatcgtgggatgaaggtagctttagtagagatgcaagactttgcacaaggtacaagttcacgctcaactaaacttgtacacggtggtttaagatatttaaaacaactgcaagtaggggtagttgcagaaacaggtaaagaacgtgctattgtttatgaaaatggtccacatgtgacaacaccagaatggatgcttttacctatgcataaaggtggtacatttggtaaattctcaacttctattggactagctatgtacgatcgtctagctggtgtcaaaaagtccgaacgtaaaaaaatgttatctaagcaagaaacgttaaataaagaacctttagttaaacgtgatggattaaaaggcggtggctactatgtggaataccgcactgatgatgcgcgtttaactattgaagttatgaaaaaagctgctgaaaatggagcagaaatcattaattatacaaaatcagaacacttcacttatgattccaataagaaagtaaatggtattgaagtattggatatgattgatggcgaaacgtatgcgattaaagctaaaaaagttattaatgcttctggtccttgggttgatgaagtgagaagtggcgattatgcacgtaacaataagcaattaagattaactaaaggtgtacacgttgttatagatcaatctaaattcccattaggtcaagcagtttactttgatactgaaaaagacggacgcatgatttttgcgattccacgtgaaggaaaagcttatgtaggaacaactgacacgttttatgataatgaaaaagcaacacctttaacaacacaagaagatagagactacttaattaatgcaattaactatatgttcccaacagttaatgttaaagatgaagatattgaatcaacatgggctggtattcgtccgctaattcttgaaaaaggtaaagatccttctgaaatctcacgtaaagatgaagtttgggaaggtgaatctggattattaactatagcaggcggtaaattaactggttatcgtcatatggcactagaaattgttgatttattagctaaacgtttaaaacaagaatacggattgaaatttgaatcatgtgccacaaaaaatctaaaaatttccggtggtgacgttggcggaagcaaaaactttgaacactttgttgaacaaaaagttgatgcagctaaaggatttggaattgatgaagatgtggcacgtcgcttagcaagtaaatatggttcaaatgttgatcaactatttaatattgctcaaacggcaccatatcatgatagtaaattaccattagaaatttatgttgaattagtttatagtattcaacaagaaatggtttacaaaccaactgacttcttagtacgtcgttctggcaaattatactttaatattcaagatgtgttagattataaaaatgctgtgatagatgttatggcggatatgcttaattatagtgaaactcaaaaagaagcttatactgaagaagtagaagttgcgattgatgaggcacgtacaggtaatgatcaacctgcaactaaagcttaa

SEQ ID NO: 1342 - DNA, 417 bp, Staphylococcus epidermidis
actaaatcttcaaatgcatgtaattcatcaccgttatttttttccatctttttcttggaaaccgttcgtcctaaaaatagatacaaaataaatccaatgacaggaagaacgaataatacgaataaccacgcccaagttgaactggcagtacgtcgatcacgttcaaggaaaatgatgacaaatgccaatactacgttagttataaacccaactactaacaatatagttaaaatagtacccaaaaatccaaaattcattactaaatactcctattcagtctttcaccaagaaaatttagccgccgatttactgaactatgcttccgttaccaatgttaaaatagcattaaagtcctcgtcattatgcggaaatgcacgttcttcgatttgtttaatagtaatgtttaataatttgtaa

SEQ ID NO: 1343 - DNA, 747 bp, Staphylococcus epidermidis
aggagggaattaccagtgatatcaacttattttaaaatagaattaaagattatatttagaaagaaattgtatttagttatgtccatattcctacctgtcgtgttttatttattatttacttctatattagacatgccagaagaagcaaaacttaagttttataaagagtatatgtacagtatgacagtatttagtttaatgaacttttgtctattgtcatttccattagatttgattgaagagcgaaatcaaggttggtataagcggttaatggtgaccccattatcatcatttcaatattatttagttaaaattagtaagacaatgtgtcagtttttaatagcaattacaattattttttcagtagctcatttttacaaagatgttcacatgactgtttttcaatggatattctctgcattaactttatggattggggttagtttatttttgactttaggattgattatcgctcaactcaacgatattcaaaaagcaagtagttttgccaatttacttaatattacactagctatattaggaggtctatggtttccagtatacacgtttcctgattggcttcagtcgatttctaaacacatgccaacatataatttaaagctacttgctatagatttagcgcaaaataaaggggtgaatatagaagcgtttggctatctcgtggtctattgtataatctttgtgagtattgctttattcatgaataagaaaggagatgtacactaa

SEQ ID NO: 1344 - DNA, 510 bp, Staphylococcus epidermidis
agtattatatctaaatctgacataaatttctattattgtattaataaaaaaatttggagaagtgatattatgaaaacttttaaggcagtaagatttcaaattgtgaatgaacatggtgcaatatcagaatacgtcattgaagatggtgtgattataaataaagaaggaagtggcactgggtggttactagaaatagtaatttcaaatgaacactatgaaacatttaagcaatataaggataacaaacaacttttagatattagagtagtcatcacaagacctgctaacgatccagcgttatttaatgcaacagttaaaagcgttaaaaattttaaatattcaatgtcagtcgttttagaatgtcacatctacactttgagacaagaatacgctgagagtttattagaagaattagttgatgaaggacttacaggtgaaaagttgaaaaaaacatttaatcgtatgatgcaatcaaaacctaagttgaaagatgagaaaatcgaaagataa

SEQ ID NO: 1345 - DNA, 693 bp, Staphylococcus epidermidis
gaaaacaaatcacttttaggaggatttttaataatgaaaaaaacattagttgcatcatcattagctataggactaggcgttgtagcaggtaacgcaggtcatgacgcacatgcaagtgagactacaaatgttgataaagcagagttagctcaaaaagcgttaactaatgatcaatcactaaatgaaagccctgttcaagaaggtgcttataatattaattttgattacaatggtaattcatatcattttgaatctgatggttctacttggagttggagttatgaatcaacaaacaatgctacgcaacctgttcaaccaagccaatctcaagtagctacacaacaacaacctgtacaagtatcagcaccacaaaatgagcaaacagcacaaccacaaacaaaatcaacatctacaagtcaaacttcttcaagtaaagcttcaagtggttcatcagtaaatgtaaattcacatttacaacaaattgctcaacgtgaatcaggtggcgatattcatgcaataaacccatcttcaggtgcagcaggtaaatatcaattcttacaatcaacttgggattctgttgctccaagtcaatataaaggtgtttcacctgcaaaagctccagaaagcgtacaagaccgagcagcagtaaaattatataatactggtggcccaggtcattgggtaactgcataa

SEQ ID NO: 1346 - DNA, 426 bp, Staphylococcus epidermidis
ggtgatttcccacccaattcaagagacacttttttgaagtcttttgcagctttttccataatttttgaacctgtaggaccagaacctgtaaatgacatcattcttacttttggatgttcacttaaaggatttcctactccagatccatcaccattgactaagttaaacacacctttaggtacgcctactttatcaaaaatttctgctaaaataattgcagcaaatggtgtttcttcagatggttttaaaacaacagggctaccagcagcaaacgcagcagctaatttaagtgaagtttggtttgtagggaaattccaaggtgtaacaagtccagcaactccaattgcttctttaacaaccaaatcatcgccacgttgttcttcaaattggaagctatctaaagcatctcttgcagctgtaaaatga

SEQ ID NO: 1347 - DNA, 300 bp, Staphylococcus epidermidis; identical to SEQ ID NO: 233

SEQ ID NO: 1348 - DNA, 714 bp, Staphylococcus epidermidis
ttttattttttgaggaggctaattatgacattttcaaaagagttgagggaagcatcaagacctattattgatgacatttacaatgatggttttattcaagatttactagcaggtaagttatctaatcaagctgtaagacaatacttaagagcagacgcttcttatttaaaagagtttacaaatatttatgcaatgctcatacccaaaatgagttctatggaagatgttaaatttctagtagaacaaattgagtttatgttagaaggagaagttgaagcgcatgaggttctagctgatttcattaatgaaccatatgaagaaatagtaaaagaaaaagtatggccaccaagtggtgatcattatattaaacatatgtacttcaatgcatttgcacgtgaaaatgcagccttcacgattgcagcgatggcaccctgtccatacgtctacgctgtcattggtaaacgtgcgatggaagatcccaaattaaataaagaatcagtgacttctaaatggtttcaattttatagtactgaaatggacgaacttgttgatgtgttcgatcaattgatggaccgtttaactaaacattgtagtgagacagaaaaaaaagagattaaagaaaatttcttgcaaagtactattcatgagagacatttcttcaatatggcatatattaatgaaaaatgggaatatgggggaaataacaatgaataa

SEQ ID NO: 1349 - DNA, 672 bp, Staphylococcus epidermidis
aggaggacgtttgaaatgagtattttagttattggagcaaatggaggcgtaggttctaaactagtaagtcaattaaatgaagaacacgttgattttacagctggtgtacgtaaggaagatcaagttaaagaattagaaaataaagggattaaagctacattaatagatgtagaaaaaaatagtattaatgatttaaaaaatatctttacagattatgataaagttatcttttcagttggatctggtggaagcactggagcggataaaacaatcattgttgatttagatggtgctgtaaaaacaattaaagctagtaaagaagcgggtatcaaacattatgttatggtatcaacatacgattctagacgtgaagcattcgatgcgagtggagatttaaaaccgtatacaattgcaaagcattatgctgatgattacttaagaacatcagatcttaattatacaattgtacatccaggttcacttacagatgatgctggaactggaaaaatagaagctgatttatatttcgacaaagcaggatcaattccacgtgaagatgttgctacagttttaaaagaagtagtaacttctgatggttttaataatcaagaattccaaattttaagtggcaatcatggtgttaaagatgcattgaaaaactatgaatcttaa

SEQ ID NO: 1350 - DNA, 1215 bp, Staphylococcus epidermidis
tacgcaaagtttcaaagggagttagatacaatgcataataaacaaaagatattagattttatagaaaataataaatatgattatgtagaaataagtcatcgtattcatgaacgccctgaattaggcaatgaagaaatttttgcatcgagaacattaattgaccaattaagagcaaatcgattcgaaatcgaaacggatattgcaggacatgcaacaggatttatagcaacgtatgattctgatatgactggaccggttataggatttctagctgaatatgatgctttacctggtcttggtcacgcatgcgggcataatattattggtactgctagcgtacttgctgcagtagcactaaaagaagtcgtcgatgaaattggtggtaaagtagtcgttttgggatgtcctgctgaagaaggtggggaaaatggctccgcaaaagcttcttatgttaaagcaggtgtcattgatgaaattgatgtagcattgatgattcatcctggaaatgaaacctatcgtacaattaatactttagctgtggatgttctagatattaaattctatggacgtagtgcgcatgcatctgaaaatgcagatgaagcattaaacgctttagatgcaatgatttcatattttaatggtatagcacagttaaggcaacacattaaaaaaggacaacgagttcacggggttattttagacggtggtaaagcggctaatattatacctgattttacacatgcgagattttatactcgagctacttcacggaaagaacttgatgttttaactgaaaaagtaaaccaaattgcaagaggtgctgcgattcaaactgggtgtgattttgaatttggtcctatccagaatggtgtaaacgaatttatcaaagcgcctaaacttgatgatttatttgaaaaatatgcaactgaattaggagaagaagtgattgatgatgattttggttatggatctacagatacaggtaatgtaagtcatgttgtaccaactatacatccacatattaaaattggttctcgaaatcttgtaggacatacccaccgctttagagaagcggctgcaagtttacaaggtgatcaggcactcattcgaggtgcaaaaattttagcattaatgggactagaattaatcgaaaataaaccgttgttagacgaaataattgaagagcatacgcatataaaggggcatgttaagtaa

SEQ ID NO: 1351 - DNA, 1194 bp, Staphylococcus epidermidis
atgatgactacaccgttcaaaagaattcatctaatagttatggactcagtaggtataggcgaaggtcctgatgcagcggcattcaatgacgaaggatcacacactttaaagcatactttagaaggatttaagcaaaagttaccacatctagaacaacttggattaggaaatattgcaccgcttcctgttgtttcaaaagttacacatccaggtgcattttataccaaactaagtgaagcttcagtaggtaaggatacaatgactggacattgggaaattatggggttaaatataatgcaaccatttaaggtttatccaaatggtttcccagaagagcttgttaaagagattgaagatatgactggacgaaaggttgtagcaaatagacctgcttcaggaactcagattattgacgagtggggcgaacatcaaatgaaaactggagatttaatagtttatactagtgctgatccagtcttacaaattgctgcacatgaagacgtgattccacttgaagaactttacgagatttgtgaaaaagttcgtgaactaacaaaagatcctaaatatttaatagggagaatcattgctcgaccatatgttggtgaacctggtaacttcactagaacttctaatcgacatgattacgcgttaaaaccatttggacgaacagtgatgaatagccttaaagatagtggttatgatgtaatcgcgattggtaaaattaacgatatttatgacggtgaaggcgtgacagaagctatacgtactaaaaataatatggacggtatggatcaattgattgaagttgtaaaaaaagattttgaaggtatcagtttccttaatttagttgattttgatgcattgtatggccatcgtcgtgataaagaagggtatgctcaagcaattaaagattttgatcttcgtttacctgaattaatgaatcatttaagagaagatgatttagttattattacagctgatcatggtaatgatccaattgctaaaggtacagatcatacacgtgaatacattccacttttaatgtttagtccgaaaattaaagattatcatgaactttcacaagacacgacatttagctctatcggtgttacaatagcagataacttcaacgtagaattacctaaatatggaaaaagttatttaaaagaaatgggggttgagcatcaatga

SEQ ID NO: 1352 - DNA, 912 bp, Staphylococcus epidermidis
attatgtggttttgctttttgaaatccggatttataataattaaacaaattttaagcactccttttttttcatataaatacaatatcaaaattctaataaattttaaattaatatctaacataatagagcacaaaatgttagaatatgctaataagataacattgaagggagataatatcatgaaatttgctgttatcactgatattcatggaaactttgatgcgcttcaaactgttttagatgatattgatagtagagatgatatcgaaaaaatttataacctaggtgataacatagggattggacatgagacaaataaagtactggatactatatttgaccgggatgatatggaaatgattgcaggtaatcatgatgaagctattatgtcactcgtcaatggaacaccttatcctgaagatttaaaagggaaattttatgagcatcatcaatggatagaaggacatttagatgagtcctattacgatgaaattaatcaattgcctagatatattgaaatgaccataaaagggaaaaagattttatttattcattatgaaattgaaaatgataaaatgtcagctcctattgatgaacaaccttttgcacctattacaaaagatgacgaacaagctatttctgaattatttaaagacaaagaagccgatttaattttatttggacataaccataggttgcatatgtttgatgataaatcaacagtatattttaatcctggatcagtaggtttgaacaatggttcaaacaccgtatatggtattattaccgttaatgaaaaaggaatttcagtagagagagtgaaattagcgtacaataatgaagaatttttagcaggatttgaagaaaagcaagtaccagctagagaatttatatttaagaatttcatttaa

SEQ ID NO: 1353 - DNA, 1029 bp, Staphylococcus epidermidis
atgatatacacgtttcaactttacttaaacaagccattcaccactccaaacatcctagtgaaggtggaatttctaatgacaaatcataatcatcaacatcatcattctcatgcacacggacacgttcatacagataataaaaaggtactcatgttttctttcattatcattagtctcttcatgcttgtagaaattataggtgggtttttagcaaatagtctagcattattgtctgatggttttcacatgctaagtgacgctatatccttaggagtagctcttatagcttttatatatgctgaaaagcatgctacaaaaagtaaaacatatggttacaagcgttttgagattttagcagcacttttcaatggagttaccctatttatcatcagtattattataataatcgaagcgatacgaagatttttagaacctcctgaggttcaatcgaaggaaatgttcatcattagtgtgattggtcttatggtaaatatcattgtagcgatacttatgtttaaaggaggagatacctctcacaaccttaatatgagaggcgcatttttacatgtacttggagacttgttcggctctgttggcgcaatcgttgcttctcttttaatttggggctttaattttacaatagcggatcctatagctagtattttagtttcgttaattattttaaaaagtgcttacggcatttctaaatcatcccttaacatattgatggaaggaacgcctaatgatatagatttaaatgctgtaattaaagcaattagtaaagatgaaagaattcaaaatgtacatgattgtcatgtatggaccatttcaaatgatatgaatgcattaagttgtcatgcagttgtaccagaatatttatcagttcaaacgtgtgaaacaatgttaaagtcaatcgaaagtgacctattgcaattaaatattcagcatatgacaatacaacttgaaacaccagaacacaaacacgatgaatcaacattgtgctcaggtatacatgaacactctcattag

SEQ ID NO: 1354 - DNA, 1686 bp, Staphylococcus epidermidis
atacataggttactcacagtttttaatagattttatcaatcattaaatagtttactaaattttacaggaggtcagacaatgacaaagtttatttttgtaacaggcggggttgtgtcatcattaggaaaaggaataacagccgcttctctaggaagattacttaaagatagaggacttaaagttacaatacaaaaattcgatccatatttaaatgtagacccaggcacaatgagtccgtatcaacatggtgaagtgttcgttacagacgatggtgctgagactgatttagacttaggacattatgaacgttttatagatattaatttaaataaatattcaaatgttactgccggaaaagtatattcacatgtgttgaaaaaagaacgccgtggtgattacttgggtggtactgtacaagttattccccatattacaaacgaaattaaagaaagattgctattagctggtgagagtactaatgcggatgttgtaattactgaaattggtggaacaacaggtgatatagagtctttacctttcttggaagccattcgtcaaattagaagcgacttaggtcgtgaaaatgtaatgtatgtacattgtactttgctaccatatattaaagctgctggggaaatgaaaacaaaacctacacagcacagtgttaaagaattacgaggtctaggtattcaacctgatttaatagtagtacgtacagaatacgaaatgacacaagatttgaaagacaaaatcgccctattttgtgatatcaaaaaggaaagtgttatagaatgtagagatgcagattctctttatgaaattccgttacaacttagtaagcaaaatatggacgacattgttattcaacgtttacaattaaatgccaagtatgaaacgcaattggatgagtggaaacatctattaaataccgttaataatttagatggtaaaattacaatcggtttagttggtaaatatgtgagcttacaagatgcttatctatcagttgttgaatcacttaagcatgctggttatccatttaaaaaagacgttgtggtaaaatggattgattcaagtgaggtcaatgatgataatgttgaggcttatttatccgacgttgatggtattttagttcctggtggatttggattcagagcaagtgaaggtaaaattgcagctattcgttatgcccgtgagaataacataccattctttggcatttgtctaggaatgcaattggcaactgttgaatttgcgcgtcatgttttaggctatgaaggtgcgcattcagcagaattagatccaagtacaccatatccaattatagatttattaccagaacaaaaagatattgaagatttaggtggaaccttaagacttggtctttatccttgccacattaaagaaggtacattggcagagaaaatttataataaaaacgatattgaagaacgtcatcgtcatagatatgaattcaataacgagtttagggaacaattagaaagtaacggtatggtattttcaggtacaagtccagatggtcgtttagtagaaattattgaaatacctaaaaatgatttctttattgcatgtcaattccatcctgaattcttatcaagacctaatcgtccacagcctatatttaaatcatttgtagaagcggcgttgaattaccaacaaaaataa

SEQ ID NO: 1355 - DNA, 294 bp, Staphylococcus epidermidis
gggagcttgactgcgagacctacaagtcgagcagggtcgaaagacggacttagtgatccggtggttccgcatggaagggccatcgctcaacggataaaagctaccccggggataacaggcttatctcccccaagagttcacatcgacggggaggtttggcacctcgatgtcggctcatcgcatcctggggctgtagttggtcccaagggttgggctgttcgcccattaaagcggtacgcgagctgggttcagaacgtcgtgagacagttcggtccctatccgtcgtgggcgtag

SEQ ID NO: 1356 - DNA, 786 bp, Staphylococcus epidermidis
tcatattgcgccctctactacaaagggagtaaaaatttaatagaaagaggtgagtttatggatcacaaatccccactcgttagttggaacgtctttggtttcgatattgtttttaatttggccagtgttttaatggtagtgattacagcaattttagtttttattttagctatagtttgcactcgaaacttaaagaaacgaccaactggaaaacaaaacttcattgaatgggtatttgattttgttagaggtattattgaaagtaatatggcctggaaaaaaggtgggaatttccacttcttagcagtgacattaattcttttcatttttgtggccaacatgcttggtttaccgttcgcaattgtcactcatgaccatacgctatggtggaaatcaccaacagcagacgctacggtaactctaacgttatctacaactatgattttgttaacgcactattacggtattaaaatgcgtggaacaaaagcttatgcagctggatattttaaacctttctggccattagctattattaatgtattcgaagaattcacttctacattaactttaggtctacgtttgtacggtaatatttttgcaggtgaattattactcggtttacttgcatcattgttctttgaacaacctgcatggggttggataattagtattcctggattaattgtttggcaagcgttctctatattcgtgggaacaattcaagcatatatctttgtaatgctttcaatggtttacatgtcacataaagtggcagacggacattaa

SEQ ID NO: 1357 - DNA, 636 bp, Staphylococcus epidermidis
ttaagcgattatgttttgaaaaaggtggaactatcaatgtatgaaacgtaccattcaggttggattgaaaccataacaggaagtatgtttagtgggaaatctgaagaacttatacgtcgcttaagacgtggaatatacgctaaacaaaaggtggttgttttcaaaccagcaattgatgatcgttaccataaagaaaaggtcgtctcacataatggtaatgagatagaagcgattaatatatctacagctcaagaaattttaaatcatatgctagaagaagtaaacgtcatcggaattgacgaagtgcaattttttgaagacgatattgtcaacatagttgaaaaattagctgaaaacgggcatcgtgttattgtagcaggtttagatatggattttagaggagaaccgtttaaacctatgcccaagttgctcgcagttagtgaacatattacaaagttgcaagcagtatgttctgtatgtggttcaccttcgagtcgtacacaacggttaataaatggtgaaccggcgaaagtagatgatcccatcatattggttggtgcaaatgaaagttacgagccacgttgtagagcacatcatatagttgcacctagtgaaaatgagaaggaggaaatgtag

SEQ ID NO: 1358 - DNA, 573 bp, Staphylococcus epidermidis
caagtttgctatgttccttttttattttatacaaaggggtgggttcaaatgcgtgatttacaacaactgcttgatgaattgaaagatatgtcattctttaatccaggcgaaatgtgtatcattggttgttcaacttccgaagttataggtaaacgtattggttctgttggatcaatggacgtagctaaagaaatttacgaaaatttgaaacaactagagattgatacaggcgtgacatttgcttttcaaggatgtgaacatattaacagggcagtaacgatagaaagagcaaatttcaacccattgactatggaagaagttactgtcgttccagacgttcatgcaggtggtagtttatccacttacgcttatcaacaaatggaagatcctattgttgttgagcatattactgtttcaaaaggtatagatataggtcagaccttaattggaatgcatattaaacatgtgtgtgttcctgtaagaacaagtgttaaacaaattggagaagctatcgttaccatagcgacatctagacctaagaaaattggtggcgaacgagctaaatatcaataa

SEQ ID NO: 1359 - DNA, 207 bp, Staphylococcus epidermidis
tctgtgcgatattctttaaataagttttactattttgttatcacaatacgaattattttacctaaagagtttaattatctaagattaagcatcttgaatagcaaaagtaagttcacagctacaagcaagttggccatcaacagtcgctttagccgaacccttaccaataggaccttttattttagttatttcaacttccaacattaa

SEQ ID NO: 1360 - DNA, 375 bp, Staphylococcus epidermidis
acaaatattcatatgttggagtgtgaattttcaatgagtggatatcatattaacgttgaaagcaatcaggatacattgattaaagtcactcatattttcaaagctttaagtgattttaatcgtgtgagaataatggagtttcttgaaaacggtgaagcaagtgttggacatatttcacattctttaaatatgactcaatcaaatgtatcacatcaattgaaactacttaaaagcactcatcttgttaaatctaaaagacaagggcaatcaatgatttattctatagatgatatacacgtttcaactttacttaaacaagccattcaccactccaaacatcctagtgaaggtggaatttctaatgacaaatcataa

SEQ ID NO: 1361 - DNA, 672 bp, Staphylococcus epidermidis
aaatcaagtcaaaaaggtagagatatgaatatgatgtttgattcaaaacaattatcagtctattttatttgcggaacacaagatatacctaaaaataaatcaattgagcaagttctcaaagaggcattagaagctggaatcacgctatatcaatttcgtgaaaaaggtccgaatgcactaaaaggggaaaagaaaaaacagttagccttaaaacttaaacaattatgtcactcatatcacgtacctatgatagttaatgatgatgttcaattagcccaagagattaatgctgatggcattcatgtaggtcaagatgatatggaaattcaacaatttgcaagccaatttaaaaataagattataggtttaagtgttgggaatttgaaagagtatcaacaatctgatttgtctaaagttgattacattggagtaggtccaatgtatacaacatcatcaaaagatgacgctagtaaacctgttggtccatctatgatatctcaattaagattatatattcatgattttcctatagttgccattggaggtataaatgaaactaacgtgcagcctattgttgacgaaggtgcagatggtatttctgtcatctcagctattacacgtagtaccaatatagacaaaacggttaaatatttcttaagatatttcacctaa

SEQ ID NO: 1362 - DNA, 687 bp, Staphylococcus epidermidis
actaaaaaacatggaggaaaaatgatgaataaagcaaaattgatagaccatacattattaaaacctgattcaacaaaggaacaaatagatactattataaatgaagcaaaagcatatcagtttaagtctgtatgtgtgaaccctacacatgtacaatatgcatctgaacaacttaaaggaacagacgttttagtgtgtactgttattggatttccactaggtgcaacaactacagcggttaaatcttatgaaacaaaagatgcgattaacaatggtgcccaagagattgatatggtgataaatattggagcacttaaggatggctgttttgatgaagtgcaaaatgatatcgaagccgtcgttcaagcagccaatggtaaaacagttaaggtaattattgagactgttttattaactgagaaagagaagattaaagcatgtcaattatctgaagcggcaggtgcacattttgttaaaacatccacaggttttgctggtgggggtgcaacagttgaagatgtaaaattaatgaaagatactgttggtgatcgtttagaagtaaaagcgtcaggcggcgtgagaaatctagaagattttaataatatgattgaagcgggtgctacacgtattggtgctagtgccggtgtgcaaattattcaaggacttgaatcaaatactgattactaa

SEQ ID NO: 1363 - DNA, 1404 bp, Staphylococcus epidermidis
attaattttaagataaggagcattataatgactgaggaaattaactatttttggcttaattgtggttacaatagatggaatcataatgaaccattagtgggacagacagcgttatttgaatctggcgcacattttaatcctacacaaggatatagagcatttaaaaaagctaaagctggagatcaagtgattttctatcaagtacaaacagattctggacttttaggtataggtgaaattataagtgtgcaatccggtgctcaaaataaaataagagtagaatttaaatttaaagaaacgctaaaaccacttacaacggattatcttaaaagaagtgaaacactcgattttcgtatgagtaacatgagggaaacacttttcaaccaaatcagagagtcagaatttgagttaatagttagtttaggtaaaggaaaatcgaaaattcctcgatattttttattagcagaaacagaagcgtttgaacctggtaaaaactatactatatttactcatacatttaatggaatcaaaaggaatggttatcatttttacactcaactagaggtgggtgataacattattatatataataaatatcaaaaccaatcggttatcggtattggcgaagtatcaaagcatatacatgagaaaccacctataccaggtcgaacgaatagtacagctattgaaattttttatgagaaagatatcaagcccatttcattaggtcatttaaataaacatcctaaattgaagaatctgtactttttacaagaaaatgcgaaacagtcaatagcaagtatgtcacaagctcaatacgatgccattttggacatgagtatgaataatggtattaaacatccttttgaaacagtaaaaaaagcagaactatcaactcaaaatgctgaagatgatagtttaaaaccttttgtattattagttgttgaacaaaaaggagaaggcttaaaggcagctgaagaattactccaaaaaacaaatgcaaaccctgtgattactagcggacatccagattttactgaagatatgctttatggtaaatatttacctaatgagtcaggagcgctatattatcgtgaaggattcatcacacatctaatgcctaagaaagataaaagttatttagtcattgataacttcaatcgcatcgatgtagatattttccaaacatatattaatgtacttgaaggctatgaagtgacattaccgagatataataaagatggaagcatgattaagtggtcaaaaaataaagattctttttatcattttaatcctaattggcatattgttggtattacatatgactctatagaaaaaattaagcaaaaatattcgtcacagtttttaaaatatacgcgtatcgtcaaagtgaatcatgactaa

SEQ ID NO: 1364 - DNA, 1155 bp, Staphylococcus epidermidis
aatttgtttaattattataaatccggatttcaaaaagcaaaaccacataatctaaagttaatactactctcattaataacttttgtcatttgctatattacttctaatattgcattctcattagttatattaagagctcaaaggttaccaatgttagctcaactcggtgaatctactacaaaacctataatatctattatttttattttactcattttagctttattatttatttttgtaggttacccattgataactggtacagtatatgcaattcaaaaagctattaataaagagaaagttctttttagtgatttattttttgcttttaaaaaaggcaaatatgctaaatcagtaattttagctttaataactttagttttattcattgtaatcgtacttattctagtgctattaaataaattatatagtttagctcttagcccaatattaatcggcttacaacaatcaataagcggctacgacaatccaatgggaattttaattacaatacaaattgtgttgttactcataacaggtttcatctcatcaattttctattggtttgtaattatattcattattaattatactaccgcttatacagaagattcatctcgtaaagtaatgagtaatttaaaagaaggatttaaaggtattaaaaacggtaagaaaacttggtttaaatttttcattggcgtattacttattagtttacttgcaagtattattaacaaaccgctattattcggtgtacaatacttaacaagcagtatgtctcaaacggtggctcaaactattattataatagctagaatcgtatctatagtattacgcctatgtctttattacattttgatttttggaattattaattatttcgttagacgtggtgacaaaccagtcaaaagcaaaagacgtcataaaaataaagatattaacaaaggtaatgtaaacgacaaagtagatactaaattaaatgcttccaactccaaagatacagaagcagataaaatgaaagatcaacaaacacatatacaacaagacaaaactgatagtcaagaaaataacatatatgattccatcaaagaaaaagtaaatgaaaataaagaaaatgttacagaacaatctaaaaatctatttgataagaaatag

SEQ ID NO: 1365 - DNA, 183 bp, Staphylococcus epidermidis
acaatttataagatattttttatagttgttttgtataagaaaaacgtgactttcgatcagcaacatagcacgggtggaattttaattcaactttttgaaaatgaattaaattctgcccttatttctttacagcatataatcacagaagaggtgaaaacatgcacacacaaatatgggatttaa

SEQ ID NO: 1366 - DNA, 501 bp, Staphylococcus epidermidis
aatcattataatataataaccattgtaaaaatgaggttcgaaggagtgtttgatatgagtcaacaacaagatgtagtcaaagaattaaatcaacaagtcgcaaactggacggtagcttatacaaagttgcataatttccattggtacgttaaaggtcctaatttcttttctttacacacaaaattcgaagaattatacaatgaagctagtcaatatgttgatgatttagcagaaagaattttggcaataggtggtaatccaattggaacactttccgagtgtttagataaatcaatagtaaatgaagcaggaaaacattattcagctgaagaaatggtagaagaattgtctaaagatttttctaaaatctctaaacaattagaacaagcaattgaagtgtcgggaagtgctagtgatgacgtttcagaagatatgtttatcggcatgcaaacttcagttgataagcataattggatgttacaatcttatttaggtcattaa

SEQ ID NO: 1367 - DNA, 963 bp, Staphylococcus epidermidis
gcttttaataatggaggtgtgaacatgccgttatttttaaaacccatttttctggataaagtatggggcagtgataatcttcgtcaatttgggtatcaactacctaataatcacataggtgaatgttggggaatttcagcacatccacacggaaaaagtgtgattgaaaatggtatatttgctggtcaaacattggatcaagtatggaacaatcatagagaaatatttggagattttccaagtaaagattttccattaatggctaaaattgtagatgctgctgcgccattgtctattcatgtacatcccgacgattcttatgcatatgaacacgaagaaggtcaatatggaaaatctgaatgttggtacatcattgaagctgatgaaggtgcaaagattactataggtacgtatgcgaaatctcgtgatgaatttgaagagcaattggagcaaggtacatttgaaaattatttgagaacaatacaagtgcaaccaggtgatttttactttataccagctggaacgatacattctataggtgcaggcattatggcgtatgaagtcatgcaatcatcagatatttcatacagaatttatgattatcatagaaaaactgataatagcgaggaacgtgaattaaatatagataaggcattagatgttattaattattcaaatgaactacctaatatcactcctcaaaatgaagtgatagaaaatcacaattgtacacatattgtatctagtgatttttttactatggttaagtgggatatttctggaactctaaattatatgaagcctagagaattttgtcttgtttctgttttagatggacaaggtaaacttattgtagatggtgatatatatgaaatatctaaaggttcaaactttgtgttaacttccgaagatttagatagtgttttcgaaggagattttaaactaatcattagttacatttaa

SEQ ID NO: 1368 - DNA, 1194 bp, Staphylococcus epidermidis
gtaatgaataataaagtaaatggtccgtttctcacacttagtgatttgtataatgatgacattgtttacacatctcgaccttcatatgtgtcgaacccatggttgaaaccagatgaacaccaatcaaatttcttaactggaagagaattacttatagctaatcgttttcctgtcattgttcatgaggcaagtgttacaaacaaattagaacaactttttaatatagtgggtagggaaattccaccacatacttataaatttaaagatcaagaaacatatgaaagcttgataaggaatttagctcttcatcaaggtaaaaaaatctactttcaatatattcataatgaagatattttacctaaagaatattatgcacttgataaagatgtttttgttgctcttaataataaagcacgaattccagaatggactaataacaaatatctaccacaaagagaaattgtctcaattaaagattttgaatctcgtattcaagcatggtcgtatccatttgtcataaaaccaggcgatgatttacctacagcaggaggatatggtgttatgatttgttataatgatacagatttagataaagctatcacacgcatcaacaatgcatcagcagagactgaacatttaatcattgagcaaaaaattaatgcagtgaataactattgtgtacaatttgcttattcagatgatattggtatcaaatacttaggaacagcgcaacagttaactaatgactatggattttacaacggaaatgaaaatgttaatgatgtgcctcagaatgtaatagacgctggtagagagattatggaaataggcgtaagcaaaggtttttttggtgtagcaggttttgacttactagtagatgataataatgatgtttatgcgattgatttaaactttaggcaaaacggatcaacgagtatgctacttttagcaaaagatttaactcatggatatcataaattttacagttacttttctaatggagataatacaaaattctataatgctattttaaaatacgtagaattaggtgtactttatccactttcctattacgatggagattggtatggaaagaatcaagttaattctagatttggctgcatttggcatggggaaaataaagaattaattaatcaatatgaacaacaatttatattggaagctggattataa

SEQ ID NO: 1369 - DNA, 792 bp, Staphylococcus epidermidis
atgatgaataatttagaacgattacgttcagaaaatccactcgtaatttgctataccaatgatgttgtgaaaaactttactgcgaatggtttactaagtttaggtgctagtcccgcaatgagtgaggcaccagaagaagctgaagattttactcgaatggctagtgcgcttttaattaacatcggtacactcacacgtgaaaatgaagaagacattatcaaaataggtaaaattgctaatcagcaaggtacaccaatagtttttgatccagtggcagttggtgcttctacatatcgtaaaaatttttgtcaacgttttcttggtgaagttaatgtcacagtaataaaaggcaatgcttcagaaatattgacattaatagattttaatacaactatgaaaggtactgacagtgacagcgaattagattcagtaaatattgcaaaaaaagcggctaatactttaaatactgctattgtcattactggaaaagatgatattattgcaaaaaatgagaaaataattaaattatctaatggttctccgcttcttactaaaatcacgggggctggatgcttgttaggtggtgtattagcaagtttcttgtttagaaatactcaaccttcaattgatttattagttgaagcggtaagtgtctacaacatcgcagcagaatttgctgaacaagcgcctcatgtaaatggacctggtacttttctatctgaactgctagatcaactttatcagatgaatgacattacttataaaaatcaagtcaaaaaggtagagatatga

SEQ ID NO: 1370 - DNA, 870 bp, Staphylococcus epidermidis
atggaggataatatgaaaaatataaaagcaatttttttagatatggatggaacgattttacatgaaaataataaagcctcggaatatactaaacaagtgattaatgaattgagagagcaaaattataaagttttccttgctactgggagatcttattcagaaatcagtcagcttgttcctgatggattcactgtagatggtattatcagttcgaatggaacttcaggtgaaattcatggagataatttgtttagacatagtttaactttagaacgagtacagaaaattgtggaattggctaaaaaacaacatatttattatgaagtttttccttttgaaagtaatcgtatatctcttaaagaagatgaagattggatgaaagaaatgatttccactatagagccacctgacgctgtaagtcaaagtgagtggtcatcgcgaagagaggcaattaaaggaaaaatagattggcgagataccttacctgatgcacacttttctaaaatatatttatttagtcccaacttagataaaataactgattttcgcaaccagcttgttgaaaaccaatcaaatttaggtattaccgtatctaattcttcgcgttataatgctgaaacgatgccatatcatacagataagggtacaggtatcaaggaaatgattgatcactatggtattaagcaagaagaaactttagttattggtgatagtgataatgatagagctatgtttaattttggccatcacactgttgcaatgaaaaatgcaagacaagaaattaaaaatcttacagatgatattaccgaatacacgaacgaagaagatggtgcagcacattacttaaaaagtcatttattagataactag

SEQ ID NO: 1371 - DNA, 225 bp, Staphylococcus epidermidis
gccaacatcctagttgtctgggcaacgccacatccttttccacttaacatatattttgggaccttagctggtggtctgggctgtttccctttcgaacacggaccttatcacccatgttctgactcccaagttaaattaattggcattcggagtttgtctgaattcggtaacccgagaggggcccttcgtccaaacagtgctctacctccaataatcatcacttga

SEQ ID NO: 1372 - DNA, 399 bp, Staphylococcus epidermidis
gttcgaatcctacctgcggagccatggctccttggtcaagcggttaagacaccgccctttcacggcggtaacacgggttcgagtcccgtaggagtcattttatggagaattagctcagctgggagagcatctgccttacaagcagagggtcggcggttcgaacccgtcattctccaccatttaattaaatactgcggaggggtagcgaagtggctaaacgcggcggactgtaaatccgctccttcgggttcggcagttcgaatctgcccccctccaccattcttgggctatagccaagcggtaaggcaacggactttgactccgtcatgcgctggttcgaatccagctagcccagccattagagccattagctcagttggtagagcatctgacttttaa

SEQ ID NO: 1373 - DNA, 465 bp, Staphylococcus epidermidis
aaatttaacaagaatttgaatagaattgacaccataccacaggctatattatcatttagattgtatgagtggaacggtttacatgattggtataggacactcggaggctataaaatgcgtcgtttcaacatcattttcaaacaatatttgcaatattatctttatatattggtaataattggaatattgtactcaatttcaccccacccatttctcttgggtcttatgataggtacatgtggttctttagtaaatacatacatctttgagatttatttagctaaatcaatgcataaagaaactacacaaatgtctactggtagtacttggaggtatttagtggcagttattgcatgtgtattatggttattctttaaagaacacattaatattatcggagttttaattgggttaatgatttcttatattgtaatcatattgcgccctctactacaaagggagtaa

SEQ ID NO: 1374 - DNA, 1332 bp, Staphylococcus epidermidis
aatgggtgcaagtctatgcctggtagagaacgaacatctccgcagtatgaatctttccacgaattatataaaaacaatactactaaagagctcactcaaaaagccaaatctttaaaattaactaattacagtaaattaaataaaaaagaattggtacttgccattatggaagcacaaatggaaaaagatggtaattactatatggaaggaatattagatgatattcaacaagatggatatggtttcttaagaaccgttaactattctaaaggtgagaaggatatttatatttctgcaagccaaattcgacgttttgaaataaaacgtggtgataaagtaacgggtaaagttcgtaaaccaaaagataatgaaaaatattatggtctacttcaagttgattttgtaaacgaccataatgcagaagaagtcaaaaaacgtcctcacttccaagctttaacacctctttatccggaagaaagaatcctattagaaacgcaatctacaaattattccactcgtattatggatttagtcacaccaataggtcttggtcaacgtggtcttatagttgcaccacctaaagctggtaagacaagtttattaaaagaaatcgctaacgcaatagcgagtaataaaccggaagcgaatttgtttatattactagtaggtgagcgtccagaagaagtgacggatattgaaagatcggttgaatctgcagaagtcgttcattcgactttcgatgaaccaccagaacaccatgttaaagttgctgaattattattagagcgtgcaaaacgattagttgaaattggagaagatgtaattatacttatggactccataacacgtttggcacgagcatataatctagtcataccacctagtggacgtacattgtcaggtgggcttgatcccgcttcattacacaaacctaaagcgtttttcggtgcagcacgtaacattgaagctgggggaagtttgacaattttagctactgctttagttgagacaggatctcgtatggatgatatgatctatgaagagttcaagggtacaggtaatatggaattacatcttgatcgtaagttatcagaacgtagaatattcccagcgatagacataggtcgtagttcaacacgaaaagaagagctattaatcactaaagcggaattagattcattatggcaattacgaaatttatttactgattcaacagactctacagacgttttattagaaaacttaagcgttcgaaaagtaatgaagaattgtttaagcaattgccaaaaagcagttgaagagagtactaaaactggaagaccaattatttaa

SEQ ID NO: 1375 - DNA, 399 bp, Staphylococcus epidermidis
cacatgttaaataaaatagtcattgttggtagaatgacgaaagatgctcaaatctatgaaaaggaggataacaaaatagcaacattttgcgttgctacagaaagaaactacaaagatgataataatgaaatttctacagattatttactttgtaaagctttcggtaaaactgccactaatattgaaaagtacactagtcaaggtactttagtaggtataactggacaaatgcgttcaagaaaatatgaaaaagaaggccaaacacattttgttacagaattatacgttgaaacaataaaattcatgtccccaaaaaataaaaacaatgaaactccctctgataatcaatttgaaaacaacacttatcaacctgatgatttagaaataattcatatttaa

SEQ ID NO: 1376 - DNA, 714 bp, Staphylococcus epidermidis
atgaagctaaagagagagttcacgcactcacatctaaatatccattatataattaatagacatacacattggaggaaaatgattatgagtaaagtacatgtttttgatcacccattaatacaacacaaactaagttatattagagatgctcgcactggaacaaaagagtttagggaacttgtagatgaagtcggtatgttaatggcttatgaagtaactagagacttagaactgcaagatgttgaaatacaaacacctgtgactaaaatgacagctaaacgtttggcgggtaaaaagttagcaattgtacctattttaagagctggtctaggcatgacagatggtgtgttaagtcttgttcctgctgctagggtaggacatataggactatatagagatccagagactcttgaagcggtagagtactttgcgaaaatgcctcaagacatcgatgaacgtcaaattattgtggttgatcctatgcttgctactggtgcttcagctattgaagcaatttcttcattaaaaaaacgtggagctaaaagtatacgttttatgtgtttaatagctgcccctgaaggcgttgaaaaaatgcaagaagcacacccagatgtagatatatatattgcggcattagatgaaaaattaaatgacaaagcgtatattacaccaggtttaggtgatgcaggggatagattattcggtactaaataa

SEQ ID NO: 1377 - DNA, 1512 bp, Staphylococcus epidermidis
atggccataaaagctgaagaaatcagtgcattgcttcgctcacaaattgaaaattatgagtcagaaatgtccgttacagatgttggtacagtactccaaattggtgacggtatcgcattaattcacggacttaacgacgttatggctggtgagctagtagaattccataacggtgttcttggtttagcacaaaaccttgaagaatctaatgtgggtgtggttattttaggaccatatgaagaaattagtgaaggtgacgaagttaaacgtactggccgaattatggaagtaccagtcggagaggaaatgataggaagagttgttaatcctcttggacaacccattgacggacaaggtccaatcaatgcgactaaaactcgtcctgtagagaaaaaagcaactggcgtaatggatcgtaaatctgtagatgaaccattacaaacaggtatcaaagcaattgatgctttagtaccaattggccgtggtcaacgtgaattaatcattggtgaccgtcaaactggtaaaacaactgttgcaattgattcaatcttaaaccaaaaagatcaagatacaatttgtatttatgttgcaataggtcaaaaagattcaacagttcgtgcaaatgttgaaaaattaagacaagcaggtgctttagactacacaatcgttgtatctgcatccgcagctgatccagcaccattactttatattgcaccttattctggtgtaactatgggtgaagagttcatgtttaatggaaaacatgttcttatcgtttacgatgatttaactaaacaagcggcagcataccgtgagctatcattattattacgtagaccaccaggtcgtgaagcatatcctggggacgtgttctacttacacagtagattattagaaagagctgcaaaacttaacgatgatcttggaggcggttcaattactgctttaccaatcattgaaactcaagctggcgatatctcagcatacgttccaacaaatgttatctcaattactgacggacaaatattcttacaatctgatttattcttctcaggtgttagaccagcgattaatgctgggcaatcagtatctcgtgttggtggttcagctcaaattaaagcgatgaaaaaagttgcaggaacattacgtttagacttagcttcatatcgtgagttagaatcatttgcgcaatttggttctgatttagatgaatttacagctaaaaaattagcgcgtggtgaacgtactgttgaagtattaaaacaaggtcaaaataacccactgcctgtagaacatcaagtacttattatttttgctttaactaaaggttacttagatgatattcctgtccaagatatcaatcgttttgaagaggaatttaaccactgggctgagtcaaatgcaactgaattattaaatgaaattagagaaactggtgctttaccagatgctgataaatttgattctgctatcacagaatttaaaaaaggatttaataaatcagaagaataa

SEQ ID NO: 1378 - DNA, 543 bp, Staphylococcus epidermidis
ataatggcaaaggtagcaaaaaaatatgccaaagcattatttgatgtcgctctagatacaaatcaactagatgttgtctatgaagatttagaaacaattagccattcatcgtttgatttcatcaaacaacttaaagcaattgatagtaatccaagcttaactgcaaatcaacgtgaagaatttgtagaaagagtttacaacgaagcaaatccatatgtggtaaatactttaaaagtattagcagataaccgacatatttcaattgtagagaatgtttttaaatcattccaaaatttatataacaaatactacaaacaagattttgcaattattgaatcgacttacgagttaagcgaagatgaaatatcaagaattgtagaacttatcaaaaagcaaactgaattatcaaatgtaattgttaacactaaaatcaatcaagatttaattggtggatttagagttaaggttggaactacagttatggatggtagtgttagaaatgaccttgttcaattacaaagaaaatttgaaagagctaactaa

SEQ ID NO: 1379 - DNA, 204 bp, Staphylococcus epidermidis
ggaaatcaaaagtcttatcttgttccctttttatattcaaagttaaatattttaatgagtataattatactaaattttctacttttaaatgaacttgaaaagagtgtaatgcttgattctattgaatccaatttaaagcattgttattttaaagggtcattttcagaaaataatggtatagtaatcaataaaacgctttattag

SEQ ID NO: 1380 - DNA, 1296 bp, Staphylococcus epidermidis
tattttaaaaagaaggaaacaaaggagaaaagtgatatggctcaagaggtaataaaaattagaggtggacaagcactaaaaggagaagtagaaattagtggagcaaaaaatagtgcagttgctattatccccgcaactttattagctcaaggacaagtaaagttggaaggccttcctcaaatctctgatgtcgaaactctagtaagtttgttagaagatttaaatattgaagcaagattaaatggtaaacaattagaagtggatactacacaaatagagaatgcacctctacctaataataaagttgagtctttacgtgcttcttattatatgatgggcgcaatgcttggtcgttttaaaaaatgtgtaattggattgccaggtggatgtccactcgggccaagacctattgatcaacatattaagggattcaaagcattaggagcagaaattgacgaatctagcaatacatccatgaaattagtagcaaaagaacttagaggcgctcatatatttttagatatggtaagtgttggagcgacgattaatattatgcttgcggcagtccatgccaaaggtcaaactgttattgataatgcagccaaagaacctgaagtcgtagatgttgcaaactttttaatgagtatgggtgctgatattagaggagcaggtacaacatcaataaaaatcaatggtgttgaggaactaaaaggttcagagtatcaaattattccggacagaattgaagctggttcttatatgtgtatggccgcagcaatgggtgaggaggtcattttacataatattgttcctaaacatgttgaagctttaactgttaagttgcaagagttaggtgtagatattgaaattgaagatgaaaaaataatcattcgtaaacaaacaccgtataaaaatgtagatataaaaacgcttgtttatccaggttttgcaactgatttacaacaacctattacaccattattattcatgacagaaggaccttcgtttgtgactgatactatttatccagcgcgttttaaacatgtagaagaattacagcgtatgggtgctaatattaaatcggatgagggaacagctgtgattaaaccttcgacacttaatggagctgaagtatatgcaagtgatttacgcgcaggcgcttgcttaattactgcaggtttaatagctgaaggtgtgacgacaatatttaatgtaaaacatatttatagaggatatactaacatcgttgaacatcttaaagcacttggtgctgatatttggacggaaacggtataa

SEQ ID NO: 1381 - DNA, 435 bp, Staphylococcus epidermidis
gcaatgaaaaaggagtgtatacacatgccaataatttattatgatggaaattgtgtttattgttataactatgcaatttggttaattcaaaacggactttcacataaatatgagtttgcaacaattaaaggtcaaataggtaaacaattttttgaaaattatcctgatgctcaaaataagaatagtgttattcttcaaaaaggaaatcatttagaatttgaatcacaggctgttgcaacattgatatcgtcactacctaatcactctaaatttcttggaataggattaagattaattcctaaaccactaagagatttaggatatcgattatttgcaaataatcgagataaaatgtggaaaacacattggcacaagccaactgattatgaaaaatcattttttcttgatgataatgaaaaaatcaaactaacctaa

SEQ ID NO: 1382 - DNA, 1092 bp, Staphylococcus epidermidis
gaaggaggaaatgtagtgtttgatcaattagatatagtagaagaacgatatgaacaattaaatgaattactgagtgatcctgatgtcgtgaatgacgctgataaattaagaaaatattcaaaagaacaagctgacttacaaaagactgttgatgtgtacagaagttataaaaccaaaaaagaagaattacgagatattgaagatatgctaaatgaaacatctgataaagaagaagttgaaatgctaaaagaagaaagtagtgctttaaaaacagaattacctgatatggaagaagaattaaaaatcttacttatacctaaagatcctaatgatgataaagatgttatagttgaaatccgtgcagctgcagggggagatgaagctgcaatatttgctggggacttaatgagaatgtattcaaaatacgccgaggcaaacggatttaaaacagaaatagttgaagcttcagaaagtgatcatggtggatataaagaagtgagtttctcagtatctggtacaggtgcttacagtaaattaaaatttgaaaatggtgcacatagggtccaacgtgtgcctgaaacagaatcaggggggcgaattcacacttctaccgcaactgttgctgtattacctgaagctgaagatgtcgaaattgagatacgtaatgaagatttaaaaattgatacttatcgctctagtggtgctggtggtcagcacgttaacacgactgactctgcagtgcgtattacacacttgccgactggtgttatagcaacttcttctgaaaagtctcaaattcaaaaccgagaaaaagctatgaaagttttaaaagcacgattgtatgatatgaaattgcaagaagaacaacaaaaatatgcttctcaaagaaaatcagctgttggtacaggtgatcgttctgaaagaataagaacttataattatcctcaaagtcgtgtgacagatcatcgaattggtttaacgcttcaaaagttaaatcaaatcatggaaggaaatttagacgagattgtggaggcactcacactttcagaacaaactgagaaactgaaagaattaaacaatggtgaattataa

SEQ ID NO: 1383 - DNA, 426 bp, Staphylococcus epidermidis
aaagctatgaaaataatttttgtatgtagtggcaacacttgtcgaagcccactggctgaaagtatagccaagtcccttttaccacacgatagtatagcttcaagagggctattcgcagttgagggacaggccatatctaaggaatcgttagaattaattcataagtacgatttacctgaaccatcacgagcacaagcatttcatatagatgatcttgatgctgatattatacttaccatgacgcaagctcataaagatttaatattttctatgtatggacgacaatctaatgtctttacattaaatgagtatgtaggtgacacacaagaaattgatgacccatttggtggctcgtttgatgtttatgaacaaacttataccaaaatttatgatttagtcgacaaaataaaatttaaacacgagtaa

SEQ ID NO: 1384 - DNA, 357 bp, Staphylococcus epidermidis
gcatcaatgaaagttttaagattcttattaggactagcatttggaacagctggtgttttacattttactagagagagacaatttagaaatattgttccagattatttacctttacaaaaaactgctgtattggtaacaggtgttatagaaatcttttttggtatcatgttgcttattaaaagaccagcatcatggttgaaaaagggtattaatttattcttgttagcagtgttcccagcaaatatttatatggctcgtaaaggattgccattaggtgacaaagaactacctaaatgggcactttattcgagattaccattgcaatttgtgcttattaaagccattaaaaaattataa

SEQ ID NO: 1385 - DNA, 840 bp, Staphylococcus epidermidis
acaatggtgaattataaagagaagtttgcagaagccaagacaattgccgtaaatgaggggtttgaatcaactcgtgccgaatggttgtttttagatgtttttggttggtcgaaaacagattatttaattcataaagatgagcaaatgtctttgacatcaattaacaaattggataaagcgttggatagaatgatcacaggagaacctattcaatacattgttggatttcagtctttttatggttatcaatataaagtgaatcaacactgtcttataccaaggcctgaaaccgaggaagttatgttgcattttttagaattgtgtaaaaagactgataccatagcagatattggaactggaagtggtgctatagcaattacgcttaagttactgcaacctgaattaaatgttattgcaacagatttgtatgaagatgctttaaatgtagctaagcaaaatgctagtcattatcaccaaaatattcagtttttgcgtggaaatgctttaaaaccgctaattgaaaatgatataaaattggatgggctgatatctaatccaccatacataggccatagtgaaataatagatatggagtcaacagtactaaattatgagccacatcatgctctatttgctgagaaaaacggatttgctatttatgagtcaatattagaagatttaccatttgtaatgaaacaaggtggacatgttgtttttgaaataggttatagtcaaggagatatcttaaaaagaatgattcaagatttatatcctgaaaaagaagtagagattttcaaagatatcaatggaaatcagcgtattatatctattatttggtag

SEQ ID NO: 1386 - DNA, 351 bp, Staphylococcus epidermidis
ctatcgaacctttttttaaattttaaaatgttaaaaagtaatatccatttttataagtatctttattgcctcttttcgtgtacaatgttatacagtaatcttacgaaggagcttaatatggattatcttggtcagttcgcaattgttcatttaatcttacatgttgtttgtatttgcgtagcttattgggctttaaattccataaaattagaccaattttttaaaaagggctacccattacaagttcaagtttgtatgatttttatttctattttactgggtacggcagtcagtaactttatagttgatttattgcaatattcaactcaagtgaaatacttgataaaataa

SEQ ID NO: 1387 - DNA, 204 bp, Staphylococcus epidermidis
ccgcttattgattgttgtaagccgattaatattgggctaagagctaaactatataatttatttaatagcactagaataagtacgattacaatgaataaaactaaagttattaaagctaaaattactgatttagcatatttgccttttttaaaagcaaaaaataaatcactaaaaagaactttctctttattaatagctttttga

SEQ ID NO: 1388 - DNA, 492 bp, Staphylococcus epidermidis
agcaataaggaggataaatgcatgactaaaatgaatgtagaaagctttaatttagaccatactaaggttgttgcaccttttattcgtctagccgggactatggaaggtcttaatggtgatgtcatacacaaatatgacattcgtttcaaacagcccaataaggaacatatggatatgcctggtctacattccttagagcatttaatggcagaaaacattagaaatcatactgataaagtagtagatttaagtcctatgggttgtcaaactggattctatgtttcatttattaatcatgacgactacgatgacgtattaaatattatcgatcaaacattgcatgatgtgttaaatgctagcgaagtcccagcttgtaatgaggttcaatgtggttgggctgcaagtcattctttagaaggtgctaaaacaattgctcaagcatttttagataaaagagagcaatggaatgacatctacggagaaggtaaataa

SEQ ID NO: 1389 - DNA, 1377 bp, Staphylococcus epidermidis
atacaaaaggagcgtttaaaaatgggaaaatattttggtactgatggtgttcgtggtgtcgctaaccaagaactcacacctgaattggcttttaaactaggtagatacggaggatatgttctcgcacataataagggtgaaaagcatcctcgagttttagtaggaagagatacaagagtatcaggagaaatgctagaatctgcattaattgctggtttaatttcaattggcgcagaagtgatgcgcttaggtgttatttcaacaccgggtgtggcttatttgactaaagaaatggaagcagcattaggtgttatgatttctgcgtcacataatccggttgctgataatggaattaaattttttggttcagatggctttaaattgtcagatgatcaagaaaatgaaattgagcaattattagatcaaaccaatcctgatttaccacgtccagtaggagaggatattgtacattattcagattattttgaaggtgcacaaaagtatctaagttatcttaaatcaactgttgatgttaattttgagggtcttaaaattgtattagatggtgcaaacgggtcaacttcttctttagccccattcttgtttggcgatttagaagcggatactgagacaattggatgtaatccagatggttataatattaatgaacaatgtggctctactcatccagaaaaattagctgaagcggtgttagaaactgaaagtgactttggtttagcttttgatggagatggcgatcgtattattgcggtagatgaaaatggacaaattgtagatggagatcaaattatgttcattattggtcaagaaatgtataaaaaccaagaactcaatggaaatatgatagtttcgacagtaatgagtaaccttggtttctacaaagctctagaaaaagaaggtattcagtcaaacaaaactaaagttggagatcgctatgttgtcgaggaaatgagaagaggaaattataatcttggtggtgaacaatccggtcatatcgtattaatggattacaatactactggtgatggattattaacgggtgttcagttggcttccgttattaaaatgagtggtaaaactctaagcgagttagcttctcaaatgaaaaagtatccacaatctttaattaatgtgagagtgactgacaaatatcgtgttgaagagaatattcatgttcaagagataatgacgaaagttgaaacagagatgaatggtgaaggaagaattcttgttcgtccttctggaactgaacctttagtacgtgtaatggttgaggctgcaactgacgcggatgctgaaagatatgctcaaagtatcgctgacgttgttgaagacaaaatgggtttagataaataa

SEQ ID NO: 1390 - DNA, 1098 bp, Staphylococcus epidermidis
attaaattctgcccttatttctttacagcatataatcacagaagaggtgaaaacatgcacacacaaatatgggatttaagaatgtataaaaataatgttagtcaatatccacatatagatgagataaaacaaactttcctagatggaggtttagtagcgatacctactgaaacagtatatggtcttggtgcgaatgctagaaacgaagaagcagtcgaaaacatctatgttgcaaaaggacgtccgtccgataatccgttaatcgttcatattcacagtattgaacaactcgatgattttgtagagtatattgatgataaggttaaagtattgatggatgaattttggccgggacctatttcttttatattaccacttaaacagggatatctttgcagtaaagtgactggtggattagaatctatcgctgttagaatgcctagtcataaaatagggagagcattacttcaaattgtagatgaacccatagcagctcctagtgctaatattagtggtcgaccgtcaccaacaacttttgaacatgtgaatagagatttaaatggtaaagtcaacggtatagttaatggtgatcaatgtgaagaaggacttgaaagtactgtgattgattgcacacagtttccgtttcgtatcgcgcgaccaggttcaattacgcaagatatgatagaaactaaactacctcattcgataaatcgtcaaatatatgaggaaaatgaaaagcctatcgcacctggtatgaaatataaacattattccccagagaccccattaacaattgttaaagatttaaataaaaaaattgctaatgatgataaatggtcaaaagtagcatttgtattcccagagagtcaaagaagtttgattcccgaaaatagcatttttatatctttatgtgaaaataagggagattttaaatcagcaggccataatttatatgaaattttacatgaacttgaccagaatgaagaaatagaagaggcatatatttatggatttgaagataatcatcacactgaagctatcatgaaccgaatgttaaaagcagcaagttataaactaattaaaggtgaaaagctatga

SEQ ID NO: 1391 - DNA, 189 bp, Staphylococcus epidermidis
acctacaactggaatggattttatataaagagacaactatttaaaacatttggtaagcatattttaaatgattcacaactttctgtcatacttgtaacacatataatagaagaaatgccgttatttttgaaaaagatttacttaaagacttttaaatatttaacaaggttaatatttaagatgttatga

SEQ ID NO: 1392 - DNA, 537 bp, Staphylococcus epidermidis
cgaaaggagtgtcatgagcccgtgactgcaacagctaatacatttattctcggtgcaggagttgaatgggggacaacatttgtaacactcgtaacatttgtaatcctcatcatacttttgaagaaatttgcttggggtccattaaaagaagtaatggacaaacgtgaacgtgatatcaataaagatattgacgacgcagaacaagctaagataaatgctcaaaaacttgaagaagaaaatagaaagacacttaaagaaactcaagatgaagttcaaaaaatcttagacgatgctaagattcaagcacgtaagcaacatgaagaaattattcatgaagctaacgaaaaagctaatggtatgattgaaactgctcaaagtgaaattaatagtcaaaaagaacgtgcaatttctgatattaataatcaagtttctgaactatcagtacttattgcatctaaagttcttagaaaagaaatttcagagcaagatcaaaaagaattagttgaaaagtatttaaaagaggcaggggataaataa

SEQ ID NO: 1393 - DNA, 891 bp, Staphylococcus epidermidis
aatgttattttgtcgtatgacagtgtcaataatgattggtataataatcaatatggaaaagtattacccggaggagatgttatggatttttccaatttttttcaaaatctgagtactataaaaattattactagtttactcgatttactgattgtttggtatgtgttgtatcttctcattacagtttttaaaggtactaaagcaattcaattattaaagggaatagttgtcattgttatcggccagcaaatcagtaaaattcttaacttaacagcaacatctaaattgtttgatattgtaattcaatggggtgttttagcactcattgtgatatttcaacctgaaataagaagagccttagaacaattaggtagaggaagttttttaaaacgatatacgaatacttatagtcgcgatgaagaaaagttgattcaatctgtgtctaaagctgttcaatatatggctaagcgacgcattggtgcgcttattgtttttgaaaaagagacaggtttgcaggattatatagaaactggaataccgatgaattcagatatatctcaagagctactaactaatgtatttatccctaatacgccattacacgatggtgcaatgataattcaaggaagtaagattgccgttgctgcaagttatttaccattatcagatagtgttaaaatatcaaaaagtttaggaactagacatagagcggcagttggaatttcagaagtttctgatgcttttactgttgttgtatcagaagaaactggtgatatatcagtcacttttgatggaaaattaagaagagatatttcaaaagatgtttttgaagaattgcttgctgaacattggtttggtgcacactttcaaaagaaaggtgtgaattcataa

SEQ ID NO: 1394 - DNA, 882 bp, Staphylococcus epidermidis
ttaatagataggggtaaagcaatgtttataaaaaaagattttgatgatattacagttcaagtatttgaagaaaaatatagagatgcacttaaccaatttgaattaagtgaacgacaacaaatatattcttcattgcctcaaactgttttagatgatgcattaaaagatgaaaatcgaattgctaatgtagctttaaataaagaaggaaaagtagtggggttcttcgtattgcatcgttattatcaacatgaaggttatgatacaccaaacaatgttgtttatgtacgttcattgtcagttaatgaaaagtttcaaggccatggatatgggacaaaaatgatgatgtttttaccagagtatgttcaagcattatttcctgattttacacatttatacttagtagtagacgctgaaaaccaaagtgcttggaacgtttatgaacgtgcaggttttatgcatacagctacaaaagaagaaggacctattgggaaagaaagactttattatttagatttagattcaaaacatgtatcttctttaaggctaaaagagggggaagccgcatataatgatgatattcacgtgattaatttgcttaaagatgatgtaaaggtaggctttattgcactagaacaaaatgataataaaatgaatatttctgcaatcgaagttaataagcaaaataggaatgagggaattgcagaaagtgctttacgccaattaccaacgtatatacgtaaacagtttgaagacattgaaattttatcaattactttatatggcgaacgtaatgaattaaaaccattgtgcttgaatagtaattttgtagcaatagaggaaactgaggattatacacgttttgaaaaatatattaattattaa

SEQ ID NO: 1395 - DNA, 207 bp, Staphylococcus epidermidis; identical to SEQ ID NO: 239

SEQ ID NO: 1396 - DNA, 297 bp, Staphylococcus epidermidis
ctctgttccagatggttcagggcaaaggagctgaaaaaaatgaaacaaggaattcatcctgaataccacaaagttatctttttagatacaacaacaaactttaaattcttaagtggttctacaaaaacatcttcagaaactatggaatgggaagatggaaatgaatacccagttattcgtttagatgtatcatcagattctcatccattctatactggacgtcaaaaattcgcagcagcggatggtcgtgtggaacgtttcaacaaaaagtttggactcaaatcaaacaacaactaa

SEQ ID NO: 1397 - DNA, 471 bp, Staphylococcus epidermidis
tattattacagcttaagctcggaggttttaaaaatggaaacgatttttgattataatcaaattaaacaaattatcccacatagacaaccttttttactaatagataaaattgtagagtatgaagaaggtaaaaggtgtgtaggactaaagcaagtatcaggtaatgaaccatttttccagggacatttccctaattacgctgtgatgcctggtgttcttattacagaagctttagcgcaaactggtgcagtagctatgttaaatagtgaagaaaataaagggaaaatagcattgtttgcaggcattgataagtgtcgcttcaaaaaacaagtcgtacctggagatacattaatgttggaagttgaaataactaaaataaaaggtcctattggtaagggttcggctaaagcgactgttgatggccaacttgcttgtagctgtgaacttacttttgctattcaagatgcttaa

SEQ ID NO: 1398 - DNA, 936 bp, Staphylococcus epidermidis
atgcttgaaagtaaatggggattaagatttgtcgctctcatattagcagtttttttctttttatcagtaaataatgtgttcggaaatatttttaatacagatgatttatctcaaaaatcatccaaaactattcaagatgtgcccgttgatgttatctataatagtaaagacctacatgtaactaaaattcctgaaaacgtcgatgttaatttaacaggaccacaatcaaaattaatcaaaattgaaaaccctgaagatttgaaagtagttgttgatctttctggaaaaaaagcagggaaatatcaaaaaaaatatcaagttagaggcatagatagtggtatcaactatcaaattaaacctgaagttgcacacattaaccttgaaaataaaataacacgagttatgcatgtgcaaccagacattagtagtaacagtttagatccaaaatataaaataagtaaacaaagtatttcaccagaaactgtaaaagtgactggtggagagcaacaattaaaaaatatagcttatttaaaagcaacttttaaaaattctagtaaagtgaacaaagacaccaatgatgttgcagatgttagtgcatttgataaacaattgaataaattaaatgtatcaattaatccaaatgaagttaatttaaaagtaacagttgaaccattcagtaaaatggttaaggtacgtaaaaaaacaacgggtaagcttaatgaaaataaagaattagatagtgttaaactggaagataaagaagtagaaatctttggtaatagagatgaattacaaaatattaatgaaattactgctgaagtagatattgatggaatttcagaatctacagaaaaaacagtatcatttaacttacctaaagatgtgactaaagtgaatccaaaggaaacaaaagcgtatataaatgttaaaaattga

SEQ ID NO: 1399 - DNA, 246 bp, Staphylococcus epidermidis
tataaggagagaggctttgtgaagcaatttatatatatttctctagtttgtggcattatttccggagcagggatatttttacaattaccacattatccatctatgatgattccaagatttgtggcgattcttggaataattagcgctgcaatcacaataagagataaggaaataagtggtatgcttaaacttggtgggataatgattaatataatgccgttacttgggagtgtcattgctaaataa

SEQ ID NO: 1400 - DNA, 540 bp, Staphylococcus epidermidis
agagattggaggtttacaatgtcaaaaatcttaaacacacaattaactggtatttttaatcggcttgaaaaacaagagttggatattcaaatggcagctcaatgtctcattcaagcaattggtggagaaggacatgtctatatcaaaggctacgatgatttaaaattctatgagtcattcatattacaaagccatgaaaaattagcgtctagcttaccacttgaagatttacaaaattttaacgatatagatacaacagatagggtactgttattttcaccatactacacttcggaagttgaaagtgatgtacttcaacttattgatttagatgtcgatttagtgcttatttgtaataaccctaaacgagatgattttcctaatcatttaattcattatgttaatttatcaacacctaggcccattgtttacacagaagattatgataaaatcattcaaccacatccgatggccttaaattatatttattatgatatttatactcaaatgattgagatgactagagacctagatttatag

SEQ ID NO: 1401 - DNA, 819 bp, Staphylococcus epidermidis
ttgttatggagtgatagacatatgaagattggaattgatgccggagggactttaattaaaattgtacaagagcatgacaatcgtagatattacagaactgaattaacaactaatatccaaaaagtcatagattggcttaacaatgaagaaatcgaaacattaaagcttacaggtggaaatgctggagtaatagcagatcaaattcatcattcccctgaaatatttgtagagttcgatgcatcatcaaaaggtttagaaattttattggatgaacaaggtcatcaaattgaacattacatttttgctaatgtaggtacaggtacttctttccactattttgatggaaaagaccagcaacgtgttggaggtgtaggtaccggaggcgggatgatacaaggtttaggctatttattgtccaatataacagattataaagaattaacgaatttagctcaaaatggagatcgtgatgccattgatttaaaagtaaaacatatttataaagatactgaaccaccaattcctggagatttaacagcagcaaattttggaaatgtattacatcacttagataatcagtttacatcagctaacaaacttgcctctgcaattggcgtcgttggtgaagttataacaactatggctattactttagcacgtgaatataagactaatcacgttgtatatatcggttcatcatttaataacaatcaattactacgtgaagttgttgaaaattacactgttctaagaggatttaaaccgtactatattgagaatggtgctttttcaggcgctttaggagcactttacctctaa

SEQ ID NO: 1402 - DNA, 732 bp, Staphylococcus epidermidis
ctattaaggagaagatatattatgacagaaagtacacctcacattaacccaaatggagttaaaatagctaaaactgtattaatgccaggcgatccattacgtgctcaatatattgctgaaaattttttagaaaatgttgaacaattcaatacagtacgtaatatgtttggttacacaggaacttataaaggcaaagaagtttctgtgatgggctctgggatgggaattccaagtattggtatttattcttatgaactttaccatttctttgatgtggatacaatcattcgcgtaggttcatgtggcgctcttcaagaagatgtcaatttatatgatgtgattattgcacaagccgcttccacaaactcaaattatgttgatcaatttaatataccgggtcactttgcgcctattgctgattttaatctagtagctaaagctaagaaagctgctgatgaaattggtgccatatcacatgtaggtaacgttttgtcatctgatacattttataatgctgattcaacttttaatgattcatggaaaaagatgggtatcttaggtatcgaaatggaatctgcaggtctatatttaaatgccatccatgcaaataaaaaggctttaggtatttttacagtaagtgatcatattctaagagatgaagccactagtgcagaagagagacaaacatcatttactcaaatgatggaaatagcgctcgaaatagctgaatag

SEQ ID NO: 1403 - DNA, 228 bp, Staphylococcus epidermidis
cccaagaatggtggaggggggcagattcgaactgccgaacccgaaggagcggatttacagtccgccgcgtttagccacttcgctacccctccgcagtatttaattaaatggtggagaatgacgggttcgaaccgccgaccctctgcttgtaaggcagatgctctcccagctgagctaattctccataaaatgactcctacgggactcgaacccgtgttaccgccgtga

SEQ ID NO: 1404 - DNA, 690 bp, Staphylococcus epidermidis
gccacacccggtgttgaaataacacctaagcgcatcacttctgcgccaattgaaattaaaccagcaattaatgcagattctagcatttctcctgatactcttgtatctcttcctactaaaactcgaggatgcttttcacccttattatgtgcgagaacatatcctccgtatctacctagtttaaaagccaattcaggtgtgagttcttggttagcgacaccacgaacaccatcagtaccaaaatattttcccatttttaaacgctccttttgtatctatcaatttttaacatttatatacgcttttgtttcctttggattcactttagtcacatctttaggtaagttaaatgatactgttttttctgtagattctgaaattccatcaatatctacttcagcagtaatttcattaatattttgtaattcatctctattaccaaagatttctacttctttatcttccagtttaacactatctaattctttattttcattaagcttacccgttgtttttttacgtaccttaaccattttactgaatggttcaactgttacttttaaattaacttcatttggattaattgatacatttaatttattcaattgtttatcaaatgcactaacatctgcaacatcattggtgtctttgttcactttactagaatttttaaaagttgcttttaaataa

SEQ ID NO: 1405 - DNA, 888 bp, Staphylococcus epidermidis
  unsure (849): Identity of nucleotide at the above locations are unknown.
tactccaaaggtggtgagataatggcctctcttaaagagatagatagtcgtattaaatcgacaagtaagatgaagcaaataacaaaggcgatgaacatggtttctagttcaaaattacgtagagctgagaaaaatactaaatcatttagaccttatatggaaaagatgcaagatgctattacagctgtagctggttcaaatagtacttctaatcatccaatgcttaaatctagagatattaaaagaagtggttacttagtaatcactagtgataaaggcttagccggtgcctatagtacaaatgttttaaaaagcttagtaaacgatatcaattctaaacacaacgacagtagtgaatatagtctaatcgttttaggtcagcaaggtgtagatttcttcaaacatagaggatatgaaattgaaagttctttagttgaagttccagatcaaccttcatttaaatctattcaatctatagctaaacatgctattgatttatttagcgaggaaaacatagatgaattgactatttattacagtcattatgttagtgtcttagaaaataaacctgcaactaaacaagttttaccattatctcaagaagattcaggtcaaggacatggtcaaatgtcttcatacgaatttgaaccagataaagaatctattttaagcgttattttgccacaatacgttgaaagcttaatctacggtacaatcttagatgcaaaagctagtgaacatgcttcacgtatgacagcaatgagaaatgcttcagataatgcgacagaactaatcgatgatttatcattagaatacaatagagcgagacaagctgcgattactcaacanattactgaaattgttggtggatcatcagctcttgagtaa

SEQ ID NO: 1406 - DNA, 234 bp, Staphylococcus epidermidis
atattaggaggaaattttattatgaatttaatcgcagcggcaatcgcaattggtttatcagcattaggtgcaggtattggtaacggtcttatcgtatctagaacagttgaaggtgtagcacgtcaaccagaagcacgtgggcaattaatgggtatcatgttcattggtgttggtttagttgaggcattaccaatcatcggtgttgtaattgcattcatgacatttgctggataa

SEQ ID NO: 1407 - DNA, 1239 bp, Staphylococcus epidermidis
atgtcttatatcgagaaaaaggataaagttgtttacgatgctattcaaaaggagtttcaacgacaaaatagtaatattgaactcattgcatcagaaaatttcgtatcacaagcagttatggaagcccaaggttcagtattaacgaataaatatgctgagggttatcctgggcgtcgttattatggagggtgtgagcatgtagatgtaactgagtccattgccattgaaagagcaaaagctttatttggagcagaacatgttaatgttcaaccccattcaggttctcaagctaatatggctgtgtatttggttgctttagaaatgggcgatactgtgttaggtatgaatttgagtcatggtggtcatttaacacatggggcaactgtcaattttagtggtaaattttatcattttgttgaatatggtgtggaccaagaaaatgaattaataaactatgatgaagtgagacgtttagcaattgagcatcaacctaaattaattgtagctggtgcttcagcatattcaagaactattgactttaaaaaatttaaagaaattgctgatgaagtaggagctaaattgatggtagatatggcacatattgctggtttagtagctgctggtttacatcctaatcctttagaatatgctgattttgtgactactacaactcataaaactttacgcggtccacgtggtggtatgattttatgtaaagaagaatataaaaaagatatagataaaacaatcttcccaggtattcaaggcggtccattagaacatgtcatcgccgcaaaagctgttgcatttggagaagctttgaacgacgattttaaagattatcaaaatcaagtcattaaaaatgcacaagctttagctcaaacattaattgaagaaggcttcagagttgtatctggcggaacagacaatcatttagttgcagttgatgttaaaggttctatcaatatgactggtaaattagctgaagagacacttgataaagtaggaattacatgtaataagaatactattccatttgataaagaaaaaccgtttgtaacaagtggtgttagactaggaacaccagcagctacaactcgtggttttgatgaatctgcatttgtggaagtagcaaaaattattagtttagcattaaataactatgataatgatactaaactaaatgaagctaaagagagagttcacgcactcacatctaaatatccattatataattaa

SEQ ID NO: 1408 - DNA, 216 bp, Staphylococcus epidermidis
aagttgattttaaaaattaaaaatgcaagtatcatcgttagacacttgcatatcatcatcttttatttagcaatgacactcccaagtaacggcattatattaatcattatcccaccaagtttaagcataccacttatttccttatctcttattgtgattgcagcgctaattattccaagaatcgccacaaatcttggaatcatcatagatggataa

SEQ ID NO: 1409 - DNA, 1467 bp, Staphylococcus epidermidis
tatatgtatatatcttttctaaggagtgaatataataagatgagaaatttcactaaacaatatataaacggtgaatgggttgatagtgcaagcggtgaaactattgatgttattaaccctgcaactgaagaagtaatgggtaaaattgctaaaggtaacgaagaagatgttaataaagctgtagatgctgcagataaagtatatttagaatttagacatagttctgttgaagaaagaagagaacttttagataaaatcgtaaaagaatatcaaaatagaaaaaatgatttaattgaagcaattactgatgaactaggagcgcctttatcagtttccgagaacgttcattatcaaatgggattgaatcattttacagctgcaagagatgctttagatagcttccaatttgaagaacaacgtggcgatgatttggttgttaaagaagcaattggagttgctggacttgttacaccttggaatttccctacaaaccaaacttcacttaaattagctgctgcgtttgctgctggtagccctgttgttttaaaaccatctgaagaaacaccatttgctgcaattattttagcagaaatttttgataaagtaggcgtacctaaaggtgtgtttaacttagtcaatggtgatggatctggagtaggaaatcctttaagtgaacatccaaaagtaagaatgatgtcatttacaggttctggtcctacaggttcaaaaattatggaaaaagctgcaaaagacttcaaaaaagtgtctcttgaattgggtgggaaatcaccttatatcgtattagatgacgttgatgttgaagaagctgctaatgcaacaacgaaaaaagtagttaacaatacaggtcaagtttgtactgcaggaacacgtgtacttattcctgaaagtattaaagaagactacttaacagcagttaaagaagcatttagtaaagttaaagtaggtcaaccaagagaagaaggaactcaagtaggtcctattattagtaaaaaacaatttgatcaagttcaggattacattgataaaggtatcaatgaaggagcagagttattctacggtggtccaggtaaaccagaaggattagataaaggatattttgcgcgtccaactatatttattaatgtagataatcacatgacgattgcacaagaagaaattttcggacctgtcatgtctgtaatcacttataataatcttgacgaagctattgaaattgctaatgatactaaatatggtcttgctggctatgttattggtaaagataaagatacattgagacatgttgctcgttcaatcgaagctggtacaattgaaattaatgaagctggtagaaaaccagacttaccattcggtggttataaagaatctggcttaggtcgtgaatggggcgattatggtatcgaagaattcttagaagtaaaatcaatagctggatattttaaataa

SEQ ID NO: 1410 - DNA, 675 bp, Staphylococcus epidermidis
gggttaagtatgtcatacaaatatgaagcattttttaaagatattttgattaatgaatatatttattttgcttcaaaaaataaaaaattaattagaatacaacatgagaatttgccatatattgctatgtggacagacgaaaatgttgctgagtcttatttgttacatcattcaattgattacgacaaaatcattagagcagatattgaccgttttgtaacatatgaaatggatgaaatctttgatccaggtgacaaagttttagttaatgtgaataatggtgaagaaggaaacattgtagatatagttaaaatgactgatgagttgatgtctgaattagatgatataagaatgagagagtttattaaagatgtcgcaaaatatgacgaagtatacggattgacaaacaaaggtgaaaagaattttattatgatttcagatgatgaccataacaaaccacacatcatgcctgtttggagtattaagagtagagcgcgtaaagtacgtgatcaagattttgaagaatgtgatttaatcgaaattgaaggtgaagtctttagtgaatggttagacaagttacgcgatgataataaagcagtggcgattgatttgaaatcaggtgttgttggtactgttgtatcagcgcaaaaactgtcaaatgaagcaacattttaa

SEQ ID NO: 1411 - DNA, 1860 bp, Staphylococcus epidermidis
gcagtgataattaatcataatagccgtgttatcccatttgttggaggatattatatgtgtggaattgttggttatattggctacgataatgccaaagaattactattaaaagggttagaaaaattagaatatcgtggttatgactcagcaggtattgctgtagttaatgatgatggtacaaaactttttaaagaaaaaggaagaattgctgaattacgtaaagttgcagataatagtgatgaggatggtacgttaggaattggtcatacacgttgggcgacacatggtgttccaaattatgaaaattcacatccacaccagtcaacatctggacgttttacattagttcataatggtgtaattgaaaattatgaagaattaaaagctgaatatttatctgatgtcactttttcatcagaaactgatacggaagttattgtacaattagtagattatttttctagacaaggattagctacagaagatgcatttacaaaagtagttaaattattacatgggtcatatgctttaggattattagatgataatgataaagatactatttatgtggctaaaaacaagtctccgcttttagtaggtgtaggtgaaggtttcaatgttattgcttctgatgctctagcaatgttacaaactacaaaccaatacaaagagatacatgaccatgaaatagttattgttaagcgagacacagtagaaattaaagatcttgaggggcacattcaacaacgtgatacgtatacggcagaaatagatgctgctgatgcagaaaaaggcgtatatgatcattacatgttaaaagaaattcatgaacagcctgcagtgatgcgtcgcattattcaagaatatcaagatgaaaaaggtaatttaaaaatcgattcagagattattaatgatgtagcagatgctgatcgtatttacatcgttgcagctggtactagttatcatgctggattggttggtaaagaatttattgaaaaatgggcaggtgtacctactgaggttcatgtagcttctgaatttgtatataatatgccacttctttctgaaaaaccactatttatttatatttcacaatctggtgaaacagctgatagtcgtgctgtattagttgaaacaaataagttaggtcacaaatcattaacaattactaatgttgctggttcaacattatcacgtgaagcggatcatacattacttttacatgctggacctgagattgcagtcgcatctacaaaagcatatacagcgcaaattgctgttttatctatcttatctcaaattgttgctaaaaatcatggtcgtgaaaccgatgttgatttattaagagaactagctaaggttactacagctattgaaacaattgttgacgatgcacctaagatggagcaaattgcaacggatttcttaaaaactactcgtaatgcattcttcattggacgaacaattgattataatgttagtttagaaggtgcattaaaattaaaagaaatttcttatattcaagctgaaggatttgcaggtggggaattaaagcacggaacaatcgctttgattgaagatggcacacctgttataggtttagctacacaagaaaacgttaatctatcaattcgtggaaatatgaaagaagtagtagcacgtggtgcatatccttgtatgatttcaatggaaggtttgaataaagaaggagacacatacgtgattccacaagtacatgaattattaactcctttagtatctgtagtgacaatgcaattaatctcatattatgctgcgttacaacgagatttagatgttgacaaacctcgtaacttagccaaatcggttacagtagagtaa

SEQ ID NO: 1412 - DNA, 567 bp, Staphylococcus epidermidis
agaaaatcctttgaaaggaagtatttttatatgaaaattcaagattacacaaaagaaatggttgatgagaaatcattcatcgatatggcctatactttattaaatgataaacaaacaacgatgaatttatatgatattattgatgaatttaaatctttaggcggatatgagtatgaagatattgaaaatcgaatcgtacaattctataccgatttaaacactgatggtcgttttttaaatgtaggagaaaatctttggggtctacgtgattggtactctgtagatgatattgaggaaaaaatcgcaccaacaattcaaaaattcgatattctagatgacgaagatgaagaagatcaaaaccttaaattattaggtgatgacgacgctgatgaagatgacgatattcctgctcaaacagatgatcaagaaacattagacgagtcagataatgatgaagatgatgttgaaatgaatgaagcagatatcgttattgatgaagacgaagacgaagatattgctgaaggtgaagaagaagcctttgaagacgccgaagactttaatgattaa

SEQ ID NO: 1413 - DNA, 1428 bp, Staphylococcus epidermidis
aaggaggaaatcaacatgggaattggccgtgtagctcaagttatgggtccagtaatagatgttcgttttgaacataacgaagtacctgagataaataatgcattacacatcgaagttcctaaagaagatggagcgcttcaattaacattagaagttgcacttcaactaggtgacgatgtagttcgtacaattgcaatggactcaactgacggcgttcaaagaggaatggaagttaaagatacaggtagagacataagtgtacctgtcggtgacgtaactctaggaagagtgtttaacgtactaggagaaactattgacttagatgaaaaaattgatgattcagtacgacgtgaccctatccatagacaagctccaggattcgacgaattatcaacaaaagtagaaatcttagaaactggtattaaagtagtagacttattagcaccttacataaaaggtggtaaaattggattatttggtggtgccggtgtaggtaaaaccgtactaatccaagaacttattaataacatcgctcaagaacacggtggtatctcagtattcgctggtgttggtgaacgtacacgtgaaggtaatgatctttactatgaaatgagtgacagtggtgttatcaagaaaactgcaatggtctttggtcaaatgaatgagccacctggtgcacgtatgcgtgtagcattatccggattaacaatggccgaatatttccgagatgaagaaggccaagatgtgttattattcattgataacattttcagattcactcaagctggttcagaagtttctgcgttattaggtcgtatgccatcagctgttggttatcaacctacacttgctacagaaatgggtcaattacaagaacgtataagttcaacaaataaaggttcagttacatcaattcaagctgttttcgtaccagccgatgactatactgaccctgcgccagcaacaacgttcgcacacttagattcaacaacaaacttagagcgtaaattaacagaaatgggtatttatccagctgtagacccgcttgcttctacatctagagctttggaaccttcagtagtaggtcaagagcattatgatgtggcacgtgaagttcaatctactttacaaaaatatagagagttacaagatattattgcgattcttggtatggatgaattatcagatgaagataaacaaactgtggaacgagcacgtagaattcaattcttcttatcacaaaacttccacgttgcagaacaatttactggacaaaaaggttcatatgtacctgttaaaacaacagttgcagacttcagagatattttagatggtaagtatgaccatattcctgaagacgcattccgtttagtaggtagcatggaagacgtaattgagaaagcaaaagatatgggtgttgaagtctaa

SEQ ID NO: 1414 - DNA, 1305 bp, Staphylococcus epidermidis
ataatgagaatgattgacatcatagaaaagaaacgagacggtaagtcattaacaaaagaagaaatagaattttttgtaaacggatacactcatgaggaggttccagattaccaagcttcaagtttagctatggcgatattctttcaagatatgaatgatgaagaaagagcggcattgacaatgtcaatggttaactcaggagagaagatcgacttaagcgatatcaatggtattaaggtagacaagcattctacagggggcgtcggtgatacaacgacactcgttcttgccccattagtagcggcagtaggtgttccagttgcaaagatgagtggtcgtggtctaggacatacgggggggacgatagataaattagaatcagttaagggatttaatgttgaaatcagtgaaaaagattttataaaacttgtaaatgataaccaagtagcagtaataggccaatcaggcaatctcacaccagctgataaaaaattatatgcattgagggatgtaacagggacagttaactctattcctctcatcgcttcgtccataatgagtaagaaaattgctgctggcgcagatgcaattgttctagatgtcaaaactggcagtggtgcgtttatgaagacgctagatgatgccgaagcacttgcgcatgcgatggtaagaattggtaataatgtaggtcgtaatacgatggctattatttcagatatgagtcaacctttaggaaatgcaattggtaatgcgctcgaattaaaagaagctatcgcaacattaaaaggaaatgggccgaaagacctaacagagcttgtgttaacacttggttctcaaatggttgtcttagctgaacaagcaacatctttagatgaagcgcgtcagatgctaatcgatgctataaaaacaggcaaagctttaaacaaattcaaaacatttctatcgaatcaaggaggagatgactctattgtggattctcctgaaaagttacctagcgcgaaatatcaagttgaatttaaagctaaaaaagatggttatataactgaaataatagctaatgagataggcgttgcttcaatgatgttaggcgctggtcgtcaaacaaaagaagacgttattgatttaggtgtaggtatcgtgttaaataaaaaagtaggagaacatgttgagaaaggtgaaaatattttaactattcataccaacaccaaagagatcgatgatattttatataaactagacaatagtattactattgagagtaagggcgaagctccaaccttaattcataaaataataaccgagtag

SEQ ID NO: 1415 - DNA, 1062 bp, Staphylococcus epidermidis
atatttttgatgaaaaaagttatgaccatatttggaactaggcctgaagctataaaaatggctccgttgattaaaacgttagagaaagattctgacctggaacccgttgttgtagtcaccgcccaacatagagagatgcttgattcagtgttgaatacttttaacataagtgcagattatgatttgaatattatgaaagctggtcaaacattgtctgaagtaacatctgaagcaatgaaaaagttagaagatatcatacaaaaggaagtgcctgatatggtacttgttcatggtgatacagtgacaaccttttctggagcattagccgcattttatagtcaaacacctataggacatgttgaagctggattaaggagttataataaatattcaccttatcctgaagaaataaatagacaaatggttggggtaatggcagatttgcactttgccccaacctataatgctgcacagaatttagtaaaagagggtaaattagccaaacatatagctatcactggtaatacagctattgacgcaatgaattatacaatcgatcaccaatattcatcatctatcatacaaaaacataaaaataaaaactttattttactcacagcacatagacgtgaaaatataggtaaacctatgataaacgtgtttaaagcgattagaaagttgattgatgaatatcaggatttagcgttggtctatcctatgcatatgaatcccaaagtaagagatattgcgcaaaaatatttaggaaatcatcctaggattgaattgatagaaccacttgatgtggttgattttcataattttgctaaacaagcatatctcattatgactgactctggtggaatacaagaggaggcaccatcattacacaaaccagttttagtattgagagatagtactgaaagaccggagggagtagatgctggaactttgagagtcattggtacgaatgaagaagatgtctataatgaaactaaaaaattaatagaaaacccagacctttatcaaaaaatgagtcaagctgttaatccatatggcggttga

SEQ ID NO: 1416 - DNA, 210 bp, Staphylococcus epidermidis
atatcagtgataacagcaaatttcatgatattatctcccttcaatgttatcttattagcatattctaacattttgtgctctattatgttagatattaatttaaaatttattagaattttgatattgtatttatatgaaaaaaaaggagtgcttaaaatttgtttaattattataaatccggatttcaaaaagcaaaaccacataatctaa

SEQ ID NO: 1417 - DNA, 417 bp, Staphylococcus epidermidis
gaggtatggataatgaatacacttagactaaatattgtcactcctaatggttctgtctatgaacgtgaagacgttgagatggctgtcttacaaacaacagctggtgaaatggggattatgtatggtcacattccaactgttgctgcattaaaaacaggtcatgtgaaagttaattttcacaacggaaatgaatttattgcagtaagtgatggctttattgaagcaagacaacatcaattatcaattatcgtccaaacggccgaacctgctagtgaaatcgatgttgaaagagctaaattagctaagtcgagagcagaatcacatttagaagatgatgatgataatacagacataaatagagctaaaagagcacttgaacgagcaaataatcgtttacgtgttgcagaattacaataa

SEQ ID NO: 1418 - DNA, 948 bp, Staphylococcus epidermidis
ctaaacattgtagtgagacagaaaaaaaagagattaaagaaaatttcttgcaaagtactattcatgagagacatttcttcaatatggcatatattaatgaaaaatgggaatatgggggaaataacaatgaataaacctaaaattgcactaacaatagcaggcacagatcccaccggtggggcaggtgttatggcggatttaaaatcatttcacgcgtgtggcgtttatggtatggccactataacaagtatcgttgctcaaaataccctaggagttcaacatatccataatttagaatcttcatgggtaaaggaacaacttgatagtgtgtttgatgatgaattaccacaagctatcaaaacgggtatgattgcaacaaaaaaaacgatggagttgattcaaagttacttaaaggaacattccaatattccttatgtgattgatccagttatgcttgccaaaagtggtgattcattgatggatgaaaatactaaaaatcatttgcaatcaacattattacctttggctgatgttgtcactccgaatatacctgaagctgaggaaattactggtattaaaattaatgatgaagaaagcatacgtaaagcaggtcaaatctttattaatgaaattggtagtaagggtgttgtaattaagggagggcattcagccgatttaaataatgctaaagattttctttttactaagaatgaaacgtatacctttgagaacaaacgctttgatactaaacatactcatggaactggttgtactttttcagcagttattacagcagaattagctaaaggtcgttccataaaagatgcagttaaaaaagcaaaagagtttatttcattaagtattgaacataccccagaaattggcaaggggagaggacctgtaaatcattttgcttatatgaagaaagtaggtttagatgatgaataa

SEQ ID NO: 1419 - DNA, 912 bp, Staphylococcus epidermidis
tataatgacgttgaaaaaaacgtgcactgttgcactcaaggaggaactttaatgcctttagtttcaatgaaagaaatgttaatcgatgcgaaagaaaacggttatgcggttggtcaatacaatcttaataacctcgaatttacacaagctattttagaagcgtctcaagaagagaatgcgccagttattttaggtgtttctgaaggggcagctcgttatatgagtggtttttatacagttgtgaaaatggtagaaggtttaatgcatgacttagacatcacaatcccagtagcaattcatttagaccacggttcaagctttgaaaaatgtaaagaagcaattgatgctggattcacatctgtaatgattgatgcatctcatagtccttttgaagaaaatgttgaaatcacttctaaagtagttgagtatgctcatgatagaggcgtttctgtagaagctgaattaggtacagttggtggacaagaagacgacgtagttgctgatggcgttatctatgcagaccctaaagaatgtcaagaattagtagaaaaaactggaattgatactttagctccagcattaggttctgtacatggaccatataaaggtgaacctaaattaggatttaaagagatggaagaaattggtgcttcaactggattacctttagtattacacggtggtacaggtattccaactaaagatattcaaaaagctattccttatggtactgctaaaattaacgtgaatactgaaaatcaaattgcgtctgctaaagcagttcgtgaagtattaaacaacgacaaagatgtgtatgatccacgtaaatatttaggaccagcacgtgaagcaattaaagagacagttaaaggtaaaattagagaattcggtacttctaatcgcgctaaataa

SEQ ID NO: 1420 - DNA, 1296 bp, Staphylococcus epidermidis
ctgattagagttttaagtggaggattaaagatggataaaatagtaataaatggtggaaatcgtttaacaggtgaagttaatgttgaaggagctaaaaatgctgtattacctgtacttacagcgtcattacttgcttctgaaggacacagtaaactagttaatgtcccagagttaagcgatgttgaaacaatcaataatgtattatctacactcaatgcaaatgtagagtatgataaagataaaaatgcagttaaagttgatgcaactaaaactttaaatgaagaagccccttatgaatatgtgagtaaaatgcgagcaagcatcttggttatgggaccactacttgctcgactagggcatgctattgttgctttgccaggaggatgtgcgattggaacacgtcctatcgagcagcacattaaaggatttgaagctttaggtgcagacattcatttagaaaatggaaatatttatgcaaatgctaaagatggattaaagggagcacatattcatttagattttccgagtgtaggtgcaactcaaaatattattatggcagcgtccttggcatcaggaaaatctatcattgagaatgtcgctaaagaacctgaaattgttgatttagctaattatattaatgaaatgggcggtaaaattacaggtgcaggtactgataccattacgatacatggtgttgaaaaactttacggtgttgaacatgcaattataccagatagaattgaagctggaacgttacttatcgcaggtgcaataactcgtggtgacatatttgtacgtggtgcaattaaagaacatatggctagtttaatatataagcttgaagagatgggggtagatcttgaatattatgaagaaggtataagagttacagcaaatggagatttaaatccagtagatgtaaaaactttaccacacccaggtttcccaactgatatgcaatctcaaatgatggctttattattaacagcaaatggacacaaagtgattactgagactgtttttgaaaatagatttatgcacgttgcagaatttagaagaatgaatgcgaatataagtgttgaaggaagaagtgctaaaattgaaggaaaaagccatttacaaggtgctcaagttaaagcaacagatttaagagctgctgcagccttaatcttagctggtttagttgcagagggaactacgcaagtgactgagttaaagcatctagatagaggatacgtcaatttacatggaaaactaaaaagtctaggtgcaaacatagaacgtgtaaatcgataa

SEQ ID NO: 1421 - DNA, 186 bp, Staphylococcus epidermidis
cgcgaagaattagatacggtaatacctaaatttgattggttttcaacaagctggttgcgaaaatcagttattttatctaagttgggactaaataaatatattttagaaaagtgtgcatcaggtaaggtatctcgccaatctatttttcctttaattgcctctcttcgcgatgaccactcactttga

SEQ ID NO: 1422 - DNA, 1131 bp, Staphylococcus epidermidis
acaattacgttaaagaaaaaggctaaaagaactgtaattgtaatggaggaaaacgaaatgacaaaagaaaatatttgtatcgtttttggaggtaaaagtgcagaacacgatgtttcaattttaactgcacaaaatgttttaaacgcaattgataaagaacgatatcaagttgatatcatttatataacaaacgatggtgaatggaagaaaaaagataatattacacaagaaataaaaaatactgatgaactcgtcattaacgatgtagagactggagaaatctcacagttactcagtaaaggtagtttaggaaaatcatatgatgcagtattcccgttattgcatggtccaaatggagaagatggaactatccaaggtctttttgaagtacttgatataccatatgtaggtaatggtgtgttagctgcttcaagctcaatggataaactcgtgatgaaacaattatttgagcatagaggtttacctcaattaccttatattagctttttaagaagtgagtatgaaaaatatgaaaataatatcattaagttagttaatgataagttaacatatcctgtatttgtaaaacctgctaatctcggttcaagtgttggtataagtaaatgtaacaatgaagaagaattaaaatctgggatagctgaagcattccaatttgatcgtaaacttgtcattgaacaagggattaatgctagagagatcgaagtagctgtcttaggtaacgattatcctgaaacgacatggcctggtgaggttgttaaggatgtagctttttatgattataaatcaaagtataaagacggtaagattagattagatattccagcagatttagatcaagatgttcaaatgacattaagatacatggcattagaggcctttaaagctactgattgttcgggattagttcgtgcagatttctttgttactgatgataatcaaatttatatcaatgaaacaaatgccatgccaggatttactgcatatagtatgtatccaaacttatggaaaaatatgggcttatcttaccctgatttaattgctaaattgattgatttggctaaagaacgttatgaagataaaaagaaaaataaatataaaattgattattag

SEQ ID NO: 1423 - DNA, 471 bp, Staphylococcus epidermidis
ctatggttgacccaaatgaataatttagcattacaaagccttaccgaaagtatagcgataaagtattttggcaaagcttttaagcacgaggtatattataataagcgtttacgtaccactggcggtagatatatattaagtagtcataatatagaaataaatccaaaacagtatgaaatgtttggagaaaaagcagtcattgatatcataaaacatgaactgtgtcattattttcttcatttagctggtgaaggatatcaacatcgtgataaagcattcaaaattttgagtgccaaagtaggagcacctaggttttgtactccgacagaatcttatcaagatagagctaattataaatataggtgcatctattgtgaacaagaatttattcgtataaagcgtgtgaatcttgaaaaaatgcgttgtggacgatgtggaggtattttaaaacttattcaaacaagaaagtga

SEQ ID NO: 1424 - DNA, 1215 bp, Staphylococcus epidermidis
gcaatgaattattcttctcgtcaacaacctaaacgtaactggttacgtaaagtagactggatactcgtactagttatatcactattagcactaacaagtgttattttaatcagttccgctatgggtggcggacaatatagtgcaaatttcagtattagacaaattatttattatattttcggagctattattgcatttttaattatgataatttcaccgaagaaaattaaaaataatacttatattttatatagtatattttgcgttctattaatagggttacttattttacctgaaacttcaatcaccccaattattaatggtgctaaaagttggtacagtttcggtcctataagcatccaaccttccgaattcatgaaaattatacttatacttgctttggctaaaacgatatctaaacataatcaatttacatttaataagtcttttcagtctgatttaatgttattttttaaaattttaggtgtatccattatacctatggcattaattctattgcaaaatgacttaggtactactttggtgttatgtgcaattatagctggcgtcatgttagtaagtggaataacatggaggatattagcccctctatttattgttgcatttgtgagtggttctagtattatattagctatcatttataaaccatccttgatagaaaacctattaggaataaaaatgtatcaaatgggacgtatcaattcttggttagatccctattcatacagtagtggggatggatatcacttaacagaatctttaaaagctattggttctggtcaattattaggtaaaggttataaccatggcgaagtttatattcctgagaatcataccgactttattttttcagtgattggagaagaaatgggctttataggttcagtattattgatattacttttcttattcttaatatttcaccttatacgattagctagtaaaattgatagtcagtttaacaaagtatttatcataggatatgtatcgttgattgtttttcacgtgttacaaaatatcggcatgacggttcaattactaccgattacaggtataccacttccgtttattagttacggtggaagttctttatggagtttaatgactggtataggagtagttctttcaatttattatcatgaaccccaacgatatgaaatacccacattatctaaaaaatctaatacaatttaa

SEQ ID NO: 1425 - DNA, 1587 bp, Staphylococcus epidermidis
gtgaacatatatgtaaaaaagcatattaagaaatatacacgtaaaaggagaattattttgcaaaattttaaagaactagggatttcggataaaacggttcaaacattagaagcaatgggatttaaagaaccgacacctatccaaaaagatagcatcccttacgcgttagaaggagatgacatccttggacaagcccaaactggtactgggaaaacaggggcgtttggtatacctttaattgagaaagttgtaggccaacagggtgttcaatcattaattcttgcgccaacgagagagcttgctatgcaagtagctgagcaattaagagagttcagtaaaggtcaaaaagtacaagttgttacagtctttggtggtatgcctattgaaagacagattaaagcattaaaaagaggccctcaaattgtagtaggtacgccgggaagagttattgatcatcttaatcgtcgtacacttaaaactcaaggaattcacacgcttattttagatgaagcagatgaaatgatgaatatgggattcatcgatgatatgagatttattatggataaaattccagctgaacaacgtcaaactatgctattttctgctacgatgccaaaagcaatccaagaattggtacagcagtttatgaaagctcctaaaataattaagacaatgaataatgaaatgtcagatcctcaaattgatgaatattatacaatcgttaaagaattagagaaatttgatacatttacaaactttttagatgttcatcagcctgaattggcgattgtctttggtcgtactaagcgtcgcgtagatgaattaacaagcgcgctattatctaaaggatacaaagcagaaggtttacatggggatattacccaagcaaaacgtttagaagtattgaagaaatttaagaacgatcaaatagatattttagttgctacagatgtggctgcacgtggtcttgatatttctggtgtgagtcatgtttataattttgatatccctcaagatacagaaagttatacgcaccgtattggacgtactggtcgagcaggaaaagaaggtattgcagttacttttgtaaatccaattgagatggattatattcgacaaattgaagatgtcaataatcgtcgaatgaaagcattaagacctccacatcgtaaagaggtgcttaaagcgcgtgaagatgatattaaagatagagttcaaaactggatgtcaagagaaaatgagccacgtttacaaagaatatcaagtgaattacttaaagaatatgatagtacagaattagtagcctctttacttcaagaacttgtagaagctaatgatgaagtggaagtacaattaacttttgaaaaaccattagcacgtaaaaatcgcagtaataaaggcggttctagaagaagtaatcataaacgtggtaatggtaagtttgataataaaaatagacgatcaaaagggtctaaaggtcaatcaagcaaaaagaaaaaccaaaagaaatttgaccgtagagataagcaacaaaaaagtggtaatcaatcactaaaaggtcgcacatttgctgatcaccaaaaataa

SEQ ID NO: 1426 - DNA, 327 bp, Staphylococcus epidermidis
ataatacgatataatatgaacagaggtgactttatggcagacatggagagtgcacatcactcagagcaaataaaaacaaatttaaaatcaagattaaatagaatagaaggtcaagtaagagcaataaatcgtatgattgatgatgacgtttactgtgatgatgtactaactcaaattagagcaacacgttcagcattgaatagtgtagctactaaattactagaccatcacatgaaaggttgtattatggaaaaaataaacgacggtgcgcaagaagaagcaatggatgaattgctcgtgacattccaaaaattaataaaagattaa

SEQ ID NO: 1427 - DNA, 669 bp, Staphylococcus epidermidis
gtaaggagtctatctatgaactcaagaatgaagattaaaaaagcttatgagtatatgaaaagtttccatcaacatgatacaactggacatgatattgcacatgtggaacgtgtctataacaacgcttgttatatcgctaaacgagaaaatataacagatacacttgttatagaactatcatctttattgcatgatactgttgatagtaaattaactgatgaaattttagcatatgatcagcttaaacagttcttatctaccctagatttaagcagtgaaatatcacaacaagttctctatattattaaacatatgagttatcgagctggtaaaaataatcacgttaaactttcaatagatggtgaaatcgttagagatgctgatcgcctagatgcaataggagcaatcggcattgcgagaacattccagttttcaggacactttggtgaacctatgtggactgaaacgaagctttcaaatgaagagttacatacgtctctcgttgaagaattagacaattcagcaataaaacatttttatgaaaaattatttaaattaaaagatttaatgcacactcctactgcaaaaaaacttgctgaagaaagacatcaatttatgattcaatatctcaaacaatttatgtcagagtggaattttaataaagagtaa

SEQ ID NO: 1428 - DNA, 486 bp, Staphylococcus epidermidis
aataacatgcaatctacacaagattatattgaaatgcggttgccagcttctgcagaatacgtaagtttaatacgtttgacgctttcaggggtgttttcaagagctggcgcatcttacgatgatatagaagattctaaaatagcagtgagtgaagcggtgacaaatgcggttaaacatgcatataaaaaaaattctgaaataggcatgattaatctttgttttgaaatatttgatgatagaattaaaattgttatttcagaccaaggagaaagttttgattatgaagccacaaaatcacatttaggtccatataatgataatgaaaatattgattttctacgtgaaggtggtctaggattatttttaattgagtctttaatggatgaagttactgtttataaagaatctggtgtaacaatcagtatgattaagtatataaaaaaagagcaggtgcgaaataatggcgaaagagtcgaaatcagctag

SEQ ID NO: 1429 - DNA, 2187 bp, Staphylococcus epidermidis
gtaatttttaaagaaaagcgtggtagaaaaaaacaaatggataacagtttaattgaaacaattgtaagtaaatatcaattttcggaaaaacaaattaaagcagttttaaaattgctgaaagaaaacaatacggttccatttatagcgagatatcgtaaagaagctacaggtggacttgatgaagtagaaattaaacaaatcaatgatgaatataactatatgttaaatcttcaaaaacgtaaagaagaagtaatacataatattgatcaacagggtcttttaacttcagatttaaagcaagacatattaacacagacgaagctccaaagagttgaggatttgtatcgtccatataaacaaaaaaagaaaacacgtgcaactgaagctaaaagaaaaggattagaagatttagcagattggttttcacaatcaaaattggatacaaaaattgaagataaagcccaattattcttaaatgatgaagtgactacaattgaagatgcaatagaaggagctaaagatattatagctgaacgtatttcggataatcctcaatatcgctctaaaatacttaaagatgtttttaatcagggactaattgtttcctcgaaaaagaaaaaagccgaagatgagaaacaaacattttctatgtactatgattacaatgaaccaattaaacgtattgctaatcatcgtgttttggcgatgaatcgaggagaaaaagaaaaagtattatcaataaaaattgattttgacacgacacgtattcaaagagaaatagcaaatgttgagataaaaactcaaaatgaggcaactccgtttattaaagaggctattcaggatagtcttaagcgattaattcttccttcaatagaaagagaaattagaggagatttaacacaaaatgcagagtctcatgcaatagatgtattcagtgaaaatcttagaaatttattactacaaccaccaatgaaaggtaaacaaattcttggagtagatccagcatttagaacaggttgcaagcttgctgtcgtcaatccatttggtacctttattgctaaaggtgttatttatcctcatccaccaatatcaaaagttgaggaagcggaaaaagagctagtaaaggtgataagtgactataatattgagcttttagcgattggtaacggtactgcgagtagagaaactgaacaatttgttgctaaagtaataaaaaaatatcaacttcaagctcaatttatcatagtcaatgaagctggcgcatcagtttattcagcatcagaaattgctagacaagaatttccagattttcaagtagaagaacgaagtgcagtttcaattggtagaagagttcaggaccctttaagcgaacttgttaaaatagatcctaaatctataggagtaggacagtaccaacatgatgtcaatcaaaaagatttaagtagtgccttaacgtttgtagtagagactgccgtcaatcaagttggtgtggatgtgaatactgcttctaaatccttgttacaatatgtatcaggtcttacatcaactatcgctcaaaatattattgattatagagaagaaaacggacctataaaacatcataaagaaataagtagtattaaacgattaggtgcaaaaacatttgagcaaagtattggttttttaagaattgttgatggtgaagaacctttagataatactgcaatacatcctgaaagttacgatgttgcatatcgcatgcttcatcaactagatttaactgcacaagatataggttccgttaaactcaaaaatacgttatcaaatgttaatatttcaacacttgtgtctcaattaaatattggtgaacctacattaaaagatataatacaatctttgattgcacctaatagagatccaagagatgaatttgaaacacctattttgaagtccgatgtattatcgattgaagatttatctaaaggcatgaagttgaatggtacagtaagaaatgttgttgactttggagcatttgtagatatcggtgttaaacaagacgggctagtacacatatcaaaattatctaagaaattcgttaaaaatccaatggatatgataagtgtaggagatattgtagaagtttggattttagatatagatgaaaataaaggcaaagtttcattgactatggttgacccaaatgaataa

SEQ ID NO: 1430 - DNA, 219 bp, Staphylococcus epidermidis
aatgttaataatcataaaaattatatgtttgatgattgttgtcttatgaattttatcattagacgtcttattaattgtaaagtaataatcgatgacttgaatatgatgatgtcacttttttatattattaatgtccatataaaggtaattttagttatccttgacttacgctatggtagtaaaataaataaaaagaacatatttgtattttttaattga

SEQ ID NO: 1431 - DNA, 1026 bp, Staphylococcus epidermidis
agtggaagtaaggaggcgcatttcgtggaagaattcacaaaaagttataaagcccttgttaaagaaagtttaataactaacaataaaacattattaattaagaaatgtgaagcattcacaaatgaagttataaagaaagatgttttacctgaagatatagttgagatacataaagattatattaatacattagatttaactgaagaagatatattagaaacactcgatgtgttacaagaagtcgttaaaggatttggatatagttaccgagattaccaaagacttgttaataagcttcaagtccacgataaagaaatggatttagcctcaagacttcaacaaactatgctgaaagctgatattccacaatttgatagcattcaaataggagtgatatctgttgctgcacaaaaagtaagtggtgattattttaatcttattgaccataaagatggcacaatgagttttgctgtggcagacgttataggttcaggcataccagcagctttagctatgagtatgataaaatttggcatggatgcttatggacattcacaactacctagtgatggtttgaagcgtttgaaccgtgttgttgaaaagaacgttaaccaaaatatgtttgtcacaatgttttatggactgtatgaagagatgaatcatctactttactgtagctcagctgggcatgaacctggctatatatatcgcgcagaaactgaagcgtttgaggaaattggtgtgcgaggaagagttctaggtgtgagtcccaaaacacgttatagccaacaggaaatccctatttatcttgatgatttaatcataatttttactgatggtgttacagaggcacgtgatgtagagggtaattttattgataaagataagttgttagacttaattcaaaaatataagcatatgcatccacaggatatagttcaaattatttacgaagcgattttaaaattacaaaatcctgcgagaaaagatgatatgactattttaattataaaaagagtaaactaa

SEQ ID NO: 1432 - DNA, 327 bp, Staphylococcus epidermidis
atgaatctaaatattgaaacaataactcatgatgatttttatgaggttaaagttggtggagaattggacgtatatactgtacctgaattagaagaggtactagtaccaatgagacaagaaggcacacatgatgttcacgttaacttagctaatgtgagctatatggattcaacaggtctcggtttattcgtaggcacgttaaaagcattaaatcaaaatgataaaaatctctatatcttaggtgtttcagagcggataggtagattgtttgatattacaggtttaaaagatttaatgcatgttaatgaaggaacggaggtagaataa

SEQ ID NO: 1433 - DNA, 186 bp, Staphylococcus epidermidis
cggcttctgaaacttaatattatcatatttttaaattcaattgcatttgataatctaaatatagaactaaattttaatgacaatttgcgccaatatacatatttttattatgactattacatattaaaagttaataaggtgctatcattctgtgatattctagcaaatttaaaagaagtcatgtaa

SEQ ID NO: 1434 - DNA, 216 bp, Staphylococcus epidermidis
gagggtatgaaattgaaaaaaggattgataaatgtttcaggtattaaaacaactgaacaagctaaacagctcaaagatcatttatctaagatgataggcatcaatagtgtggatatcgattaccaaatgaatgagattcgagtagaatttgacactcctgcaaatttaaataacattgaaaaagaaatttacgattacggatttcgtattttgtaa

SEQ ID NO: 1435 - DNA, 186 bp, Staphylococcus epidermidis
ttatgtttagatatcgttttagccaaagcaagtataagtataattttcatgaattcggaaggttggatgcttataggaccgaaactgtaccaacttttagcaccattaataattggggtgattgaagtttcaggtaaaataagtaaccctattaatagaacgcaaaatatactatataaaatataa

SEQ ID NO: 1436 - DNA, 1488 bp, Staphylococcus epidermidis
cctatgatagaagtctttactatggcacttcatcaatctaatattataattaatattttattagttagtgcctttttattaaatttagtttttgcattcattattattttcatggagaggcgtacagcaaattctatatgggcgtggttattggttttagtttttctacctttagtaggattcatattgtatttattattaggtcgccaaatacagagagaacatatatttaaactcgccaaagaggataaagttggtcttgaaatgattgttgacgagcaattagaggcattgaaaaagcaagacttttctaagggtaatcatcaaattgttaaatttaaagaaatggtacaaatgttactttataataatgctgcttttttaacaactgataatgatctaacaatttatacagatggtcatcagaagttcgatgatttaattaatgatattagacacgcacaatcatatattcacatccaatactacattattcatagtgataatctcggaaagcaattgttacatgaattagaaaaaaaagctgaagaaggtatagaagttaaaatgctatacgatgatatgggctcaagagatttacgaaagaaagatctaaaaaagtttcgtcaaaaaggcggtcacgctgaatctttctttccatcaaaattaccacttattaatttaagaatgaataatagaaaccacagaaaaatagtagtcattgacggtacgattggatatgttggtggttttaatgtaggagatgaatatataggtaaatctaagaaatttggttattggagggacacacacttacgtattaaaggtgacgcggtaaatgcccttcaacttagattcatcttagattggaactcacaatcaactcgtgacaatttaacttatgaatctcgatattttcctgatgttgactctggtggtacgataggcatacaaattgcttcaagtgggcctgatgaagattgggaacaaattaaatatggttatttaaaaatgatttcatcagccaaagaatctatatacattcaatcaccatacttcattcccgatcaagcttttttagattcgattaaaattgcagcgcttggtggtgtggatgttaacatcatggttcctaacaaacgtgatcatccctttgtttattgggctacgcttaaaaacgtagcgtctttacttgaagctggcgttaatgtctatcattatgataatggttttctacattcaaaaacacttgtcattgatgatgaggtagcaagtgtaggaactgccaatatggataatcgaagctttacattaaactttgaggtcaatgcttttatttatgatgaaggcgtagcacgatcattaaaacaagctttcattaatgatatgaaattatctaacaagctcacttctgaagaatatgctaaacgaaatctgctagttaaattcaaagaagggatttcacaactactttctccaattttataa

SEQ ID NO: 1437 - DNA, 375 bp, Staphylococcus epidermidis
tatactaaagaggcgatacaagtgatttatggaataggtatagatttaatagaaattgaacgaattaaaaatcttcagaatcaaacaaaatttattgaaagaatacttactatagaggaaagagacaaattaaatcaatatacaaacgagcaacgtagattagaatttttagctggacgctttactgtgaaagaagcatttagtaaggccttaggtactgggttggggaaatcagtatcgtttcaggatattaactgttacaacgacgctctaggtaaaccatgtattgactatcctggtttttatacacatgtgagtattacacatacggagaattatgctatgagtcaagttattcttgaaaaaaacgaatga

SEQ ID NO: 1438 - DNA, 522 bp, Staphylococcus epidermidis
aaggtgatactcatgaagtcttataaatatatgcatcaaaacggtattaaagtaatgagaattagtggtgctttttggacacttttacttgtgatagcattgtctattttaatattgcttaatgaattaaaattccattttattgatactaaaaatttaataattggagtaataattttaactacaatagtttgtattttatttatgattatagtgccttggtttaaatttaaacatcttagatattttttagatgataaagaaatacatattagagaaggtatcatttttatagatgtgcacgtcatcccttactttagaatacaaaatatagatatagttgagggatttatcatgagaaagttccaactcgcttcgctgtcattatcaactgctgggggaaattctgaaatagcattgatagatattcaagaagcacaaagattgaaaaaacaaattaaacaacaaaaatcaataacgacaaatgtaacttcattagaaaaattaaacgatgatatataa

SEQ ID NO: 1439 - DNA, 276 bp, Staphylococcus epidermidis
gggatgacgtgcacatctataaaaatgataccttctctaatatgtatttctttatcatctaaaaaatatctaagatgtttaaatttaaaccaaggcactataatcataaataaaatacaaactattgtagttaaaattattactccaattattaaatttttagtatcaataaaatggaattttaattcattaagcaatattaaaatagacaatgctatcacaagtaaaagtgtccaaaaagcaccactaattctcattactttaataccgttttga

SEQ ID NO: 1440 - DNA, 792 bp, Staphylococcus epidermidis
aaaaagagcaggtgcgaaataatggcgaaagagtcgaaatcagctagtgaagtatcacctgaacaaattaaccaatggattaaacaacatcaagaaaacgaagatagccaagctcaagataaattagtaaaacattatcgtaagctgattgaatctttagcttataagtattctaagggacaatcacatcatgaagatttagttcaagttggtatggttggtctaataggtgctattaatagatttgacttatcatttgatcgtaagtttgaagccttcttagtaccaacagttattggtgagattaaaagatatttacgagataaaacatggagtgttcatgtacctagacgtattaaagaaatcggtccaagaatcaaaaaagttagtgatgaattaacaaatgaacttgaacgttcaccatctattagtgaaatcgcacaacgcttagaagtttcagatgaagaagttttggaagcgatggagatgggtcagagttacaatgccctaagtgtggatcactctatagaagcagataaagatggttcgacagttacattattagatatcatgggacaacaagatgataattatgatttaacggaaaagcgtatgatattagagcgtattttacctattttgtcagagagagaaagacaaatcatacaatgtacttttattgaaggtcttagccaaaaagagactggtgaaagaattggtcttagtcaaatgcatgtttcacgtttgcaacgtaccgcaataaaaaaattacaagaagctgcaagacagtaa

SEQ ID NO: 1441 - DNA, 1083 bp, Staphylococcus epidermidis
  unsure (1060): Identity of nucleotide at the above locations are unknown.
gtagtttcaaggaggacatatatgtcagagaagttttatagagcaacatatttaaatgtgaatttagatgcaattttagcaaattatcaaaatttcaatcaattacacgctaataagactgtcatttcagtcattaaagccaatggatatggattaggaagtgtgaaaatagcacaacatttaatgcgtcatggtgcaacattttttgcggtggctacacttgatgaagcaatagaattaagaatgcatggagttgatgctaaattattagttttaggtgttgttccaacagaagacattgagaaggctatacagcatcgtgttgctttaacagtaccttctaaagcatggttgaaggaaactatcaagcaaattcctgatgataaccaaaaaaatttatggctacatgtaaaattagatactggtatgggccgaattggaatgaaagatatagatgaatataaagaagtggttgatttaattaataaaagagatcatttagtttttgaaggagttttcacacattttgcgagtgcagatgaacctggaaattctatgaatgaacaatatactttgttcaaagagatggttaatcaagttgagaaaccaaactatattcattgtcaaaattctgctggatcactactcatggatggtcaattttgtaatgcaataagattaggaatctctctttatggatactatccttcagaatatgttaaagataatgtaaaagttcatttaagaccaagtgcgcagttagtatcagaaaccgttcaagttaaaacacttaaagctggtgaaactgttagttatggacgtacatatattgctgatgaagaaatgacaattgcaattttacctattgggtatgccgacggatatttaagatcgatgcaaggtgcgttcgtcaatgttaacgggagtcaatgtgaagtcattggacgtatttgtatggaccaattgatagttaaggttccttctcatgtaaaaacgggtgataaagtaatacttatggataatcacgttgattcaccaccatcagctgaaaccgtacccnataaacaaggtaggactaactag

SEQ ID NO: 1442 - DNA, 501 bp, Staphylococcus epidermidis
atcttgaaaaggagtacatttatgaaaaatgatagtacgtttcatagaagcccaatccaagcgctaaagtactattacataactagttgcataggtttatttattttgcttgttatacttagtttacttttgtattttagctatttaaatcattggtggccttttacatcctacatctttcttgggctaggtttgttatcgattttaaacacttgtatatctccactaattaaatatagatatcattattataaaattcacgaagattttgtcatattaaaaagattatttatttttaggaaagaagaattaagtaaaatagagagaatacaatttatcgatattggaactaatccgttatcaaaaaaattaaatcttaattccataactttatttactgcaggtcatacaatctcatttccaataatatctgagaaagaagcacaaaatattcaacaacaaatactattgagattgagaggtgcaaatgacgatgtatag

SEQ ID NO: 1443 - DNA, 363 bp, Staphylococcus epidermidis
atgattagaagaggagatgtttatttagcggatttatcaccagttcaagggtctgaacaagggggagtaagacctgtagttatcattcaaaatgatactggtaataaatatagtccaactgtaattgtagctgcgattactggtaggattaataaagcgaaaataccaacccacgtagaaattgaaaagaaaaagtataaattagacaaagattcagttattcttcttgaacaaattagaacactagataaaaagcgtttaaaagaaaaattaacatttttatcagagagtaaaatgatagaggttgataatgccttagatattagtttgggattaaataactttgatcatcataaatcttaa

SEQ ID NO: 1444 - DNA, 837 bp, Staphylococcus epidermidis
ctattgattggcctatcaggttgtgattactctacacctgagaagcaagatggattcttctttaatacttttgttcaacctatgaaacatctcttacagtggttaggaaatgatgtttttcataataattttggactagcaattattgtattagttcttttcattcgtttaatcttgttaccatttatgttatctaactataaaaatagtcacatgatgcgtgagaaaatgaaagtggctaaacctgaagtagatggcattcaagaaaaggttaaacgtgcgcgaacacaagaagaaaaaatggctgcaaaccaagaacttatggaagtttataaaaaatatgatatgaaccctatgaagagcatgttaggatgtttacctatacttattcaaatgccaattattatgggattatactttgtattaaaagataagcttgtaaatggtttatctgaacatccgcatttcttatggttcaatttaactaagcctgatatttggattacagttattgccggtgtgctatactttattcaagctgtagtttcaagcaaaacgatgcctcaagagcaacgtcagatgggctatatgatgatggttatttctccaataatgattatttggatttctttacaagcatcatcagctttaggtttatattggtctgtcagtgcattattcttagtaattcaaacgcattttgctaatatttattactctaaacttgctaaaaaagaagttcaaccttttattgaaaagtatgaaagagaacataatccatcttcaaagaaaaaagggaaaaatactcaagtagtatcaaaaaagaataaaaaataa

SEQ ID NO: 1445 - DNA, 1521 bp, Staphylococcus epidermidis
gaggtgcaaatgacgatgtatagtccgcaaaagctacatccaatttcttatattgatggcttgattagtgtgattaaatcaaatttcattgtaattatcatctttttatttaatataaaagattttaaatatgatgatttttcgtcttatattattccaggtataatgactttgatattttctatcggtttcattcataatattattaaggtttataatacacgatattggattgaagaggatcattttattttaactactggtgtttttaataaggaacgaaaagaactaaatattagtcgcatacaatctgcagatacgtctcaaggtttgattaatcaaattgttggcggcgttgaactcatcattaaaacaccaagtgatggcatagaattagggacaatttccaaaaagcaaagtgaagttattgaacaagaattgcgatctattcaagaacgcatgaataaccaggtaaatcaagaagctaaagagttaaatgatgagaatcatactcagacatatcaacaacatgccaaaccccaatatgcaatatttaaaatgccttttaaacaactattatttatgtctatgacaagtggagctatagcacttgcttttgtgacactatctcctattattggcagtctctcaagtgttattccatgggataaatttggtgaagaaatatcttcggtatttaaaacgatatatttcattgtcatttttattgtcatactagtgttattattaagttatataatcggaactatcatgtacttaataaagttttatggatatcaagttattcaagataatcatcaacttaaaattcaatatggattatttacaaagaaaaatatcactgtaccaactgaccgactgcaaggtgtacttgaacatcaatcttttatacgaaaattatttggttatacatctatacatttctatattacaagtgatatagatactactgaaggggaacccactgataatgatggaagaattatgattttaccgtttattccaagaaaagaggcatataaagtgattaggcctttggttcctgagatgacatttaatcatgctaaaattggcatgcctttaaaaggatttcatcgtcactttctaattccttccttatgtattattggtatgggcattattggatggtatatgtggtctttatggtctttaatcatagctttattaccaatcttattattttttgtttacgctatactttatacacgttttagtggttttgcttttagcgaatcagagctagttgtccaaaaagcgtctatattaaatattaagagattttatgttaaaaaagaaaaagttttaggaatggctattagccaacatccctttcttgaaagaagtcaactcgcaaattttcaatttgttattgctaagggtagtagtcagcaaaacattggtttgaagtttagtgaagtagataatgttcttaaactcaaaaattggtacatgaaaggtgatactcatgaagtcttataa

SEQ ID NO: 1446 - DNA, 207 bp, Staphylococcus epidermidis
tataacaacttttggaatcagatggaggttcttttcatgttatcttttaatcaaaatagaaaccacagtcttgaacaatctttaaaagaaggttatgcacaaatggccgatttaaacctctccctagcaacagaagcttttccgatagagtgtgaagcttgtgattgcaatgaatcacatttaatatctaattcaaagaatgaatga

SEQ ID NO: 1447 - DNA, 1374 bp, Staphylococcus epidermidis
ttattagaggttttagttatgataaacgtaacattagagcaaattaaaaactggatagattgtgaaattgatgaaaaacatttaaaaaaaacgataaatggggtttcaattgattcacgaaaaatcaatgaaggggcgctatttataccttttaaaggtgagaatgttgatggccatcgttttatcacgcaagcgttgaacgatggtgctggagctgtttttagtgaaaaagagaataaatattctgaagggaaccaaggtcctattatttgggtagaagatactttaatagccttacagcaattggcaaaagcatatctaaatcatgtgaatcctaaggtgatagcggttactggttctaatgggaaaacaacaacaaaagacatgattgaaagtgtattatcaactgaatttaaagttaagaaaacacaaggaaattataataatgaaattggaatgccgttgactttactagaacttgatgaagacacagaaatttctattctagaaatggggatgtcaggttttcatcaaatagagttgttatctcatatcgcacaacctgatatagcggtcatcacaaacattggtgagtcacatatgcaagatttaggatcgcgagaaggcattgcaaaagctaaatttgaaataacaactggtctcaaaacaaatggtatatttatttatgacggagatgaacctttattaaaacctcatgttaatcaagttaaaaatgcgaaattaataagcattgggttaaattcagacaatacatatacttgtcatatgaacgatgtaaaaaacgaaggtattcattttactatcaatcaaaaagaacattatcatttaccaattttgggcacgcataatatgaaaaatgctgctattgcaattgctattggacatgaattaggcctaaatgaaacaataattcaaaataatattcacaatgtgcaattaaccgctatgagaatggaaagacatgaatcatcaaataatgtaacagtaattaatgacgcatataacgcaagtccaacgagtatgaaagctgccattgatacattaagtggcatgaaaggtcgaaaaattttaatattagcagatgtacttgaattaggacctaatagtcaattgatgcacaaacaagttggtgaatatttgaaagataaaaatattgatgttttatatacatttggtaaagaagctagttatatccatgatagtggtaaaatttttgttaaagaagcaaaatactttgataataaagaacagttaattcagacgctaatatctcaagttaaacctgaggacaaagtcttagttaaaggttcacgaggtatgaaacttgaggaagttgttgacgcattgttgtaa

SEQ ID NO: 1448 - DNA, 2217 bp, Staphylococcus epidermidis
tattttagattggtgcataataaagataaattaatgaggtgtatgtatagtatgcaaactcgattgggagaaaaagatattaatttaccgcagtattacaacaatagggagttaagttggctagattttaactatagggtattacaagaatcatatgataaaaataatccgttgcttgaaaaacttaattttatttctatcttcagttcaaatttagatgaattctttatggttcgagtggctgggttaaaagaccaagtcaaaatgggatatgacaaacctgaaaataaagcacaaatgacgcctcaagaacaacttgatgctattaaaattaaaaatacagactatgtgaacactcaatatcaacgttataacgaattaattaaagaattagccaattacgatattgagatggtaaaacctgaagacttatcagatgcattgatagaaaaattagaacaagagttcaagttaagtgtcttgccgacactcactccgttaggtattgatgcgtatcatccatttccaaagttaaataataaaagtttaaatatttttgttgatatcgatacggaagatgccattaattcagctatcgttcaaattccttcattaattccacgctttttaactttaaatgagggtacaaaacaatacgttgtcatggtagaagatgtgattacgtatttcatcaattatttatttacaggatacgaagtactaaatacttttactttccgaatcacacgtaatgcagatttaaccattcatgaagatggcgctgaggacttgcttatagaaattgaacgtttcttaaaagaacgtaagagtggttcggctgtacgtttagaattagattgtcgcacttctgaaaaagagaatgtagaatggttaatcaatcaattagaaattgaagataatgatatttattatttagatggtccacttgatttaacattcttatttggattggttgatcatctatctcataagctcaaatatttaacgtatgagaaatatactcctcaaccacctagatcattaggcaacaagaatatctatcaattatcattagaaagagatatattcttccaccatccgtatgaatcatttgaaccaatagttgactttattcgacaagcagcagatgacccaaatacaatcgctatcaaacaaaccttgtatcgagtgagtaaggattcgccgattattaacagcttaaaagaagctgctgaaaacggcaagcaagtaacggtgctcgtagaattaaaagcacgctttgatgaagaaaataacgtacattgggcacgtatgctagaagatgctggctgtcacgttatttatggtatgacacatctaaaaacgcatagtaaaattgcgctagtcgttaaacgcatcaacaatgaacttacgtcatttgttcatttaggcacaggtaactataatgataaaactgctaaattatacacagatatgggtatcattacgacaaataaagatatcgctgaggatgcaattaacttctttaattacttgagtggttactcaacaaaaccagaatacaataaattgattgtagcaccatacgatattcgagacgtcttcattgatcgtatcgataaagagatacgtagtcatttacaacatggtaatggtaaaattatgatgaaaatgaactctttaaccgataaaacgattatcgaaaagctcttcgaagcatcccaagcaggcgttaaaatacaactcatcattcgtggtatatgttgtcttaaaccaggcattccaggtattagcgaaaatatagaggttgttagtatagtgggtcgtttgcttgaacattcacgtatttactacttccataataatagtgaggcgcatatttatttatcttcagctgacgttatgacacgtaatatgattaaacgtgtcgaaatattgttccctgttgaagataaatcaataggacaacgattagttaactatatgaatttacaattatctgacaaccaaaaaggtcgttaccaagatgcacaaggcctttatcattatgtcgaaaacaattcatctcctttaaactctcaatcttacttgatgcaagaagcaattaagtatggagaagaactaaaaaaacaatcggtacaaccttctggacaacctgttcattctagacgtggcggtagttggatgcgaaaattaaaaaacacatttaaaagataa

SEQ ID NO: 1449 - DNA, 591 bp, Staphylococcus epidermidis
acagcaatatctttcaaaaggggcaagctaattatgaatatatataataaagtgacattatctgtcattttagttataacaattatcatttcgttcctcttttatttttatacaacagagaaaaaagtggacaaagataaattgtatgaaaacaaaattacaaatcataaacaagcaggtaaacctaaaaattatggtgtcgcatctaataataaaatagctacgaaagtcggaaataagattattgaagatggtggaaatgcggttgatgcggcaataggtgtttcttatgcactagcagtgacagaacctcattcatcaggactaggaggtggcggtgcgacacttacatataatggtaaagagaatgaaacgcctaaagcttatgaatataaaacaatgtcctcatatgaatataaagaaggcgacaaaattggagttcctggcttcgtgagaggattacatgatatgcacgcgaaagaaggaaaaatggatgagaaaaagattttagattacgttattccgcttgctaaagatggttttgaggtagattcagaactagtaaagaagtttgaaattatatggtcgtga

SEQ ID NO: 1450 - DNA, 231 bp, Staphylococcus epidermidis
tttgaagtatcattttgtttatttttgcgattgtgttctatttttttatcattcttattagaattcgtatggtggttaatagctgcatataatgaaaagcccaatgcgcatataagaatgattactactattgtagctgaaaattttttcaaagcgtatatcctccatcctttttatcaactatattttattataatccttttttttattgtaagtagaattattctataa

SEQ ID NO: 1451 - DNA, 390 bp, Staphylococcus epidermidis
atagctggatttgtactccactgcattaaattccacataaataagccaactaataataatcctgttcctggtaataataagttaagaattatcatcattattataaatattgaaatcgaaattattaaccaacgcttactagtaaacttatcagataaaacaccgcctaatgaagtaccaatcacacctgctacaccattaacaagtagtgctaaagacacaaaagacatttcatgtccattggataaaattaatggattaataaacacgaatgttacagaattagcaaccagcactaaaaatgtaatcatcagatatttaaaaacctcacgaggtcttatgacgcttgagccagtttgtgattcaatactagatgaacgaggtgtttga

SEQ ID NO: 1452 - DNA, 825 bp, Staphylococcus epidermidis
atagggggattaacgatgattaaagccattgcggtagatatggatggaacatttcttgacacaaataaacagtttgatcgaaatcgttttgaaactatttttaaagaattaatagataaaaatattaagtttatagctgcgagtgggaatcaatttgcaaagctaaaatcaatttttggagatagggaaatgttctttatatctgaaaatggagcagtcatctataaaggtaatcaactttacaattatcgaagttttgatcagtatatttttcaaaaagttgtaaattatttaaatttgaatcaaaagataaacaatttgattatttgtggtgtaaaaagtgcatatattttaaaagaaacaagcgaagcatttaagcaagatgcacgtacatattatcaccaactaatagaggttgactccttacaaacattacctgatgatgattatgtgaaaattgctttcaatataaatcgtcagactcatccagacttagatgagaaattagctcttaagtttaaagacgatattaaactagtatcaagtgggagagatagtatagatgttattatgccaaatatgactaagggtcaagctttgtctagattattaaaagaatggcaaatgcctgcttcacatttaatggcatttggagatgcaaataacgataaagatatgttggagcttgccgaacatagttatgttatggctaatagtgaagatcaatcattatttgatatagcgagtcatgtggcaccttccaatgatgaacaaggcgtactatcaacaatcgaaaatgttgttctcggttattccaataaataa

SEQ ID NO: 1453 - DNA, 1566 bp, Staphylococcus epidermidis
ttatcagaatcagccaattcattttatctacatgtagatgattttttaatacgtattgttaaggaatgtttgctgactcatgttaatagtaagttgatgttatggaggtttgttatgggaagtttttttaatcggatgactcgaaaagagaatcctactatttatcaaagtaaagatgggcatcttaaacgcacattacgtgtacgcgactttcttgcactaggtgttggtacaattgtttctacatctatcttcactttaccaggtgttgtcgcggctgagcatgccggacctgctgtttcattgtcattcttattagctgctattgtggcaggtcttgtagcctttacttatgcagaaatggcatctacaatgccttttgctggttcagcttattcatggattaatgttctttttggtgaattattcggatgggttgccggttgggcgcttttagcagaatactttattgctgttgctttcgttgcttcaggcttttctgctaacttaagaggtcttattgcaccattgggcatttctttacctaaatcattatctaatccatttggaagtaacggtggtgtcattgatatcattgctgctgtagtgattattttaactgcattactattatcacgcggaatgaacgaagccgctcgtatggaaaatgtattggttatattaaaggtgttggccatcattttatttgtgattgttgggctaactgcgattaatttcagtaactatataccttttattccagaacataaagttactgaaactggcgactttggaggttggcaaggtatttatgctggagtttcaatgatttttttagcttatattggttttgactctattgctgctaattcagctgaagcgattaatccacagaagacaatgcctagaggaatcttagggtcactcatagtagcaattgtattgtttgtggccgtagcacttgttcttgttggcatgttccattactctcaatacgctgataatgcagagccagtaggttgggcattacgagaaagtggtcatggtattattgctgcaattgttcaagcaatttctgtcatcggtatgttcactgcattaatcggtatgatgcttgcaggttcacgtctattatattcatttggacgagatggtttactcccttcttggttaagtcaattgaatcacaaacatttacctaatcgagcacttgccatacttacaatcattggcgtagttatcggatcaatgttcccgtttgctttcttagcacaattgatttccgcaggtacccttgttgcattcatgtttgtgtcactagcaatgtatcgattaagaaaacgtgaagggaaagatttacctaagccagagtttaaattacctttatatcctatattgcctgcaattacatttatattagtattgctagtattttggggattaagttttgaagctaagttgtatacactgatatggtttattgtaggtataattatttatttaatttatggaattagacattccaaaaagaatgatgaagaagcgtatcaagtacctagaaaataa

SEQ ID NO: 1454 - DNA, 201 bp, Staphylococcus epidermidis
attgctctgtcttctgctttctctttagcaaatatgattgttaaaattactgttatggtagccaatataccaccaatgagaattgcagatccacgtaaaagtgcttcttctggggctatcggtaagtttatagataagcaaaacgttactaaaaagaatgtcgatgatggaccagcgatttttagtgcattaaacgtataa

SEQ ID NO: 1455 - DNA, 312 bp, Staphylococcus epidermidis
tataacatgtcatttaatatttggatgtggattttacttgtattatttattgtggggacaatagctgtaattctcattttaacagttggctcagtgttagaagagcgctcatatgaccgtcgatcagaagatgaaaagcgcaaaaatttagaaaaaaatcttgagatgtcaaagggacatacagatgtatcgcaagagtcgagcaatggggaagaacaagtaacacaagagcattctcaacatgtcgttcaagatcatcaacaaacacatcaaaatataaatcaatcaacacaagataatagaaataattag

SEQ ID NO: 1456 - DNA, 225 bp, Staphylococcus epidermidis
ctatatgcgtctggcgttaaggtagcaatacctgttttaggatcatacgtcgcagatccagacagattcatatgttcattaaagttatctttgttcaccacaacagaattagatgtcagacttgaagttgttgtcgtggacgttgttgtcggtgctgccatcgtattcaaaacagtaaatctactaaatgttcttaaatttgcaaaggaagtaggactcgattga

SEQ ID NO: 1457 - DNA, 1458 bp, Staphylococcus epidermidis
catctaactttaacatatatagagggtgaaacgatgtcagggaaactagaagaattacaattaaaagtagctcgattaagtcgacgtactcatgaattaggtattccaattatggtattatttgaggggattcctgcttcggggaagacacgtttatcaaatgaattactattgcacctagatgccaaatattcgcgatttatagctactaaatcgccagagtcaaacgatttacgttaccaatttttacaaaaatattggaatactttaccacaaaagggcaatataaatatttattttagaagttggtattcacactttttagattataaagaaaataaaattaagcatgatcaatataaaaattatgatgttttagtcaatcaaatttatcattttgaatcgatgttaaagaatgataactatgaaattataaaatttttcatagaaataaatgaagaaaaacgcaatgaacatattcaacagacaaaagataatccattaactagatggaaagttcaagaatatgaaaatgttatacctcaagaaagttatctaaatcaaatgcatcaattcatcaacaaagataaagattggaaagtgatcgattacacagagcgcgagcatgcttttgaaaaaatgtacttacatttaatagatagacttgagcaagctataaaaaaagttgaacaacaaacaactaaagtcaacggtaagttcacatcaagctttacgacttctttatttaataataatcttgagaaagtagacaaaaaaacgtataaaaatctcattgttgaattgcaacagagaatgagagaaatccaatttgctttatatgaaagaaagattccccttgttttggttttcgaaggtatggatgctgctggtaaaggtggcaatattaaacgtattagagaaaaattagatccaacaggatatgaagtgaatggtattagtgcacctacggatgtcgaacttaagcatcattatttgtggagatttgctaaaaagatgccaaaatcaggtcatataaaaatatttgatcggagttggtatggtcgtgtactagttgaacgtgtagaaggttttgcaagccagaatgaatggcaacgagcatctgatgaaatcaatcaatttgaaaagatgtggacagatgaaggtacaatcatattaaaattcttcttatgtttagataaagatgagcagcttaagcgttttaaagaccgtgaaaataatcctgataaacaatggaagattactgaagaagattggcgtaatagagaaaaatgggatgaatatttagaagcaagtcatgatatgattgaatctacaaacacttcatatgccccttggtatattgttccggcagatcataaaaaaacgagtcggattgaagtacttaaaacaattattagaaaatgtgaagaagtactatggggagttaagacgtattaa

SEQ ID NO: 1458 - DNA, 1311 bp, Staphylococcus epidermidis
ttcaaaacttttcacaatttttgtaaagcgcttacatatttattatatattcctggtcatgtctgttatatttcattgtataaaacgaattttctttggtatgatactagtgctacttcaaaaaatgaaaggatgtcacaccttatgaatataggtatagataaaataagtttctatgtacccaaatattatgtagacatggctaaacttgcagaagcgcgccaagtcgatcctaataaatttttaattggaattggtcaaactgaaatggctgtgagcccagtgaatcaagatatcgtatctatgggagccaatgctgctaaagatattataacagaagaagataaaaagaatattggtatggttatagtagcaactgagtctgcgattgataatgccaaagcagcagccgttcaaattcaccatcttttaggtattcaaccctttgcaagatgctttgaaatgaaagaggcttgttatgcagcaacacctgcaattcaacttgccaaagattatcttgctcaacgccctaacgaaaaggttcttgtcattgctagtgacacagctcgttatggtattcattctggtggtgagcctactcaaggtgccggtgcagttgcaatgatgatttcacataacccaagtattttaaaacttaatgatgatgccgtagcatatactgaagacgtttatgatttctggcgtccaacgggtcatcaatatcccttagttgctggtgcattgtcgaaagatgcctatatcaagtcattccaagaaagttggaatgaatatgcacgtcgccataataaaacactcgctgatttcgcttcactatgtttccatgtaccattcaccaaaatgggacaaaaagctttagattctattattaatcatgccgatgaaactacacaagaccgtcttaactctagttaccaagatgcagttgattataatcgttatgtcggtaatatttacacagggtccttatatttaagtctcatctctttattagaaacacgtgatttaaaaggcggacaaacgattggtctctttagttatggttctggttctgtaggcgagttctttagtggaacattagtagatggattcaaggagcaattagatgttgagcgccacaaatctttattaaataatagtatagaggtttctgttgatgaatatgaacattttttcaaacgctttgaccaattagaattgaatcatgaacttgaaaaatcaaatgcagatcgtgacattttctatttaaaatctattgataacaatattcgtgaatatcatatagcagaataa

SEQ ID NO: 1459 - DNA, 2091 bp, Staphylococcus epidermidis
tcttatttgttcatgctttttttgtggcacgtaaataagaagatagagaggaatgaattgattatgtttaaaaagctatttggtcaaatgcaacgtatcggtaaagctttaatgttaccagttgcgattttaccggctgcagggttgctattagcaattgggactgcgtttcaaggcgaagcgttacaacattatcttccatttataaaaaatgatattgttcaacaaatcgctaatatgcttacaggtgctggtggtattatatttgataatctacctattatctttgctttaggtgtagcaattggtcttgcaggtggagatggtgtagctgctattgctgcatttgttggttttatcattttaaataaaacaatgggggcattcttgcatgtaactccagataaattatctgatccaactaatggatatgcaaatgtattagggattcctacacttcaaacaggtgtgttcggaggtattattattggtgcactagcagcctggtgttataacaaattctataatattaccttaccatcatatttaggattctttgcaggtaaacgttttgtaccaattatgatggcaacaacatctttcattttagcctttccaatggcaattatttggccaacgattcaaaacggtttaaatgcatttagtgagggattattagattcaaatacaggtgtagctgtatttttatttggatttattaagcgattattaataccatttggtttacatcacattttccatgcaccattctggtttgaatttggttcttggaaaaatgctgctggagagataattagaggcgaccaacgtatttttattgaacaaatccgtgaaggtgctcatttaacttctggtaaattcatgcaaggggaattcccagtcatgatgtttggattaccagctgcagcattggctatttatcaaacagcaaaacctgagaataagaaagtagttgcaggtttaatgatttctgctgcattaacatcatttttaactggtattactgaaccattagaattctcattcttatttgtagcaccattcttattcgtaattcacgcagtattagatggtttatcattcttgacactatacttgttaaatgtacatttaggatatactttctctggaggatttatagattatgtcttattaggtattctacctaataaaacagcatggtggcttgtcatcccagtaggtattatttatgcagtgatttactactttgtatttagattccttattgttaaatttaactataaaacaccaggtcgtgaagataaaaaatcatctgtaacaactacatcggctagtcaactgccattcgatgttttgaaagcaatgggtggtaaagaaaatattaaacatctacatgcttgtattactagactaagaatacaagtaaatgaaaaatcaaaagttgatgttgccggccttaaatcattaggtgcttcaggagtacttgaagtcggtaacaatatgcaagccattttcggtcctaaatctgatcaaatcaaacatgatatggctaagataataagtggagaaattacaaaaccaagtgaaacaacaattgatgaagaagtgtcagatgagtctgtacatgtggaagatattgtagaaacagaaatttacgcacctggacatggtgagataataccgttatctgaagtacctgataaagttttctctgaaaagatgatgggtgatggtatcggatttgtaccagattcaagaaaaattgtagcaccatttgatggtacagttaaaacaattttccctacaaaacatgcgataggattggaatctgatagtggcgttgaagtgttaattcacattggtatcgatacagttaaattaaatggtgaaggttttgaaagcttggtaaatactgatgaaccagtaacacaaggtcaaccattaatgaagattgatttagaatacttaaaggaacatgctccaagtattattacaccagtaatcataacaaaccaagaagacaaaacattaacaattgaagatgtaaaacaagtcgatcctggtaaagcgattatgacaattaaataa

SEQ ID NO: 1460 - DNA, 1590 bp, Staphylococcus epidermidis
ggggtattgtttatgtcagttttaactgtcatgcaattcatagtcaatattatcatcatgattgtgttattaacgattatgattcttgggggtatttggttatttaaagataaaggtcaaaatcaacacagtgtactaagaaattttcctgttttgggtcgaatccgttatatttctgaaaaaatcggtcccgaattaagacaatatttcttcgctaacgataatgaaggaaaacctttttcacgaagtgattataaaaacatcgttttagctggaaaatataaatcacgaatgaccagttttggtacagggaaagattacttagagggattttatattcaaaatacgatgttcccacttcaagcaactgaattacatatcgatcatactgaattcatttctacattcttatatcatattgagaatgagcgcctatttagtagagaagaatacagaaaaagcgctcaggttgatccgtttttcttaactgatgaacatgcagtagtattgggctctaaccttaagcatccctttaaaattaaacgcttagttggtcaatctgggatgagttatggcgctttaggtaaaaatgcaattactgcactgtcaatggggttagctaaagctggtacatggatgaatacaggtgaaggtggattatctgaatatcatttgaaaggtaatggtgacatcatctatcaaattggtccaggactctttggagtaagagatcatgatggcaattttaatagagacatgtttatcaatcttgccgaacacaataatgtacgcgcatttgaaattaagttagctcaaggtgctaaaacacgtggtgggcatatggaggggaacaaagtcacagaagagattgcacgcattagaaatgtgaaaccatatgaaactattaattcacctaatcgttttgattttattaaaaatccaacagatttactgaatttcgttaatcatttacaatcgataggtcaaaaacctgtcggcttcaaaattgttgtcagtaaagttgaagaaatagaggcgttagttaaaacaatgatagagatagacacctatccaagctttattactgttgatggtggtgaaggtggtacaggcgctaccttccaagagcttgaagatggtgttggtttaccgttatttacagcacttcctatcgtttcaagtatgttagaaaagtatggcataagaaacaaggttaaaatttttgcgtccggtaaattagtgactccagataaaatcgctattgcattaggattaggtgcggatctcgtcaatattgctagaggtatgatgataagtgtaggatgcatcatgagccaacaatgtcatttaaatacatgtccagttggagtagcaacaaccgatcctaaaaaggaaaagggacttattgttgatgaaaaacaataccgtgttacaaattatgttacaagtttgcatgaaggtttatttaacatcgctgcagctgtaggcgttcatagtccaacggagattacttccgaccatattatctatagacaattagatggcactacaacgtccattcaggattataaacttaaattaatttcttaa

SEQ ID NO: 1461 - DNA, 1164 bp, Staphylococcus epidermidis
agcagattgttactcattatagcgtgtgttgcgcttattctctggctaggaattaaagagaagaagcgtcatgcaaatcgacttgaaaaaattccattacgtattaacataaatggaattcgtgggaaatctacgattactcggatggcttacagtgttctacgtgaggaccagtatagagttgttggtaagacaacaggaacagatgcacgaatgctctattggtttactgaaaaggaatatccagtaatcagaaaaccacaaggcgccaacattggagaacaacgagatattattcgtaaggtggttaaacaaaaagcaaatgccctagttaatgagtgtatggctgtaaatccagattatcaaattacctttcaaaatgatttagtaaaagcaaatatcggtgtaattgttaatgtgatggaagaccatatggatgtcttaggaccgacacttaaagatgtagcgcaagcttttactgcaacaattccatataacgggaaattagttgtaatgaaagataactatactagtttctttgtaaaggaagctaaaaagcgtaattcagaactcattgttgtagataaagacgtcataccagaatcatatttacggaagttcgattatttagtatttcctgataatgtagctattgtgttaggaatagcgcaagcagttggtgtagatgaagaaactgcattacaaggtatgttaaatgcaccagccgatccaggtgctgttagaattaaatatttccatgcaaatcgcacaaaaaatgtatttgttaatgcattcgctgctaatgaaccgcagtctacaaaagcgattttaaataaagtggaatcatataattatccatacgataagaaaataatcattctcaattgtcgttcagatagggttgatagaacacaactctttgttgataactttttaggtgaagtcgattacgatgttctcatttgtacaggaaaaagtacacaaatggtgacacagtttatggaaactatgccagaaaaaacatatatcaattatgaaggacgagactttgtagagattgaaaaaggtattctacatgaagctgagaatgcacttgtattttgtgtaggaaacatccacggcccgggtggtagaatagcggaattcatagaagggatagaataa

SEQ ID NO: 1462 - DNA, 747 bp, Staphylococcus epidermidis
gagggggctccgctaatgtctatagaaagaattatttatgacaattttcaaaacgatccatttataaatgaattagatattaatgatgagacaaaaggcgcttatgagattttaaaatgggcatatcaaacttatgaaaatgatattgtttattcttgcagttttggtgctgagagtatggttttgattgacttgatttctcaaattaaacccgacgcacaaattgtatttttagacactgatttacattttcaagaaacatatgacttaatagatagggtgaaagataaatatccgcaattacgcattaaaatgaaaaaaccggaacttacgttagaggaacaaggtgagaaatataatcctgctttatggaagaatgatcctaaccaatgttgctacatacgcaagattaaaccactagaagacgtattatctggtgctgtagcttggatatcaggtcttagacgagcacaatcaccaacacgagcacatacaaatttcattaacaaagatgaaagatttaagtcaattaaagtgtgtcccttaatctattggacagaagaagaagtatggtcttatatacgtgataaggacttaccttataatgaattacatgatcaaaattatccaagtattggttgcattccatgtacatcacccgtatttgattctaatgattcacgtgctggtcgttggtccaattctagtaagactgaatgcggattacatgtagctgataaaccataa

SEQ ID NO: 1463 - DNA, 1389 bp, Staphylococcus epidermidis
gctacgactttatatgtaaaggtgtgttcaaacatggttcaagtcaagataggtaactgtaccatcaatggcatacacaaaaagaatattgatgtattcttaggtatcccgtatgccaaatcgttcaataagatatctcgattccaacattcaaagcttatggaactaagcaaaccaatgattgatgcaactcatattcaatccatcccaccacaaccctacaattcacttgaagactttttttcgatgacagattcatcgtttaattcttttaaacaaaatgattattgcctgtttttaaatatttggaaaccatcatccaatcaaaatcatttacctgtagtgatttacttttatggtggtagttttcttcaaggacatggcacagctgaactatattgtcctgaacacatagtagaacaagaaaatataatagtagttacttttaattatcgcttaggtgcactcggctacctagattggtcttattttaatcaacatttgaactataataatgggatttctgatcaaattaacgttttaagatgggtacatcaatatatcgaacattttggcggtgatccaaataacgtgacactaatgggtcaatctgcaggtagtatgagtatcatgacattaatgcaaatgcccgaacttgatgattattatcataaagtgatgttactaagtggaacgttaactactgatacaccactcaatgcacatactaaagtacaacatttttcacaactcatgaggcattattttcctaataaaacacttaagacacttaacagtgatgacattttatatctaatggagtctcaaaaaatagagcgtggaagatctcgtggacttgatttgatttatcaacctattaaagatcatcatatgtcacgatccattaaaaaatttcccaaaccgacattcatgagttatacacacgatgaaggtgatatttatattgaagacgcaacacgcaccttaccttctgaacgttttattcacttgatgtctcaatatggtacacacgtcgaaaaaaatgatgccctcacaatgaaacaacaaagaaatgtaataacagagtattgttttgttcgtccgatttatctatttttaaatcaaatgaatagttgcgacacttggctagcacgttttgattggcaccaaccccatacctcctactttaaaagtgcatatcatatattggatttagtattttggtttggtcatctctctattttgactaaaaatcattattctgtaacccaacatgatatgaatttaagtcgtaacatgatatctgacttagcttattttgcccgaaaaggtaagatgccatggaaatgttatgaacctcaacatcaagcgttacatatctatagataa

SEQ ID NO: 1464 - DNA, 408 bp, Staphylococcus epidermidis
aaaggggtgttgttgatggaaaaagcaaaatttgtcattaagttaatacttcaacttgcccttatcatgcttattacttttataggcacagaagttcaaaaattacttcatatacctctagcaggtagtatcttagggcttatgctttttttcctattgttacaatttaaaattgtacctgaatcatggattaatgtaggagcagactttttacttaaaacaatggttttcttctttatcccatcagtggtaggaattatggatgttgcatctaatatcacgatgaattatatattattctttattgttattataattggtacatgccttgtagcactatcatcaggttatatcgctgaaaaaatgctagaaaaaagcaatacacgtaaaggaactgatcactcatga

SEQ ID NO: 1465 - DNA, 1293 bp, Staphylococcus epidermidis
attgttacgtttgaattcaaccactttacacaaaggatgggatatcaattggataaacgtcaatttgaaattttagatatgctagtgagatttaatactgaaagtccacctggacgtaatacagatccattgcaagatgaaatcgaaacgttacttaaacaactggatttttcaatacagagagaacagttatatgacaatgatagtgtgatagtagccaccttaaaagggcacaatcctaaagcgccaaaactgatattgaatggacatgttgatgtagcttctgtagatgacgatcaatattggcagtatccaccttttaaacttaccaacaaagatgaatggttatacggtcgtggcgttagcgatatgaaaggtggtatgtcttcattattctacgtcttggagcaattacatcaagcggggcaacgtccagaaggtgatattattgttcaatcagtagtcggtgaagaagtaggtgaagcaggaactaaacgtgcatgtgaaataggacctaaaggtgacttagcccttgtcttagatacgagtgagaatcaagcacttgggcaaggtggcgtgattaccggatggattacagttaaaagtaaaaatacaatacatgatggtgcgcgtagtcaaacgatacatgctggtgggggcttgtttggtgcaagtgccattgaaaaaatgacaaaggtgattcaatcgcttaatgaacttgaaaggcattggggtgtcatgaagaagagtcctggaatgcctccaggtgcgaatacaattaacccagctgtcatagaaggtggacgtcaccctgcatttattgcagatgaatgtcgattatggattactgttcattacttaccgaacgaaagttatgaatctgtagttaatgaaatagagcgatatttaaataaggttgcagaagcagatgtatggctcagagagaatccacttgaatttgaatggggtggtacatccatgattgaggataaaggagaaattttcccaagtttcactgttccgacacatcatccaggttttaagcaattagaagaagcacatgaacatattcataataaaaagcttgaacatggtatgagtacaactgtaactgatggaggttggacagcacattttggcattcccacgatattatatgggccaggtagtttagaagaggcacatagtgtagatgagaaaataaaagcaaaggaattagctcaatatagtgatgttttatatacatttttaaaagaatggtatgaacacccacaatcctataaatcatcatag

SEQ ID NO: 1466 - DNA, 1986 bp, Staphylococcus epidermidis
atgtatgcgtttacaattattgttaggaaaaggagcgtgcatactatgaaaatacttgcaattacatcatgtccaaatggaattgctcatacatatatggctcaagaaaaattagaacaagcagcaaaagatatgggcgttgatattaaggttgaaactcaaggaggcgtcggagcagaaaatgtgctcacttctaaagaaatcaaagaagctgatggaatcatcattgctgccgatagacaggtagatttatcaaggtttaatggtaaacctctcatcaatgaaagtgtacgtgaaggtattcatagacccaaggaattaatacaacgtgtgattgaccaagatgcacaaatttaccatgatcaaaatatttcttcaaatatatctagagaccaggaagaacctcataaaagtaatattcaaatggtatatcagcatttaatgaatggtgtttccttcatggttccatttatcgtcgttggcggtttactcatagctattgccttaactcttggaggacacaccactccaaaaggattagttatcaccgaagattcattttggaaatctattgaaaatattggtagtttatcgtttaaattcatggttcccatccttgctggttatatcgcggtgagtattgctgataagcctggtcttgttccaggtatgattggtggtgccattgctgctgatggtagtttatatggaagtgaagcaggagccggtttcgttggtggtatcgtcgcaggtttcttagcgggctatattgcaaaatggattaaacagattaaagttcctaaagctatggctcctattatgcctattattattatacctattctatcttctttaatagttggtctcatttttatatttgtaataggcacaccaatttcaaatatatttggtgcattaacatcatggttaaaaggaatgcaaggtgctaacatcattattcttgctcttattattggcgcgatgattgcttttgatatgggaggtccagtaaacaaagtagcattcttattcggttctgcattaattactgaaggcaactacactgtgatgggaatggttgctgtagcagtatgtacaccaccgattggtttaggtttagctacatttgttcgtaaacaccaattcaataaagcagaacaagaaatgggtaaggcatcatttacgatgggattatttggtattactgaaggggcaatcccttttgctgcacaagatcctctaagaatcattccagccaatatgattggcgcgatgattgcttcagtaatagcggcggttggaggtgtcggtgataaagttgctcatggaggtcctattgtcgctgtactaggtggaataagtaatattttatggttctttatagctgttgtcgttggaagcttagtaaccatgttcacagtcttgttatttaagcgtcacacccctgctatagcaaaaagcaataatggaaatgatacttctgttggaactgaaaatgtattttctgatgaccaatctattaatcacagcaaacaactctcacatcatatggtgttcgataaatcactcattgaaattaccaaggaaccaatgacaagagatcaagctattgatagattacttactaagttatgccatcgtcattacattacgaatatagaagaggtaagaaccgcaatccttaaacgagaggctgagtcaacaactgctatcggaatgaacgttgcaataccacatgctaaatctcatgcagttaaacgtcctatcgtcgctgtattaaatcataaagcaggtgtagagtgggaaagtctagatgaatcaaatcctcagctcatttttcttattgcagttcccaatgataataacgatacacatttaaaactgctacaacggttatcacgaacgctcatgaaagataatacgcgtgatgagttaattcatgctcaaagtcgtgatgaaatatttaatattttaaaagagatataa

SEQ ID NO: 1467 - DNA, 1035 bp, Staphylococcus epidermidis
cagaagaagcccaagcatctatttaataacacaacgaaatcaataggtaggctagcaggaaatgatgaaagtttaaaactaaatttgcgtgacatgttttctgaggtgtttaaatctcacaccaaagatgaagcggatgatgtatttattgctggaacaaagcgtacgacgccacatattaatgaagtttcggaggagtggggaagaccttgggtgttctcgcgtgtatttttagctttaggtatcactttcctagcgttatggatattaacaaatatatttgataatgccaatgccataccaggtatgatatttattggcgcactattagttcctatttcaggattaatcttcttcttcgaatctaatgcatttaaaaatattagtatctttgatgtaatgaggatgttctttattggtggtgtattgtcactcattagtacaatgattttatatcaatttgttacatttagtactgaatcgcaatactatggaattatgactataacagatgcattcatagtaggatttgttgaagagcttggaaaagcaactgttgttattttatttattaattatttaaaaacaaataaaatactcaatggattacttatcggtgctgctgttggtgcagggttcgcggtgtttgaatcagccggttatatctttaggtttggatttaatttatttgatggagctaataatattactgaaatcactatacaaagaggttggacagctttaggcagtcacctcgtttgggcagctattgttggtgctgcggcagtaatagtgaaagaaacaaagcatttcgaatgggcgaatatcatcgataaacgttttatatttttcttttttgtagcagtgacattacacggaatatgggatacggaaataacacttttaagtagtggttatttaaaatatatcttattaattatgattgcatggctatttatatttatacttatgaaagcagggctaactcaggtgaatcagttgcgtgatgaatacaatcgtttagaggaaaggtga

SEQ ID NO: 1468 - DNA, 906 bp, Staphylococcus epidermidis
aaagaacagttaactgaagacaatgtccaatctattgaaggatttgatggactatcattgtctcaaacattaccattatcagaaacaatttataataaattaaatcaacttggaattcggcagatcgctcaacgaagtgctggatttgatggttataatttagagttagcatctaaatatggtcttattatatctaatgtgccttcctattcacctcgaagcattgctgagtttaccgtgactcaagccatcaatattgtacgtcactttaatcatattcaaagaaaaatgagattgcacgattttaggtgggaagcatcaattttatctcaatcaatcaaagatttaaaggtagcggttattggcacgggacatattggtggcattgttgcacaaatattctcagaaggatatctatgtgacgttgtagcgtatgatccttttccaagtgaacatgtgaaaccttacgttacctataaacaaagtataaatgaggcaattaaagaggcagatattgtcacaatacatatgccgtcaacacaatataacaattacctgtttaatgaaaacatgtttcaaatgtttaaaaagggtgctgtgtttgtaaattgtgctagaggatccttagtagataccaaggctttgttatctgcaatagagcaaggtcaaattaaaggtgcagcacttgatacttatgaatatgaaattggagtatatacgacagatagaagtgaagaaggtttgaatgacccacttttagaggaattaattactagagaagatattattgttacaccgcatatagcattttatactgaagaggcaatcaaacatcttatttttgatgctttagatgcaacaatggaagtattaaatactggcacgacggagttaagagtaaattaa

SEQ ID NO: 1469 - DNA, 471 bp, Staphylococcus epidermidis
tatattaagttaagtgtaattcaaaaacaaggagtttttataatggcaaattctatttactcaactacaatgatttcaaatggtggacgtgatggtcgcgtttttagtccagataatacatttgttcaaaaccttgcaacacctaaggaaatgggtggtcaaggaggcaacgatactaatcctgaacaattatttgctgctggatatagtgcatgctttaatagcgcgctatcattaatcttatctcaaaataaaataagtgatgccaacccagaagttgaaatcactattgaattacttaaagatgatactgacaatggttttaaactcggcgcagatattaaagtcacacttgaaaatatgtcccaacaagatgctgagaaatttgtggagcaagcacatcaattctgtccatactcaaaagcgacacgtggtaacattgacgttcagttagatgttacagcgcaataa

SEQ ID NO: 1470 - DNA, 213 bp, Staphylococcus epidermidis
aatgtaaagttgctcatcaccgaaggaggactatttatgtttaccatatcaatcatcgctatgattattggtgttgtgcttattgttttaagtcaaattatctatcattcaaaaccgatagatgctaaggaaaaaatgtttatacccggtgtatgcctttttttagtaggactcttaagtttaatcggtcactttgttaatggctacgtataa

SEQ ID NO: 1471 - DNA, 849 bp, Staphylococcus epidermidis
ctatgtgagttcgaaagtgagggaaaaattagcatgaatacgttggatagtaaatatgaattaaaatcaaaaaaacatcgtcagcgaataattaaaaattgggttatagtcactgtagttgcagctgtaattatatgggcgtttgcaggaattccaggtcttgaacttaaaagtaagtctattgaaatattaaagtctatcttttacggactatttcatccagatttaagttacatatatatacctgatggtgaagacttacttagaggtttgctggaaacttttgctattgcagtgattggcacgttcattgcttcaattatatgtattccttttgcatttttaggagctaaaaatatgatgaaattacgaccggttacgggcataagtaaattcatattaagcattatacgtgtgtttcctgaaattgtaatggcgttaatatttattaaagctgttggaccaggttcgttttcaggtgtacttgcactggggattcattcagtcggcatgttagggaagctttttgttgaagatattgaaagtttagattttagcgctgtagaatctttaaaggcgagtggagcaaataaaatgaagacgttaatgtttgctgtaataccacaaattttaccatcgtttatttcacttattttgtatcgatttgaattgaatttacgttcggcctccattttaggattaatcggcgcaggtggcataggtacaccattaatttttgctttacaaacacgatcttgggaccgagttggcatgattctaattggtttgattgcgatggtcgctttagttgatttaatatctggcgcggttcgtaaacgtatcgtttag

SEQ ID NO: 1472 - DNA, 1449 bp, Staphylococcus epidermidis
aaggcatatacgttttcaatccctccttctaaaggagaaatgaatatgaatgacacaggagataaaagattaagtcgaacatcattaatcggtcttgttataggttcgatgattggtggcggtgctttcaatattcaatctgatatgggaggccacgctggaggattagcaattataattggatggttgattactgctataggaatgatttcattagcacttgtctttcaaaacctaactaatgaacgatctgatttagatggtggtatttatagttatgctcaagcaggttttggtgattttatagggtttgcaagtgcttggggatattggttctcagcttttttaggtaatgtcgcatatgcaacgttattaatgtcttctatagggaacttctttccaatatttaaagggggcaacacatttcctagtatcatagtggcatcaatattattgtggagtgtgcactttttaatattaaaaggagttgagacggctgctttaatcaatagtattgtcactattacaaaattaattcctatcttattagtgattatatgtatgattgtagcctttaattttaatacattcaggataggtttctttggaatggatggatatggatcattatcatttcatttcgctaatacgatgtcacaagttaaaagtacgatgttagtgacagtttgggtatttattggtattgaaggtgctgttgtattctccggaagagctaaaaataaaaaagatgttggaactgccactgttatcggacttatttcagtattgctcatttacttcttgctgactgtattagcacaaggtattgtgattcaaaatcatatttctaaacttgaggcaccatcaatggcacaaattttagcttatatagttggtgattggggagcaacatttgtcaatattggtcttattatttcagtattaggtgcatggctaggttggacattactcgccggagagttgccttttattgtagctaaagatggtttgtttcctaagtggtttgcaaaagaaaataaaaatggggcacctatgaacgccttattcattactaatgtattagttcaaatattccttattagtatgctgtttaccaaaagtgcttatcattttgcattttctctcgcggcaagtgctatactttatccatacatgttcagtgcgttttatcaggtgaaatatacaatagaatacaagttaactgcaacgcctaaacaatggattataggaattctagcatctatttatgcaatttggctggtttacgcgtcaggtatagattatttgttacttaccatgttgctctatatcccggggattatcgtctatgttgttgttcaaaaaaataatcaaaagcgacttacacaatttgactatattttcttcggtcttatcgttattttagcattgatagggttattacgatga

SEQ ID NO: 1473 - DNA, 2385 bp, Staphylococcus epidermidis
atggcgaatacaacgttgactttggatattattggtatgacatgtgctgcgtgctcaaatcgtattgaaaagaaattgaatcgtatgaatcatgttcaagctaaagtgaatctgactactgaaaaagcaactatcgactatgagtctgacgattatcatctcgaagattttgtagagcaaattcaaagtctcggctatgatgttgcagttgagcaagtagaattaaatataaatggtatgacatgtgctgcatgttctaatcgtatagaaaaggttctaaatcaaacgcaaggtgtacaacaggcaacagtaaacttaactaccgaacaagcactcatcaaatattaccctagtgctacgaacacggaagcattaattaagcgtattcaaaatattggatacgatgctgaaactaaaacttcatcaaaagcgcaatcaaatcgtaaaaaacaagagttaaaacataaacgcaataaattaatcatttcagctattttatcgttgccactattattagtaatggtggtgcatatctcaccaatttccattccatccattttggtcaatccttgggtacaattaattctttcaacacctgtccaatttattattgggtggcaattttacgttggcgcgtataaaaatttgcgaaatggttcagctaacatggatgtattggttgctgttggtaccagtgccgcatatttttatagcatttatgaaatgatgatgtggctcacacatcaaacacatcacccgcatttatattttgaaacaagtgctattttaattacgttaattcttcttggtaaatatttagaagcacgtgccaaatcacagactaccaatgcattaagcgaattgttaaatttacaagcgaaagaagcacgagtaattaaagaaaataaagaaattatgcttccacttgataaagttaaagtcggagatactttactaataaaacccggcgaaaagatacctgtagatggcaaagtcactaaaggtgatacttctattgacgaatccatgctaactggtgagtctatacctgttgaaaaaagtagtggcgattcagtgattggttctaccatgaataaaaatggttcaatcatgattgaagcaactcaagtaggtggtgatactgcattatcacatataattaaagtggttgaggatgctcaaagttctaaagcaccgattcaacgcttagctgatattatttctggatattttgttccgattgtagttagcattgcggttattacttttatcatatggattatattcgttcaccccgggcaatttgaacctgcacttgtttcagcaatatctgttttagttattgcttgtccctgtgcacttggtttagcaacgcctacatctattatggtaggtacaggacgtgctgcagaaaatggcatattattcaaaggaggccaatttgtagaacgtgcacattatgttgatacaatcgtgctagataaaacaggcacaattactaatggtcaacctgtagtaactgattatgttggtgacaatgatacattacaacttttagcaagtgctgaaaatgcttcagaacatcctcttgctgatgctattgttacttatgctaaagataaaggtcttaatttacttgataatgacacttttaaatcaattccgggacatggtattaaagctacgattcatcaacaacaaatccttgtgggcaatcgaaaattaatgaacgattacaatatatctattagtaataaattaaatgaccaattaaatcactatgaacatttaagtcaaacggcaatgatgattgccgtggataatcaaattaatggaatcattgctgttgctgatacagtaaaaaatgatgctaaacaagcgataaaagaactaagaaatatgaatatcgacgtggttatgctgactggtgataacaatcgaacagctcaaaccatcgccaaacaagttggcattgaacatgtaattgcagaagtgttgcccgaagaaaaggcacatcaaatctctttattacaagacaaaggtaaacaggttgccatggtcggtgatggaattaatgatgcgcctgcacttgtaaaagccgatattggaatggctataggcactggagctgaggtagcgattgaagctgcagatattacgattcttggtggtgacttgctattagttccaaaagctatcaaagcaagtaaagctacgattaaaaatattcgacaaaatttattttgggcatttggatataacgtagctggcatcccaatagctgcttgtggtttattagcaccttggattgccggtgctgctatggcattaagttctgttagcgtagttatgaatgcattaagactgaaaaaaatgaaactatag

SEQ ID NO: 1474 - DNA, 210 bp, Staphylococcus epidermidis
actaaattaacgaggtgccttatgtataaagattataatgtgactcaacttacgctaccaatgaaaacttcattttttatccccgcaaatgatatttcacgacatgcaaatgatattgtagaaacaattcccgagactgaattcgatgaattaagacatcatcggggtgcaacatcataccattcaaaaatgattttaaaagaactatga

SEQ ID NO: 1475 - DNA, 297 bp, Staphylococcus epidermidis
aagtggataacacccatactatttatagatattgttatttttacaccaatcattgaagaacttttatttcgtcatttaatcattcatgaactaggtaaaaaattaacttatggtttgatgtatattgtgtcaatagtgggatttacatattttcattgtactgatgcagtttcaccatttgaagcaggaccttactttattgcagcagtcgtatttgttataggttaccattttagccaccgtaatttagcagtacccattgctttgcatatgattacaaatttaatagcattttaa

SEQ ID NO: 1476 - DNA, 225 bp, Staphylococcus epidermidis
aatttctcaactccatttacatatatctatgtgtatgttagaaataattatgtaagcgtatcacaaacaacaacaagggaggattatattatgtcaggtatcgttgaatcattacataacgctgtaaacgctggtttacacgtaaaacaagattgggtagacatgggattcggtattgcagatacagttgcaaaaatcgttgaccaagttttaaaatttgtttaa

SEQ ID NO: 1477 - DNA, 2421 bp, Staphylococcus epidermidis
acacatcaaactatcacaggagtgatacgaatggctaaaggtgttaaccaaattattaataatattaggttaagaaaattgcgcaaaatattaaatcaaattaatgcgcttagtgaggagttctcaaattttagtgatgaagcacttcaagcgaagacaaaagaatttaaagtttatttaaatgataataaagcttcactcaatcacattctgccacaagcttatgcaacagttagagaggcttctaagcgcgttttaggtatgtatccaaaagatgtgcagattttaggagcaatcgctatgcatcaggggaatattgcagaaatgcaaacaggagaaggtaagacgcttacagctaccatgcttctgtacttaaatgcacttacaggtaagggtgcttatctaatcacaacaaatgattacttagcaaaacgcgattttttagaaatgaaaccactatatgaatggctaggcttgtctgtatcattaggatttgtggacattccagaatatgaatacgctgaaaatgaaaaatatgaactgtaccaccatgacattgtttacacgactaatgggcgactagggtttgattatttaattgataatttagctgatgatattcgtgccaaatttttaccgaaattaaactttgctattattgatgaagtcgattctattatattagacgctgcccaaacgcctttagttatttctggtgcaccacgtgtacaatctaatttatttcacatcgttaaaacgtttgttgaaacacttgagaaagataaagacttcatagttaattttaataaaaaagaagtgtggctcactgatgagggctcggaaaaagcaagccattatttcaaagtgaatagtatataccaacagcaatattttgatttagttaggatgattcatttatcgcttagagctaagtatttattcaaatataatttagactattttatttttgatggtgagattgtgcttatagatagaataactggtcgtatgctacctggaacaaagcttcagtctggtttacatcaagctatagaggctctggaaaatgttgaaatttctcaagatatgagtgtgatggcaaccataacattccaaaacttatttaagcaatttgatgaattttcaggtatgactggaacaggtaaattaggggaaaaagaattctttgatttatattcaaaagttgttatagagattccgactcacagtccgattgaacgagatgatagacctgatagagtatttgctaatggtgacaaaaagaacgatgcaattttaaagacagtgattggtatacatgaaactcaacaacctgtgttactaattacacgtactgcagaagcggcagaatatttttcagctgagttatttaaacgtgatatacccaacaatttattaatcgctcaaaatgtagctaaagaggcacaaatgattgctgaggcgggacaattatctgcagttactgttgctacaagtatggcagggcgtggaactgatataaagttatcaaaagaggttcatgatatcggtggcttagcagtgattattaatgaacatatggataatagccgtgttgatcgtcaattaagaggacgctcaggtcgccaaggagatcctggatattcacagatttttgtatcacttgatgatgatttagtaaaacgttggagtaactctaacttggcagaaaataaaaacctccaaacgatggatgcatctaaactagaaagtagtgcactctttaaaaaacgtgtaaagtcaattgttaataaagcgcaacgtgtatctgaagagactgctatgaaaaatagagaaatggcaaatgaattcgaaaaaagtattagtgttcaacgagataaaatttatgctgaacgtaatcacatacttgaagcaagcgattttgatgattttaattttgaacagcttgcacgagatgtgtttacaaaagacgttaaaaatcttgacttaagtagtgaacgtgcacttgtgaattatatatacgaaaacttaagttttgtcttcgatgaagatgtatcaaatattaatatgcaaaatgatgaagaaatcatacaattcttaatacaacaatttactcaacaatttaacaatcgtttagaagttgctgctgattcatatttaaaacttcgtttcattcaaaaatcaattttgaaagcgatagatagcgaatggattgaacaagtagataacttacaacaacttaaagccagtgtaaacaatcgacaaaatggacagcgtaatgtcatttttgaatatcataaagtggctcttgaaacgtatgaatatatgtctgaagatataaaaaggaagatggttagaaatttatgtttaagtattctagcctttgataaggacggagatatggtcattcatttcccataa

SEQ ID NO: 1478 - DNA, 1575 bp, Staphylococcus epidermidis
aacatcaaaacacattctaggggggagtgcatgtctaaaattttactaactggtgcatcaggttatattggtaaccatctcaagaataaattaaaaaaagatcatgaagtgatagctatatccagaaatactcataataaaacggatgaagaaaatgtcacgtggaagtcagcagacttatttgatttggacgaagttacaaaagtaatgaaagatgtagatacagcgatatatttagtacactctatgatgccatcagcaaaattaacgcaggctagctttgaagatatggatgcattgttagcagataattttgcgcgtgcggctcaaaagcagggtgttaagcatattgtctacatgagtggtttaataccagaaaatgatgagctatctgcacatttaagaagtcgacttgaatgtgaaaaaattcttggtgattacggtataccagttagcacattacgtgcaggtttaattattggtgcaaaaggtagttcttatccaattcttaaacgactagttgagagattgccagcaatggttttgcctagttgggcttacaataaaattgcacctgttgccattgacgatgtgatagatggtttagcagcattggtgaatcgaacacccaaagataacgaagcaattgatatcacaggtcctgaagtgatgaattataaaacgctgatacagcgcacagctaacgtacttgataagcgactgcctatgcttgatttacctattatacccattatcgtaagtcgatattgggtacaactgatttcaaatgtaccgaaagaaatggtatatccattaatgaatagtttaactcacgatatggtaccacatcgaaaacgcgttgtgtctaacttgtccgtaggaaatatcacctttgaagatagtgtgaaaagagcactaagagaagaacaaaagacttctaagaaaaagtcagattcgaaaaattctcaatcatttgggcttatgcatcaagaaattaaagatgtacgagccattacacggtttaaaattccggaaggttattcgattaaagatgtgactaaagaatatgcaaaattcatcaataatatcacactacatatcgttaaaggtacgataaatgaacgagaatttaatatgaatttgcccttcattaataaatttattttaaaaatggaacgtgatgaagctgactctacagaagatatggtggtatataatattgtgggtggcgatttagcacattcaaatgatggtggaaatgcacgctttgaattccgaagaataagaaacaccaatgagggtattattgctttacaagaatatgaacctacattaccttgggtagtatataaactaactcaagctaaagcacacaagactgttatgaatatttttaaaaacaaaatggcacgtttagcgcaacaaaaaaatgtaaaagatgaaacatatatgtctaatcgtgtaactattggagtaacagtagcatcagcgttcgttattggaagcgcagtagggttccaactttttaaaaagcatcaaatcaaaaagaacacaatgtcgaatgcagaattataa

SEQ ID NO: 1479 - DNA, 1170 bp, Staphylococcus epidermidis
aaaatgaaaacagtatctaaatattttgtatatatgatgatattagttacgtttttcatagttgttagtgggtgttcgattaatcaatcttttagcgataaacaaaatacaaataaaacaatacgtgtggttgctgtaggtgataatttaattcacccagttgtatataaagatgcacaaattacggggaatagttttgattttaaacctatgtatcaaccagtaaaaaaagacattcaaaacgcagatatttcttttgttaatcaagaatcaccattaggtggggatgataggccttattcaggatttaaaaactttaatacaccgagtagtattgctcaggatttagtagatactggctttaattttgtaaacggtgcaaacaatcatgccttagatcaaggagagcaaggtgtaagaaatcatattcatacttggaacaaatttaaatatcaagttttgttcacgggtgtatatgaatcagaacaagcacaccgtcaaattcctattaaaacaattaaaggtgtgaaagttgctttattaagttacacatttggtacaaacgatcatcaaccaactcatgattatacggtagatacgtttgatgaaaataaaattaagcaagatgttaagaaagccaaacaacaaagtgatgtagtacttgtttcagcacattggggtaatgaaggtaagcatcagcctaacgccactcaaaaaaaatatgcacaaattttcgctgatgcaggtgttgatgtagttttaggtacacatcctcatgtgattcaaccagtaaaatgggttgacggtagagaagggaatcgtacactcgtagcatattcattagggaatttcttgaacggtcagtcaacagggaatgaaagtaatgatttattaggacggatagattttaaaattagtaagaaagataaacagtttcaagttcaagatgtgaagtggagaagtatggtgaattattacgaattaactcaacaccaaaaccagttccttaagtcgaactttaaagtgatgatgctagatgactataatgacaaagatgccactcatcatggtcgcaatcaaatggatagttcttcgatgagccctgcacacttacgagatatcacacgttcagttattgataaacaatatttagacaatcggagtttatag

SEQ ID NO: 1480 - DNA, 726 bp, Staphylococcus epidermidis
gttgatagaacgattaacgataggagtggatataaaatgaattattcaccaaaacaaggtgttaaaagtcatggattgccacatgatccgttcaaaagtagcacagtacctagacctataggttggatttctacagtatctaaagaaggtaaagataacttggcgccgtacagtcaatatcaaaatcttacatgggatcccccaatggtaatgtttgcggctaatcagtcagtgcttggcgatcatgaaagaaaagatacagttaaaaatgcggaagaaactggttggtttgtatggaatatggcaacatatgatttgcgtgaagcagtgaatttatcatccaaagcattacctccagaagatgatgaatttgactttgctggtgtgacgaaagaatcgtgtatcgaagctcctggaagtagggtaaaggaatcacctgttcattttgaatgtgaatatgttcaaacagtaagaattcccactggagaccctgtttcaactgtggatgtagtcatcggtcgtgtagcacaagtgcatattgacgataaagtaattatggacaacggaaaattagacattaagtcaatcagacctatagcacgtctcggttattatgattacacggttgtcgatgaaatatttgaaatgaaagcacctgcagcttcgaaagaagaattggctggacttgaaggtcgaaattttgacaacactaataatgaatcatga

SEQ ID NO: 1481 - DNA, 2031 bp, Staphylococcus epidermidis
atgaagagaacagataaaattggtgtctacctcaagctgtcatgttctgcgttgttacttagtggttcgctggttggttatggcttcacaaaagatgcttttgcagattcagaaagtacatcatcaaatgttgaaaatacttctaatagtaactccatcgctgacaaaatccaacaagctaaagatgatattaaagatttgaaagaactttctgacgcagatatcaaaagttttgaagaacgtttagataaagtcgataatcaatcaagtattgaccgtattataaatgatgcaaaagataaaaataatcatttaaaatcgacagactctagtgccacatcatcaaaaactgaagatgacgatacatctgaaaaagataatgatgatatgactaaagacttagataaaatactgtcggatttagattcaattgctaaaaatgttgataaccgtcaacaaggtgaaaatagtgcttctaaacctagtgactcaacaaccgatgaaaaagatgattcaaataataaagtacacgatacaaatgctagtacacgcaatgcaactactgatgattctgaagagtcggttattgataaattagataaaatccaacaagattttaagtctgactctaataataagctttctgaacaaagcgatcagcaagcatcaccatctaataaaaacgaaaataacaaagaagaatctagtacgacaacaaatcaatccgatagtgatagtaaagacgataaaagtaatgatggtcgtcgctcaacattagaacgtatagcatcagatactgatcaaattagggattcaaaagatcaacatgtcacagatgaaaaacaagatatacaagcaattacacgttcactacaaggtagtgataagattgaaaaagcacttgctaaggtacaatctgacaatcaaccactagattctaattatataaataataaattaatgaatttaagatcactagatacaaaagtagaggataataacactttatctgatgataagaaacaagcgcttaaacaagaaattgataaaactaagcaaagtattgaccgacaaagaaatattattatagatcaactcaatggtgctagtaataaaaaacaagcaaccgaagatatcttaaatagtgttttcagcaaaaatgaagtagaagacataatgaaacgtattaaaacaaatggccgaagtaatgaagatatcgctaatcaaattgccaagcaaattgatggtcttgcattaacttctagtgatgatattttaaaatcaatgttagatcaatctaaagataaagaaagtttaattaaacaattgttgacgacacgacttggtaatgatgaagcagatcgtattgctaaaaaattgttaagccaaaacttgtcgaattctcaaatcgtagaacaattaaaacgtcatttcaatagtcaaggaacagctacagctgatgatatattgaatggtgtgattaatgatgctaaagacaaaagacaagcgattgaaacaatattacaaacccgtatcaataaagacaaagctaaaattatcgccgatgttattgcgcgtgtacaaaaggacaaatcagatatcatggatctcattcactctgcgattgaaggcaaggcaaatgatttattagatatagaaaaacgagcaaaacaagctaagaaagatttagaatatattttagatcctataaagaatagaccatccttgttagatcgtattaacaaaggtgtcggtgattctaattcaatatttgatagaccaagtttacttgataaacttcactcaagaggatctattcttgataaattagatcattcggcaccggagaatggattatctttagataataaaggtggccttttaagtgatttatttgacgacgatggtaatatctcattaccagcgacaggtgaagtcatcaaacaacattggataccagtggctgttgtactcatgtcattaggtggagcgctcatctttatggcgcgtagaaaaaaacaccaaaattaa

SEQ ID NO: 1482 - DNA, 606 bp, Staphylococcus epidermidis
aatggaggaacaagaatgatacaacgtaaaggtgaattaatactttcatggattggcaatggattacatctgttgtatgtatttttagtaggcatatttttcataatgacacaaacaagtgaatttaaaaatgggatgattcaaggatttatagaagaaaatccgggggaatatgatttagcataccaaacttataatttgatgttaggtttaggtgttgttttcattattatacttctcattttattaattgtatcaatagttgccgctattttaattggcaaaaatgcaaaagtatcaggaatattacttgttattacaggaatcattggtctctttttaagttttattgctggtgccttatggttaatagcaggtatcatgcttttagtacgtaaaccacaaacacaaaatgaccaaatcaattctcaatatagtaatgacatacattcacatgttgtgccagaagaaaagaaacgtgaacaacaacaatataatatgaatgaaccacatattggtcaatcatcaacatctcatcatgatcacgcattgaatgatcaaaataaacgagaaaatcataatcatgataatcaaccatacaaatag

SEQ ID NO: 1483 - DNA, 1203 bp, Staphylococcus epidermidis
aaaggaggaacaacgacgatgctaacagtcggaattataccttcgccaggtatagcgcatcaacatgtaaaaaaaataattccaaatgttaaacagttattgtcaaagcggactaaacatagtcaatggaatttcgacatcaaagtcgatctcatgataggatctgcagaagatgtacatgaaagtgttgaaaaagcagcacaaattaaagaggaacatcagtgggattacgttgtttgcctgacagatttgcctagtatttcagataataaagtggttgtcagcgactttaatagtgacaaacatgttgcaatgctatcattaccgtcactaggttttattgatttgaaacgcaagctagttaaaacgatgacttcattgattgaacaattatattataatcaaccgaaagacaaaaatgcgccacatccttttgtacgcgtgaaggctgtagaacctgacgaagacgccacatcaaagcaacgatatattaatattttatttatcataagttggattcagttaattggtggactgacacgagcaaatcagccttggaaaaacatctttaattttaagaaaatcatttcagttgcctttgcaacaggaacttatgtctccatattttcaatgccatgggaattaagcgtgatttattcgccgcttcgacttatcatattgatggtgattgctatacttgggatggccggatggctattctatgcgcatcaattgattgaaaagaaaactgctaaatctcagcgagtatatcgatatatttataattcaaccacacttgttacattaagtttgattaccctcataaattatgtcattttatatttattgttaatcatcagtattacactctttgtccctgtggaattatttaatagttggacgagtgcccaatcacaatttacattctcaaattatatgagattgatttggtttgtatcatcattagggcttttagctggagctatgggatcaacagttgaaaatgaagagaaaatacgtcgtattacttattcttatagacaatatcatcgttataaagaagctgagcaagaacaaaaagaacaagaaacttctcgtgatgtatcacaacaaaatgtcgaacaacaaacttcaagtaaagatgaaaataatgaacaatatgaaggtaaaaaacaaggacatagagaggaggatgacgcatga

SEQ ID NO: 1484 - DNA, 867 bp, Staphylococcus epidermidis
agcaacatgactaaagttattacaacaatcaatgaaatgcaatctattgttaaacaacatcaacgtgaaggtaaaacaataggattcgttccgactatgggagctttacatgatggtcatttaaccatgatgaagcaatctgtaagcgaaaatgatctcacggttattagtatatttgtgaatcccttgcagtttggacctaatgaggattttgatgcttatccacgtcaactcgatgatgatgtggctgcagtaaaaaagttacaagtggattatgttttccatccgagtgtagatgaaatgtatccagaagaattaggtattcatctgaaagttggacacttggcacaagtattagagggagcacaaagacctggacacttcgaaggtgttgtgaccgtggtcaacaaactatttaatattgtgcaaccagattatgcctattttgggaaaaaggatgcacaacaattagctattgttgaaaagatggttaaagactttaatcttcctgtacatgttatcggtattgatatcgtaagagaaaaagatggtttagccaaaagctctagaaatatttacttgacctctgaagaacgaaaagaggcaaaacatttatatcaaagtctacgcttagcaaagaatttgtatgaagcgggtgaacgagatagcaatgagattataggtcaaatcgctgcgtatttaaacaaaaatattagtggacatattgatgatttgggtatttatagttatccaaatcttatacaacaatcaaagattcatggacgaatattcatatcattggcagttaaattttctaaagcaagattgatagataatataattattggagatgactatattgattag

SEQ ID NO: 1485 - DNA, 1971 bp, Staphylococcus epidermidis
ctatgcatgacccatattacagaaagtgaaatgaaacaaaaatatctagatttactctcacaaaaatttgacagtgcagaaaaacttgctactgaaattattaacttagagtcaatcttagaattacctaaagggactgaacattttgttagtgaccttcatggtgaatacgaatctttccaacatgttttaagaaacggatctggaaatgtgcgtgctaaaattaatgatatcttcaaagataaattatcccagcaagaaatcaacgacttagcagcattagtatactatccggaagaaaaactaaaattagttaaaaataatttcgattcaatcggaacattaaatatttggtatattacaaccattcaacgattaattgatttaattacatattgctcatcaaaatatacacgttcaaaattacgcaaagcattacctgaacaatacgtttatattattgaagagctactttacaagagcaatgaatttcataataaaaagccttattatgaaacattagttaaccaaattattgaattagaacaatcagatgatttgatcattggcctttcctatactgtacaacgtctagtcgtagaccatcttcatgtcgtgggcgatatctatgaccgtggtcctaaacctgataaaattatggatacattaataaattatcattctgtagatatccaatggggaaatcatgatgtattatggattggcgcctatgctggttcaaaagtatgtcttgctaacctactacgaatctgtgcacgttatgataatttagatattatcgaagatgcatatggcatcaatctacgtcctttacttacgcttgctgaaaagtattacgatgctgaaaacccagcgtttaaacctaagaaacgaccagataaagacgtcagtcttacaaaacgcgaagaaagtcaaatcacaaaaattcatcaagcaattgcgatgattcaatttaaacttgaaatgcctattattaagcgccgtccttcttttgagatggaagaacgtttagttttagaaaaaatagattatgataataatgaaatcactatatataataaaacatatccgcttaaagatacttgtttccaaactgtaaaccctaacaatcccgctgagttactagcagaggaaaaagaagttatggataagctattactttcattccaacaatctgaaaaattaagacgtcatatgtctttccttatgcgaaaaggaaaattatatcttccatataatggcaaccttttaattcacggttgtattcccgtcgatgaaaatggagaaatggaatcatttgaaattgaaggtgaacgtttaagtggtcgtgaactactcgatgtttttgaatatcatgtaagaagagcttttgaccataaagaatctaccgaagacatttctacagatttagtatggtatctttggacaggtaaatattcatctttatttggtaaacgtgccatgacaacgtttgaacgttattttatagaagataaagcatctcataaagaggagaaaaatccttattattacttacgtgaagatgttgatatgatacgtaaaatgttaaaggattttggtcttaatccagatgaaggacgtatcataaatggtcatacgcctgttaaagaaattgatggtgaagatccaattaaagctaatggtaaaatgttagtcatagatggaggattttcaaaagcttatcaatcaacaactggtattgccggatacacacttttatataattcatttggtatgcaattggttgcacataaagagttcaatagaaaagaaaaagtgttatcaatgggggcagatgaattgtcagtgaaacgcgttgtagatgaagaattgcaacgtaaaaaaattagagataccaatatcggtaagcaactgcaagaccaaattgatatcctcaaaattttaatgcacgaccgatatttaacataa

SEQ ID NO: 1486 - DNA, 999 bp, Staphylococcus epidermidis
tttttaatgacaaaaattatgtttttcggcacaagagcatatgagaaggacatggcattacgttggggaaagaaaaataatatcgatgtcactacatcaacagaacttttaagtgtagatactgtcgatcaattaaaagattatgacggtgttacaacaatgcagttcggtaaattagaacctgaagtttaccctaaattagagtcctatggtattaaacaaattgcacaacgtacggctggatttgatatgtatgacttagaacttgcaaaaaaacatgaaattattatctcgaatatacctagttattcacctgaaacaattgctgaatattcggtatctatcgctctgcaactcgtacgaaaattcccaacaattgaaaaacgtgtgcaagcacataatttcacatgggcgtcccctattatgtctcgtccagtaaaaaatatgactgtagcaatcatcggtacagggcgtattggtgctgcaactggtaaaatctatgctggttttggtgcgagagtagttggttatgatgcatatcctaatcattctttatctttcttagaatataaagaaacagtagaggatgcaattaaagatgctgatattatctcattacatgtacccgctaataaagatagtttccatttatttgataacaatatgtttaaaaatgttaaaaaaggtgccgttttagtcaatgccgcaagaggagctgtgataaacacgcctgatttaattgaagcagtaaataatggtacattatcaggtgctgccattgacacatatgaaaatgaagctaattatttcacatttgattgttcaaatcaaacgattgacgacccaatattattagacctaattagaaatgaaaatattttagttacacctcatattgcctttttctccgatgaagcagtacaaaatttagtagagggtggtttgaatgcagcattatcagtaattaatactggcacatgtgatacgcgattaaactaa

SEQ ID NO: 1487 - DNA, 213 bp, Staphylococcus epidermidis
gcctcaatgacatatatttctttatcacaaaagattcggaacgcaaatattctaaattatcagaaaatatttacaaatttgaaaattattagtatattgattactatcctattaatattgatttattttaaaacgatagcagttgatagttttatagcttcatatgtagatagctatattaaaaagagtcactattgggagggaactcaatga

SEQ ID NO: 1488 - DNA, 1062 bp, Staphylococcus epidermidis
cttatgtcgacgataaaaaatatcgatggaccaaaggattttgtttttagagtgttatcaggggtagcaattggaatagtagccggactcgttccaaatgcaattttgggagaaatttttaaatactttatgcaatatcatcctattttcaaaactttattaggggtcgttcaagccatccaatttacagtgccagcgcttattggagcattgatagctatgaagttcaatatgacacctttagcaatagctgtagtagcaagtgcctcatatgttggtagtggtgcagctcaatttaaacaaggtacatgggtaattgcgggaattggggatttaattaatacgatgttaactgcatccatcgccgtgttacttattttattaataaaaaaacgtgttggtagtatggctttaattgtttttccgacagttgttggtggtttagcagctacaatcggcgtatttactttaccatatgtaaggttaattacaacgggaattggtaacatggttaatagctttactgaattacaaccagtgtttatgagtatgttaatctctatggtgtttagttttataatcatatcaccattgtcaactgtagccatagctattgctattggattatcaggtattgctgcgggatctgcttcaataggtatagcagcgacagaagctgtattattgattggtaccagcaaagttaatcatgtaggtattcctttatcaatatttttcggtggggtgaaaatgatgatgccaaatatggttaaataccctgtcattatgattccgattttcttgacagcggcaatatctggtattgcttcagggattattggtatttcaggaacaaaagaatcagcaggatttggttttatcggaatggttgggcctattaatgcctttaaatttatgcatgttgattctgcatggttaagtttattacttattgtcatcgccttttttgttgtgccgtttctagttgcatggattttagatttaatacttagaagattaattcatttgtatgagaatgatatttttaaatttatgggataa

SEQ ID NO: 1489 - DNA, 198 bp, Staphylococcus epidermidis
cctggaacgactaaccctgctggattaatcccaaatttctcagcaaatatcaaactgagtacgacacctacgaataaggagaaatataattctgaacctatcattttattctatcccttctatgaattccgctattctaccacccgggccgtggatgtttcctacacaaaatacaagtgcattctcagcttcatgtag

SEQ ID NO: 1490 - DNA, 483 bp, Staphylococcus epidermidis
gagaaggcgactactatgaaaaaagtcatatcgcttttagtagtattagttataagtgctgtatctctttcggcatgtgggaaagaacgcacaaaaacttatgaaggcgaagtcaacggaaagcaagtgattacatctttgacatacaaagatgatgaagttctcaaacaatctactatagcaacaattaaatatgatgatttaggcatcgataaagatgaagctaaacaaatgtttaaaaatgatgaacaagcattcaaagggatagacggggttacatataaagctgattttaaagatcgaaaagccatcgaacatatcgatattgattataaagatgcggatatagatcagcttaagaaaaatttaggtttcatatcatcagatgccaaaaaaggtgaccatgtgagtgtggatagggttgttaaacaactcaaacgtaatggtttaaaagataaaagtaaaatgaatgaagataattaa

SEQ ID NO: 1491 - DNA, 993 bp, Staphylococcus epidermidis
cacagttatttgtgtaactttattatgaaggagttcgttaaaatgaaaaaatttgggaaaaaagttgttttagtaggagacggttccgtaggttcaagttatgcatttgctatggtgactcaaggaattgcagatgaatttgtaattattgatattgcaaaagataaagtggaagcagacgttaaagatttaaaccatggtgcactttacagttcttcaccagtgactgtaaaagctggagaatatgaagattgtaaagatgcagatttagttgttattacagcaggtgcacctcaaaaaccgggtgaaactcgtttacaacttgttgagaaaaatactaaaatcatgaaaagtatcgtaactagtgtcatggatagtggctttgatggtttcttcctaattgctgcaaacccagttgatatcttaacacgttatgttaaagaagttacaggtttaccagctgaacgtgttattggttctggtacagtgcttgatagtgcaagattcagatatttaataagtaaagaattaggtgttacatcaagtagtgttcacgctagcattataggtgaacatggtgactctgaacttgcagtttggtctcaagcaaacgttggaggtatttcagtgtatgatacattgaaagaagaaactggtagcgatgctaaagcgaatgaaatttatattaatacaagagatgctgcttacgatatcattcaagctaaaggatctacgtattatggtatagctctagcactattacgtatttctaaagctttactaaataatgaaaatagtattttgacagtttctagtcaacttaatggtcaatatggatttaacgatgtttatcttggcttaccaacacttatcaatcaaaatggtgcagttaaaatttatgaaacaccattaaatgataacgaactacaattactagaaaaatcagtgaaaactttagaagacacttatgattctataaaacatttagtttaa

SEQ ID NO: 1492 - DNA, 579 bp, Staphylococcus epidermidis
aatggaggtgcaatgatggattataataacaatgacagtcaatatatcgaagaagctaaagatttagttatcaactcaatcggtgaaaccatggatttgtatggtatcaaccgtagtgtaggtaacttgtatggcattatggtttttgaaggaagtatgacacttgatgaaatgcgacaacaactgcaaatgagtaaacctagtatgagtacaggtgtaaaaaaactacaagaatacgatatcgtcaaacaacaattcacgcgtggtagccgaaagcaacattttattgcagagaaagatttcttcactttcttccgcaacttttttactaaaaaatgggaacgtgaaattgacactaatatggaagcaattgaagatgcagaaaatatcattcacccacttcttgaaaagaatgatatagatgaggaagttaaaaaacaagcaataaatgtaaaagcgcagttagaccactctaaaatatattacaagtggctcgctcaattaagtgaagctctagagtcaggagaaatttttaactatttcccaattccagatgaacaacatcatcatgatcaataa

SEQ ID NO: 1493 - DNA, 441 bp, Staphylococcus epidermidis
ttttatttggctggagctatttcagacaagattttgaatacaggtcaatcacgttttgttgcacgtggcgtaattgcgattgcgggatttgtggtattctcaatttcaattttcttagcagtacatacagacaacttatatgtaaccattttctggttatcactttgtttaggtggcgtacgtatttctatgggaatgagttgggctgcagccactgacttaggtcgtaatttctctggaactgtgtcaggttggatgaacttatggggaaatgttggcgcacttattagtcctttacttgcaggaattgttgtagatcatttaggatggtcaatgacattacaactcttaatcgttccggctattatagcagcaattctatggttcttcgttaaaccagacaaacctcttattgttagtgaagaacacgttaataaataa

SEQ ID NO: 1494 - DNA, 288 bp, Staphylococcus epidermidis
acgtcgatggctgcagaaattaaacaaggcgatcataaattctatgtaggtaatgacgaaaataacccaaaagctgttattacatttaaagaggttgataacaatgaaatagacattgatcatactggagtttctgatgaactcggtggacaaggtctaggtaaaaaattagttaatcgtgttgttgaacatgcacgagaaaacaatctaaaaattatcgcttcttgtccattcgcaaaaaacgtattagaaaaagatgatcatgcacaagatgtttatctaggatag

SEQ ID NO: 1495 - DNA, 864 bp, Staphylococcus epidermidis
atgaaggaggccaaaatgaagaagcaacagaataaagtccatatgattaatatatctttatgccttatagggacattacttattgcaatcgcagtaaatagttttgttataccgggcaatttaggtgagggtggttctataggcctttcattaattctgaattatactctaggtatttcacccgcactcagttccttcatcattaacgcaatattaattattgtaggttggaaatttctcagtagaacgacagcgatttacactgctataacaatcaccgcaagttcaatttttcttgatttaactcacacattcggattaggtattcatgataattttattaattcaatttttgcaggtttaatgttgggaatcggttctgggttagtaattactgctcatagtacattgggtggtacatctgtcattgcacgtatcatttcaaaatatagtgagatgaagacgtcacaagcactacttatattagatgcaatcatcgtgttatcatttatcgttgttttacctataacgaatgtattatatactattgtgatgctatttattgttgaaaaatcaatgtcttttgttgttgaaggatttaatcctaaaaaagctgtgacagttatttcaaaatataataaagaaatcagtgctgatatatatgaaatgactggaagaggggcaaccttattaagtggtaaaggtgcttaccaaaaaagtgatacagaagttctatatgccgtggtatcccaaaatcaagttggagcaataaaaaagattgttaatcaatatgatgaaaatgcctttttagtgattcatgatgtgcgtgatgtcttaggtaatggatttattaatattaaataa

SEQ ID NO: 1496 - DNA, 546 bp, Staphylococcus epidermidis
tatacacatttaaggagttggagaaatatgtatcaatcaatgtatgactcgcccgttggcttattgcaattaattacaaacgatggcatctcgttgtcacatgtcttataccctaatcaacatttgaaaggaattaaaacaaatgatacgttagatgtttttaaagatactaaagcgtggttaagagagtattttaaagggaattatcctgagataaaagtaccgttagcaccaaaaggcactgattttcaacagaaggtatggaatgaacttcagacaattcgttatagagaacttaaaacatatggagagattgctaaaacagtaggacgagcaatgaataagccagcaatgtctgctcaggctgtaggaggtgctgttgggagtaatcctatttctatacttataccatgtcatcgagtggttggtaaagatggaaatttaacaggatacggaggtactttagacaacaaaataaaattattaaaattggaagaaatagatatgacacatttatacagacctaaaaaaacaacgaaaccttga

SEQ ID NO: 1497 - DNA, 357 bp, Staphylococcus epidermidis
caacttttttatagagataacttgaaagtagggattaaattgatttgttctaattgtggggcacatttagagaaggatgataaattttgtgttaattgtgggcagagtgtgttcgataatccaaagacaaaaactgaacataattttaatagtcaagatagacaatgtccaaagtgtcacaaagtagtaaatgtcgatgataagttttgtatcaattgtggtcattctcttcagcaaacattatcaaattcaaatgacaacatagcatcacatacatattcaaatacaaaacctgaaattgaaaatgaaactgcagatcatattcgattgacagaagaagcccaagcatctatttaa

SEQ ID NO: 1498 - DNA, 213 bp, Staphylococcus epidermidis
tcaattatttatataaaggatgaattcgtcatgtttattttagtcaatacaatattgttcatagcgatttttggttatacagcaatgacattagtaaaattctttaaacgttcaaaagaaggtgattgtggtgggtgtaaatctaattgcaaatgcgatacgaatacttcatctcataaaaataaattaaatattccacatattaagtcatag

SEQ ID NO: 1499 - DNA, 477 bp, Staphylococcus epidermidis
atgagtatttatgatattgaggtagagaattatgatggctctacctatttactaaaaagatataaagggaaagtgctcattatcgtaaatactgcaacgaattgtactttgaatgatcaatttaataaattagaaatgctttataaaaaatatcataagtatggtcttgagattttgagcttcccttgcaatgattttaataatcaggagccaggattaatcaaagatatttatcgagtatataaatataagtttggtattactttccccatccatgctaagattaatgttaatggagagcatgaacaccctttgtacacattattaaaatgtaaacaaccaggattatttggttcgcaaattaaatggaatttcactaaatttgtagtagatcaacagggaaatattgttaaacgatttttaccttgtgataatcctaaccaaatggaaaaattaataaggcaattattaaaataa

SEQ ID NO: 1500 - DNA, 1212 bp, Staphylococcus epidermidis
attaaagtttataataatcttgaggagaggattaagatgaatcaaactttagttcaacatctacgtgaaaaagagcaaagaatgaaagaaataagacgttacttacatgaaaatcctgaattatcattcgaagaaaatgaaacatctaaatatattgcaaacttttataaagataaggattgtttagttgagacgaatgtgggtcctaatggaattaaagttaccatcgcaggtaaacatccaggaaaaactatcgctattcgtgctgactttgatgcgctaccgataaaagaagaaacagaattaccttatgcttctaaaaatgagggagtcatgcatgcttgtggtcatgatgcacatactgcgtacatgctaatacttggagaaacattaattgaaatgaaagatcaattgagaggtaatgtcgtgattatacatcaacctgcagaagaaatgccaccgggcggtgcgaaaggtatgatagatgacggcgtattagaaggggtggaccatgttttaggtgcacatgtgatgagtatgatggaaacaggtaaaatatactatcgtgaaggttttgttcaaacgggacgcgcttattttagacttgttgtgaaaggtcagggtggtcacggctcatccccacatacatcgaatgacgctattgtagcaggtgcgcattttgtaacgaccgcacagaccattgtttcaagacgcttaaatccgtttgaaacgggtgtagtcacaataggttccttcgacgggaaaggacaattcaatgtgattaaagatacaataacaatcgaaggtgatgtacgtgcactgactgatgatacaagagacaatattcagaatgaaatgacacgactagtcagaggattagaagagatgttcggagtgatttgtgattttgaatttaaaaaggattatccagctctttacaatgatcctgaatttacttcttatgtagcaacaactttaaaaaatgctaagctggatgacataaaagcaatagatatttgtgagccgcagccaccctcagaagatttcgcgttttatgcgttagaaagaccttcaacatttatttattcgggtgcagcaccagaagatggacctatgtaccctcaccatcatcctaagtttaatatcaatgaaacatctatgcttgtagttgcagaggcagtgggtacaattgtattagattatttgaaataa

SEQ ID NO: 1501 - DNA, 1296 bp, Staphylococcus epidermidis
agttgtaattacattgataaagttaaagttttacaatttatgaaaggcggtatcatgatgagcgtattatctaatgaagaaagagttgaaattttatccgatatagtctcaataaaaactgtaaatagtaatgaattagaggttgcacagtattttgaaagactatttagtcagtatggaattcgttcatatatagatattgttgcagacgggcgagcgaatttaatagcaacggttggttccagtcatccagttattgggatatctggacatatggatgttgtatctgaaggaaatcatgatgattggacgtatgatccttttacactaacagaggaccaaggctatttatacggtaggggagctgcggatatgaagtctggattagcagctttagccattgctcttattgaaattaaagaaagtggtaagttaacacagggaactattaaattcatggcaacagtgggtgaagaaatggaacaatcaggttcgcaacagttgtttgaaaaaggatatgctgatgatttagatgccttactcatagcagaaccatcatttcctagtttggtgtatgcacataaaggttcaatggactttagaataaaatctaaaggacgtgcttcacatagttcaataccatttttaggacaaaatgctattaaaccattattagagtttattcaaaatataaatcaagaatatgaaaaaataatgcaaacagtaaaaggtgagtccttagatttttcaaatatgattaataaattagagaatcaattacctaaccatataacaaaagaaaaagcacaagagcttatacaggggcttgttatgacaaatagtatcgttcaaggtggtacacaagtaaattcagtaccagattttgctacagctgaatttaatgtacgcacaataccagaatataataataacaaagtaaaagcgttatttaataaatatgtagagcaagcaaatcacaatggtgctagtttgactcaagaactttatcttgatttagaacctgtagtaacaacaggtcaaaatcgcttggtagagctaggatttgatattgcaaaaagccatttttctaacgaaagagatttaatcattactcctactgtagcagttactgatgcttcaaacttattaaaaggaaaagatgaaaattttccatttttaatgtttggcccaggaaatggacctcatcaaattaatgaatgcgttgaaaaagtaaattatttagaatttgttgaatattatatagagtttatcacttcatatttaaatgaaaagtaa

SEQ ID NO: 1502 - DNA, 873 bp, Staphylococcus epidermidis
aaagtgaatttattaaaatttcacaacaaaatcaaaggatatactcaaaatagacaaccaggtattgaagcggatatggaacctaaacccattgcagaattagaagaatataaagcagcaggaaagttagagaataaagttgctctaataacaggaggagattcaggtattggacgtgcgatagcaatactatatgctaaagaaggggcaaatgttgctattggttattatgacgaacatcaagatgccgaagacacagttaatcgacttcaagaaatgggtgtaaaagctaaagcttatgctcatgacttaaaagatgaaaagcaatctcaaaagttaatcaaagatgtcataaatgacttcggtagtttaaatatattagtaaataatgggggcgtgcaatttccacgcgatcattttgaagatatcactccacaacaagtgaaagaaacttttatgacgaatatttttggtatgatgtttttatcccaggcagcagtaccttacctatctgaaggagatacaattataaacactacaagtgtcacagcatataaaggatcggggcatctcattgattattcagctacaaaaggtgccatagtatcgtttacccgttctcttgctactactttaatggaaaagggaattcgcgttaacgccgttgcgcccggcccaatctattcacctttaattcctgcgacatttgatgaagaaaaagtagaacatcaaggtgacgaaacgccgatgggtcgtcgtggacaaccagcagaacttgcaccatcttatgtcttcttagcaacacatgcagatagttcctatattactggtcaagttattcatgtcaatggtggcgattttatcacatcttaa

SEQ ID NO: 1503 - DNA, 198 bp, Staphylococcus epidermidis
cagcaattctatggttcttcgttaaaccagacaaacctcttattgttagtgaagaacacgttaataaataatatttttcaaacacatgcaatgacattcatatcattgcgtgtgtttattcttttattatgtggtatagaacatggaagcgataagcgaattgttttttttatcagttataaactgctaaacttataa

SEQ ID NO: 1504 - DNA, 2088 bp, Staphylococcus epidermidis
agaaacctttttaatcatgcatatctagttaaaaaattaaatagcaagattaagattgttggtgaaatacatggtccattggaatatattaatgagaatatagatttagcattagactgtattgattgtgttcgagtgagtacagctagaattaaaaatgaatttatagctaaatatgactatcatcgggtttttaatcaatacgtaaatgcacaacatatcgatttaaaatcagagccgataaatactaaacgaaattttttaattaaagcacgttttgaggatgaagttaaagatatttcatatattattaaattgtttaattacatcattaaaaaccaaattgttgatgatgctcaactttatttaataggatatggtccttcagaaatgctttacaaaaatttgataaattactatcatcttaatgagtatatccatattaatgaaaaagaaccacagagttatatttatgtatctagttcgccatatgaaacgctcggctattctatattagaaacgattgcacagggtaataaagctctagtttactatggtgatgataacgtgttaaaggatatctatgcaccatatgaagcgatacgttttttaaccaaagatatgattaaagatagtaaaataattaaagactttctaaattataaatatagtcactttgatcgacaaaaatattatcgacagttggaaagtacgtttaaatgcattaattatggacaggaatttttaaataatgttgaaactttctcttcatctcaacatgtaaaagtgaagaaaattcatcgacatctcggtagtgaaaaacaaatagatatagcaagtcgtttaaaagagagtcgttggatgaatttaattagaaaaaataaatatttatttaataaatgtaaaacgtactatgaaaaaagaacgcatatgagctatatcaaaaatttaaatcaaatacctgtagacgacgattcaatatttatagagtctttccatggcaagaattttagtggagatcctaaatatattgctcttgctattaagagacagtatgatcataaaaaaatatatgtgagttcaaccaattcacttgttgatatggaaatcaaacgttacggttttacacctgttcgatttggaagcgagaaatatattaaaacgtttagaaagtgtaagtatgtttttatcaatggtaactcgtgggataaagtgtacaagtcttcagatcagatatttgttcaaacatggcacggttttccattaaagaaaatggttaatgatttaaatgaacaacatgaaagacaacaacaactagaggcattcataccacgcatgaaaaaatgggattacattttgacatcatcagatattaatacgacgttgttggaatctgcttttatgctaaataaaaatccaaatcttaaagttctagaatacggcgcacctaagaatgaatatttaataaataataataatttacaagagcgccagcagttacagcttaaatatatgtataagatagatgatgataaaaaatatatattatattgtcccacttggaggggaaatcaaagaaaagaagtcactcagattaatttaaaagatttacttaaatatttaccagagaattatgagattattgtgaaacttcatcctaatgaaagtcatttaagaaccagatataatcaaatagataatcgaattcactgttatttcaatgaacttgttgatattcaagaactgtatattctgagtgaatgtatgattacagattactcgtcgaccatttttgactatatacatttaaacaagccagtctttattcttcaagaagacgagcaacaatataaacaaagtgttggtttttattttgatttgtttgaagtgggtgattttcttaaagcctctttaaatgaacacatgttagctaaacaaatttgtagcactgattatataaattattcaaaagtggttcatcgtttgatgaaacaagatagttcgaaaagcagtgaaaagttaatggccgaaattcttggggaaccagaatatccaagttcatcaaactgcaaacaacagatttcttaa

SEQ ID NO: 1505 - DNA, 1881 bp, Staphylococcus epidermidis
tatacactatatatagcgaagggtgacgaaatgactactctagaaacatcattaactcgattaatcacaaaagatccaactatattaaatgaaaatgcaaataaagatagtaatacattctcaacaatgcgagatttaacagctggaacggtatcaaagtcttatgcactcgatcatttacttccaaagcatgttgctcatgcacatcaatcgggagatattcattttcacgacttagattaccatccatttcaaccattaaccaattgttgtctcatagatgcaaaagatatgttagagaatggctttgagataggcaatgctaatgttacaacacttcaatcaatacaaaccgcttcagcacaacttgtacaaatcattgcaaacgtttcaagcagtcaatatggaggttgtactgtcgatcgtgttgacgaattactaagtaaatatgcacaaatgaacgcacaacatcacagggaagtagcgaatgatttcgttcaacctgacaaaattgagaattatgtggatacacaagtaactaaggatattggtgatgcaattgaaagtttagagtatgagattaacacactctatacttccaatggacaaacgccattcgttactttgggatttggtttaggaacagatcaattaagtcgaaaaattcaacaagcaattttacatacccgtattaaaggtctcggtaaagatagggtcactgcaattttccctaaacttgtattttcaataaaaaaggggattaactttggtccagaagatcctaactatgatattaaacaacttgcattggaatgttcaacaaagcgcatgtatcccgatattttaaattacgataaacttgtggaactgcttggtgattttaaagcaccgatgggatgtcgttcatttttaccaagttggaagaatgatgaaggtcaattggaaaataatggacgatgtaacttaggtgtagtgacgttgaacgtaccgagaattgcaatcgaagcagatggcaacatgcagcagttttgggatatctttgaaaaacgcatgcaattattacatgatgcacttgtgtatcggattgaaagactacaagatgctattccagataacgcgcctattttatataaaagtggtgcatttaaaaataaactcacttcagaagatactgtcgattcattatttacaaaacaacgcgcaacgatttcaatggggtatatcggtttatacgaagcggcaacattattttatggaccgaattgggaacacaatcctgaagctaaaacattcacactagacatattaagagaaatgaaacgttatcaagtagagtggacgaaacaatatgatatttggttcagtatatacagtacacctagtgaatcactaacagatagattttgccgattggacaaagaaaaatttggatctattccagatgttactgataaaggatattaccaaaattcattccactatgatgtgcgtaaagatgtaacgccgtttgaaaaattagattttgaaaaagactatccttactatgcaagtggtggattcattcattattgtgaatatccaaagttaaatcataatctgaaagctttagaagcagtatgggattatgcttatgataaggtaggttatttaggtacgaatattcctattgatcactgttatcgttgtggctatgatggagattttgaaactactgctaacggatatagatgcccacattgtggtaacactgatcctaaaacggttgacgttgtaaaaagaacatgtggttatttaggaaatccagttcaaagacctgttattgaaggtcgacaaaaagagatatgtgcaagagtgaaacacatgaaggcacttcgttcatga

SEQ ID NO: 1506 - DNA, 1683 bp, Staphylococcus epidermidis
tataatgtatattttaattttaataaagaggaatttgtaaatatgaaaaataattggatagatgtattagatgaaagtttagtcaaagatttttataataatcaaacttccgaagagcaacaagaaggacttaatactacactgtcttttggcacggctggtattagagggaaattcggtttaggtgaaggacgattaaataagttcacagtatctaaagtagcgttaggctttgcccattatttaacatcaagtatcgcgcatcctgttgtcgtcatacattatgacacaagacacttatcacctgaatttgctcaaattatcgctaatattctagcaagtcttgatattaaagtttatcttgctgatacatacagaacaacacctgatttgtcatttgcagtcagatacttacaggctgatgcgggtgttatgattacagctagtcataatcctaaagattacaatggaattaaagtttatggagaagatggtgctcaattatcaaccgacgattccgcacgactaagcacatatatcgataagttaggtcatccgcttcatattaatttacctagtttaactactgaacaacaatcattaattcattcagtcccgagcgaagtcagagaagattatttcaaaaacgtacaagacttagttggaacgattccacagtctgatttaaaagttgtctttacaagcttgcatggtacgagtgtgccagttgtacctgacatcttatcttctcttaactttaatcaatttgagttagtcgcatcacaatgtgaacctgattcagatttcagctctgtagccagtgcaaatccagaggatcataaagcctttgatcaatcgatagaactcgctaatcacattgatgctgatttacttattggcacagatcccgatgcagaccgtttaggaatagttgaacgtgatgctgaaggtaacatccactattacaacggaaatcagattggtgcacttttgttaaattatcgtatcaaacaaacagaaggattatctaacagaattatgttccaatcaattgtaagtggtggcttagctaaatctcttgctcaatatcataatgtcaatttcaaagaagttttgacaggttttaaatatatcgcagctgaaataagacatctgtctcctgaacaaaactttatttttggctacgaggaaagttatggcttcttagcccgtcctttcgtgagagataaagatgcgattcaaattgtgccattaatgattaagtatgcagctgaattaaaaaacaaaggacgcatgcttaaagatgaattagaagacattactcgaaatgtcggtaactttaatgacaagcttttctcacatacatttgaaggtactcaaggcaaggcaaaaatcgaaaatattatgactcaattcagaagtgaaacaccttcggaaatgtgtggtcttaaagtcattgcaatcgaagattttgaaacaggtaaaaagactgacttacaaaatgatgaagtcagcgatataactttacctaaagcgaatgtaataaagatatactttaatgaaggatttattgctttgcgtccttctggtacagagcctaaaattaaactttatgtatcactttcttgtgaccattttgacgtagttgcacaaaaaatgaacgatgctatatttaactcttaa

SEQ ID NO: 1507 - DNA, 801 bp, Staphylococcus epidermidis
tattggacatatcattttaaagagaaaggaaagatggtaatcatggatgacttgaaacaaaatcaatcttctaacgaaaaacctaaaggtaataaaataattaatattttgatattcatcggaatgattttattaattcaaatacctattggcgtgtcactaatagctttacctttttcagtgaaattcagtaagttaacatccatcgcattaagtatgctaataactggtacagcactattaatcatatggttagttaggaattattatttgagtcatacatatgaaagacaatatcaatcaatgaggggaaaagatatctttattaatattggttttctggtattatcaatggtttttagtattctaagtagtgtattaatggtcatatttactggcaacgatactacagcgaatgagaaagaaatcaatgaaagtttagatttacttttacaaaaagaccatttaccacatatttcaattgttgcaactgttgttttaatgatatgtattataggtccgtatttagaggaattactcttccgaggaatttttaaagaaacattatttatgaaatatcgattttggctaccattcattatatcttctattatttttagttcacaacatttatcaacaaatatattttcatatgcaatttattttctaatgggttgtgtattataccttgcctataacagaagacgtaatatcaaagatagtatgatggttcacatgttgaataattctgtttcaacattaccggtatttgttggttatttatggatatattttagatag

SEQ ID NO: 1508 - DNA, 1011 bp, Staphylococcus epidermidis
tttcaaaaatatacatattacaccaatattgatatgaaggggacagtaagtagaatgaaaaatcttaagtttttagtggtgcttgttttatcggtggttatttttgcagcagcctgtgggaattcaagttctttggataataataaaagttcggatagtggatcagattcaaaatcgggtagttatacacctaaagaattaacagtacaatttgtaccttctcaaaacgctgatacactcgaagctaaggcaaaaccgttagaaaaattgttgtcagataaattagggattccggttaaagtatcagtttcaacaaactacaacacgatagttgaagcgatgaaatctaagaaagtggatgttggtttcttgccaccaactgcatatacattagcacacgatcaaaaggcagcggatttattattaaaggcagaacgttacgacgttaatgaagatgggtctccaagtaaaaagttagttgatgattataaatcagaaatccttgttaaaaaggactctggtattaataatctcaaagatttaaaaggtaaaaaaattgcattacaagatgtaacttctacagcaggatatacattccctctagtaacattaaaaaaagaagctggtattgatgcaacaaaagatatgaaaatagtcaatgttaaaggacacgatcaagcagttatttcattgttaaatggagatgtggatgcagcagctgtatttaatgatgcacgtacagttgtaaaaaaagatcaaccaaatgtatttaaagatactaaaatattaaaactcactaaacctattcctaatgatacgatttcagtacgtcctgatatggataaaaaattccaagataaattgaaaaaagcttttaaagaaatttctaaaactaaaaaaggtcataaaatcattagcgaggtatattctcatgaaggttatgttgatactaaagattcagactttgatatcgttagacaatatgaaaaagctgttcatgatatgaaataa

SEQ ID NO: 1509 - DNA, 1335 bp, Staphylococcus epidermidis
aatatgaaatattgcagtaattgtggtcaacctcttcgagaaggtgtaaaggtgtgtacaaattgtggtacgcctgtgagaaatgatggacctaattataaacattcagaacaacgttattctcatcaacaaccacgttccaataagagtaataaaaaaacttggttgattgttactatagtgttagccattatcattgctttggtagtaatctttactatagctaaaaatcaaatgtctccagaaaaacaagcgactcacattgcacatgctatcaaaaaagacgatgctaaatcattatctaagcaattaacatcaaacgatcatcgtttaaatgaagaagaagcacgtgcgtacttaaagtatattaaagcagaaagtgatttaaagcatgttgctgacaaagttgaagaaaacaccaaagatattaaaaataatcactataacaatttatctgtagatgcaaatgataataatattttaaatatatctaaagacgggaaaaaatatgttttttttgataactatcaatttaatgttcctcaaaaaacaattacgatcgtttcaagtgatagtggtgaaattacttatgaatttaacggggataaacatcatatttctgtagaagaagatgacgataaagaattaggaacatttcctatcggtgattataatttaaaagcatcaaaagacatggaaggtaaaaattttaaaggcgctattacaattgatatgagtgaaagtgatagtattgcatatgaatcgtttaaacaaaaacgttttaatgttgatactgaaggcggatatatattagataatgtaaaaatatatgctaatggtaaagaaataggcgatggtttttcatcagaaacatatggtccttatgatccagatgaagaagttatcgttcacgctgaaggttcatacgaaggaaaaacttttaaatcaaattcggtcaatgtagcaagtgcaagcgaaaaagatggtggtgtgacagatgtcacagtcaaattcgatgaagaagctattgatcagtatgtcgataaaaaattagatgaaaaatacgatgattcagatgacgagtcagataacgattcaagtagtggcgaagtaacgcgtgaaaatgtaattgataaagtagagtcatatgaaggacatacactagatactgatacgtatacgtataaagaacctgaaaaaaccggtgatggtaaatggggtttttcattcttagataaagatggagatttagctggatcgtacacggtagacattgacgacggttatgttacagaatatgacgaagatggtgaagaagttggatctggttattaa

SEQ ID NO: 1510 - DNA, 1545 bp, Staphylococcus epidermidis
aatatgaaatatatgattggtgtagatatggggacaacgagtacgaaggctgtgctatatgatgaaaatggcaagtttataatgaaacataatattggctatgacttacatacaccaaacgtagatgtgtctgaagaaaatccggatgaaatatttgatgctgtgcttatgacggttaaatatattgtaagagaatctggcatcgcaaaagaagatattaagtttatttccttgagtgcacaaatgcatagtttgattgctatgaacgaggataatcaacgtttaactgaaaatatcacttgggctgacaatcgtgcgaatgattatgctgatttaatagaaaaatcatatggcggttttgaattgtatcaacgaactggtacaccgattcatcctatgtcaccattatctaaaatcttttggatgagacatgaggaaccgaaaatatttaaacaaacagctatgtttgcagatttaaaaacatacgtactgtttcaattatatgaaaggttcgtcattgattattctttaggatcagctacaggtatgatgaacttagaacaattagattgggataataaggctttagaattgttaggtattgaaagaaatcagttaccacaacttgttccaactacacatgttttaactggaatgaaaaaacgctacgcaacgttgatggggattgatgagcaaacgcctgtgattgtcggagcgagcgatggcgtattatctaacttaggtgtaaatagctatcaaaaaggtgaagttgctgtaactattggcacatcgggtgcaattcgcacggtaattaatcagccaaaaacagacgagaaagggcgtattttctgttatattctcgacaaagatcaatatgtgattggcggtccagtcaataatggtggtgtcgtcttgagatggttgcgagatgaaattttagcgagtgaagttgaaacggctaaaaggttgggggtcgatccttatgatgtgttaactcagattgcaagcagagtaaaaccaggtgcagaaggattgatttttcatccctatttagctggagagcgcgcaccattgtggaatgctgacgcaagggggtcattcttcggattgacattatctcacaagaaagagcatatgattcgtgcggccttggaaggtgtactgtataacttatatacggtttatcttgctttaattgaagtgatgaatgaaacaccaacaacgattaaagcaacgggtggttttgctaaaagtgaaatttggcgacaaatgatggcagatatttttgatacagacttaatcgtacctgaaagctacgaaagttcatgtctaggtgcatgtgtacttggaatgaaagctctgggagaaatagatgatttttcagtcattaaagatatggttggtactacacatgcccatgaacctaaccaagaaacagttgccatctaccaacaacttgttaccatttttattaacattagtcgttctatgactgagaactacagtgatattgcgaatttccaacgagaacatttaagtgattaa

SEQ ID NO: 1511 - DNA, 1557 bp, Staphylococcus epidermidis
ggacggagatatggtcattcatttcccataaacaaagaggtgttagacatgacgatttataatatcaattttggaatcggttgggccagtagtggtgttgaatatgcacaagtgtatcgagcaaaactattaaggcaattaccttatccaacaaaatttatatttttagattttattcaatcagaaaatattcaaacactcacaagcaacatagggtttaaagatgatgaagttatttggctatatcaatacttcacagacgtaaaaatcgctcctacaacgtacacagttgatgatttaatttcagagttaggtaatgaggttactcgaaaagaacaaaacggtaaagtattacgactctatttaaataatcagcaaacattcgtaacctgctatttaaaaaatgctaacgaacattacgttgatcgtgcagagtttgtggtgaatggaatgttaattaggaaagatttttatagctatgtaagaacattctcggagtattatgctccttttgacaataaagctaaaatatatatgcgtcaattttataatgaaaatggatcaattgcatatcgcgaatatatagatgaagatgaacatgtttttgtgtttgatgatgcacgtttatacagtaaacaagcactcgtcgcatactttatacgtcaattgcgattgaattcagaggatatcattattattgatcgagcaactgatgtgggacaagccatattagaaaacaagggatccagtaaagttggcgtagtcgttcacgctgaacatttcagtgaaggtgcgactgatgggactcacattttatggaataattattatgagtatcaattcgaaaatgcacagcatattgatttctttatcacagcgacagatttgcaaaggcagacactaagtgaacaatttaaacaatataagaatgattgtccacgtatacgtacaattccagtaggtagtatagaatcgttacaatatcctgaaaaagaaagaaaaccatattccatcatgaccgcatcacgtcttgctaacgaaaaacatgttgattggatagtggaagctgtgattaaagctaaacatcagttacctcaattgagttttgatatctacggacaaggagaagaacaagaaaaaattaaaaatattattaccaaacatcgtgctgaggattacatacaaattaaaggacatagaaatcttcgtacaatatatcagcaatatgaattattcatagcggcctcacaaagtgaagggttcggactgacattaatggaagcggttggctctggtttaggtatgattggatttgatgtgaattatggcagtccgacatttattcgacatcatcaaaatggctatttgataccgatagattttgaacaagcgtctactgatgatatcacaacgcaaatcgctcatatgattattcgatattttgaagatggtcccataagggcacatgaggtatcgtatgacattgcagaatcatttaaaacatcgcatattgttgatctatggagacaactcattgaagaggtgctatatgattaa

SEQ ID NO: 1512 - DNA, 1539 bp, Staphylococcus epidermidis
aaactaactctcagtcaaagtttgtcttctatacttgatttatcatacatattgggaggcaatttatttatgaaatttatgaacaaaatgggtaagacgacgcttgcttcatcaatcgtagcagcatccgttttaagtacggtaaacgtatcatatgcttcaggtagctcagaacaaagtgctcaaactaagcaaacacaaaacgatgccattgctttcggcaacacaaaaaatccaaaaaatgtcatctttatggttggcgatggtatgggaccttcttttaacactgcatatcgctattataaaaataagcctggtgctaagaaaatgactccaactgcatttgataaatatctaaaaggaacaaatcgtacttattctaatgatcctaaagaaaatgttacagactctgctgctggaggaacagcttttagtaccggtcacaaaacatataacggtgcgattagtgttgatacaaataaaaaaccaattaaatctgtgctagaacaagctaaagaacaaggaaaatcaactggtttagtaactactgctgaacttactgatgcaacacctgctgtatatgctgctcatatagattcacgcgacaaaaaagatgaaattgcacagcaattttataatgataaaataaatggcaaacataaagtcgatgtgatgttaggtggcggtgcaaaatacttcggtaaagaaaataaaaatttagcgaaaaaattcaaaaaagatggttatgatatcgtttctaataaagatgaattaaatcaatcacaaagcaagcaagttttaggtactttctcagaaaaagatatgccattacaaatagatgcacctcaatctaatccgttgctagtagacatgcaaaacagtgcactaaataaattaagtaaaaataataaaggattctttttaatggttgagggtgcttcaattgataaagctgcacaccctaatgatatcactggtgtgatgtctgaaatgtctggtttcgaaacagcttttgataatgctattaattatgcaaagacacataaagatacacttgttgtagcaactgcagaccactcaactggtggtctatcaaccgcaaaaggtaaagattataaatggaatccagaggctattcacaagatgaaacattctggaatgtatatgacaaaacaaatcgctgatggaaaagatcctgaaaaagtaattaaagatggatacggcattgatttcccaaataaacaactcgataaagtcaaaaaagcagcagacgagcttcacaaattacaaaaagaaggtaaagatgacaaagacgaaaaagttgtagaacaaacaacaaaattacaaaatgcaattcaaaaaccaattaacgatgcttcacacacaggttggacaaccaatggccatacaggtgtagatgttaacacatatgcatatgggccaggttctaacaaattcaaagggaatatggaaaatacccaaagcgctaaaaacttatttgactttttcggagacaatgtaacatcaaatcaaaattag

SEQ ID NO: 1513 - DNA, 684 bp, Staphylococcus epidermidis
aacgtgacgtatggttatccgaaaaagtggaaggaaaacatgacttcaggacaagtaatagctgctgagttacgtttaggaatagtgagtggtgaaattgaatcccatatacaactaagtgaaaatcaagttgcacaacaatttaatgtgagtcgttcaccagtcagagatgcatttaagttacttcaaacagatcaactgattcaattagaacgtatgggcgcacaggtacttccttttggtgatcaagagaaaaaggaaatgtatgatttgcgtttgatgctcgaatcattcgccttttcaaaattaagtggaacagatacacaacatattgttaaggaaatgaaaaagcaattagaaatgatgaaggttgcagtccaattcgaggatgctgaagcatttacacaacatgattttgagtttcatgaggtgatgattcaagcaacaaaccatcagtatcttaaagtgttttggaatcaccttaagcctgttatggaatcactcatactcatttcaatgagacaaagaatgacaaatgaccccaaagatttcgagagaattcatagtaatcatcaagtttttatagatgctgttgagaacgatgatgcctccatattgagaaaagcattccatttaaattttgatgatgtaggagaaaatattgaagcattctggttacgttaa

SEQ ID NO: 1514 - DNA, 222 bp, Staphylococcus epidermidis
tataaagatttacttcggcacattttaaattcagccattaacttccaatatacaaaacacctgagacaaatatcgatgtctcaggctcagttatttaagtataaacacctacttgaaaagcacacttcaatttatgtactagtcattttaatatttaaattgtggagtgagaactattggtgtaccttaatgaaatttacgtgcatatgtacaatacattaa

SEQ ID NO: 1515 - DNA, 2835 bp, Staphylococcus epidermidis
atgcactatctgatgttgatgtactcgttgagtctgaaatgcttgtacttgttgactcacttaaggatgtacttgcactgtccgagtcgctctcacttgttgacgttgatccactttctgatgtcgatgtgctcgttgagtctgaaagactcgtacttctcgagtcacttaatgacgtacttgtactgtttgaggcactcacactcgttgatgttgatgtacttgtcgattctgaaacgctcgtacttgtcgagtcacttaacgatgtacttgcactgtccgagtcgctctcacttgttgatgttgacgcactgtctgatgtcgacatactcgttgaatctgaaagactcgtacttgtcgattcacttaatgacgtacttgcactattcgagtcactcacactcgttgatgttgacgcactttctgacgttgacgcgcttgttgaatctgaaacgcttgtgcttactgattcacttgatgacgtacttgcactgtccgagtcgctctcacttgttgatgcagatgcactgtctgatgtcgatgtacttgttgagtctgaaacgcttgtacttgttgagccactcaatgatgtgcttgtactgtttgactcactcacactcgttgatgtggatgcactatctgatgtggatgtgcttgttgattctgaatcacttgtgcttactgattcacttgatgacgtacttgcactgtccgagtcactcacactcgttgatgttgatgcactgtctgatgtcgatgtactcgttgaatctgaaacgctcgtacttaatgattcacttatggatgtgcttgtactgtttgactcactcacactcgttgatgttgatgcactgtctgatgttgatgtacttgttgagtctgaaatgcttgtacttgttgagccactcaacgatgtacttgctctttccgagtcgctctcacttgttgatgcagatgcactatcggatgttgatgtacttgttgagtctgaaacgcttgtacttaatgagccacttaacgatgtgctggcactgtttgagtcactcacactcgttgatgttgatgcactgtctgatgtcgatgtactcgttgaatctgaaagactcgtacttgtcgagccacttaaggatgtacttgctctttccgagtcgctctcacttgttgacgttgatgcactgtctgatgtcgatgtactcgttgaatctgaaagactcgtacttgtcgagccacttaacgatgtacttgcactgtctgactcactctcactcgttgatgtggacgcactgtcggatgtcgacgcgcttgttgaatctgaaacgcttgtgcttatcgactcgcttaatgacgtactttcacttgttgagtcactctcactcgttgacgttgatgcactgtcggatgtcgacgtactcgttgaatctgaaacgctcgtacttaatgattcacttatggatgtacttgcactttccgagtcgctcacactcgttgatgttgatgcactgtcggatgtcgacgcgcttgttgaatctgaaacgcttgtgcttgtcgactcgcttaatgacgtactttcacttgttgagtcactctcactcgttgacgttgatgcactttctgacgttgacgtacttgttgagtccgaaagacttgtgcttgtcgattcacttaatgacgtacttgtactgtctgactcactctcactcgttgacgttgatgcactgtcggatgtcgacgtactcgttgaatctgaaatgcttgtacttaatgatccacttaacgatgtgctggcactgtttgactcactctcactcgttgatgtggatgcactttctgacgttgacgcgcttgttgaatctgaaacgcttgtgcttaatgattcactcaacgatgtactttcacttgttgagtcactctcgcttgttgacgttgatgcactgtcggatgtcgacgcactcgttgagcctgaaagactcgtacttgtcgattcacttaatgacgtacttgtactgtctgactcactctcactcgttgacgttgatgcactgtcggatgtcgacgcactcgttgagcctgaaagactcgtacttgtcgattcacttaatgacgtacttttactgtttgattcactctcgctcgctgacattgatgcactgtcggatgtcgacgtactcgttgaatctgaaacgcttgtacttgtcgattcacttaatgacgtacttgcactgtctgactcactctcactcgttgatgtggacgcactgtcggatgtcgatgtacttgttgaatctgaaacgcttgtgcttgtcgatttacttaatgacgtacttgcgctattggagtcacttacgctcgttgacgttgatgcgctatcagacgtcgacgtactcactgattctgataatagtttacttgtgcttgctgattcgctcgcttttattgatgcgctatcagacgtcgatgtgctcgttgagtctgaaatgcttgtacttgttgagccactcacacttgttgatgttgacgcactttctgacgttgacacgcttgctgaatctgaaacgcttgtgcttgtcgattcacttaatgacgtacttttactcgttgactcactctttcttgctgactctgatgcactatcagatgtcgacgtactcgctgattctgataattgtttacttgtgcttgctgattcgctcgcttggattgacgtactattcgacgtcgacgcacttaacgactctgagagactcttacttgttgataatgattgactcgcttttacactatcacttagcgatgtactattacttatacttgttgaaacactatttactatgctag

SEQ ID NO: 1516 - DNA, 1197 bp, Staphylococcus epidermidis
aaggggcatctagttgttatgactgtcgcacgcacaacaacatttatattaagtgttttcatcgtaggtatggttgagatgatggttgcaggtattatgaatttaatgagtcaagatcttcatgtttctgaagcggtggttgggcaactggtaacgttgtacgcgcttacctttgcgatatgtggtccgttattagtgaagttgactcatcggttttcttcgcgatcagtattattatggacgttaattgtctttatcttcgggaatggtatgattgccattgcgccacattttggaataatagttgtaggacgtattttatcttctgccgcagcttcactcattattgtgaaagttttagcactcacagcgatgctcacatcagcaaaaaacagaggtaaaatgattggtattgtttatacaggttttagtggagcgaatgtctttggtgttcccatcggtacagtgattggcgactgggtaggatggcgatttacatttttattcattattattgtaagtgtatttgttggtgttttaatgttaatatatctaccaaaagaagatgaattgtcacatccaaatcaaacacctcgttcatctagtattgaatcacaaactggctcaagcgtcataagacctcgtgaggtttttaaatatctgatgattacatttttagtgctggttgctaattctgtaacattcgtgtttattaatccattaattttatccaatggacatgaaatgtcttttgtgtctttagcactacttgttaatggtgtagcaggtgtgattggtacttcattaggcggtgttttatctgataagtttactagtaagcgttggttaataatttcgatttcaatatttataataatgatgataattcttaacttattattaccaggaacaggattattattagttggcttatttatgtggaatttaatgcagtggagtacaaatccagctattcaaagcggtattattgaacacgtcgaaggagatacaagccaagtgatgagttggaatatgtcgagtctcaatgccggtattggcgttggcggaatcgtaggtggactcgttatgacacatttatcagtggaatatgttacttatactagtgcattgataggtttaattagtcttatcattgtattcactttaaaaaatagacattatgctaaaaatttatga

SEQ ID NO: 1517 - DNA, 198 bp, Staphylococcus epidermidis
acgtttattcatatcgttaatattgatgaaaatattaacgatatgaataaacgttcttctatcaattgcaataattatttcctttccaaactaaaaagtcgttgtaaagtggctataagtcatctccctcattcacgcacattacaacgacatgttatatataaattaaaacatttcagaaacaactttttgttctaa

SEQ ID NO: 1518 - DNA, 411 bp, Staphylococcus epidermidis
aatcatattcattatcaagaagccccaaatcttacaaaggttgaatatggtgaccattatgaacgcagatttatgaagcctaagaaattgaaggccaacatcgaatatacaacaccgcatggacacgtgtatcgaacggatcacaaaggccgtattaaagaagtatatgcggatgacctatcacttctagatggcggacgtaattcatatgcgcaacgaacagtaggaagagaataccgattaccagatgatgacggcggtcatttaattgcgcgcggattcggaggttctaaagatatagataatctcgtcccccaaagtaaatacatcaaccgctcatttaaagagaacggagaatggtataacatgaagaaagaatggcaaaaagcaattaaaaagggagagaagtaa

SEQ ID NO: 1519 - DNA, 2028 bp, Staphylococcus epidermidis
tgcacgactcataacattagaggagtagttataatgactcaaagctactgtattcttggaaaccctaatgtaggcaaaacatcattatttaatgcgttaaccggttcttacgaatatataggtaactggagtggcgtaaccgttgaaaagaaagtaggaaaattgaaagataatgtaggtgatttagttgatttaccgggcatttatgatttatcacctatttctaaagatgagacggttgtcacagattatttaatgtcaacgtcattcacaggaatgattaacattattgacgcatgtcagcttaaaagaaatcttaatcttacaatacagttgatggaactcaacaaacctatgattattggtttaaatatgatagatgttgcaacacaaagaggtattaaaattaactatcaagctttgatgagaaaattaaaagtaccggtatttccaattgttgctagaaaggcaaaggggacacatagtcttttaggagagcttaattatttagaaccacatcaacgtcgtgcatttaagattaattatggaactgaaattgaaactgcaattcaacaaatttgttcaattatcaaacaggataatatgtatccaacagaacgtttacgttttatagccatacagtatttaatagacaatgttcaaatttatcaagaactcgatgccatgattttagaacagttagaacccattaagcgaaagttaagtaacgcgacagaacaatcaacacgccaaagaattgaagctgtgcgaaatgattacattaatcagctattggaagatatcgtagaatatcccgaagaggataaacaattctttacttcaaaagtggatcgattattattaaatagatatctaggtatacctatatttttaggtattatgtggcttatttttcaaacaacctttacatggataggaacaccattatctgatcaattagacgcttttataagtggtcctttatcagaatggattaaatctgttatgaatacattacatattacgtcgtttcttcaagatcttattacagatggtattatcgctggtgtgggttctgtattggtatttgtaccacaaattgttgtgttattcttttttatttctttattagaagattcaggttatatggcaagaatagctgtattaatggataaaacaatggaatctataggtttaagtggaaaatcatttattcctatgattattggatttggatgcaatgtaccaagtattatggcagcaagaagtatagagaatgagaaagaacgtttgattacaatattggttgcacccttcatgtcatgttcagcacgcttaccggtttatgcactttttgtaggagcgttcttttcagcacatcaatcactagttgtattaagcttatatattttaggtatagttgtcgctttactagtaagtacgttattgaataaattgatattaaaagataatcagtctgtttttattgtggagttaccgacataccgtgttccatcatttaaaacactttggcgcagtacttgggaaaaagcaaaaggttttgtcaaaaaagcaggtacctttatttttggtggttcagtcgttatttggacactcacatacatcggtccgcacggtgttaatgtcccgattaatcaaagttttatgcatatgattggtcaagggttcgcgaatttaattgcacctttaggatttggctcttggcaggcaggagcaactttaatacctggctttcttgctaaagaagtgattatcagttctatggctattttatactcttctagcgaaagtggtttaacacaagtcattcaacagcaattcactccactttcagcttatgcattcatgatttttattttactttacgttccttgtatttcaacagtcgctacgattcgtaaagagacaagttcttggaaatggacattactagcggttgtttatccaatagcaacagcatatatattaacgttcgtattctatcaagttagtcaattatttatataa

SEQ ID NO: 1520 - DNA, 1083 bp, Staphylococcus epidermidis
cttgaacatcacgaaatacattcacttatgctattaaatttgatagcgacttataaaatgaaaggggcgcatcccatgaaaaacatcaagaaaccctttgatttaaaaggtaagtcattgctaaaagagtatgatcttacaggtgaagaatttgaaggtctaatcgattttgctatgacattaaaaaaatataaacaacaaggcacaccacatcgatatttagagggtaagaacattgctttactcttcgaaaagacatctactcggacgcgtgccgcatttacagtcgcatctattgatctaggtgcacaccctgaatttttagggaaaaatgatattcaattaggaaaaaaagaatctgttgaggatactgctaaagttttaggcagaatgtttgatggaattgaatttagaggtttttcacaaaaaactgttgaacaattggccgaattctctggagtaccagtatggaatgggttaactgatgattggcatcctacacaaatgttagctgattatatgacaattaaagaaaattttggatatttaaaaggcatcaacctaacttatgtaggaaacggacgtaataatgttgcacattcgcttatggtggcgggtgcgatgcttggcgtaaatgtacgtatttgtacaccctcatcattaacaccgagagatgtatattttaatattgctaaagatcaagcgtctaattatggaggttcagttaagatgactgataacattcatactgctgtcaaagatgcagatgttatttatactgatgtttgggtatcaatgggtgaagaaagtgaattcgaaacacgtattcatttattgaaagactatcaagttaatagaaaaatgcttaatttaaccggtaaagtagatacgatatttttacattgtttaccagcttttcatgatacacaaacagaatatgggcagaatatttttgagaaatatggcttaactgaaatggaagtgacagacgaaatctttagaagtgagcattctagagtgtttgatcaagctgaaaatcgaatgcatacgattaaagccgtgatggcagcaactttaggctag

SEQ ID NO: 1521 - DNA, 477 bp, Staphylococcus epidermidis
gaggttgatcattcaatgaaaaagagtaaacgacaagatttagtaactatgattgttaagcaaaatcacatttataaaaaagcagatattattgattacattgatgatcactttggtgtacgttatagcatgactactattgcgagagatttaagagaacttcatatttatcgcctgcctgtgaaggcaaatcaatatgaatacaaattacttacgcaacaatctcaattagactcaagagtaagactaaatgattatatagaaacagaaattattaacactatgattaaagaatcgtatatactaataaagacgacaccaggatttgcacaaagcataaattattatattgatcagttacaactgaaagagattataggaacgataagtggtaatgatacaattatgattcttacacattcccagtctatagctgaatatgtctattacaaaatatttaatcataattattcataa

SEQ ID NO: 1522 - DNA, 297 bp, Staphylococcus epidermidis
gggatgagtcaatatccattctatagacgcatgtttatcatcataaaaaaatgtacactcatatataattcaataaaggagttgtatcctatgagaaaaatacttaagggtattatattatcattaataatcatcggcttaatcaaaacgttcaatgaatatgatattatacattgtgcaaatcattatttcgaacaaatcaaaagtggaaaaataattgaagatatcaaaatcgatcatttcaataattatcataatattaattttgaagatctaaatccttctgactttttttaa

SEQ ID NO: 1523 - DNA, 732 bp, Staphylococcus epidermidis
aagagaggtcatattgtgattgaagcgaatcaaattttagctaaaatgaaaaatcaaaaaatcaactatgataaagtattaagaaagataatttctcaatgggaacgtgatggagaacgccctaaaatcttacttcatagttgttgtgcaccttgtagtacatatacgttagagtttttaacacaatatgcggatatagcgatttattttgcgaatcctaatatacatcccaaaagtgaatatttaagacgtgctaaagttcaagaacaatttgtaaatgattttaataataaaacaggtgcaaatgtaaagtatattgaagccgaatatgaaccgcataaatttatgaaaatggcaaaagataaaggtttaactgaagagccggaaggtggactaagatgtacggcttgtttcgagatgcgattagaaattgttgcaaaagctgctttagaacatggttacgattattttggtagtgcaatcacactctctccaaagaaaaatgcgcaattaatcaatgaactaggtatggatgtacaaaatatatataatgtaaaatatttaccaagtgattttaaaaagaataaagggtatgaacgttctatcgaaatgtgtaatgattataatatttttagacaatgttattgtggttgtgtatttgcagcgatgaagcaaggtatagattttaaacaaataaataaagatgctcaagcatttttacaacaattttaa

SEQ ID NO: 1524 - DNA, 1983 bp, Staphylococcus epidermidis
gggagcacacataagatgaagaaaaataaatttttagtatatttactatcgacggcgcttatcacgccaaccttcgctacacaaacagcttttgctgaagattcatctaataaaaatacaaattcagataaaatggaacaacatcaatcacaaaaagaaacatcaaaacaatctgaaaaagatgaatttaacaacgatgattctaaacacgattctgatgataaaaaaagcacttctgacagcaaggacaaagactctaataaaccattatcagctgactcaacacatcgtaactataaaatgaaagatgataatttagttgatcaactttatgataattttaagtctcagtcagtagatttttctaaatactgggaaccgaataaatacgaagacagttttagtttaacgtcactcatccaaaatttatttgattttgattctgatataacagattacgaacagccacaaaagacaagccattcttctaatgacgaaaaagatcaagtagaccaagcagatcaggcaaaacaaccatcacaacatcaagaaccatcacagtcgtctgctaaacaagatcaagaatcatcaaacgatgaaaaagaaaagacaactaaccatcaagccgattctgacgtcagtgatttacttggagaaatggataaagaagatcaagaaggcgaagacgtagatacaaacaaaaatcaatcttcttctgagcaacaacaaactcaagcgaatgatgatagctcagaacataacaagaaatattctagtattacagattcagcattagactctatattagatgaatatagtcaggacgctaagaaaacagaaaaagattacaataagagcaagaatacaagtcacactaaaacatctcaaagtgataatgccgacaaaaatccacaattaccaacagatgatgaattaaaacatcaatcaaaacctgcacaatcatttgaggatgacattaaacgctcaaatacacgttcaacaagtcttttccaacaactacctgaattagacaatggtgacttatcttctgattcatttaatgttgttgacagtcaagacacacgtgatttcattcaatcaattgctaaagatgcgcatcagattggaaaagaccaagatatatatgcatcagttatgattgctcaagctattttagaatctgactctggaaaaagttcacttgcacaatcaccaaatcataacttgtttggaatcaaaggtgactacaaaggacaatctgtaacttttaatactttagaagctgatagcagtaatcatatgttcagtatccaagcaggtttccgtaaatacccaagtactaaacaatctcttgaagattatgcagatttaatcaaacatggtatcgatggtaatccgtcaatttataaaccaacttggaagagtgaagctctatcatataaagatgctacttcacatctgtcacgctcatacgccacagatcctaattattctaaaaaattaaatagtattattaaacattatcatttaacatcttttgacaaagaaaaaatgcctaacatgaagaaatacaacaaatcaataggtacggatgtctctggtaatgacttcaaaccatttactgaaacttccggtacatcaccttacccacatggccaatgtacttggtatgtgtaccaccgtatgaatcaatttgatgcatccatttctggtgacttaggtgatgctcataattggaataatcgtgctgaaagtgaaggctatacggtaacgcacacacctaaaaatcatactgcagttgtgtttgaagctggacaattaggtgctgatacacagtatggtcatgttgctttcgttgaaaaagttaatgacgacggttcaattgttatttctgaatcaaatgttaaaggattaggtgtcatttcattcagaactattgatgcagaagatgctcaagatttagattacattaaaggtaaatag

SEQ ID NO: 1525 - DNA, 684 bp, Staphylococcus epidermidis
cataaaggtcttagaagaagaaaaagacaatttctatatttattcaatagaaattgtcttttttataattgtataaagaaaaccatgcgctatgcgtatggttcagaaaaggttttaccgttatctaaaaaaacatctcatcatgctagaatatatattggtcagccaaccaaaatattcaacacgaggagatgcttttttatgtcatctgacacaaacagtttagcacatacaaaatggaattgtaagtatcacatagtctttgcaccaaaatatagaagacaagtgatatacggaaaaatcaaaagagatattggagttattttacgtcaactatgtgaaagaaaaggcgtagaaataatagaagcagaagcatctaaaaatcatattcatatgttagttagtattccacctaaattaggagtatcctcatttgttggatatttaaaaggtaaaagcagtttaatgatttttgatagacatgctaatttaaaatatagatatggaaatagaaagttttggtgtaaaggattttatgtagatacagtaggtagaaataaaaaggtaattgaaaattacattcgtaatcaattacaagaagagatcgttgcagatcaaatttcaatggaagaatacctagatccctttacaggagaagaaattaaaaaaagacgaaaaaaatag

SEQ ID NO: 1526 - DNA, 756 bp, Staphylococcus epidermidis
ataacaaaacaaacaaattttaaattatatctggaggatttatatatcatgaaaaaaacagttatcgcttctacattagcagtatctttaggaattgcaggttacggtttatcaggacatgaagcacacgcttcagaaactacaaacgttgataaagcacacttagtagatttagcacaacataatcctgaagaattaaatgctaaaccagttcaagctggtgcttacgatattcatttcgtagacaatggataccaatacaacttcacttcaaatggttctgaatggtcatggagctacgctgtagctggttcagatgctgattacacagaatcatcatcaaaccaagaagtaagtgcaaatacacaatctagtaacacaaatgtacaagctgtttcagctccaacttcttcagaaagtcgtagctacagcacatcaactacttcatactcagcaccaagccataactacagctctcacagtagttcagtaagattatcaaatggtaatactgctggttctgtaggttcatatgctgctgctcaaatggctgcacgtactggtgtatctgcttcaacatgggaacacatcattgctagagaatcaaatggtcaattacatgcacgtaatgcttcaggtgctgctggattattccaaactatgccaggttggggttcaactggttcagtaaatgatcaaatcaatgccgcttataaagcatataaagcacaaggtttatctgcttggggtatgtaa

SEQ ID NO: 1527 - DNA, 228 bp, Staphylococcus epidermidis
ctttattttaaatatatcggtgacagacatccactgaaaaacactagttatatttttaaaatgagagcttcaggaatttttctctatacaaataaaccgataaataaaataaatataatacctgatactgaaataattgtctctaataacgaccatgttaaaaatgtttctttaactgtcagcccgaaatattctttaaacatccagaatcctgcatcattgacgtga

SEQ ID NO: 1528 - DNA, 1101 bp, Staphylococcus epidermidis
agacttattaatggaggaatgactatgccagaatctaaagcgttacttaaatctttaacagatgttaatggtatttctggacatgaaatgcaagttaaatctttaatgaaagattatttaacacctgtgagcgatgatatcgttgaagaccaattaggtggtatttttggtaaaaagaatgctactcatggaactaaatctttaatgatttctggccatttagatgaaattggctttatcgttacacaaattgatgaacaaggatacatttatttcacgccaattggtggatggtggaatcaagtcatgttatctcaaaaagtgacgattactactgaaagtggcaaagagatacgtggaattattggttctaaacctccacacgccctctcgtcggaagaacgcaaaaaaccagttgatattaaaaatatgtacatcgatattggtgtgcgtaataaagaagaagcgaaagaagcgggaatcgaattaggtaatatgattacaccttatagcgaatttgaatcattagcgaatgataaatacttaactgctaaagcttttgataatcgctatggatgtgcactcgctgttgaagtacttcaacaactaaaagatgaaaacatagacatcaatttatatgccggtgcaactgtacaagaagaagtaggtttacgtggtgctaaagttgcagcaaatttgattaaacctgatttagcaattgcggtggacgtcggggttgcatacgatgttccaggtatgacgagtgaaaaaaatgaaggtaagttgggcgatggtccattagcaatattgatggatgccactagtatcgctcacgatggtttgcgcaaacatattaaagacgttgctgagcatcataatattccagtacagtgggcaacaacacctggtggtggtacagatgcaggtagcattcatgtagccaatgaaggtatcccaacgattacaatcggcgtgccattaagatatatgcactctaatgtatctgtgctcaacattgatgattatacaaattcagtgcgcttaattactgagattgttcgatcattaaatgatgacagttatcaagcacttatgtggtaa

SEQ ID NO: 1529 - DNA, 189 bp, Staphylococcus epidermidis
gttaaaattaaagtaactaatcttatattgaggtgtatcatgagaaaactgatatctaccattatcgtttcaacattattaattggaggatgttccacggtgcataaagaagcaaaacatacatcacaatcaattcctgaagaagttcccgcaagtcaatacaaaggtcaaggtttccacaaccagtag

SEQ ID NO: 1530 - DNA, 882 bp, Staphylococcus epidermidis
atggaaattaaacaaattaaatatttcgtagaagttgtacgacaaggtggtatgacgcaagcatctgaacacttatacattgcacagtcaacgattagcaaagcgattaaaaatattgaaaatgaatacgatattacattgtttgaccggtcacaaaaacaaataaaactaacagatataggtcaaacattttatgataatagtttagaatttttagctttattcgagaaattatctttagaaatgaatgacattgtgaacgttcaaaaaggtcatattaaaataggcttatcaccaatgatgaatgttcaaatgtttacaaatgcattgaatcagtttcacagactctatcctaatgtgacatatgaagtgattgagggtggtggtaaaattgttgagaacttaacatctaatgatgatgtggatattggtattactacattacctgtagatcacactgaatttcattcaacttctttatataatgaagaattattattagtagtaagtaatgaccatcatttagcacatttaaataaagtagacatggcagatttgaaagatgaagagtttgttttatttcatgatgattattatttaaaagatcaaattatagagaactgtaaaaggctaggctattaccctaaaactgttgctaatatttctcaaattagttttatcgctaatatgattcaacaaggaataggaattagtatcgttccagaaagtttagttaatttaatggggaataacgtaacgtccattcaattagagaatgttgaattatcatggcatcttggcgtgatatggagaaaagatgcttatctcaatcatgtaactcgcaaatggattgaatttatttctgagatgaaaccaacatag

SEQ ID NO: 1531 - DNA, 273 bp, Staphylococcus epidermidis
atgaagattaacatatttggatataatatcttcgccaagggcggaacatcaagaagtaatattaacttagtgaaaagcttattagaaattggacatgaggtacactactttaattatcaggactataataaaagtgatatcacaaaactaattatttacgaaggtttgagcacaaagcatcttcatattcatcaatttaatagtggaaaagaacttgctcatggagacctacttataattactagagaaacctttttaatcatgcatatctag

SEQ ID NO: 1532 - DNA, 912 bp, Staphylococcus epidermidis
agggggattaacatgtttgattcaattagagagacaatagattattcagttgaaaataacatcagttttgctgatatgatgattaatgatgaaatggaaagagaaggtaaatctcgcgaagaagtgcgtgatttaatgagacaaaacttaaatgttatgcgtgaggcagttgaaaaaggtacgactggcgacggtgtggaaagtgtaacaggttatacaggtcatgacgctgctaaacttcgagattacaacgagaataatcatgcattatcaggtcatgaaatgattgatgcagtcaaaggtgcagttgcaacgaacgaagtcaatgcagcaatgggtattatttgtgctactccgacagctggttcctcgggaacgattcccggcgtaatatttaaattagaaaaaactcataatatcactgaagatcaaatgatagattttctattcacatcagctttattcgggcgagtagttgcaaacaacgcaagcgttgccggtgcaactggtggttgtcaagccgaagtgggttcggcatctgcaatggctgcagctgctgcagtatcaatttttaacgggtcaccagaacaatcaggacatgccatggcattggcaattagtaacttattaggcttagtttgcgatccagttgctggtttagttgaaattccatgtgtaatgcgtaatgctattggttcaggaaatgcattaatatctgcagaccttgcactagctggagttgaaagtcaaattccagttgatgaagtcataggtgctatggatagagtaggtcgtaatttacctgcatcattaagagaaacaggtttaggcggtttagcaggtacacctactggcgaagaaattaaacgtaaaatattcggcgaagcagacaacatggttaaaaataaataa

SEQ ID NO: 1533 - DNA, 303 bp, Staphylococcus epidermidis
gagttgactaaaatgattataattaatgctaaattaaaaatcgatgctaataaacgcgaggattatctaaaacttatgaaagaattagtcataaattctagaaaagaagacggtaatttattctatcatcattacgaagatgtaactgagaaaaatgtctttgtcgtagttgaaaactataaagacgaacaagcggttcaagcacacaatcaatcagatcactttaaagtttttagtgataatattagtcaatatttaattgaagaacctcaaattgatgtaagtcaacctattcaattataa

SEQ ID NO: 1534 - DNA, 942 bp, Staphylococcus epidermidis
ttattttataaagtggtttattttgttgagttaaatatattagaatgtgagggagtatttgaattgaagaaattagcagtgatatgtgcgtttacaatattaatattagctggttgtggtcttggtgatagtgataataatggaagctcaacgataaatgatgatcaacaatcaggatataaaagtaacagagattcaaaatcaagtataagtagaaatcaaacagaagataatcagcaggacacacaacaagatacccattcgaatagatactatgctcaagtttggttaactgctttagatagttatagaggtgaaagtgaccttccttttgacgatttagaaattgtacatcaaaatatttctaataaagttttagatccctatcacccagacgaatcagccaaactacctgaaggaacagaattgttaacagcaagtgttactgcagcaggttcagtttattataaaagtaatggagatggcacaattacaatatatagtgtaccatcacatttccaagggagttggcgtgacgctgattactctaaaagagaatctcaacgcattatagatgatgctcgtacagttaagttatacaacgctagtgaaagtgaaatcaataagataagtcagatgatgaggactgaattttcagttggtgataatttaacagatgaagatgatacttctgaatctgaagatcaatcaagtagttctgatgaagtaacggtgacacgaagtaatgttatcgatatagttgaagactacgaagggcatcaattagatacagacacatatatttacaaagaaccagaaaaagatagcgatggtagttgggggttctcatttacagataaagaaggccatttagaaggatcttatattatcgataaagatggagaagtaacgaagtatgatgaagatggagagccagaataa

SEQ ID NO: 1535 - DNA, 240 bp, Staphylococcus epidermidis
attccatataaaggagtatatattttccgccactttttcaactcatatattctcaaattgatttatagtaatagtatgtatttctcttcattattatttagacatttacttcaaaacaatataattgaaataaaaaagagtctggacatccatctaccttgtgtccagactcttaatcatgctcatagtattttattgattcaatcatcatcttatttatatcttttcaaacctttttga

SEQ ID NO: 1536 - DNA, 687 bp, Staphylococcus epidermidis
tgtcgatataaggatgtgtttaaattgctacttaaggttgaacatcttacatacaaggttgataatcgtacgattttagatgatattaatttgaatattaataaaggagacacgattgctattgtaggtccttctggaagcggtaagagtactttactcaaacaattgaatcatttaattagtcccacgagtggagatttatatttgaatgatcaatcttactttaattataagccggaagagataagaacacgtgtgagttatttaatgcaacaaagtgagttaatcggttatacaattgaagataatatgaaatttcctgctgaggctagaagtgaagcttttgaccgtgataaagcgaaacaactcatctctcaagtaggattaggtaattatcagttagatgctcaaattgagcacatgtctgggggagagcaacaacgtattaccatcgctagacaactcatgtatgaacctgaagttttattattggacgaagctactagcgctttagatacacataataaaaagaaaattgaagaaattatatttaaactagcagataaagggattgccattttgtggattacgcatagtgatgaccaaagtatgcgtcattttaagcgtagaatcacaattactgacggtaagatatcgagtgatgaggagttgaatggtaatgagtaa

SEQ ID NO: 1537 - DNA, 318 bp, Staphylococcus epidermidis
ataacgtataaaagtttaagaatgctattattcattggaggtcctatcatggataaaataaacaaagaagataccgatactaaaaaagatagtaataacaactataaacatcaaaatgaccatatagatagacaaggtttaaatggttatcaaaaaactgatttagatcttgagatagaacgagaactacaggaaatgatggaaaatggagaatctaataaagaaacaaaaagtaagcatttcaaaatcttatctttcgtttcaatgattgtcattgtagtgatagccatcatacgattcatccaaaaaacgatataa

SEQ ID NO: 1538 - DNA, 297 bp, Staphylococcus epidermidis
caattaaataaagcctataagaataacttaatggctaaaacaaacaagtctgggacaaggatattttatgtcccagaccttctttatgtatatacagattcttatgagatgagtccaacacagagaatttccgaagaaattccacggacaaagcaagttggggttggggccccaacagagagaatttccgaagaaattccacggacaaagcaagttggggttggggagaagacaggggacaatgaattctatcctagtttagcgttcattttaataaggggaattttacaaagttga

SEQ ID NO: 1539 - DNA, 813 bp, Staphylococcus epidermidis
gggtggaataaagtgacgacaccaacaacgcataaatataatcgctatttaaataaaaggatgtctcttaaaactagcttttcaattattttaatcacgggtttgattatctggagttttatttatactggatttagcattggagatttaatgataggtctgccacaaattggcgtattcttcaaacaaatgatacctccagattggggttatctagatcatattacacaaccaatgctagacacgattcgtatggcaattgtcggtacttttctaggaagtattgtctccattcctatagcgttactgtgtgcgagtaatattgttcaaacaaagtggattgcgattccatcacgttttgtccttaatattgtacgcacaatacctgatttattattagctgccgtatttgtagccatatttggtattggacaaattccgggtgtattagcactttttgttctaacaatatgtatcattggtaaattattatatgaatcattagaaacaattgatccaggacctatggaagctatgacagctgtaggggctaataaagtgaaatggattgcatttggcgttgttcctcaagcaatttcatcatttatgtcatatgtgttatttgcctttgaaattaacattcgggcatcagcagttttaggtcttgttggcgcaggtggtattgggttgttctacgatcaaacgttaggattgtttcaatataaaaagacagcaatgattatcctgttcactctaatcattgtagttattattgactatgtgagttcgaaagtgagggaaaaattagcatga

SEQ ID NO: 1540 - DNA, 231 bp, Staphylococcus epidermidis
agaggtgataaggtgagtttttatcattttatacaaaatttcgttggtgatgaaacacctctaggtaaactagccacatgtattaaccaagatgaagatttacctatggaagaaacaacagcacataatatattaaactattttaatcagttaaattattttgatgacgattgtattgaagctgtaaaacgctcactatcactatatgaacaaagtaaagtagccctataa

SEQ ID NO: 1541 - DNA, 2637 bp, Staphylococcus epidermidis
aaaggagataacagtatgtctaaaagctacgctaaattttacaaatgtgctttgcaagttaacccatatagttacattaaatatagaggcctagaacatgaaatgacagaggaacaatataatgagtctatataccaatattgtaagaccaataatatatcaattattggtctagcagatcatggtaacgttgataactcgagtaaactcagacaatatttagtatctaaaggtatccttgtatttccaggttttgaaatttccacatcagaaaaagttcacattgtatgtttattttcagaaaataccgaagaacgagaattagagagatacttaggagaactaggattatcaaatcttgaagaaggtaattctccaagtactctaagttttcatgaaatcacacaaaaagtattagatagaggaggattttggtacgcagcacatgttaccagtgataatggcatcttgaaaggaaaacataacaatctctggcaatcagataaattaatagcagcacaaataccttcaaaaaaaaacgaagtagaccctaagtatactagtatacttaaaaataaagatcctaattatcaaaaacaaactccttttgctcttattaatgctaaagatattagtaaaccggaagatctagcgttagatacttcaagttgtttaattaaaatgtcaaagcttaattttgaaagctttaaattagcttttagagatcctgatgctagagttaaattaaactctgacattaataacaaatttccacattcttctattgataaaattaaaatttctatgggatacttggataacctctcgttagatttatcttcaaatcttaatactattattggtggtagaggaactggaaaatcaacacttatcgaattaattcgttatgcattagatatagctcctacgagtcaaaatacaaacacatcttttgaaaacatctgtaagtctaatttaggaatcggtggaaaagtagaattaattgtcacatcacatgcacaatatggtaaacaatttaagataataaaaagatataatgaagatcctataattaaagatatagacaacaatgtgtcaaattacacagttaaagatattctccctaatatagaggtctatagccaaaatgaaattatcgatttaactacaaatgaaaacgcaaaactaaacattttgaatcgatttttagataaagatgatagaagtaatgataaaaaagaagaaataaaaactaatttacattcaaattcaaaatctttaattaaagctaaagaagatcttgaaaatttacaagaaaagatcaatcaattacctaaattaaaagaaaagttaaaacatttcaatgaactaggtattggaaagaaattagaagtacagggtaaaatatctagagaagaacaatacatacagaatactaaacaaattattgaagacaatgatatttctataacaaatatcattttaccttttaacgaaaattataatcaacaaattaaacatgttgagatttttgatagtattaaaaatattacagacaatcataataaaaaattaaaagaaataaaatctatgtttactgacctaaaagatactacacaaaacgaaatagaaaaaatttataatgtttggaaagaaaagaaaaaaaatattgagaaggaaatcaatagagctattaaatccctagatgatatagaaggtaaaactaaagaagatatagcacatgaatacactgagactcaaaaacaaataacttctattgaaccattagaaacacaattatctcgagttaaaacatctattgaaacattagaaaatgaaaggatacaacttaaagaagatttaaaagaaatatttgatgaacaactaaaaaatcttaacagatgcgtaaaaaaaataaataatagatatttaaaaaaacaagtaaacattaaaattcaaccatatgcaaatgttaataatttaatagagttcctcaaagaggaaaacggattaggagattcaacattaaaatggataaaaaatcatcaaagctttaattttcctaagtttattaaattaattaaggatagagacagtgaagctatatacgaggaatataaagatagcggtttaaaaaaacacacagcagatattctttcaaatatgctctatgagagaattctaaagttggaatcaatagagctagaaaatattatagatatacgattgaatgttggaagtgacaaagatacgaaattccgatctctaaatcatttatccaaaggacaacagtgcactgctattttgaatctattaactttaagtaataatgatcctcttttagtagatcaaccagaagataatttagataattcttttataacaaacaatttagttgaaaatattcgtaaattaaaaattaatagacaatttatttttgctacacataacgctaacatacctgtatttggcgacgcagaattaatagtgacaatggaaaatgaaaacggtcaaggaagtgtaaacaatgaaaacttaggatccattgataatactttagtaagaaattctgtcatccaaattttagaaggtggagatgttgcttttaaaatgagaaaaaataagtatggtctttga

SEQ ID NO: 1542 - DNA, 1011 bp, Staphylococcus epidermidis
ggttcttgtaaaatgtcgcgttatgaacgtcaaacacgctttgcaccatttggagaagagggtcagcaaaagctatcctcctctcaaatacttatttttggcgctggtgctttaggaagccatattgtagatcaactcgcacgcatgggggctcatcatattgcaatcgtcgatatggatattgttgaaatttcaaatttacatcgacaaacactcttcgatgaagaagacgcacatactttaatatccaaagttgaagcaatcaagcataaggttaatcaaattaatataaatgtcaatctaacaacttatgatttagaagttacttcatcaaatatcgaaaatttgataaaaaatgtcgaaccagacatcatcattgatggcatggataacttcaaaatacgatacctgattaatgaggtttgtcacaagtatcaaatcccatgggtttatggtgcagctgttggtagtaaaggatcagtatatggaatagatcaccaaggaccatgtctaaaatgtttattgcaaacaattcctgacacaggggaaagttgcgctattaatggcgtaattccccctgttatatcaatgattgcaagctatgaagtagcagaggccgtacgttatctttcaggaaaaggattttcaaagcaattaatcactattgatgcatttaatatcaattataagtcaatgaatgtagatgcactcaaaaataaagattgcccagtgtgtgaaaaacatgaatatacgttactagaaagccaacaagaacgtactattgaggacttgtgtgggaatgcttatttatttagattcccacctaaagcttttaaacacgctgcccatttccctgggaatatggtgaaatctacttcctttgccaaattaattcaatatcaaacttatgaattcaccttgtttaaagatggtcgtatgaatgcatatggtatacacaatgatgaagaagcacatcacctatacaatacgttgttaaaatccatacgctaa

SEQ ID NO: 1543 - DNA, 948 bp, Staphylococcus epidermidis
ttaagatgtaatattagtaaagaaaggtgtatcatgataaaaataatcgccacaattatcgtttcaacactaatattaggaagttgttcgacaatgaatgaagaagaaaattatgcatcacaatcaattcccgcaagtcaatacaaaggtcaaggtttccaaccagtagctgaaaaaagtgctatcgcacacgcgaaaaaacatcgtgaagaatacgaaaaacttggcgaacaattttttaaagataattttagccttaatgttaaagccacaaatgttgtaggaagtggtgatggcgtcgaagtctacgttcattgcgatgatcatgacattgtgtttaatgcaagcatcctttttgataaggaagcaatacatgaagaaggctccatgcgaagcaatgataatggagatactatgagtgatatggtaggaactgtgttaagcggttttgagtatagagcaaataaggaaaaaatggataacttagaaaaatacctcaaagataaagaagataaatatcactatactggattcaccgatgaagcaataactaaaactcaaaatataggttatcaaaataattacttttacattactactagttccacgaaattacgagattatagaaaacattttgaacctttaattaaagaaagtaacgatgattttagaaagcatatgaaacaattaaagtctaaaaaagatacgtatcttaatacagaaataacaactacacttttcagtactcttgatgaatatgacgaaaaaatcattagaaaaaatagtatatccatggctaaagaaataagaaaagagccatctattccacataatttcacattccacttattatttagcaataacaaattaaaaatcaacgatccaaacataaataacaatcaaattaatgagtatggggtgttccaccatgacggatttaaaaattaa

SEQ ID NO: 1544 - DNA, 219 bp, Staphylococcus epidermidis
aacgtacgtaaatggttcatacaaccttcttttgtcatgatgacttggtcaaatgaatacttaattaatggtaagtttttaactgcagaagcaagtaaagtcgtaatgttatatggtttaattgatttgaataaatccaagttagaaccatgttttaggaatttaggtcccacgtttgcaaatggtccaaataataatgttctttcaccatcaatgtaa

SEQ ID NO: 1545 - DNA, 189 bp, Staphylococcus epidermidis
aatctgatcaaaatggaggttatacttttgaatattaaaaagcattggttaccaattgttgtagtcattcttgtagttgttatctttttattagttactttcgctagggcaaatgaaggtttagataattatgagcaacatgaattaaataatggtgaacagcaatatctttcaaaaggggcaagctaa

SEQ ID NO: 1546 - DNA, 1521 bp, Staphylococcus epidermidis
aaatttaacaaacttaacggaggtcgtttgatggaacttgtagataaattatcaaatcgtcaatatattgatggagaatgggttgaaagttcaaataaaaacacaagagatattataaatccttacaatcaagaaacaatcttcactgtagctgaaggaactaaagaagatgttgaaagagcaattttagctgctagaagatctttcgaagacggtgaatggtcacttgaaacaagtgaagtcagaggtaaaaaagtgagagccgttgctgataaaattaaagaaaatagagaagagttagctaaattagaaacattagacactggtaaaactttagaagaatcctatgctgatatggatgatattcataatgtgtttatgtattttgctggtttagctgataaagatggcggtgaaattatcaattcacctattcctaatgctgaaagtaaagtagttaaagaacctgtaggtgttgttactcaaattacaccttggaactatccattacttcaagcatcttggaaaattgcgccagctttagcaacaggttgctcattagttatgaaaccaagtgaaattactccgttaacaacaattcgtgtatttgaattgatggaggaagttggtttccctaaaggaacaattaatttagtacttggtgctggatcagaagtgggcgacgtgatgtcaggtcatgaagaagtcgatttagtttcatttacaggtggtattgaaacaggaaaacacatcatgaaacaagcagctaatcacgtgactgacgttgcattagaattaggcggcaaaaatcctaatattatttttgatgacgctgattttgaattagctgtagaccaagcacttaatggtggatatttccacgctggtcaagtgtgctctgctggttcaagaatcttagttcacaatgatattaaagataaattcgaaaaagctcttatcgatcgtgtaagcaaaatcaaattaggtaacggttttgatcaagatactgaaatgggaccagttatctcaacagcacaccgcgataaaattgaaggttatatggaagttgcgaaaaaagatggagcaacaattgcaattggtggtaaacgccctgaacgtgaagacttacaagccggattattctttgaacctactgtaattacagattgtgatacatcaatgcgtattgttcaagaggaagtctttggaccagttgtgactgtagaaggatttgctgacgaagaagaagctattcgcttagcaaatgattcaatttacggtttagcaggtgctatatttactaaagatattggtaaagcacaacgtgttgcaaataaattgaaacttggtacggtttggattaacgatttccatccatactttgcacaagcgccatggggcggttacaaacaatcaggtatcggtagagaattaggtaaagaaggattagaggaatatttagtaagtaaacacattcttacaaatactaatccagaaccagtggattggttcagtaaataa

SEQ ID NO: 1547 - DNA, 1389 bp, Staphylococcus epidermidis
ataataaacaagagaaagaaggggaatgcgatgtttggagagatttggccactcatcagtgttgtattaggaattattatcttattaacattaattattggattgaagcttaatacatttatttcattaatcattacctcaatgataacggcgttattattaggtatgccacttaacaaaattatggaaaccattgaaaatggtatgggtagtacgttaggtcatattgctttaatctttggcttaggtgcgatattaggtaaattattagccgatggtggtggggcaacacgtattgctgatacacttattgcaaagtttggtcagaaacatgttcaatgggctatgttgatagcagcatttatcgttggtattgcgctattttttgaagtaggtcttgtactattaatcccactcgtatttacagtagctaaacgcgcaaatgtatcaatattaaaattgggactaccaatggtcacagcgttatctgttacacacggattcttaccaccacatcctggacccgttgtcatcgctaaggagcttaaagcaaatataggtgaagttttgttatatggtatgattattgctatccctgtaacacttattgcaggtccaatctttaatcgatttgcacaaaagatggttccaacagcgtatacgagagaaggggatatttcttctttaggtactcaaaaggaatttaaagaagaagagatgcctggtttcggaataagtttattgactgctattttacctgttattcttatgttgatttctacaattgtgcaactgattacaggacacgaagaagcaacaaatgtattcgaacaaattgtttacttcataggaactgctggtactgcattgcttatcgcagtaatatttgcaatctttacaatgggaatgaagcaacaacgaaaaatggaagacattatgaaatcagttacgcatgctatttatccaatcggcatgatgttactcatcatcggtggtggtggtacatttaaacaagtgctcatcgatggtggcgtaggtgatacaatcgctaagatgtttgaaggaacaagcatgtcgcccattttattagcatggattgtagctgcagtcttaaggatttcattaggatcagctacagttgctgctgtatcaacaacaggcattgtgttaccacttttagagcattcagatgttaatgtagctttggtcgttcttgcaataggtgcaggtagcgtaattctctctcacgtcaatgatgcaggattctggatgtttaaagaatatttcgggctgacagttaaagaaacatttttaacatggtcgttattagagacaattatttcagtatcaggtattatatttattttatttatcggtttatttgtatag

SEQ ID NO: 1548 - DNA, 903 bp, Staphylococcus epidermidis
tatatgcgcaaagtattaattttcgcaattgcgggatttttagcacaacttgttgatgggtcattaggcatgggatttggcgcttcatcgtcatcaatattattaacttacggtatagcaccggcagtagtgtcagcaaccgttcatttttctgaaattgcaacaacagctgcatctgggacatcacattggagatttgataatgttcataaaccaacaatgttgaagttagctatacctgggtcaataagcgcctttatcggtgcaggtgttttgacatttattcatggtgattatattaaaccattcattgctttattcttgttaagtatgggattttatattttgtatcaatttctatttaaacgtgcacatgaacatcatcatcatgtgggaaatttgagtagttttaaagtaattccacaaggttttgtggcaggatttttagacgcaatcggtggtggtggttggggaccggttaatacgccgctcctgctttcaagtaaaaaaattcaaccacgatatgcgattggaacagtctcagcaagtgaattttttgttacgtcatctgccgctttaagtttcattatctttttaggagtcactcaaattaattggtttgctgtaattgctttaagtctcggtggaatggtagcagcacctatttcagcgtatttagttaaagtgttacccattaacattcttgcaatttgtgtcggtggtttaattatttttacaaatagtaatgcattattaagctattttgtaaaagataacactatttcaaatacagttcgattcattattattcttgcaattattattttgcttgtttttcaagtcgttcgaaacaagaaattgtctttttcttataagaaaagccgagtaaacaaatataattaa

SEQ ID NO: 1549 - DNA, 1542 bp, Staphylococcus epidermidis
ctggaaagcaatatgataactactacacaagaggtgaacattatggctatgtctgacaaaaaagacgtcgtgttaatcggtgctggtgtactaagtactacatttggttctatgttgaaaacgattgcacctgattgggacattcatttatatgaacgtctagatcgtcctggtattgaaagttcaaatgaacgtaacaatgcaggaacaggacatgcagctttatgtgaattgaactatactgtacaacaacctgatggttcaattgatattgaaaaagctaaagaaattaatgaacaatttgaaatttctaaacaattctggggtcatttagttaaatcaggagaaattcaaaatcctaaagaatttattaatccattacctcatattagttttgttcgtggtaaaaataacgttaaattcttaaaagatcgttatgaagcgatgaagcaattccctatgttcgataatatcgaatatactgaagatattgaagaaatgagaaaatggattccattaatgatgaaaggccgtgaagataagggctacatggcagcgagtaaaatagacgaaggaactgacgtaaactacggtgaattaactcgtaaaatggctcaaaatcttaaaaactcaccaaacgttgaagtgcaatacaaacatgaagttgttgattttgaacgtttgtctaatggtaaatggtcagttaaaattaaaaatctaaataatggacaagtattcgaacatcaaactgattatgtgtttatcggtgctggtggtggcgcaattccattattacaaaaaactggcattccagaaagtaaacatttaggtggattcccaatcagtggtcaatttattgcttgtacaaatccgcaagttattgaacaacacgatgccaaagtttatggtaaagaaccacctggtacaccaccaatgacggtacctcacttagatacacgttacattgatggtgaaagaacattattatttggaccatttgcaaacgtgggacctaaattcctaaaacatggttctaacttggatttattcaaatcaattaaaccatataacattacgactttacttgcttctgcagttaaaaacttaccattaattaagtattcatttgaccaagtcatcatgacaaaagaaggttgtatgaaccatttacgtacgttctatcctgaagcacgtgatgaagattggcaagtttatacagctggtaaacgtgtacaagttattaaagatactgaagagaatggtaaaggatttatccaatttggtactgaagtggttaattctgaagaccactcagttattgcattactaggcgaatcaccaggagcatcaacttcagtatcagtagcactagaagttttagagaaaaacttccctgaatacgcgaaagactgggaacctaaaatcaagaaaatgattccttcatatggtgaatcacttattgatgatgttcaattaatgagaaaaatacgtaaacaaacatctaaagatcttgaattaggattctataataaagcaaaataa

SEQ ID NO: 1550 - DNA, 1056 bp, Staphylococcus epidermidis
tataatttaaaagattacaaaatatttattataggagggttttatatgcattgtccgaattgcggtaatccaatagaagatgatgatttattctgtggtgaatgtggacataaaataagtcgacatccacagtcagtcagaaatgcagaaagtgaaataacaaaagctgaaaagaatgatgaagaacaaaacataacatcaaataataaagaaaacaacgcagcgactcatcaaaatgttgattcaacatctcatgatgagactagatcaaatgaaaatgacgtagcagattcaacattacaatctaagcagtcacataatgatacccaacaatcaaatctctctacataccatcaaagacctcaacatcgagaaattcctcaaaatcaacacaatcacgatcaacagcaaagtcaaataggtcaacaagctaaacaagtaacaaatgaaagtaaaggtttctttaaaagtgcatttactgcacctgataaaatcattcaaactaatcatgttttcagttttaaattattattatcattattaataatcggttttattgtattagcaattttactcgcttccgtaataccagttgagattggtattttcggtactacaagaggaagtttggtaacgagtatcatttttggtattattctatttttggttgtcatagtaggtgcaatatttgggcttacacgtttagtagttagacaacctattgcatttaaaaaagtattatcagactatgtgttaattaatagtgtttcgttagcaattttaattatttctgtaattttaatattagcagaatcatacagctttggcggaagtatagcattattgtctttattattatttattgcttctggtatttatctaattgcgaagtatagcactggtaatcaaacaagaatatccagcttttatggtgtgattatttatatcattattttgttcttatttattcgtatttttggggaggcatttttccatcaaatatttggtgattttatagaagaactaggggatttatttgaaggaggaacttattaa

SEQ ID NO: 1551 - DNA, 1482 bp, Staphylococcus epidermidis
tgcaatttaaatttaaaactgatctttcagggaatacttctaatggaggtgtttaacatgacaaatcaattatttattaacaatgaatttatagaaagtcagtctaaagagacaatggatgtcattaatccagctactggcgaggcatttgatactatcactcttgcaactgaagaggaagtaaacgacgccattgaaaaatcgcaacaagcacaacttgaatgggagcgcgtgcctcaacctacacgtgcggaacatgttaaattacttatacctttattagaaaaaaatcgcgatgaaatagctcaattatacgtaaaagaacaaggtaaaactttagcgcaagcttatggagaaattgacaaatcaatctcatttatcgattatatgacaagtctgagtatgtcagataaaggacgtgttctacaaaatagtattgcaaatgaaacgattcaaattatcaacaaacctatcggagttactgctggtattgtgccatggaacgcaccgatacttgtccttatgcgaaaagtcattccagctatagtaactggttgttcagtagtgattaaacctagtgaagagacaacgttactcactcttcgattagctgaattattcagagcatcaactataccagcaggattgtttcaaattgttcctggcactggagaaacagtaggtacacaattagcttcgcataaagacattcaacttatttctttaactggaagtatgagagctggtaaatctgtttacgaaaatgctgctcaaactgtaaagaaagtaaatttagaattaggtggaaacgcaccagtcattgtcacatcaaatgccgatttagataaagcagttaactatatcgtgacagcccgtataaataatgcaggtcaagtttgtacgtgccctgaacgtatctttgtacatgaagatgttcacgatgactttttaaataaagtaacttccaaaatgaaaagcttaactgttggagatccatttgatgaaaacaccgattacggcgcaattattaaccaaaaacaacttgatagtattcatgaaaaggttcaagatgctattaaaaatggcgcaacattgatgactggtggacatcaattaaaacgccatggtttcttctacgcaccaacggtattagataacgttagaaaagactataatgtctttaaagatgaaatttttggtcctgttcttgcgataacaacataccgcgattttgaacaagtgattgaagacgctaatgatacaaacgctggcttatcttcttatatcttctctgaaaatttaacagaagtaatgacagcaaccgaacgtctaaaatttggtgaagtatatgcaaattgtgaggctgaagaagtcgttaatggctatcacgcaggttggcgtgaatcaggcttaggtggcgctgacggtattcacggttttgaagagtactacaataccacagtaagttatatcagatactaa

SEQ ID NO: 1552 - DNA, 834 bp, Staphylococcus epidermidis
atgaaattaaagcgtggatttcaaaaaaataagacgcccgggcgtctagaaatgaataaagttattgaaagtgacgtaacgttatcgagtatgctttggctaggaggtgagaagtctatgtcgatttatacttcaggagatatagctcataaatgccatgtgtcaacacgcactattcagtactacgataaacaaggaatcttatcgccaaactatacttctgaaactaacagacgtttttacactgataaggaagtggagaaacttgaactgattttactacttaaggaaataggttgcacaattaaagaaattaaagtgttattaaaagatgattcatcaatgaaatctctttacacgtttcttcaaatcaaaaagcatgagatacaacagtcaataacagataaagaacacaaggtatgtaaaatagagcaaattcaacgctatgttcatcaaaattcaatttctccaattcattatttacaagatataactacttatatggaagaatctcatagactcaaaggtgtcagaaagaaattatggttaagtatagctctgattgggtcattacaatatggtggtttgatcatctcaattgtaactcgaaggaaaaagcctttcttgtcgatgatgcctgtggtagctatgtattcactttggttaacaaaaaagtataaaaagaatgtttcatatgtctgccctaattgccatcatgtgtttaatcctagtgtcattcattttgtaacagcatcacatacacctaaaactagaaagcttcaatgtcctgattgtcacgaaatgcattactgtatagaaattgctaagcaatga

SEQ ID NO: 1553 - DNA, 1773 bp, Staphylococcus epidermidis
aaagagataaaagatatcaaagagacgtgtattaatagaagggacgggggatacatggttaatacaaataatcatatttcggaagaattagataaaaatcttgatgaaatggaatttttaaaagcaaatagtgactttttgcgtggaactattgaacaaagtttagctaatccaatcactggatccattacacaagatgatgcaaaactgctaaagtttcacggaagttatatgcaagatgacagggatttaagagatgagcgtcgtaaacaaaaacttgagcctgcatatagttttatgattcgagttcgtgtacctggggggaaagcgactcctgaacagtggattgctatggatgatatctctaatcaatatgcaaatcatacgattaaattaacaacacgccaagcatttcaatttcatggaattcttaaacgtaatttgaaacaatcaatgaaaaatattaatcatgcagtacttgattctattgctgcatgtggagatgttaatcgtaatacgatgtgcaatcctaatccttatcaatctcaagtacataaggagattaatgattatgcaacgcgtataagtaatcacttacttccaagaacaaatgcatatcatgaaatttggcttgatggtgaaaaggttttagattcgagtgaggaaaaggaacctatttatgggaatacgtatttaccacgtaaattcaaaataggtattgcagtaccaccatctaatgatattgacgtctattctcaagatattggtttaatcgctatcgttgaacaagatgagttaattggatttaatgtgactatcggtggcggtatgggtatgactcatggtaatactgaaacatatcctcaacttggacgtctcataggttttatacctaaggaaaaggttgtagatgtatgtgagaaaatacttacaatacaacgtgattatggtaatcgtgaaaatcgaaaaaatgcacgttttaaatatacagtggaccgtctaggagaaacttgggtgactgaagaattaaaccgacgattaggttgggaaattaaagcgccacgtgatttcgaatttgaacataatggtgatcgattaggttggattgaaggtattaataattggaatttcactttatttatacaaaatgggcgtgtgaaagatactgaagactatttgttaaaaacagccttaagagaaatcgcagaaatccatactggagatttcagattatcacctaatcagaacttagttattgcaaatgtttctcctgagaaaaaggaagaaatacaagctattattgataaatataaattaacagatggcaaaaattatacaggacttagaagaaattctatggcttgtgttgctttcccaacgtgtggtttagctatggcagaatctgaaagatatcttccttcactaattacaaaaattgaagatttattagatgagtctggtttaaaagaggaagaaataacgattcgtatgacaggttgtcccaatggatgtgcgagaccagcgctagcagaaatagcctttatcggtaaagcacctggtaaatataatatgtacttaggtggtagttttaaaggcgaacgtctaaataaaatatataaagagaatatcgacgaaaatgagatattagaaagtctacgtccattgttgttgcgttatagtaaagagcgtcttgacggagaacactttggggactttgtaattcgtgacggtgtgatagccaaagttcatgatggtcgcgattttcatagttaa

SEQ ID NO: 1554 - DNA, 600 bp, Staphylococcus epidermidis
tttaaagtaaagattcataaattaatattagggggatcacatttgaaaaaggaaaaagttatggactggacgaccttcataggcgtagtcattgtgttactttttgctgttatacctatgatggtttttccgaaagcaagtgaaataatcattaccgatatcaatagtgccatttctaattcaattggatcggtatatctctttatgggactggctatattttgttttgttttatacatagcatttggtaagtatgggaatgtcacgttaggaaaagcgactgacaaacctgaatttaataatttcacatgggcagccatgttattctgtgccggtattggttcagatattttatattggggtgttattgagtgggcattttattatcaagtacctcctaacggtgcaaaatcaatgtccgatcaagcacttcaatatgcaactcaatatggtatgtttcactggggacctatagcctgggcaatatatgtgctaccagctttgccaatcggttatttagttttcgttaagaagaaacccgtctataaaattagtcaagcttgtcgaccaattttaaaaggacatacggataaattatga

SEQ ID NO: 1555 - DNA, 1674 bp, Staphylococcus epidermidis
aagaaatcaaaggtggaattatatatgaaacaacgcgtaggacaatatttaatggacgcggtttattcagcaggtgctgacaaagtttttggtgtcccaggagattttaatctagcctttttagacgatattattgcacataatgatattaaatggattggtaatacaaatgagcttaatgcaagttatgctgccgacggatatgcacgtattaatggcatcggtgcaatggtaacaacatttggagtgggtgaattaagtgctgtcaacggaatcgctggatcttatgctgagcgtgtgccagttattgccatcactggggcacctactcgagctgtagaacaagaaggcaaatacgttcaccattcccttggcgaaggaacttttgatgattatagaaaaatgtttgagcctattacaacagcgcaagcttatattacacctgataatgctaccacagaaattccaagagtaatcaatacggcgcttcaacaacgtcgtccagttcacattcatttacctattgatgtcgcactaacagagattgaaatttcaaacccattcaaaccagaagtcgaaccacaaaaaaacgttcaaagttatatcaatatggttcaagacaaacttgaatcggcatcacaacctgtcattattacaggacatgaaataaatagtttccatctgcataaagaactcgaacaattcgttaatcaaactcaaattccagttgttcagttatctttaggtaaaggtgcatttaatgaagaaaatccttattatatgggtatctttgatggttcaatagcagaacaagatattcaagattatgttaatcaaagtgatgctattttgaatattggtgctaaattaacagattctgcaacagctgggttctcatatcaatttgatattaatgaagtgattatgctaaatcataatgaatttaaaattaatgatacatgcatcgaagcattttcattaccaaatatattaaatggtttaaataagtatattcactacaaaaacactaatgatttcccacaatatgagagaccacaatcacacaattacgaacttagtgatcagccattaactcaagagacttatttcaatatgatgcaagattttttacaacaagatgatattttaatcgctgaacaaggtacatcattctttggtgcttatgacttagccttgtacaaagataatacttttatcgggcaaccattatggggatctatcggctatacactaccagcaacgctaggaacacaaattgcaaatccatatcgtctaaacattctattaattggtgatggatcactacaattaactgttcaatcattatctacaatgattcgtcaaaatttaaaccctgtgatatttgtaattaataacgatggttatacagttgagagaatgattcatggtatgaaagaaccttacaatgacattcgcatgtgggattacaaatcattaccttctgtatttggtggtgacaatgttttagttcatgatgtaaacacttcagaagaactcatgctcaccttcgaaaatattaaatctaatagtgatcgcatgcactttgtagaagtgaaaatggctgttgaagatgcaccagttaaattaagtaatatagctaaagcattcgcatcacaaaacaaatcatcttaa

SEQ ID NO: 1556 - DNA, 1113 bp, Staphylococcus epidermidis
cgcatgacaaatcaaaaaactgtgggtctagtcgtcgctccaggtgttactgaacgccttgcagaaaatctcatacaagaaatgcctaaaatgttatctacacattatgatcatcagcaagaatggatttttgatttagttacggatccgcttactggttttgctgaatctgtagatgaaatttttgggaaagtagccgattatcacgataagagacaatgggattatgtgatagcaattacagatttaccgatgtttgcggacaagcaagtgatggcattagatattaatatggaaaatggtgcagctatattctcatatccggcatttggctggcgtccagttaaaaaacgtttcaagcatgcgatttataatattattcaagaattaaatgaagctgaacaagaaagtcgtaattatgataataataagcaaatagaaaattcagtaaaaaaacaatttccgctctctaaaatagataaagaaacaatatatatgaaagaaacagactcttatcacttaagatatttatcaagttcacgttctagaggcatgtttcgccttgttagtggaatgacctttgcgaataatccattaaatatgatggcaagtttaagtaatatagtagctattgcatttactacaggtgcatttggacttgtatttacaacgatgtggcaaatggcttataacttttcaatgtggcgcttatttggaatttcaattattgcgattattggaatgctaatatggataatgatgtcacatgatttatgggagccagttaataaaagcaaccataagcatattacttggttatacaatcttacaacaataatgacattgatttttgccattataatttattatattattctttatttactattcttaattgctgaaatcgtattattgccatcaggattcttaggtcagcaagttggattgaaaggtcctgcaggcattgatttgtatttaagtattccatggtttgcagcttcaatttctacagttgcaggtgcaataggtgctggtttacttaatgatgaactcattaaagaaagcacatatggatatcgtcagcgtgtaagatacgaagaacaacgtcgataa

SEQ ID NO: 1557 - DNA, 1890 bp, Staphylococcus epidermidis
acaatgacaaatatcggaataacaaagtataagaggtggataagattgaacttaagtgttaccaatagtccttttacggaagggcaagctaaacaaatcaatgaattgcttcacactttatcacctaaccaacaagtatggttaagtggctatctgatggcaaatcaacaatcaaatacatctacagattctgtagaacaacataacttagatgacaatacagaagcgatgctacatgaaaaggaaccttcagttgagccggaagctagatcgataacaattttatatggatctgaatctggtaatgcgcaaggacttgcagaaatatttgaacaacgtttatctgatattggaaatgacgttacgctcaaatcaatggatgactttaaacctaagaatttgaagaaagtagaagatctatttattatcacatctacacatggcgaaggagatccaccagataacgctgttgaattacatgaatacatccacggacgtaaagcgccaaaattggatggggtgagattttcagtattagcattaggagatcaaacctatgaattcttctgtcaaactggtaaagattttgataaccgtttggctgaattaggggcagaaagactttatcatcgtactgattgcgatgttgattatgaagaagacgctgaaaagtggatggccaatgttattaatacgattgattcaacaccagctggtactgaaagtgaacaagttgttagcgaatctataaaatcagcaaaagaaaagaaatatagtaagtctaatccttacgatgctgaagtattgaccaatattaatttgaatggtagaggttcagacaaagagacgagacacattgagttattacttgataattttggtgaagaatatgaaccaggagattgtgtagttgtcttgcctcaaaatgatccagctatcgtagacttacttattagcacattaggctggagtccagaaacacaagttttaattaacgaggatggagatactttaaatcttgaagaggcattaacatcgcattttgaaattactaaattaacaaaaccgttaatagaaaatgctgcgatattttttgataatgaagagctttctgaaaaaattcaagataaagaatggattcaaaactacgttgagggaagggatttgattgacttattaaatgacttcgcaacgacagaactacaacctgaaaatttacatcaattattaagaaagttaccacctagagagtactcaatatctagtagttataaagcaacaccagatgaagttcacattactgttggagcagttagatatcaagcacacggtcgggaacgttcaggtgtttgttcagtacaatttgcagagagaatacaagagggcgatacaattcctatctatttaaaacgaaatccgaattttaagtttccgcaagatgaatcaacacctgtgattatgataggtcctgggacaggtgttgcaccgtttagatcctatatgcaagaacgagaggaactaggttttgaaggaaatacatggttattctttggagatcaacacttcactacagattttctgtatcaaacggaatggcaagaatggcttgaagatggaactttatcaaaattagatgttgctttttctagagatactgataaaaaagtgtatgtgcaacataaaattgtagaaaatagtgaacaatttaatcgatggattgaaaatggcgctactatttatgtatgtggtgatgaaagtaaaatggcaaaggatgttcatcaagcgattaaaaatgtgttaatcaaagagcaaaacctatctgaaacagatgcagaagaatacttaaaacaaatgaaaagagataaaagatatcaaagagacgtgtattaa

SEQ ID NO: 1558 - DNA, 597 bp, Staphylococcus epidermidis
aggtcgacaaaaagagatatgtgcaagagtgaaacacatgaaggcacttcgttcatgaatattttaaacattaaagaaggtcaacactatatagctaaaatagaaagtcatagctttgtagatggtgaaggtgttcgatgcagtgtatatgtttccggatgtccttttcaatgtaaaggttgttataacgttaaagcccaaaattttaaatacggagaacctttcgaacttgaaatgcttgaagagattttagattattgtgcgccttcttatatcgaaggcttaagcatacttggtggagaaccattttgtaatttgtttatcacactccaacttgttgaagcttttagacaacgattcggtcatacaaaaacaatttgggtatggactggctttttatttgaatatttgaaacagcaagacgatgcgcgcaagtcattactcgaacatattgatgtattagttgatggtatgtttattcaacatttatatcgtccgaatcttccatataaaggatcacttaatcaacgggtttggtgcattgatgttcaatcttccttacaaaaagaacaggtcattgaatatctaactaaatag

SEQ ID NO: 1559 - DNA, 255 bp, Staphylococcus epidermidis
aaaaaagcaaatgaagcaacaaatttcaaagccaaaattgaagtcgtttcaacattattcagtactaaatctgatttcactaaaaataactctaagaaagatttattattcttaagtgatgatttatatcattacaaagaaaaacctgaaaacacaaacataactttacaattaagtgagccaaaaattaattctacacgcgcattttatgatgctaataacccattagaatatggagtgcataaacatgagtaa

SEQ ID NO: 1560 - DNA, 696 bp, Staphylococcus epidermidis
tgtatggcaaaagttaaagagaaagttgcagtcgttacaggtgcgagtagcggtataggagaggcgattgccaacaagttaagtcaacaaggtgcatcaatagttctggttggtcgtaacgaacaacgcttaaacgaaatagtccagcaattaaataacccggctaaagttgttacagcggatgtcactgtaaaatcgaacatagatgatatgttaaaagctgtaatagaccattttggtcatatcgatattgttgtgaatagcgcaggtcaaagtttatcatctaaaattacagactataatgttgagcagtgggatactatgatagatgtaaatattaaaggtacactccatgttttacaagcgacattgccttatttgttaaaacaatctagtgggcatatcatcaatcttgcatcagtatcaggatttgaaccgacaaagacgaacgccgtttatggtgcgacaaaagcagcaatacatgcaatcacacagtctcttgaaaaagaattagcacgtacaggcgttaaagtgactagtatttcaccaggaatggttgatacccctatgacggaagggactgattttggggaacgcaaaaaacttgaagcacagaatattgctgatgctgtagtatatgctttaacacaacctagtcacgttaatgttaatgaagtaacgataagacctgtttaa

SEQ ID NO: 1561 - DNA, 447 bp, Staphylococcus epidermidis
atgtctaaaaataaaaatgattacgaacatatgctgttttacttcgcgtataagacttttattactacagcggatgaaattattgagcaatatggcatgagtcgccaacatcatcgattcttatttttcattaataaattaccgggtataacaattaaagaacttttgattacgcttgaaatatctaaacaaggatcgcatgcaacgttacgtaaattaaaagaagaaggtttaatcgtcgaacaaacatctaagcaggatagacgagtaaaaaaactttttaccactgaagcgggtgatgatttaataggtaagttaaaccaagcacaagatgaattaattcaacagacactacaaaaagtaggccatgattggtacgcgatgatggaagaactagctaattatcgtgaaggattcaaaacaattgaacatttgaaagaagattaa

SEQ ID NO: 1562 - DNA, 753 bp, Staphylococcus epidermidis
tttgataaaaaaattcttccatatgggggacatggatggaaacaattgggtggcataaaaggtcgtaaagaaacgaatttccctcaagattggacaatattctactggtcatggtggctcgtttatgcaccgtttattggattgtttatcgcgcgtatctcaaaaggacgtacacttaaagaagttgtattaggaacaatatgctatggaacattaggttgtgtgttatttttcggtatttttggtaactatgctgtatatctacaaattactgagcaatttaatgtaataagctatttaaacaattatggtacagaggcaacaatcatagaaataatgcatcaactaccattctcgacaattactattatcttattcttaatatcagctttcttattcttagcaacaacattcgattctggttcatatattttagcagcagcgtcacagaaaaaagtgataggagaaccgttacgtgctaatcgtttgttctgggcgtttgcgttatgtttactaccgttctctttaatgctagttggaggagaacgtgcattagaagtattgaaaacagcatcattacttgctagtgtacctttaattgttatatttacgctaatgatgatttcgttcttaattatactcggacgagatcgtatcaagttagaaagacgtgcagataagcataaagaaattgaaagacgttctctaagaatagttcaggtcaaagacaaacctgaagacgataacttataa

SEQ ID NO: 1563 - DNA, 927 bp, Staphylococcus epidermidis
aatatgaaaaaattttggggaattttattaattgtgatgtcaattgctcttgtgggatgttcgaatagcaatgattcagatcaatcttctaatgaaaagtcatcatcaaaaagttcggagaaaaaaacggatgtggcgactgaatatacaaaagaggacgaatataaagaactagaaaaagaagctaaggatcttaaacaaaagccagttcttaatgaaatcgatgcacttattacagaaaaaggttttacaaacaaaacgggattgcaaggctgggaagactataaaaaattagtggataaggtaacacttgcagattataaatacacaaaagaatctaaagggtcatctatagaagaagttaataagttctttaaagataaaaaaggtgtagagattaaacgaatgaaaagtaaggaaaaaaatattaagcatatcaattatatgtatgtagatccagatggtaaaaaaacaggtgaaaataagcaacctatgtcctacgctcaaatacttgcaacatttaaagaaggtaaattagtagctacaaatattcaacctggattttttgctttagacaaaaagaaaatggttaaagctaaagacttagaaaaagttaagacattggaagatttaacgcgtttgaaagatcctaaagcgacatcatatggtattttacagacgaaatataaagggaaaccatacactcaagtttcaatattaggcagtgattctgatgaagagaatgatatttcctcagccatcttagcttattatctattttcaccaacggaattagatagtgacgataatcataaatacgttgaagttgcatcagcgccattcttaagtgctcaaaacgatttttcatcttatcaactaggcgtatttaaaaaaattatcgaaagtagtatgtcgttcgatgaataa

SEQ ID NO: 1564 - DNA, 933 bp, Staphylococcus epidermidis
gacaaagaaaaatgtaggatacagggtttgagacatatgaagtttgcatatattcaatcgattcgtaatgagatttcaattattttaataattctattattttttgcacttatattttatgtgttttctttaccttttgatgcatacgtactagcaatcagtataatattactattgatgtgtgtacgttggtggataaagtatttaagttttaaaaagaatgaacatcttaaagataaagtagcatatttagaacatgagttagcacatgttaagaatcagcaaattgaatatcgtaacgatgttgaaagttattttttaacatgggtacatcaaattaaaacacctatcactgcctcacaattacttttggagagaaacgaggagaatgtagttaatcgtgttcgacaagaaattgtgcacattgataattatacaagtctcgcattaagttatttaaaattattaaatgaagagtcagatatgacaattaccaaagtgacagttgatgatttgattcgcccgttgattttaaaatatagaattcagtttattgaacaaaagacgcaaatccattatgaaaaaagtgaggacattattttaaccgatgcacaatgggcttctataatgatagagcaacttttaaataatgctttaaaatatgctaaaggtaaagatatttggatagattttgatgttgccaatcaaactctacagattaaagataatggtattgggattagtaaagcagatattcctaaaatttttgataaaggatactcaggatttaacggtagattgaatgaacaatcaactggtataggtctatttatagtgcaacacattgcaaatcatttaaatatacaagtaactgtacaatcagagttgaatcatgggacagtattttttatacattttactaaagaaaaataa

SEQ ID NO: 1565 - DNA, 1665 bp, Staphylococcus epidermidis
atggcggaaaaacaatattctgcagcacaaatggtaattgatactttaaaaaataatggagttgagtatgtatttggtattccaggtgcgaaaatcgactacttatttaatgcactagaggatgacgatattgaattagtcgttacgcgtcatgaacaaaacgcagcgatgattgcacaaggtattggtcgtttaacaggaaaaccaggtgtggctattactacaagtggcccaggggtaagtaacttaactactggtttattaactgcaacttctgaaggtgaccctgtattagctatcggtggtcaagttaaaagaaatgacttattacgtttaacacatcaaagtattgataacgcatcattacttagatcctcaactaaatatagtgcagaagtacaagatccagaatcactatcagaggttattacgaatgcaatgcgtacagccacttcaggtaaaaatggagcgagctttatcagtattccacaagatgttatttcatcacctgtcaaagctgatgcaatttcattatgtcaaaaaccacatcttggtgtaccttcagaacaagaaattaatgaagtgattgaggctattaaaaattctaaattcccagtattattagctggaatgagaagttcaagccaagctgaaacagaagctattcgccgtttagttcaaaaaacaaatttacctgttgttgaaacattccaaggtgccggcgtaattagtcgcgaattagaaaatcacttcttcggtcgtgttggtttatttagaaaccaagtgggtgacgaattacttagaaaaagtgatttagttatcacaatcggttatgaccctattgaatatgaagcaagtaactggaataaagaattagatactaaaatcatcaatgtcgatgaagaacatgctgaaatcactaattacatgcaaccagttaaagagttaatcggaaacattgcaggtacaatagatatgatttctgaacatgtaaatgaaccatttattaatcaagatcatttagatgaacttgaaaaattaagaggcgaaatcacagaagcaactggaattaaagcaactcacaaagaaggtgtgatgcacccagttgaaatcattgaaacaatgcaaaaagttttaactgatgatactactgtaactgtagatgtgggaagccattacatttggatggctcgtaaatacagaagttacaatcctagacatttactatttagtaacggtatgcaaactctaggtgttgcacttccatgggctatttcagctgcacttgtacgtccaaatacacaagttgtttctgtagctggagacggtggtttcctattctcaggacaagaattagaaactgcagtacgtaaaaacttaaatatcattcaattaatttggaatgatggtcgttataacatggttgaattccaagaagaaatgaaatataaacgctcttcaggtgtagaatttggaccagttgattatgtaaaatatgcagaatcatttggcgctaaaggattacgtgtgactaatcaagaagaattagaggcagcacttaaagagggttacgaaactgatggaccagtattaattgatatcccagttaactatgcagataatgttaaattatctacaaatatgttaccaaatgctttaaattaa

SEQ ID NO: 1566 - DNA, 1206 bp, Staphylococcus epidermidis
ttaattggaaaaggagatttgattataatgtctaacaatgaaacaataaccaattatacaattaaacctcatggaggagaactcatcaatcgtgttgttgaaggaaacgaacgtgaacgtttgattgaggaagcattaaaatttaaaccgattactttaaatccttggggaatatcggatctagagctcataggtattggcggatttagtccccttacaggatttatgaacaaggaagactacactaaggttatagaggaaacacatttaagcaatggcttagtttggagtattcctatcactttacctgtaacagaatccgaagcagataaacttgaaataggtgatgatattgctttatatggtgaagatggtcagttatatggaacgcttaaattagaagaaaagtacacatatgataaagaaaaagaagcgcgtttggtgtacggaactactgaagaagctcatcctggagttaaaaaggtttatgaaaaaggtaatatatatttaggtggtcctattaaactattaaatcgtccaaaacatgacgcgttttcaaattatcatctggatccttcagagacgagacaattatttcatgatttaggttggaaaactgtcgtaggttttcaaacgagaaatccagtgcatcgagcacatgaatatattcaaaaatcagcactagaaattgttgatggtctacttttaaatccactagttggtgaaacaaagtcagacgatattccagcggatgtacgtatggaaagttatgaagtgatattaaaaaactattatcctgaagatagagcacgtctagtcatttatcctgctgcaatgcgctatgccggaccacgtgaagcgatacttcatgcaactgtccgtaaaaattatggttgtacacattttattgtgggaagagatcacgctggggtaggcgattattatggtacttatgaagcacaagagctgattactcaatttgaagatgagttaggtattcaaattttaaaatttgaacatgccttttattgcgaagcttgtggtaatatggcaactgctaaaacatgtccgcatgacgcttctcaacatttacatttaagtggtactaaagtaagagaaaaactgcgtaatggcgaatcattgccaactaaattttcaagaccagaagttgccgaagttctaattaaaggtttgcgagaaaaataa

SEQ ID NO: 1567 - DNA, 696 bp, Staphylococcus epidermidis
ggagagtgtttaatgatggctaaaagctatgattatcaaagtgctttcgatattattggaccagtaatgatgggaccttcaagttctcatacagcaggtgcagtaaaaattggtaattcagcgagagctgtgttaggagatatgcctaagcatatagaaattcgttattatgaatcttttgctaaaacgcatcaagggcatggtacagacgttgctattgtcggtggtgctatgggctacagcactttcgatagtagaattaaatcatccttagacatagcaaaagatgaaaatattacaattgatattattgaagatgaaggagaaagtattggtcaacatcctaactgtgcttatatcaaagcaaatacgaaagacggacgttatatagaagtgataggtatttctattggtggcggtacaatcaaactaaaaggtatcaatgtaaatggtttaaatgtggaactgaatcatgggcttccaatgttagttatagatggaaatatgaataaagctaaaataaatcatcttattaatgatttatcagatatggacttagacttaggtgaagaattaatagaaacaaatgataatgaaggtttagttgtatttcctttaaataaagcaatctcagaatcagcattaaatattattaaagataaacatagtgatttaaacgtttcctatatcaaatag

SEQ ID NO: 1568 - DNA, 1074 bp, Staphylococcus epidermidis
agaagtttgaaattatatggtcgtgatattgatcacaactcaccattctataaaggaaataaaagtgttcgcgaaggagatattgtaaaacaagataaactcgctaatacattaactaaaatcaaagataaaggtcctgattacttctatgaagatattggtaaaagtgtttcaaaacaattagataataaattaactgaaagagatttcaaagaatttaaaacagaagaaaaagaagcggtaagtactgattataagaataatcaagtgtattcagcacctaatcctttaggaggcacattaatgcttcaaggattgaaaattgatgaaaaagaaaatgtagacaatatggatcgcaataattttatcacagcaatgattaaatcacgtgatgttatgtataagaatagagacattgttaatggtaatgagcctagtaatgaacaacatctgactgatgattatttacttggtgaacttaacaaagttaatattggtgaaaacacagataatggcagtgattttgatcaaattagaacggataatacaagtacaacccattttgtagttattgataagaatggtaagttagcaagtacgactaatacactatccagttactttgggacaggagactatatgaaagagggattctatatgaataactctttaggcgactttagtaaggataaatcaagtcctaatcatggtgaacctcacaaggcgcctagatcatttatttctccgtcagtaattgttggccctaatttctatatgggtattggtacaccaggtgggaacaagattccaacaattcttaatgaagtgattgtcgattatttaaacagtgatggttcattacaagaatctattaataaaccaagattttataatgacggcggcacgatattttacgaaaatgctatgactgatgaagatataaatatctttaaaagtcttggttatggtgttgaagaaaagcataatgatccaaactttggcagtgtccaaggtgctgtttatgataaagataaaaatactgtagatgtcggtcatgatgtaggtaaccgttaa

SEQ ID NO: 1569 - DNA, 825 bp, Staphylococcus epidermidis
aatgaattgaaaactttaaatcatttaaacaaaatgaaggcatcacagcaaaagatttctatggttacagcttatgattatcctagtgctaagcaagcacaacaagctgaaattgacatgattttggtaggagattctttaggaatgacagtgttaggatatgatagtactgttcaagttacattgaacgatatgattcatcatggtaaggctgttaaaagaggtgcttcagatacatttatagttgttgatatgcctatagggactgttggtttaagtgatgaagaagatctaaaaaatgcacttaagctttatcaaaacacgaatgctaacgctgtcaaagtagaaggggctcatcttacatcatttattcaaaaagcaactaaaatgggtatacctgttgtttctcacttaggtcttacacctcaaagtgtaggtgtaatggggtataaacttcaaggggatacaaagacagccgctatgcaacttatcaaagatgctaaagctatggaaactgctggtgcagtagtactggttttagaagccatacctagtgatttagctcgagaaattagtcagcaactcactattccagttataggtataggggcaggaaaagatactgatgggcaagtgttagtgtatcatgatatgttaaattatggtgttgatcgacacgctaagtttgttaagcaatttgcagacttttcaagtggtattgatggattaaggcaatataatgaagaagttaaagcagggacgtttccttctgaaaatcatacttacaaaaaacgtattatggatgaggtagagcaacatgactaa

SEQ ID NO: 1570 - DNA, 672 bp, Staphylococcus epidermidis
acatatatgaaaattttcattgtagaagacgatttagtgattgctgaaagtttagctaatgagctatctaaatggaattatgaggtgcatgtggttgataattttgaaaagataatggaagattttcgccgagtagaaccacaactcgtattattagatatcaatctaccaacacttaatggcttccattggtgccaagaaatgcgaaaagtatctcatgtgcctattatgtttattagttcaagaacagataatatggatcaaattctggctatccaaatgggtggcgatgattttatcgagaaaccatttaacttgtctttaacagtagctaaaattcaggcactattgcgtcgcacttatgatttatcaatagctcgtgatgaaatagctgttaaaggttgtaaactaattgttgatgaggccaagcttagcaaggataatgaacatgttcaactttccttaacagagctacagatattaaaattgttatttcaaaatgaaaataaatatgtaagtcgtacagctttaattgagaagtgttgggagtctgagaattttattgatgataatacgctcgcagtaaatatgacacgattacgaaaaaaattactttctatcggtgtcgatgatttaattgagacaaagaaaaatgtaggatacagggtttga

SEQ ID NO: 1571 - DNA, 696 bp, Staphylococcus epidermidis
tcactcatgaatgaatacttacaagcagttctaatgattttgttaactattgttctgtactatgtttccaaaaagattcaagataaatacaataatccactattaaatccagctcttattgcatcaattgcaataattattgttttattggtttgcggagtaagctataaggggtatatgaaaggtggtacctggattaaccatgttttaaacgctacagttgtatgtcttgcatacccactttatcaaaataaaaagaaaataaaaaaatatttaacaattattttcacaagcgtgttgactggtgtagttctcaattttgtgttagtatttacaacgttgaaaatctttggttattctaaagacacaattgttaccctgttacctagatcaattacagcagcagtaggtatagaggtttctcaagaattgggaggaacagatacaattactgtgctctttatcataactacaggtttaatcggcagtattttaggttcaatgcttttacgtatgggaggttttaaatcttccattgcgcgaggactaacttatgggaatgcttctcacgcatttggtaccgcaaaagcattagagcttgatattgaatcaggagcgttcagttcaattggtatgattttaacagcagtcattagttctgttctcataccagtactgattttattgttttactaa

SEQ ID NO: 1572 - DNA, 1350 bp, Staphylococcus epidermidis
gagttaatgaaacaatatgatgtagtatttttaggaagtggtcatgcagcttggcatgctgcgttaacattaaagcaaagtggtaagcaagtagctatagttgaaaaagataccatcgccggtacatgtactaactatggttgtaatgcgaaaattttattagagggaccttatgaagtgcttgaagaagccaaacaatatcctaatattattgatagtcacaatttagaagtgaattggaagaatttaatgcgttacaaagaaaaagtcattaatcctatgtctgaaaccctcacatcgatgtttgaacaacaggaaattgatgtaatcatggggaaaggtaaactggtagatgctcatacaatagaggtaaataatacaactttacaatcagattatattgttatagccactggacaacatagtcatcaattagatattgagggtaaagaatatacgcatgatagtcgggaatttttatcaatgcaatctttaccggatagtatcacttttattggagcaggtattatcagtattgaattcgcttctatcatgatcaaatctggtgtagaggttaatgtgattcatcatacaaatcaggcacttgaagggtttaacgaatcacacgtcaataaattaattcaaaagttaaaagatgaaggtgttaaattttactttagtgagaataccaagtcagttaaaccgaatgcgcaacgttttatagtagaaactgagtctggaaaaatgattgaaacagattatgtactggatgcaaccggtagaaagcctaatgttcagcaaataggtttggaaaaagtgggtatacaatttagtgatagaggtattgaggttgacgattatttaagaacaaatgtgaaaaatatatacgcaagtggggacgttatcaataaaatgattcctaaacttactcctacagctacatttgagtctaattatatcgctgcccatatccttggattgaatacagatgctattcagtatccaccaataccttcagtgctttattcattgcctcgtttatctcaaataggtgtcacagttagcgaggctaagaaagatgatacgtatatgattaaagatataccattcggaagacaaatggtatttgagtatcaaaacgaaacagaagctgaaatgtcaattgtattagatagtcacaaacgtttagtaggagcagagatttatggtaatgacgctggtgatttggttaatctcctagtttttatcattaatcaaaaacttactgcacaagacttaaataaaaatatttttgcatttcctggagcttctagtggtgttatagatttattgaaattggcgatgatgtag

SEQ ID NO: 1573 - DNA, 468 bp, Staphylococcus epidermidis
attgaaatgaagggatgtcttatgttaattagcgatacaaataaaacatatataatagaagaaactagtaattcattcacaattgaaaagaataatgatcagcagcactacgaagtattagaatcaatcaacagcttatctaatgattcattttgtgtgttaaatcacttattcgtcaatggaggtaatgaagaggtttttgagtcacggtttttaaagcgaaatcaacatttgcaagatgtgcctggttttaaagcgttaagatttcttagaccggtagtcaaagggagacattacattatcatcacgctatggaacagtagacaagctttctatgattggcaaaattcacaagcatatgcgcaaactcataaaaaacgtggaactcaaaaaggtgttgatcatcgtatagtcaatagagatttatcctataatataagaatagagttagaaagtcttaataactaa

SEQ ID NO: 1574 - DNA, 1494 bp, Staphylococcus epidermidis
acgatggtgaaagaagtagttctaggaattgatttaggcacaagcgcaataaaaattattgctgttgatcaactaggaaatgtcattgaatcagtaagcgaaacattaaagttataccaagagcatcctggttatagcgaacaagaccctaatgaatggtttgaggctactaagaaagggataaaagaattaattcaatcaacagaaatgtcagataagatagtaaaggggatttctttttcaggtcaaatgcatgggttggtcatagttgatgataatggcattcctttgagaaaagcgattttatggaatgatactagaaattcaatacaatgtagacaaattgaagatatatatggtgaaagattgaattacaatccgatattagaaggatttacacttcctaaaatgttatgggtacaacaacatgaacctgaaatttggaatcgagttgatgtttttatgttgcctaaagattatttacgttattgcttaacgcagacaattcatatggaatatagtgatgcatgtagtacattattattcaatcctgagaattatgaatggacaagagatgttggagatacatttaacattggtgatatctatccacccttagtaaaatcacattcgtatgttggaaatgtaacttcatcactggctaaagaattaggattatctagtgatgttgctgtatatgctgggggtggtgataatgcatgtggtgcaattggtgctggtgtcatccatgataaaagtgcattatgtagcataggtacttcaggtgttgtattaaatgttgaataccaacgtgtgacctcatatgatagtaatttacacttattcaatcatagtgttccagatacttattacgcaatgggagtaacgttggcagcaggctatagtttaaactggttaaaacaaactttttttgaaaatgaatcttttgaagagattttaaatttagctgcatcttcaaagataggtgccaatggactactatttacaccttacttagctggagaacgtacgccacatggtgatgctcaaatacgtggaagttttataggtatcagtgggcaacatactaaagctgactttgcgagagcagtaatcgaaggcataacgtattctttatatgattctataaagattatgagacgagctggtcatgaaatgaactctatcacttcaatcggtggtggtgctaagagtagattttggttacaacttcaagctgatatttttaatgtgcaaataaaaagattgaagcatgaagaaggcccaagcatgggagcggcaattttagcggcatacggtctaggatggtttaaaacaattgagtcttgtgtagaggcatttattaaagtagacgaggtgtttgagccgaataatgaaaatcatgacctttatgaacaatactattcagtttatgaagctatatataaacaaacgaaacagcttactgctgatttgttaacgataacgaattaa

SEQ ID NO: 1575 - DNA, 1101 bp, Staphylococcus epidermidis
ttaatcacgaacaaggagcgcgtactaatgacaaagaaaaaacgtttatcgcctagtgagtggttgcttaaacaatctaaaagacataaaaggaaaaatacactttacacggcaattgtacttttagtagcgttagttctactcatatttgctgttaaatcaatacaagtagaacctgtaaaaagtgatacgagagacaaagatagcattcgtatcacctatttaggtaacgtcactttaaataaacatattcgacaaactaacttgaatgatgtttttaaaggtattcaagatactttagatcatagtgatttttcaacaggttcattaatagtaaatgatttttcaagaaatcaaaaagataacataaataaaaatattgaaaatatcatgtttctacgcaagcataatgttaaaagtgttaacttaatcaacgaatctatggataatattcaagcgacagcaatgatgagaaaaatagattcccaagcaggttataattttttaacaggtaatggttcaaatccaattaatagtaaaactgtacaacaagacattaaaggtaaaaaaatagctaatgtttcatttaccgatatcgaatctaactatactaactctttaaaaaacacgacgtcaattagtttagatccagctatattttatcctttaataaaaaaattaaaggaaaataatgattacgtcgtagtcaatgtagattgggggatacctaatgaacgaaatgtgactacacgtcaaaaagaatatgcacatgcgttagcgaatgctggtgcagatgtcattattggtcataatacagttattcaaaaagttgaaaattataagcgaacgcctattttttatagtttaggtaacacaacgtctgataacttcttatcaaaaaatcagaaaggaatgattgtacaacaagactggaaaggttcgcataatcagttccatatcacaccaattcaatcaaaagatggaaaaatctctaaagataatatgaataaaatggatcatattcgattcaaaaataacattaaagataaatcaattgatttaaaatctgatcaaaatggaggttatacttttgaatattaa

SEQ ID NO: 1576 - DNA, 420 bp, Staphylococcus epidermidis
gaagggacgaataagatgaagaaaacagcagtattaaatagtcacatttcaagcgcaatctccacactaggtcactatgatttattaacgattaatgatgcgggtatgcctatacctaatgatgacaaacgtatagatttagcagtgactaagtcattgccatgtttcattgatgtgttggagacagtgttaactgaaatggaaatacaaaaaatatatttagcagaagaaattaaaactgcgaatgcacagcaattaaaagcaattaagaaattaatcaatgatgatgtagaaattaaatttattgcgcattctgagatgaaagaaatgttaaaatctcctttaaataaaggaaatatacgtactggtgaaatcacccctttttctaacattatcctagaatctaatgtgactttttaa

SEQ ID NO: 1577 - DNA, 900 bp, Staphylococcus epidermidis
tgtattaagaataagaggatgtatatgattaagcaaaattttacaactaaagtttatccacttaaacaatttgagggagagtatagtgaagttgcctacgcaggagatagccaagctgatgatgtgattgtatttattcatggtgcactcttaacatataaaattatgacgatgttcgagccttacttcagagattacaaattaatatttattaattgtccaagtcgtggtaaaagttcagatttagatcgtgacacacatacattagatgattacgctgcacgtatatatgatgtattaacgcaaattgttaaggagcaacaaataaaagaactgagtattgttggttattcaatgggtggaatgattgcgacacgattacttaagtacaatacattaccagtctctcatcttatttatttacatagcgcagcgaaaattactccagatgcaagtatgttagcacgattattcactagtgagagtaagagagcagtgttaaaagatgaaattaaggcagtaaaaaatcttcctcaatatatactagataaaacgatttatgcacaaaaggaaaacgcacttgatttggtacaatttattgcaccaattaaaactataattacggatatgatctacacgattaatacagattatttaccagatatcgatgagattaaacaatttccgaaaatattatttatgtctggaaaagaagatcaaattattccttatacggattctcaagctacgttagaaaagtttaaggcgttaggtggaaaaactaaagaagttatttatccaggaattggtcatatcgatttcccaagtgttttagaaacccaatcagatggacaaactggcgtggtagatgaaattaaagcgtggatttcaaaaaaataa

SEQ ID NO: 1578 - DNA, 870 bp, Staphylococcus epidermidis
gagggtgagaaaatgaatgaacaatggatgagcgcattgccacttgacaatgtgaaagacatttctccagtaagtggcggagatgtaaatgaagcatttaaagtcactacagttgaagaagatattttttttctactcgttcaacgtcaacgatcagaagccttttatgccgcagaaattgcaggactaaatgaatttgaaaatgcaggtataacagctccaagagtaattgcaagtggagagataaatggagatgcatatttattattaagttttcttgaagaaggtagtcaagggagtcaaagagagcttgctcgattagttgctagaatgcatagccaataccaacaagataataaatttggattccgtttaccacatgaaggtgcagatatttcctttgataattcatggactgagacatggaaagagatttttataaatcgtagaatggatcacttacaagatgagttattacgtgtaggattgtggaaacaagaagataaaaaaatgtatgaacgtgtaagaaaagttattgttgatgaactttcaaatcatactagtaagccctctctgttacatggtgatttatggggaggtaactacatgttcttaacaaatggccaacctgctttatttgatcctgcaccactatatggagatagagaatttgacataggaatcactacagtatttggtggatttacacaagagttctatgatgaatataatcaacagttaccactagccaagggatcacaaaagcgtatagaattttatagattatatttacttatgatacatttacttaaatttggaggtatgtatgctgatagtgtacaacgctctatgaaaatcattttagaataa

SEQ ID NO: 1579 - DNA, 1809 bp, Staphylococcus epidermidis
atgaacgagaacaattatagacgtctcaacaaaacttataaaccgcactatttgcctggtttagatggtttgagagctatagcagtcattgggataatcatttatcatttaaatacgaaatggttatctggtggattccttggagtagatactttttttgtcatttctggttatctcataactagtttattattaagtgagtattatagaaataattctattaatttagttaatttttggcttagaagatttaaacgattaataccagcaatgatgtttgttgtcacggttgttttaatatatacattactatttaaacccgaattaattattagtataaaacatgatgctatagcagcacttttctatgtttctaactggtggtatatcatacaagacgtagactattttaatcaatttgctgtagcgccattaaagcatttgtggtcattagctattgaagaacaattctatctattctttccatttatacttttaggcttattaaagtttttcaaaaagagaactacaatgattattctattaatcatctctttattatcattaactgcaatgataacgatacatatgtatacaggtaacaattctagagtttatttcgggactgacacacgtttacaaacgttattattaggatgcttactagcatttatttggccaccgttctctttcagaaaggatatatctaaaggtgctaaagcaagtataagtgcaataggcatagtcggaatggcagtgctcatttatttgtttgtagtggttagtgatcaagataaatggatatatagtggaggattttatgccatctcgttcttaacactgtttgtcattgcaagcgttgtgcatccatcaagtgttttaaagaaaatactaagtttcaagttatttatttatataggtaagagatcgtatagtttatatttatggcactatcctatcattatttttatgaatagttatttcgtacaaggtcagattccttggtttgtatatatttgtgaagtgatacttatgtttgtcatggctgaagtatcttataaatttatcgaaacacctattagaaaaaatggatttaaagcattcacggtgataccgaaaaatttaacaagattttcaagaacgattattgtgttaatcttgcttgttccttctgcattcatagtatttggtgcctatgatagtttgggtaaagagcatgataaacaacaagctgcgaaacaaaaatcttttaaaacgaaccagaaagcaaaacctaaaaagccagatgaaaataatcaagataagtcttcacaacaacattttaatcctaaagaagcgtctccattattgctgggagattcagtaatggtagatatcggtcaagtctttagtgaaaaagtaccaaatgctaatattgatggaaaagttggccgacagttaattgagggtaaagatttaatcaatcaaaagtaccaagattatactaaaaaaggtcagagtgttgtgatagaacttggtacaaacggtgagtttacgaaagatcaaatgaatgaattaattgattctttaggtgaagcagatatttacttaattaaggtaagagtaccgagagactacgagtctactaataataaaattatggaacaagtagctaagaaacataaaaatgttcatattgttgattggtataaaacatctgaaggtcattctgagtattttgcatatgatggtattcacttggaatacagtggtgttaaggcattatctaatgaaatcattaagaaaatgaaagaagttaatgaaaaataa

SEQ ID NO: 1580 - DNA, 234 bp, Staphylococcus epidermidis
gtacttcgtttctttttaggaggatttggagcacacagattttaccatggtaaagtaggaagtggagttggattattagtcttaacattattaactgtttggtttacttttggaattcctactttaatatgggctattattgatgcttttttaattccaaactgggttaaagaagatgaagaaagaatacgtcagcaagctttaagcgaagtaaaattaatgaaaaataaataa

SEQ ID NO: 1581 - DNA, 216 bp, Staphylococcus epidermidis
ttggaatacctaattcatgagtacgtcgacttaatcgagctacttttaattgtaattcttctagtttccctgacatcgtttcaccctctatatatgttaaagttagatgttatattgttatattttaacatagaaaaatctcttcaacgttctaaacgtcgaagagatacgaagctttatcccataaatttaaaaatatcattctcatacaaatga

SEQ ID NO: 1582 - DNA, 198 bp, Staphylococcus epidermidis
ctaaaatttgattcgcttcaatcacaatatgacctctctttcatctacataacacattatttaataatattatatattagcgaatatataaaggaaatatcgaatgtacaagacaattcgactttaactcttaaaaaattaaaaaaagcgaccgaatttgaattgcgtgtatttccacattttaacaacaagtcctaa

SEQ ID NO: 1583 - DNA, 1356 bp, Staphylococcus epidermidis
ttgaaaattgatcaaacacttacatcacgaattagacaacttgaggcttatatcatgaaacaatttttaaacatcactcaacgtaaatttatcgaatggttgattatcttatccatttttatagttagcattcctaataaatggacattaatgatatctatcgctttatctttattacttcttaaaagaggggcgctaggtgtcgttcaattaatcatactttatatgctcagatcgcaaatatacactccctatgatacacaagagatggcgcattacatagtaagtatgaaatatatcttgatttatgtaattggagtattttttctatttaaatatgtaaaacattggataagaaatgaaatgatattaagatttatcaagtctactatgattcttatgctactttatatcataatgagtttagtcgtatctaatgatccgatagaatctattcttaaattgcttaacttctttataccgctaattttgattgttatgtatgttagtttaataaaaaagataaagaatctcattaactggattaatcaatttatcacgctagtgattgcctttacttttttatttatagttatagcgccaaaatcatatttaattgatgaggaatcacttagaagtgttttcaaggatgcacattcattcgcagttattcttgctatgggtctagttctatatatggtaacaataatcaaacaacaagattatgatgtattcaatttattattattaaatattggaatgatagagctctatttatcaaactctcgtcatattttcatatctgttattttatgtctaatgcttctattaccgttatctcacataaaaaagagaattaaacatcccataattggtgctatgatactaatggcaattgctataataaatcaaccatatatttatcatctttttattaaactaatcttaaaagggaagaatagccaagaggtctttatgccgagtgatatgaatattaaagctattgattatgcgctaactgagcatccttttttaggaagcggttttggtataccaatgataaaagcgagttcagaaatacaatactttaatgtagcaacgagtaatatcatcttcggtatgattatctttactggaataataggacttactttatgtacgatatacatgcttcatatggtacttttagttacttttccaatgagtattactattttattatttttaatcactatctttgttaatatggattatattattttatttgattccgtggggctaggtatattgtgttatatattttggggaatatatttaaaagaaggtatgtatcaatacaacaacggacaatggtaa

SEQ ID NO: 1584 - DNA, 543 bp, Staphylococcus epidermidis
tggtttaatgagaaaattttaactgtgagcatatatattgtgaatatatgcgagtcattttacactataatcaatcgtgcgcgattgaaaagaggtggatatgtgaaacaagaacaaatgaggttagcgaatcagctttgtttttcagcatataatgtaagtcgtttatttgctcaattttatgagaaaaagttaaaacagtttggtataacttattctcagtatttagtattactgacgttatgggaagagaatcctcaaacattaaattcaattggtagacatttggatttatctagtaatactttaaccccattactaaaaagacttgagcaatctggctgggttaaaagagaacgtcaacaatctgataaacgacagttgataattacgttaactgacaatgggcaacaacaacaagaagctgtttttgaagcaatttcaagttgcttaccacaagaatttgatacgactgagtatgatgaaatgaaatatgtgtttgaagaactagagcaaacattaaaacatctcatagaaaaataa

SEQ ID NO: 1585 - DNA, 1377 bp, Staphylococcus epidermidis
aaggaggacctcataatgaaatatattgtggtaggtacatctcattcaggatatgaagtgatccaaacattgcttaaagaagatgaaaatgctgatattcaagtttttgaaagtgcagatcaaccgtcctttttatcttgtggtattcaaagttatcttgaagacatctcatcatcattagatgatttacattacgcatcagttgactcttataaggcacaaggtgtaaatattcatacgaatagcacagtcacagatttagatactgacaataagactgttgtagttgaacaccaaggtcaaacagcaacttattcttatgataaattgttcctaagtcctggtggcaaacctgttacccctccagtcgatggaattgaaaaatataaacatgtattatttatgcgtggacgtgattgggcaaatcaaattaaagaacgcatgaaagatgccaaaaaggctgttgtagtcggaggtggctatatcggtattgaagctgctgaagcttttgctaaagcaggcatagatactacaatcgtagatgtcgctgatcgtatattaaacacttacttagataaagaatttacagacatattagaaacaaatgcacagcaacatggtcttcattttaaaggtggcgaaacagtaaaatcaatttcaggaaatcaaaatggcgaagtaactactgtagttaccgacaaaaatgaatatgacgcagatactgtcttatttgctgtaggtgtcgaaccagctaccgagtggctaaaagataaaattgatttaggtaagaaaggaattataaacattaaccaccaacaacaaacatctgctaaagatgtctatgcgggtggcgatgcgacattagttccttttgcaccagtatctgaggatcgttatattgcattagcaacaaattcaagacgtcaaggcgttgtcgcagcaaaaaacatgttgggtaaagaaatgacaatgccacgcgtttctggtacttcaggtttacaattatttgattataaatttggacaaactggcattcacggtacagaaatcgataattatgatggcaatttaggtcaaacatacgtagaagaattgattcgtcctcagtttatgcaagatgatacgaaaattcatatgaaaattatttatgataaagacactcaccgtatacttggtggtcaagtcatgtcaaaagaagatattactgcttctattaacacaatttcagtagtaatatctgctggtttcacacttgaacagctcgctgtccaagatttcttcttccaacctgattatgatagaccttggcattatcttaatgtgttagcccaacaagcattgggagatacatttggtagcgataagatgttattctaa

SEQ ID NO: 1586 - DNA, 1632 bp, Staphylococcus epidermidis
tgtttagatgaaagtgaattgaaaggaagtacacttatgaataaatcaaatttactagcacctgagaattataatattgttacagaaatagaaaaatatgcctcagaagatcataaaaaagccattatttacaaggataacgagcatgaaaatatttctgtaagttataaagaacttatcagtaatgctaataaagtagggaatgtattcctcaatcatgggctaaaaaagggagataaagttctcatcatgatgccacgtgcaatcgttacatatgaattatatattgcagcattgaaactagggatagcgattgttccaagttcggaaatgttacgaacaaaagatttacaatatcgaattactcacggtgagattgatgcagttatttcatttgattctctaactaaagaatttgaaaacgttaaagaatatgaccaattaaaaaaatttatagtagctggtcacaaagaagattgggtttcaatagaagatgaaaaagaaaaagtaagtgatgaccttaaaggcgcagatacaacacgagatgatttggcgattctttcttatacatcaggtacaacaggcaatccaaaagcagtaacgcattcacatggatgggggtatgcccatttacaaatggcaccaaaacattggttatgtatacaagagaatgatcttgtatgggcaactgcagcaccagggtggcaaaagtgggtgtggagtccatttttatctgtattagggatgggagcaacagcatttgtctataacggtcgtttccaccctgaaacatatctcgagttacttcaaaattatcaaattaatgttctatgttgtacaccaacagaatatcgtatgatggctaaacttagtcatttagaacagtacaatttagagtatttacacagtgcggtgtctgcgggtgaacctttaaatcgagaagttgttgaacaatttaaacgtcattttaatattactgttcgagatggatatggacaaaccgaaagtacattgttgatcggatttctaaaagatactgaaccacgtatgggttctatgggcaaaggtatacctggtagttttgttactgtcattgacgatgatggtaaagaggttggtccaaatgttaaaggtaatatcgccgtgcctttagacttaccggctttatttaaaggttactttaaagatgaagcacgcacaaaagcagcttcaacaggtgattattatgttactggagaccaagctcatattgataatgatggttatttctggttcgaaggtcgccgtgacgatattatcattagttcaggatataccattggacctttcgaggtagaagatgcactaacaaatcacgcagctgttaaagaatgtgcagttgttgcaagtcctcatgacattcgtggaaatattgttaaagcatttatcatcttgcaagatgattatgaagcaagtgatgagttaatccaagaattacaagtattttgtaaaaatgaagtagcaccgtataaatatccaagagcaattgaatttgttgaacatctaccaaaaacaaattcaggtaagatacgtcgtgttgaattacgtgacgcagaaataaaaaaatataaacaacaagattcatcacattaa

SEQ ID NO: 1587 - DNA, 813 bp, Staphylococcus epidermidis
aaggaacacgaaactatgacaaattttcattctatagatgctacacaagtaacaaacgtcactttaaatgttaaagatttaaataaattaactgatttctattctaatgtattaggtttttctattgaaaaacaaacgaatcaacaaaccgtattcaacatcggaaatcttggttatactttaactttaaatgaacttaacaacggtcgacaaccggaatttagagaagcagggttattccatgttgcttatcttttaccgactcgtagcgatttagcagacttcctttatcatgctaacaatctcaacatcgcaatgggtggtggagatcaccttgtcagtgaagcgctatatttcactgatcctgaaggcaatggtattgaagtctatcatgatcgcccttcagaagactgggtgtggcgagacggttttgtcaaaatggatacattggaagttaatgtcaatgatttaatggctcaacggtcaaatgaaggttggcaaggttggccggaagaaggaaaaatcgggcatttacatctcaaaacacacaatttagaatctgcttatgaattttatgttgaaaagctagggttcgaacatatatctaatttcccacaagcactatttatgtctactcaaaagtatcatcatcatatagctacaaatacttggcagtcaaataagattagaactcaaaatgaacaaacttatggtttatgtcactttgacatatatcaacctaatgcaaatactactcatgttacctcacctgaaggctttgacattacaattcatggtaacgaaacaaaataa

SEQ ID NO: 1588 - DNA, 1818 bp, Staphylococcus epidermidis
atcgaattagaaataaagaaggtgtttaatatgtcattggaattgcccgtgatgctaacgattgtattgttcttagcactaggcatttttagtcaatggttagcgagtagaataaaatggccatcgattgttgtcatggccatcgtaggtttgcttgtaggacctatttttggactagcaaacccaaaagaggcacttggacctgaggcatttagttcaattgtatctcttgctgtagcaattatattatttgaaggtagtagtaatctagattttagagaattaaaaggcatttctaaagctgttataagaattattacaataggagcgggaattgcatggattttaggagcaatcgctttacatgtcactatgaatttccctctgtctatttcatttgttatcggaggactattcctaatcactggtccaaccgtgattcaacccttgctgaagcaagcgaaagtaaaaagaaatgtcgattcagtattaagatgggaaagtattatcttagatcctattggacctattattgcactcactgcattttatgtattccagatttttgaggaagggataggcttagtcgttattattctctttatcttgaaactcttagctgcaattttaataggttttggtgcagcctttctatttaattggcttataagtcaagataaaattcctcaaagtttaatgccacccattcaacttgtatttattcttttaacatttagtatctgcgatgagatattatcagaatcaggtttactagctgtaacaatttttggcttaatgatggcgcgtaaaaaacgtcacgatctcatctttaaagaatcagaccactttatagataatgcatcatctatacttgtgagtactgtatttattttaattacgtcttctctcactaaagatgtgttgctcaatgtgttatcttggcagctcatactctttagtttggttatgattgtattagtaagaccaatttcagtgcttctttcaacattaggtactgaaataactaaaaaggaacgtgcagtagtagcactaatggcgcctagaggtattgtggttttaacagtggcacaattcttctcaagtttatttatggacgataaaattcctatggctcaatatattacaccagtaacttttggtcttgtatttatcactgtagtcatttatggatttggttttacacctttaagtaaactgttcggtgtagcaagtacggagccaccaggcgtaatcattgtcggagaaagtgaattttcgttccatcttggtattaatctaagggatcatggtatacccgtcatgatgttcaacttatttgaaaatacatcagaaaaagcccacgaagctgggttcgaagtatttaaaggtaatcttttatctagcaatgatagaatttattctgatttattacgttataataaatgtattttgatgacacaatcgtttatctttaacagtttagcatttaatgaattagtgcctgaatttggcttgaataatgtagatatgatgccagtatcttttaatgatgaacaagcacgaaacaatttaaatggtccaatcagaaatcatatattatttgatgaaaatcataccccacgttggtttaatcaatttattacacaacataatattgttgaagtaccggcagaagattatgaaaaaattacagaaaatgatatgttaatctatcatatcaatgaagataaagaagtgacgtttaaacgaagcaatagagatatacctgaacatgaaacaggtgtttatggtattttaaaaaatgcttatttaacttaa

SEQ ID NO: 1589 - DNA, 576 bp, Staphylococcus epidermidis
cacatgcaagaagataggaaatttgaagtcaaatggcgactagttaattcatcaacttttatgtatggtacaaaattacgttttaatcaagataatatctattttgagaaccctttgatgccatccggtacaatcattcacagttggtatatgttaactgattttgcagaagaccgtgtaagccctaagctacctattttaaaaaaagggcgccaatatcaatttcaatttaattttgaagttgaacctgagggtgcggcttattttaaaatgaaattttatcgtaagaataaagaaattcttagtcatcaaattctaaaaaataaaaaagaaaatattgtctatcctagagaagcatattcatatgaattagaacttattaatgctggcatgaatcatctatcttttcacaatataattgtgcaagaattaagagaagatagtaatcaagcttatgaggcaacgcaatatatagatcctaagaaaaaacttaaagtaattaatcaaataataaccaatataaggacacatcatctagacacatcaaactatcacaggagtgatacgaatggctaa

SEQ ID NO: 1590 - DNA, 1263 bp, Staphylococcus epidermidis
tgtagcgaagaaaaggaggaaatgagtatgacaaatggacctattcaagttaacagtgaaatcggcaaactaaagacggtattacttaaaagaccagggaaagaattagaaaacttagtgcctgattacttagatggattattgtttgatgatattccatttttaaaggtagctcaacaagagcatgatcattttgctcaagttcttcaagatgaaggaatagaagtgctttatttagaaaaattagcagcacaaagtatagaagattcaaatgtcagagagcaatttatagatgacgttttagcagaatctagaaaaactatcctaggtcatgaaaaagaaataaaaaaactcttttcaactttgtcaaatcaagcattaattaataagattatggctggcgtacgcaaagaagaaatacaacttgaatcgacacatcttgtagagtacatggatgataaatatccgttttatcttgacccaatgcctaatctatatttcacacgtgatcctcaagcttcaattggtagaggtatgacagtaaatcgtatgttttggagagcgagacgcagagaatcgattttcatttcatatattttaaaacatcatcctagatttaaagatgagaatattcctttatgggtggatcgtgactgtccgttcaacattgaaggtggagacgaactggtgttatctaaagatgtacttgcaatagggatatctgaacgtacttctgcacaagcaattgaacgtttagcacgacgtatttttaaaaatccgttatctacttttaaaaaggtggtggcgattgagattccaactagtcgaacatttatgcacttagatactgtttgtacaatgattgattacgacaaattcactacacattcagcaattcttaaatcagaaggaaacatgaatatatttattatcgaatacgatgataaagctgaagatatcaaaatccaacgttccagtcatcttaaacaaacattagaaaaagtgctcgatgttgatgaaattacattaataccaactggaaatggtgatatcatcgatggtgctcgtgaacaatggaatgatggttcgaatactttatgcatccgtcccggtgtggttgtaacttatgatcgtaattatgtttctaatcaattgttacgtgagcatggtatcaaagttattgaaattcctggaagtgaacttgtacgtggtcgaggaggccctcgatgtatgagtcaaccattaataagagaagatctatag

SEQ ID NO: 1591 - DNA, 1398 bp, Staphylococcus epidermidis
aatggagaagaaaagattatggcagataaactgcaaagagaattaagcaatagacatatacaattaattgctattggcggggctattggaacaggtttatttcttggtgctggccaatctattcatttagcaggcccatctatcttactaacatacataatagtaggttttgttctctttatgttcatgagagctatgggagaattactgttatccaatttaggatttaaatcgtttggtgacattgctcatcatcatattggttctatggcaggttttatggtggggtggacatattggttaacatggattatttcaggaatggcagaagtgactgctgttgccaagtatgtttccttctggtatccaacaattccaaactggttaacagctgcagcgactattttagttttagttgctttaaatctattcagtgctaaattatttggagaattagaattttggctatctattattaaagttttgactattttagctttgatagccgttggtgttgttatgattgtatttggaatgaagacaagctatggccctgcaacggtaacgaatatatggaaagacggaggctttttccctaatggtgcacaaggtttcttcatgtcattccaaatggcaattttctcatttattggtattgagttgattggaataactgcaggggagactaaagatcctcacaaaacaattcctcaagcaattaataatgtaccgtttagaatattattattttatataggatcgttggcagttatcatgtctgttgtaccatggcaacaattgaatcctgctgacagtccatacgttaaaatgtttggattagttggaatcccttttgcagcaggtattattaactttgttgtacttacagctgcagcctcttcttgtaatagtggtatatttgctaatagccgtacgatgtttggattagctggaagaaagcaaggtccagcattcttacatagaaccaataagcacggcgtaccacattatgctattttagtgacatgtggcttattaagtatttcagtcgtgttaaatgcaatttttaaagatgcgactaaagtgttcgtacaaattacaacattttcaactgttttaaatattatgatttggacaattattatgatcgcgtatctaggttatttaagacatgaaccgaaacagcataaagaaagtaactataaaatgtggggcggaaaatacatggcttacagtattttagggttctttgcatttatttttattatactattgattaatagtgcaacgcgttatgccgtactttctgcacccgtatggtttgttatcatgctattgatgtatcaaaaatataaaaaagaatctcgcaaagctaaaattaaaaatgaggaagagtaa

SEQ ID NO: 1592 - DNA, 789 bp, Staphylococcus epidermidis
aaattgttggaggcggttaatatgtttaaaataggaaatttagaattacaatctcgtttacttttaggtactggaaaatttgaaaatgaagaggttcagtcaaaagcaattgaggcatctgaaacaaatgtacttacatttgcagtaagacgtatgaatttatatgatcgtaacctacctaacccacttgcaaacgttaatttaaaagattttatcacttttccaaatactgcaggtgccaaaacagctcaagaagctatcagaattgctgaaattgctaatcacgcaggtgtatgtgacatgattaaagtcgaagtcattggtgatgacgaaacattattacctgatccattcgaaacatacgaggcatgcaaagtattgttagaaaaaggttacactgtttgtccttacatctctaacgatttagttttagctcaacgtttagaagaattgggtgtacacgcagttatgccacttgcatcccctattggtacaggaagaggtattaataacccattaaatttaagttatattatcgaaaatgctagtgtacctgtaatcgtagatgctggtattggttcccctaaagatgcgtgtcatgccatggagcttggcgcagatggtattttactcaacacagccatttcagcggcaaaagatcctgtgaaaatggctgaagcaatgaaattaggtataaatgctggcagactttcatatgaagctggacgcattcctgttaagtatactgcacaagcatctagtccatcagaaggtttagggttcttgtaa

SEQ ID NO: 1593 - DNA, 621 bp, Staphylococcus epidermidis
cgttgtatggaacaaattatcactgattttattagtaagtggggttatacagcgatattcattttaatcttattagagaacgtattacctgtcgttccatctgagattattttaacttttgcaggcttattatctgtgaaatcacacttatctatttggacattattaatcatagcaacaattgcttcattcattggtttactcattttgtattatatttgtagacttatctcagaagagaaattatatcgtttcgttgatcgacatggtaagtggatgaagttaaaaagtaaagatttgaaacgggcaaatgattggtttaaaaagtatggtgcatgggctgtatttttatgtcgttttgtcccagtacttcgagtattaattacaatacctgctggcattaatcgaatgaacgttatacagtttacaactttatctttaataggtactacaatttggaattttgctttaatactgctcggtcgtttgctcagtgacagttttgacgctttgatgaatggtattcatacatattcacgtatcatgtatgtcattattattattgcagtcatatattttgttatacgttatttaatgaaacgtcgtcggagtgttaaataa

SEQ ID NO: 1594 - DNA, 825 bp, Staphylococcus epidermidis
ctttggatggaacgtttagaaaacaaaatcgcagtgattaccggtgcgagtactggtattggacaagcatcagccgtggcgttagcaatagaaggagcacatgtgttagcgcttgatatatcagatcaattagaagaaactgtgcagtctattaatgataatggtgggaaagcaactgcatatcgcgtagacatttcagatgataaacaagtcaaacaattctcagaaaaaatagcacaagaatttggacatgtagatgttatttttaataatgcgggtgtagataatggcgccggacgtattcatgagtatccagttgaagtgtttgataaaattatggctgttgatatgagaggaacgtttttagtaactaaatttttattacctttaatgatgaaacaaggtggttctattattaatacagcttcattctctggacaagctgccgatttataccgttcagggtataatgctgcaaagggcggtgtcattaatttcacaaaatctatcgctatagaatacggacgtgaaaatattcgtgctaatgccatagcacctggaacaatcgaaacaccacttgttgataatttagcaggtacatcagatgaagaagccggacaaacattccgagaaaatcaaaaatgggtaacaccattaggtcgactaggaacaccggatgaagtcgggaaacttgtagcatttttagcttccgatgatagttcatttataactggtgaaactattcgtatagatggtggcgttatggcttatacatggcctggagaaatgttaagtgatgaaagttggaaaaactctactaaataa

SEQ ID NO: 1595 - DNA, 192 bp, Staphylococcus epidermidis
aattctacggacaaggcaagttggggttcggggccccaacaaagagaatttcaccgagaaattccacggacaaggcaagttgtcggtaacttggataacttattcaaaataaggtgtgtattcaactacgataagttatcatccttattttgtttcgttaccatgaattgtaatgtcaaagccttcaggtga

SEQ ID NO: 1596 - DNA, 1278 bp, Staphylococcus epidermidis
atgaaaagtttagataaaggatttagacatttaacacgaaaagataaattaaaaaaacttgttgaatacggttggctagatgatgaaaactatgaaatattacttaatcatccgttaattaatgaggaagtcgcaaacagtttaattgaaaatgtcattggtcaaggtgcactaccagtagggttattacctcgaattatagttgatgataaagaatatgtagtacctatgatggtagaggaaccttctgtcgtagcagcagcaagttatggcgcaaaactcgttaatcaaagtggtggatttaagacaatttcaagtgaacgtctaatgattggacaaattgtctttgatgatgttgaagacacaggcacattagctaactcaatatatcaaattgaatcacaaattcatcaaatcgctgatgaagcttacccttctattaaagcaagaggtggaggatatcaacgtattgaaatagatacattccctaatcatcgattattatctttgaaggtttttgttgatactaaagatgctatgggtgctaatatgttaaatacaatattagaagcaatcactgcacatctaaaagttaaattttcaaatcaaaatgttttaatgagtattttatctaatcatgcgacagcatcagtagtaaaagtacaaggggaaatagatattgaagatttacatagaggagagagaagtggcgaagaggtagcacaacgtatggaacgagcgtcagttcttgcacaagtagatatacatcgtgctgcaacacataacaaaggtgtgatgaatggtatacacgctgtagtattggctacaggcaatgatacaagaggagttgaagcaagtgctcatgcatatgcaagcaaagatggtcattatagagggatagctacttgggaatatgatcgctcacgtaataaattggttggaactattgaagttcctatgactttagcgacagtaggtggaggtacgaaagttttacctattgctaaagcctcattaaatttgcttaatgttgaaaatgcacaggaactagggcaagttgttgctgctgttggattagcacaaaatttctctgcatgtagagcgctagtgtctgaggggatacaacaaggacatatgagtttacaatataaatcattagcgattgttgtaggtgcaaaaggcgaagaaattgcgcaagtagctgaagcgctcaaatatgaatcacaagctaatactgccaaagctcaagaaatcttgatgaatataagaaagtcataa

SEQ ID NO: 1597 - DNA, 927 bp, Staphylococcus epidermidis
ttaaacttactattgaattatatcaaaactagggggatatgcatggatataaaacacatgaaatactttgttgaagttgtcaaacaaggtggtatgacaaacgcttcaaaatccttgtatattgcgcaaccaactatcagtaaagcaattaaggatattgaagcagagatggctgtccctttatttgaccggagtaaaagaagtttagtacttactgatgcaggtaaaatttttttcaagaaatgtcaagaaatcatcgcactatatgataatttgcccactgaaattaatagtttgtatggtttagaaacaggtcatatcactattagtatgtctgcagtgatgagcatgcgtaaatttattggcgtattaggagactttcatcaactttatccgaatatcacgtacaacttaatcgaaagtggtggtaagacgactgaaaaccttatacttaatgatgaagtggatattggtgtgacaacattgccagtagatcatcaaaaatttgaatgtatatctttaaacaaagaagaactgactgtagttttaaataaagaacatcctttagcacaaaaatcttctattaaaatggaagaattagctgatgagaacttcattttatttaatgaagatttctatctcaacgataaaattattgaaaatgcgaagaatgctggattcgtgccgaacatggcctcacaaatctcacaatggaatgtgattgaaaatcttgtcattaatcaattaggtatttccatattgccagccactatagcacaattacttaatgatgacgtcaaaattgtacatttggaaaatgcacatacaacttgggagcttggtgtcgtttggaaaaaagataaacgtttaagtcatgctacaaataaatggatagaatttttgaaagaaagattatccgaagaataa

SEQ ID NO: 1598 - DNA, 1440 bp, Staphylococcus epidermidis
caacgcttacttggatacttaaaatttactcgtaattatttttcagttttatacatcatcatacgattaggaggttacaacatgtttaatttcttaaaaccagctagacatatcaaatcattgccagcagaaaaagtagatgatacatataaaagactacgctttcaagtctttttaggaatatttatcggttatgctggttactatttattaagaaagaacttctctttagcaatgccttcattaattgagcaaggctttattaaaggggaattaggtattgcattatctgcagtatctatcgcatatggctttagtaaatttgtaatgggaactgtcagcgatcgaagtaatgctcggatgttcttaactttaggtttagtattgacagcaattattaacttattattaggatttattccattctttacttcaagcataactattatgtttatcatgctgtttttagttggttggttccaaggaatgggctggccaccatctggacgtgtgttagttcatgggtttagtgtcagcgaacgcggaagcaaaacgtcaatatggaatgtagcacataatgtaggcggaggtttaatggcacctattgctacgtggggtatttccatgactgcattatacaacttcggttatttaaaagggtttgaaggcgtctttatataccctgcactattggctatcattattgccatcttctcttacatactaattagagatacaccacaatctcagggtttaccaccaattgagcagtataaaaatgattatgccacttcaactaaacaaacaattgaaacagaactaactactaaagaaatattatttaaatatgtacttaataacaaatgggtatgggcgattgcttttacaaacattttcgtttattttgtgcgttatggtgttttggactgggctccgacatacttaagtgaggaaaagcattttgatttaagtgcttcaggttgggcttacttcttatacgaatgggcaggaattccgggcacgctactctgtggttatctatctgacaaactatttaaaggtcgtcgtggtccagcaggcttcttctttatgttaggcgtaacaatctttatccttatatattggttaaatccaccaggtcacgcatggttagataatctttcattaattggtattggtttcttaatttatggtccagtcatgttaattggtttacaagcgttagattatgttcctaaaaaagcagcgggtactgcggctggtctaactggtctatttggatacttgttcggtgcagttatggctaatattgtattagggtttgtagttcaacattttggatggcatattggctttgtgttattaacagtcatcagcatactcgctatgttatgtttcattttaacttggaataaacgtggtcaagaacaaatcgactag

SEQ ID NO: 1599 - DNA, 189 bp, Staphylococcus epidermidis
tcaaagctactgcatccgcttaacattaaaatgatgattgacactataattaatttcttcaatataagtgctccctgctatgaccaatttatacgcttatcactatatctgttacattataaaaaagcaatagttatcaatataaatgtaaactgtaaactaattatgtttgaaaacgtcaaagcgtga

SEQ ID NO: 1600 - DNA, 954 bp, Staphylococcus epidermidis
caaatggtactttttcttcaacccgtatttcaagaacgtttatggggtggcaccaatctcactcaatttggctacgatattccgaataattctaccggcgaatgctgggcaatttccgcacataaaaacggtcctaacacaattctcaacggaaaacataaggggaaatctttaaaacaagtttgggacgaagataaagcacttttcggaaatgactcacgtaaagattttccacttctcactaaaattttagatgcacatgattgtttgtcagtacaagtacatcctgatgatgaatatgcgcttaaacatgaaggcgaatacggtaaaactgaatgttggtatattttagacgctcaacctggtgctgaaataatctatggtgttaatgctacaagtaaaaatgaacttgaacatatgattgatcatcatcaattcgactatttatttaaacatgtacctgttaaaccgggtgatttcttttatgtaccagccggtacagttcatgctattggttccggaatcctcattttggaaactcaacaatcttcagatacaacatatcgtatatacgattatgacagaaaagataaaaatggtcatacgcgtgaattacatttaaaccaaagtaaagatgttattgatatcactacaactgaacctaatacaacacctaagactgaaatgataaatggcaattgtcacactcaatttgttgccaatcatttctttacggttgaagaatggtctatcaaagacatattagattttcaaaaaccacacacttattgcctagtgtcaatgattaacggccacgggcaagtttcaatcaataacaaagtatataaaatcgataagggcgatcattttattttaacttctgaagatcaatatattaaatttgttggtaatatggatttaatagtcagttttagtaaagatgaggcatattaa

SEQ ID NO: 1601 - DNA, 1365 bp, Staphylococcus epidermidis
aaagagtcactattgggagggaactcaatgagtaaggttaatcatttgatagatgaagatgaacgttattttgcacattctggacggattaaatattatcctctagttattgatcatggttatggagccacgttaatcgatatagatggtaagtcttatattgatttattagcaagtgcaagttcgcaaaatgtgggtcacgctccgaagccagtagtcgaagcaattaagaaccaaactgagaaatttattcattatacaccagcatatatgtatcatgaaccgttagtgcgattatcaaaaaaattatgtgacattgctcctggaaattatgagaaaagagttactttcggattaagtggctctgatgctaatgatgggattataaagtttgcacgagcgtatacaggacgtccatacatcataagttttactaatgcataccatggttcaacatttggttcattatcgatgtcttcaattagtttgaatatgcgtaagcgttacgggccattacttaatggattttaccatataccttttcccgataagtatagggggatgtttgagcaagctaaacctaacacagttgaggaatatttagctcctttaaaagaaatgtttacaaaatatgtccctgcggaggaagttgcatgtattgtggttgaaacaattcaaggtgacggtggcttacttgaacccgtgccaggttattttgaagcattacaagagctttgccacgctcacaatattcttattgcagtcgatgatatccaacaaggattaggtcgtacaggaaagtggagttccgtagatcattatcattttactccagatttaatgacatttggaaagtcattagctggaggtttaccaatgtctgcgattgtaggtcgtaaagaaatcatggaaagtcttgaagcacctgctcatttatttacaactggtgcaaatcctgtaagttgtgaagcagccttagctacgataaagatgattgaagatgaagatttactaaacgcttcatggaaaaaggggagttacgttagaaaaagaatagacccatggatagaacgttaccaatatgtaggtgatgttcgaggtattggattatcaattggaatagacatagtatcaaataaaattgagaaaactagagattctgaagcagcattaaagatatgtaattactgctttgaaaatggtgtgattatcatagcagttgcgggtaatgttttaagatttcaaccaccacttgtgattacctataagcaacttgataaagcattagatacaatagaagaggcgcttgaaaagttggaaagaggagaattaaatcaatatgacattagtggtcaaggttggtaa

SEQ ID NO: 1602 - DNA, 963 bp, Staphylococcus epidermidis
cagggagcacttatattgaagaaattaattatagtgtcaatcatcattttaatgttaagcggatgcagtagctttgatcatcgtaaacgcgaaagtattaatgacaagaataaaatgaaagtatacacgactgtatacgcatttcaaagtttgacacaacagattggtggaaaatatgttgacgcgcaatcaatatatcctgctggtgctgatttacactcatatgaaccaacacaaaaagatatgattgatattgccaaaagtgatctgtttgtctattcaagtcatcaattagatcctgtcgctgcaaagattacgaattcgatgaccaataatagcatgaaattagcgcttgccgaaggactcaaacaaagtgattttattcactctaaagaccatgatgaaaatcatgagcatcattcacatcatgaagaatcgaatcaagatcctcatgtttggttagatcctgttctaaatcaaaaattcgctttcatgattaaagagaaattaatagagaaagaccctaaacatcaagcttattacaataaaaattataaaatagtaaataaagatattgtgcatattgatcaacaactacaatcaataacgaagcattctaaaagagataaagttgtgatatcacacgattcgcttggatatttagcgcatcgttatggttttaaacaacaaggtgttaaaggtatgaatgatgaagaacctagtcaaaaagagattttgaatatcgttaaagatatacagcattcgcatgcgccttatgttttatatgaacaaaatattacctccaaaattacagatgttattaagaaagaaacagatactaaaccattaagttttcataatttagctgtattgactaaagaggagcaaaatgatgattcaatttcataccaatcattaatgaaaaagaacatttacgtattaaatcgcgcactcaataattaa

SEQ ID NO: 1603 - DNA, 765 bp, Staphylococcus epidermidis
aaaggagtttgcatagtgttattagaggttaaaaatgtaaaaaaagtctatggcagaggtatgaacacgacaatggctttaaatcaaatgaaccttgaaattgatgaaaatgaatttgtagcaatcatgggagagtcaggttcaggtaaatctacattactcaatttaattgctacttttgatcgtacaactgaaggcttgataaagttagacgggttgccacttaatcaattgaagaataaagacattgcacgttttcgtagagaaatgatgggatttgtgtttcaagattttaatgtgttgaatacgatgtcgaacaaagataatattttgatgcctcttgtacttgcaaatgaacgtccaaaaataatgcaaaaacgcttaatggaaataagtgaacaattaggaattgaagacttgcttgaaaaatatccgtctgaaatatctgggggacaaaaacaacggatagctatagcccgtgcgttgatagcacgacctaaattattattagctgatgaacccactggtgcacttgattcaaaaacctctaaaaaccttatgtgtttatttcgaaaaattaatcaaaagcatcaaactatattaatggtgacacattcaaatattgacgcgtcatatgcgaaccgtgtcatcttcatcaaagatggtcgtttgtatcatgagatttatcgtggtgaagaatcgcaaacagattatcaaaagcgtattgccgatagtttggccatattgaatggagtaggtgactaa

SEQ ID NO: 1604 - DNA, 417 bp, Staphylococcus epidermidis
acgatgccttggacgatggaagattatcctcaaagttggaaaaactttgaagaactcgaacggaaaaaagcgattgatattggtaatgcgatgctcaaagatggctataaagaatctgatgtgatacctattgctacaaatcaagctgaaaaatggtatcaacatgcttcaaaagaagaattagagacgttaaaaaacaaacatatcacgcaacatcaagaagatgaatcagcaaatcctaaacttaacgaagaaaatgttcatgtatattatgaagatcagctatggaaagtaaaatctacagaggctaaacgagcttcagatacatttgacacaaaatctgaagcagttaatcgtgcacatcatatcgcagagaataaaggtactaaagtggtcgagcatcgaaaagatgagtga

SEQ ID NO: 1605 - DNA, 750 bp, Staphylococcus epidermidis
atgaaattctgccctcattgtggaaatccgataaaaaaggaacagtcattttgtaataaatgtggaaaacatttaaagacatcgacacaaagaaaaagtgaaaatcaaattgaacatatgcgtgaacagcaatcgtatatttctcgtgaggaaagacaacatcatgattcaacattttataaagaacaaaaacatactggttggctaattgtattatcaattatatttgtcttgttgatagcagcgctattgtatggtgcgtactatgcttacaatcattatattagtgatgagcaaagtcaccaaacaacagagtctcagcaatcaaatgaaagtgatcaaaatagggaccaatccactggtccaagcattgatgtttttagtgatgactttgatcaaggttatatgaagtcagcttcaacaagtggatatagaggtgtttataatggaatgacacgtgaagaagttgaagataaatttggaacatccaatggttctgtagaaagtttgaagtggagttacgaaacatatggtgatttagctgtagcctacgatgataatgaagttgttagcgtaggtgtagcacctaatcatatttcagaagatcaatttttaagtatgtataatgaaccggatgatagaaattcaagccagctcatttatgatagtaacaaagataatgacttctctgtattagttaatgttaaaaatggagatgttactgtcattgaaaatgtaaatcaaatttaa

SEQ ID NO: 1606 - DNA, 1191 bp, Staphylococcus epidermidis
aaaggagtatggaaatcgatggaagaaagtaaaaactataatctcattacgacaatcatgtttatttcaggtatcattgtaatggcaagtttatatacggctctacctcttacagcaactttcgcagaagactttcatgttcctaaatctatagcaactttaaacggtgttttattctcattaacatattcaatcagttgtctattttatggaacgatttctgaaaagtatggcagaattaaaactattttagtaggtatgagtgcattagttatcatctgtcttatgataggtattgttcattcatttacagtgttattaatattaagagcactacaaggcgtatttgctgcatcattttctcctgtagtcatgacttatacaactgaaacttatccacgtgtgaaacgtgtaacagcaattagtttcatcagtacaagttttatgttatcaggtgtgttagggcaaaatatgagtgaattagtcgtaagttatttgaattggcagtgggtatattttattttaacaatcttatatttaattctcgtattagttatttataaaaatgtacctgagagtccacataaaaatcctgatatacaactcattaagtttttcaataactttaaagatttcaaagacaatcttaaagttttctattgtttatttatttcactaacattactgattatgtttataagtatgtatgatattttaaatgaatatgtcacatcacaccaagttgggggagacatgtctgtgtcctcaatgatgaaattgttcggtgtgataggcatgttattatctctattagcagggcgtgtaagcagtcgtataggtatgaagcgcttgctaactatcgcattaacaacatgtattgtgtcgatcatactcatgggtgtaactacgaatattatacttattacaacatttagtgtgttgtttgttgcaggtatcgcatttgcgattcctactgttatttcaaaaataggtgtagttgttaaaaacaatcaaggtttctttttatctgttaatacatttgtattattcttaggaacagcgattgcacctattttaatgttatttgtaggcgaactgtctaactttttcttacagtttttaatgattgctattgtcggactgattgctttagttgtatcaatatttatgccaggtgaccaacgttcttga

SEQ ID NO: 1607 - DNA, 1953 bp, Staphylococcus epidermidis
ttgaatttgtgggatgttagagaaaggaagattgggatgcaacaaatcattaactctttgatacacttcgaccgttcaaaaattgatatagctaaaggaatacgacaaggatttttaatgatactaccagcattgataggttacttattaggattccctatgtttggtattctaatatcaacaggtacgctagcacatgtctacgtttttagtggatcaccacaatctatgttaaaaacagtcatcacctgttcactatcatttactatttgcatgattcttggcaccttaacagtatctcagcctattttatttggattactattactgattgttgttacaatcccatattatacgtttaatgcactaaaaatcgctggtccatcatcgacattctttttagtaacgttttgcttatctataaacttaccgatagccccagaagaagcacttttacgtggatctgcaattctcattggtggtatattggctaccataacagtaattttaacaatcatatttgctaaagagaaagcagaagacagagcaattcatgcggattttaaaacattacataacttgctacatcattttgatgagccagaggatttcaaagcatatgctcgaaacgctgttacagaatttagaaattctgaaaaacttttaattacctcaacatcaggtggtaatggaaaattaagtaaaaggtttcagaaattaattttattacacacatcagcacaagggatatattcagaattactagaactcaatgaaaatcatattcgtccattaccaagtgacttagttgaaatgatggatcatatcattaaaaatgttcaacaacctaaacaacaatatcgaccgtggtcaaaagttgttgatgtggcaccagaatttcaaaatttaatggatcatattttgaaaatagatgaaatgattcacgcaaacgataatcaaattaaatatgaagcagatattcgcaagcctttatatagtaagcgaatatatcaaaatctaactttcgactcaattgtatttagaaatgctttgcaatatacagttattatggcagtagctatatttattgctctagcgtttaacattcaaaaagcgtattgggtgccattgtcagcgcataccatcatgttaggtaatgtgacaacgattcgtacgttagacaggtcacttgctagaggtattggaacgataatcgggactattgttttgtcgggaatcttggcatttcatatcgatcctattttcgctattatcattatgggattttctgccatgatgacggaagcgtttgtggcatctaactatgcatttgcagtcatttttattacgacacaagtcattatgctcaatggtctagcctctcaaaatttaaatattgagatagcgtacacccgaattattgacgttctgataggtatagctattgcagttattggtatattcatactcgcgcgtaaaactgcatcctcaatgttatctgatgctattgccgaattggtacgtaaagaaggtattttatttcattatttattttcaaaaaataaacaggaaacgaatgaacgtgatagggtagaaagtttgaatttaaacgttaaaatcagtaatgtgacacaaatttacaattcagcgaatggtgaattgtttagtaataaagaagcggtaaggtattactatccaagcatatttgctctagaggaaataagttttatgctagagcgtgccatgaataataaacaccgacaaacaataaatgatgatttaatgggtgaatatttagtcgtatttgaaaatatagctaagcatttccaatttcaagcagatttaaatatcagagacatgcaaccattacctcaatataattacatccgtgcttcgcttatgaatatacagcgtaattgtgctgaacaacgtcaggccatcacaaaagattag

SEQ ID NO: 1608 - DNA, 612 bp, Staphylococcus epidermidis
atgaagcagtggatgaatagattaatcaccttaataggcgtattgttaatcattttagctatttatttattctcaaagccatatatcgataattatctacatgaaaaagataacgatcataaaattgaaaattatgataaaaaggaaaaagaacagacaaagacatctaaatcgacgccaaagataccttccgataaatctaaaatggctggttatatagaagttccagatgcacaaataaaagaaccagtataccctggtccagcaacaccagaacaactcaatagaggtgttagttttgcagaaggtgacgaatctcttaatcaacagaatatttcaattgctggtcatacgtttacagatcgttcgcactatcaatttacaaatttaaaatcagccaaaatcggtagtaaagtgtattttaaaactggaaatcaaactagaaagtataaaataactaaaatacgtgatgttaagcctacagaggttaaggtattagacgaacatcctaataagaaaaatcaattaacattaattacttgcgatgactataacgaagaaacgggtgtttgggaaacaaggaaaatattcatagctacacaaattaactaa

SEQ ID NO: 1609 - DNA, 699 bp, Staphylococcus epidermidis
ggagttatttttatgactggaaatcaaatgttttgtagagaaaatgaacttgatgaaagttttaaacaattagcatcttatatcaatattcctgtaggcgtattactgccatttaaaagtcaatgttttgtgagacattacaacaaaggacaaattgtctactattcgtctgatgaaaccacgcatatttatctactcttaaaaggtaatattatgagagaaaattttaatttgaatggtgatgtatatcgatatctgaatagagaaaaagtgctctttcctttaaataacttatttcaagataaagttcctaatgaaatgtgtacagccctaacagattgcgaaatgattggaataccaagagatttaatagaatatttatgcaaaaatcacgaagagatttttgtgaaattattctccttattaagcgaaacacagtgtcaacatattgaatacaatatggctttaacgagtaaattagctaaagaacgcgtgactaagattttacgttacctatgtcaaacagtaggttatgatcatgacgagttttatgaaattaagcattttatgacaatacagttattgagtgatatggcaggaatatctagagaaacgacgagtcatatcataaatgaacttaaagaagagaaaatactctttaaaaacagtaaaaattggttggttagtaaagacttataa

SEQ ID NO: 1610 - DNA, 576 bp, Staphylococcus epidermidis
agaagttcccgcaagtcaatacaaaggtcaaggtttccacaaccagtagctgaaaaaagtgctatcgcacatgcgaaaaaacatcgtgaagaatacgaaaaacttggcgaacaattttttaaagataattttagccttaatgttaaagccacaaatgttgtaggaagtggtgatggcgtcgaagtctacgttcattgcgatgatcatgacattgtgtttaatgcaagcatcccttttgataaggaagcaatacatgaagaaggctccatgcgaagcaatgataatggagataccatgagtaatatggttggaactgtgttaagtggttttgaatataaagcacaaaaagaaaaatatgataacttaacaaagttctttaaaaacaatgaagaaaaatatcaatataccggttttactaaagaagcaatacataagacacagaatgttggatatcaaaatgagtattattatttagcaggtaacgttactaatattaataattatagaaaatattatgaacctttaataaaaaaagattctaagagtttcaaagaaggtatgaaaaaaagcaaatga

SEQ ID NO: 1611 - DNA, 471 bp, Staphylococcus epidermidis
aatggtaaacgatgccgagaaaagattattaatcaaaatcgtgatattgtcgcaactgagaaatctttaccaccgtggaaacgttttttaagtcatttcagtttctacgcaatcgcattgcaatactttgtagttcagtttgttatcgcgttgttcctaatatggttaccaacatatttaactgaacaatatcatgtgaatttcaaagaaatgactatcagtgcattaccttggttatttatgttcttcttaattttatttggctggagctatttcagacaagattttgaatacaggtcaatcacgttttgttgcacgtggcgtaattgcgattgcgggatttgtggtattctcaatttcaattttcttagcagtacatacagacaacttatatgtaaccattttctggttatcactttgtttaggtggcgtacgtatttctatgggaatgagttgggctgcagccactga

SEQ ID NO: 1612 - DNA, 627 bp, Staphylococcus epidermidis
gggaaatggcgtttttttattgtagaaattggggggatatttatatttattgcgattacatatcataaacaactgactaaggacgatttacagcattataaacatatcgaagaagctattgatggcttgttatttcgcacttccatgaataacgaagaaaacaaggagatgattcaatctttacttcaattgggttttagtaaagataaaataattattcatagcgatgtgacactgttagaggatttacaccttaaacgtatccattttaaagaaaatgacacaactgctttcacatataaagaagctcatcctgatatttgtgtaagtatgtctacacatgacgttgaaacagtaaaacgatgttacgaaaatggtttggattctgtcttttttggacatatttttcctacctcttcacatccaaatgtaccaccgcgttctaaagaagctattcaacaggcattaaatgttcctatccctatttatgctattggtggtattaatgaacattcacttcaaaagatgccacctggatttaaaggtatatgtgccatatcatattttaacaatgcttcactagaagaaattaaacaattaagaaaggagtggtctactcatgcatga

SEQ ID NO: 1613 - DNA, 471 bp, Staphylococcus epidermidis
agggaatttagaataaaatgttttacggaggagattaatatgaattggttaaaaatattttatcatttattatgcgcaaccacgattagcgtgatattacttattataactatattaatggatgtgttactacaaaacacacatttaactcagttattactcaatattgattttttaatcaaccctgatgaagtgccaacaattattgaagtactgattcatttaagtattggaatattgatttatctcgcctttttaattatctatcattattcaaaatccttgtatcatctagcatacttacctttagtattgatatttactttgatgtatccacttctcgtttttcttgcgcaacgtccatttttttcctttagttggaacgaatttgcatggtggttagttgcacatctttttttcatcattttaatggcgacttgtctacctatcatttcgaaaaaaattttatga

SEQ ID NO: 1614 - DNA, 1557 bp, Staphylococcus epidermidis
ggggtaattagaatggtagtacctttcaaaaatgaacctggtattgatttttcagtacagacaaatgttgagcgttttaatgaagaattaaggaaagtaaaagcgcaactaggacaagatataccacttgtgattaacggagaaaaacttactaaaactgatacttttaattcagtgaatcctgcgaatacatcacagctcattgcgaaagtgtctaaagcaacgcaagatgatattgaaaaagctttcgaatcagcaaatcatgcgtatcaatcatggaagaagtggtcgcataaggaccgtgcagaattactgttacgtgtagccgcaattatccgtcgtcgaaaagaggaaatttccgctattatggtttatgaagccggcaagccttgggatgaagcagttggagatgcagctgagggtattgattttatagaatattatgcaagatcaatgatggaacttgcagatggtaagccagtattagacagagaaggtgaacataatcgctatttttataaacctattggtacaggcgtgacaattccaccatggaattttccatttgcaattatggctggtacaaccttagcccctgttgttgcaggtaacactgtattattaaagcctgctgaggatacagttttgactgcttataaattaatggaaatattagaagaagcaggtttaccacaaggtgttgtaaattttgttcctggtgatccaaaagaaattggagattatttagtcgaccataaagatacacattttgtcacatttacaggatcccgagctacaggtacacgtatttatgaacgtagtgctgtagtgcaagaaggacaacagtttttaaaacgtgttattgcagagatgggtggcaaagatgcgatagttgtagataataatgtagatacagatttagcggctgaagcaattgttacatctgcttttggtttctctggtcaaaaatgctctgcgtgttctcgtgccatagtccatcaagacgtacatgatgaaatattggaaaaagcaattcaattaactcaaaaattaactttaggtaatactgaagagaacacatttatggggccagtaattaatcaaaaacaatttgataaaatcaaaaattatattgaaattggtaaaaaagaaggcaaactagagactggtggtggaacagatgattctaccggttatttcattgaaccaacgattttctccggactacaatctgcggatcgtatcatgcaagaagaaatttttggaccagtcgtaggctttattaaggtcaaggattttgatgaggctattgaagtagctaatgatactgactatggtttgacaggcgctgtaattactaatcatcgtgaacattggattaaggctgtgaatgaatttgatgtaggtaacctttacttgaatagaggttgtacagctgcagtagtgggttatcatccatttggtggattcaagatgtctggtacagatgctaaaacaggaagtccagattacttacttaatttcttagaacaaaaagttgtttctgaaatgttttaa

SEQ ID NO: 1615 - DNA, 2871 bp, Staphylococcus epidermidis
aggagaattagattgagtaatttgatacaagatattaagcaatctttatataagggatttatagataaagatagttcccataaaggcaattttgttccaagattactagtaaataacaaagaagaaaatgtactttctactattatagatcagctgcataattgccaatcattttgtatttcggttgcatttataaccgagagtggtttagcaagtctaaaatcacatttttatgatttaagtaagaaaggcgtaaaaggaaggataataacatcaaattacttaggatttaatagtccgaaaatgtttgaggaattattaaaattagagaatgtagaggttaaattaacaaacattgaggggttccatgctaaggggtacatatttgaacatcataatcacacttcttttattatagggagttcgaatttaacttctaatgcattgaaattgaattatgaacataatttatttttatctactcataaaaatggagatcttgttaacaatattaaacataaatttgatgaactttgggattctagcttttctttaactaatgaatggataaatgaatataaacagtcttttgaatatcaaacattgcaaaaagtatttgataacactgtcgttcaaaattcagaaattaaaaagtttaatgagtcaaaacttataaaacccaatttaatgcaagaacacgctttaaagtcattagaatctttgagaaatgtgggaggagaaaaggggttaattatatctgcgacaggaactggaaaaactattttatgcgcacttgatgtaagagcatattctccagataaatttctatttattgttcataatgaaggtatattaaatagagctatagaagaatttaagaaagtatttccatatgaagatgaaagtgattttggattattaacaggaaagagaaaagatcatgatgctaaatttctttttgcaacaattcaaacactttctaaaaaggaaaattataaattctttaactctaatcattttgactacatcgtttttgacgaggcgcatcgaactgctgcatctagttatcagaaaatatttaattattttaaacctaactttttgctaggaatgactgcaacaccagaaagaactgatgaattaaatatttttgaattatttaattataatattgcttacgaaattcgtttacaagaggccttagagagtaatattttatgtccttttcattattttggagttacagattatattcaaaatgaaatgagtcaagaagatgcatttaatctaaaatatttagcatctaatgagcgtgttgaacatatcataaaaaagactaattattatggttactcaggtgatgttgtaaaaggtttaatatttgttagtagtaggggtgaggcgtatcaattagcaaaccaattaagtaaacgtggtatatcatcggttggtttgacaggaaaagattctatagcttatagaactgaaacaattcaacaactaaaagaaggatctattaattatataattactgttgatttgtttaacgaaggaattgatattcctgaaataaatcaagttgtaatgttaagacctactaaatcaagtattatatttattcaacagcttggtagaggattaagaaaaagtactaataaagaattcgttactgttattgattttattggtaattataaaactaactatatgatcccaatagccttatctggaaataaatctcaaaataaggataattatagaaaattcttaacagatactacggttttaaacggtgtttcaacaataaattttgaagaagtagctaaaaataaaatttataattcactagattctgttaaattaaaccaaccaaaattaattaaagaagcttttaacaatgtaaaagaccgtataggtaaattacctttactcatggactttataaataacgattcgatagatccaagtgtgattttctcacgttttaaaaattattatgagtttttaataaaaaataaaattattgagaatgaattaagtattaatgaatttaaaaatttaacatttttatcaagacaattatcacctggacttaaaaaagtagatattgatgtattgaaagaagttatacaaaatgacgtaacttatgaaaatttaacaaaaaaaatgttaaacattaataacgatatttctgaatatgatattaacacttcattaagcattttagattttacttttttcaaaaagactataggtaaaacttatggactacctttaatacaatataaggataatcttatttgtctagcaaatgaatttaaagaggctttaaataaaccactatttaacacatttgttcatgacttaattgatcttgctaattataataatgacagatatcaaaataagaaaaacagtttaattctatataacaaatattctagggaagattttgttaagttattaaactgggataaagatgaatctggaacaatcaatggttatcgtatgaaacatcgtacacttcctttatttatcacttatgataaacatgagaatatcagtgataatactaagtatgacgatgaatttttgagccaagacgaattgaaatggtacacgcggtctaatcgtaaattaacttcaccagaagtacaaaatattttaaagcatgaagaaaataatacagatatgtatatatttgtgaaaaaaagagatgatgaagggaaatatttctactatttaggtaaagccaaatatattaaaggaactgagaagcaagattatatgcctaatggaaatagcgtggtaactatgcatttatcaatgaatacgtccattcgagatgatatttatagatacatcacttaa

SEQ ID NO: 1616 - DNA, 210 bp, Staphylococcus epidermidis
cctttttatagttgttttaaagtgaaattttttaaaaagtatgaaattgatttaaaaaaagatattttgtttatgaaaagtaaattgaatgagagattggaaatgaaaaacagagactgtggaagtatgaaagtatataaaaagagtagaacagaattcaatttgaattcattattctactctttaatcttgtatagaaacatttgctaa

SEQ ID NO: 1617 - DNA, 864 bp, Staphylococcus epidermidis
aagtctaatagaaaaacattaaaattattgtacggctatattaagatgaaaataaatgttttatgcgagaagagggacaatatggatattaaacaatcttcagagaaacaaggtcgaccgcatcatttatcagacagtaggacagttttgaaaagaaattttatattaataccaacttatattttattacaaagtatcataccaatcattgttgttttcggctcattaggcatcactgccatgataacacaacaggcaccaccacaatggttgtatcattgttcattgagtttaagttttgtgattgctcaaggtctaatattaattatcttttataaaatacatcaatctgtaataaatgatgtgatgaagcaacaatggataattgcaaagaataaaataattaaaattgtaatagttgcgattgtcgtatatttattattacttataattcgggtgattggaacatcattacctaatcatttaagttatcatctcactcaatccgaacaacgtacgctagggctatttaaatcaccatatgtgttgttagttacttttatatccatggtattcttacgtccaatggtagaacaaatcatttatagatatctcatcatccatgaattaggaaaagtatggaatagacaatttgtaattggtttgtctattgttattgaaacgatcgtacatgtttacgacatggcatcgatttttgaaatttttccatatatcgttattgcttcagcagctacaatactatatattaaatcgcgggataatttaattgtcgcttatatatttcaagtgattttgcaatgtatcctttttatagaaattttatgtaagtataccaacttttaa

SEQ ID NO: 1618 - DNA, 858 bp, Staphylococcus epidermidis
ctacagctcagagtcaagcggaggaaagcgagcgataaggtgaaggataataatgaagtattaaagttatttatagtttcagattcaattggagaaacagcgcaacggatgattcatgcgacgctgacacagtttccagatttaactcaagtagaaattaagaaatttccatatattaaggacgaacaagaatttttaaatgtcttacaattagctaaagaacagaatgcaattgttgcaacaacattagtgagtgagtcatttaatgcattaggtcatcagtttgcaaatgaacatcaaattccctatgtagattacatgtctgagttaattagcataattaaacaacatacacacgctaaaccattaatggaaagtggtgcgttgcgtaagcttaatgatgagtattttaagcgtatagaagcaattgagtattcagtgaaatatgatgatggtaagcattttacagatattggagaagcggatgctttaatagtaggtgtatcacgtacctctaaaacgccattaagtatgtacttagctaataaaggatataagattgcaaatattcctttagtccctgaagtggctattccagataatgtatttcaacaaaagaatttaaaggtatttggattaacagcaagtcccaattatatcgcaaatatacgacgtaatcgtgcagaaacattagggctatcttcagaatctaattacaatagtttagagcgtatcaaaaaagaattatcttatgctgaagaagtttttagaaaattaaatgcaacggtaattaatacagaatataaatcgatagaggaatcggcattttatattgaaaagtttttagctaaacgttaa

SEQ ID NO: 1619 - DNA, 1761 bp, Staphylococcus epidermidis
aaagggaggctatttgtaaaaatggcacaaattaaagcaaatgaagcattagttaaggcattacaaacctggaatattgatcatttatatggtattcctggcgactcagtagatgctgttgttgatagcttacgtacggtcagagatcaatttaaattctatcacgtacgtcatgaacaggtagcgagtttagctgctgcaagttacacaaaaatgacagggaaaattggtgtagctttaagtatcggaggacctggtattgtacacttattaaatggtatgtacgatgctaaaatggataatgtacctcaacttattattgctggacaaacaaatagtacattattaggtacaaaattcttccaacagacaaacatttctaaaatggttgatgatgttgctgtatatcaccaccaaattcaaaaaggtgataacgtatttgaaattacaaatgaagcaattcgtacggcatacgagaaaaaaggtgtctctgttatcatttgtccaaatgacttattaactcaaaaaattaaagacactacaaatcgtgcagttgatacaactaaaccaaaaccagcttcaccaaaattcaaaagtattaaaaaagcagctaaattaattgataaagctaaaaaaccagtaatgcttattggtttaggtacacaacacgctaaagatgaattacgtgaatttattgaagctgcaaaaattccagttattcacacattacctgcaaaaacaatcttacctgacgatcatccttatagtattggtaacttaggtaaaattggtactaaaacatcttatcaaacaattcaagatgcagacttattaattatggctggtacgaactatccgtatgttaactatttacctaagaaaaacattaaagctattcaaatcgatacgaacgaagaaaatattggtgcacgctttaaaattaatgtaggtattttaggtgatagtaaagttgctttccatcaactaactgaaaacattaagcatgttgcaaaacgtccattcttagataagacattagaacgtaaagcagtttgggataaatggatgaaacaagatttgaataatgacaattcaccattacgtccagaacgtttaatgaaagcaatcaatgctaacttaaaagatgatgcaattatctcagcagatgttggtacttctacagtatggtctacgcgttacttaaacttatctgtaaataataaattcattatttctagttggttaggtactatgggctgtggtttaccaggtgcgatggcagctaaaattgcttatccaaaccgtcaagcagtagctatcacaggtgacggtgcgttccaaatggtaatgcaagactttgctacagctgttcaatataacttaccaatgacaatcttcgtattaaataacaaacaattgtcattcattaaatatgaacaacaagctgctggtgaattagagtatgccattgatttttctgatatggatcatgctaaatttgctgaagctgctggtggtaaaggctatgttgtgaaagatgtaagtcgtcttgacaacatcgttgaagaggcaatggctcaagatgttccaacaatcgttgacgttcatgttgatcctaatgctgcaccattaccaggtaaaattgtaaacgaagaagcatttggttacagtaaatgggcttatagatcaattactgaagataaaaacttagactttgatcaaatcccaccaatctctgtagcagctaaacgtttcttataa

SEQ ID NO: 1620 - DNA, 903 bp, Staphylococcus epidermidis
ggagtggaaagtatgaataaagaacaattagaaaaaatgactcatggtaaaggattcattgctgcattagaccaaagtggtggtagtacacctaaagcacttaaagaatatggtgtgaatgaagaccaatacagtaatgaagacgaaatgttccaacttgttcacgatatgcgtacacgtgttgtaacttcaccttcattttcacctgataaaattttaggtgcgattttattcgaacaaactatggatcgcgaagttgaaggtaaatacactggagactatttagcggacaaaggcgttgttcctttcttaaaagtcgacaaaggtcttgctgaagagaaaaatggcgtacaattaatgaaacctattgatgatttagatgaaactttagatcgtgcaaatgaacgtcatatcttcggtactaaaatgcgttctaacatccttgaacttaatgaacaaggaatcaaagatgttgttgaacaacaatttgaattcgctaaaaaaatcatcgctaaaggtttagtacctattatcgaaccagaagttaatattaatgctaaagataaatctgaaattgagaaagttttaaaagctgaaatcaaaaaaggtttagattcattaaacgatgatcaattagttatgttaaaattaactattcctactgaagctaacttatataaagatttagctgaccaccctaatgttgtacgtgtagtagtattatcaggtggttacagccgagatgaagctaacaaattgttaaaagataacgatgaattaattgcaagcttctcacgtgcattagcaagtgacttacgtgctagccaatcacaagaagaattcgataaagcattaggcgatgctgtagattcaatctatgatgcgtcagtaaataaaaactaa

SEQ ID NO: 1621 - DNA, 1431 bp, Staphylococcus epidermidis
gggcacatgaggtatcgtatgacattgcagaatcatttaaaacatcgcatattgttgatctatggagacaactcattgaagaggtgctatatgattaatttattcgaaaattataatcaagaaacacaggaattacatcaatctcttaagcgtgctggttacaatcactttacgattgtaattaatgatgatggatttttacctgatgatgtgacatcgccgtatcgttttttcacagcatatcaaatttatgaagatgatacccctgctttttttaatgatattgatacgccgcctttttgggaaattaaaggagatgcgacaatggctaccattacagatatgggtgagcttagaggtaaaatcttttataaggaacattataagacacgtgtagttagccatgtagagtggcttgattcaaaacagcgtttgcgttcggttgattattatacaaaagaaggatttaaatttgctgaaacagtttacgatttgttaggtaatgcaatattaaaaaagtatatgacacgtgaaggtaaagaagtgatttatgagaattatgtaactaacgatgtagttgtagaatatgaagggaaatcttatttttttgagtcatatacagagtggattaaattttacttgagtgaaatgggcattgagataaaagaagttatatttaatactttatcaacaccatttttagcaatttatcatttgccgacattgaaaaaaggtattttattttggcaagaacaatctcagggttatgtcccaggaaatatgaaagtcatgttatcaccaaaccttcaaagtcgctttgccgttattgtccctaatcagaatgaatacaaattgatcaaggaacaactatctagggaggaacaacaggcagtatatgcatctggttacttatatgacacgtataaacggaatcattattctaagaatgtattaacattaacaaattcagatcaaataccacatgttgaaacgttggtacgtttgcataaagattatcaatttcacataggcgctaaaactgagatgtcttcaaaattattaagtttatcgcaatatgaaaatgttaaattatatccaataattaaagaacaaacagttcaaaccttatatcaacaatgtgacatctatttagatattaatgaggggaacgaaatagggaatgctgtaagaagcgcatataatcatcaattgttaattatgggatataaagaggttgttcataatcaagatttcgttgcaatagaaaatcagtttcttgtaaatgatataagtcagttgagtaacgctttgaaagagataggaaatcatcgtggtcaatttgaaacacgtttagcactacaacaacgtcatgctaatgctgtgccggtatcaacatttaaatacgcattagtacaagcattaagtggttaa

SEQ ID NO: 1622 - DNA, 783 bp, Staphylococcus epidermidis
atggtaatgagtaatacagcactttgtctgacagcacttttattactaatccctatctttatttcttataaagaaggattgcatattatcaaagatttagttattgctacaattagagcaaccatacaactattgattttaggctttttattacattatattttcgaaattaatgaaaaatggttattagtgctatgtgtgttagtcattattatcaatgcatcttggaatacaataagtcgtgcttcacctgtcatgcatcatgttttttggatatcatttgtggctatatttgtgggaacagcgctaccattggcagcaactgttgctacaggtgcaattaaatttacagcgaatgaagtgattccaattggaggtatgttagctaataatggtttaatcgcgattaatctcgcttatcagaatttagaaaaagcatttgttcaagatgtttctgatattgaatccaaacttacgttagcagcgacacctaagctcgcatcaaaatcatctattagagaaagtatacgcttagcgattgttcctacaattgattctgtaaaaacatatggtctagtttcaattccaggtatgatgacaggattgattatcggaggcgttgacccacttcaagcaattaaatttcaattgcttgtcgtgtttattcatacaacagcgacgattatgtctgcactcattgcaacgtatatgagttacggtcaattctttaatgctcgtcatcaactcattgctagaacgcaacgcacaagacaaagtagttaa

SEQ ID NO: 1623 - DNA, 525 bp, Staphylococcus epidermidis
aaaggatggaggatatacgctttgaaaaaattttcagctacaatagtagtaatcattcttatatgcgcattgggcttttcattatatgcagctattaaccaccatacgaattctaataagaatgataaaaaaatagaacacaatcgcaaaaataaacaaaatgatacttcaaatcagaatcgtgatactaatcaacaccaagaccaaactcaaccaacaaataatgactataacaacgataatcaatcagatactgaacaaccagcacaacaacctaactatcatcaatacccaaataataatcaacagtctggttcaaataaaaataactcttcagaaaataacaaacagaaaccgaatcagaacaaaactaatcaatcagattatcaaccatcacaatcaacaccacaacagtcgtcacaacctaataataatcaatctgattcacaacaaaatggcaactcaaataataattccaacaatcaaaatcatggaacaaatgataatcagaataaaaatcgttaa

SEQ ID NO: 1624 - DNA, 1356 bp, Staphylococcus epidermidis
ttcataaggagaattgatatgaaagtcaaaagtatttcacggttcttttcaatgaagaaagtgacgctaagtttcgttactttatttattggagtagggacaataggttcatacaatcagtatgctgatgcaagtatgaaaacgcaacaaacacatgtaactaagtcatctccaactcaaaagacgacgtccaattttaaacgttcagttaaagatacgtctgttaaatctagagctacatcaataaaaagagctacatcaaccaaacaagctatatcacccaaaacgtcatcaactaaaaaaactacaatagcaaaaaaatctaccacagtaaataaaacgcgcacaacaaccaagactcagcctaccattcgtaagagttcaacaacttcaacacgttcaaaaacaatgcctacttctgtgaaacgcacaacttctcataaagcaactactgtgtcgccaacttctaaagctaaaatatcaacaaagacacaacaatcaactaaaagtcatacaacttcagttaagaaaaacactacacaactaagtaaaacaaaatctccgtcaacgtcaacaaaatctaaaacagttcaatcctctacgacaaaggcacaacctactttatcgactcaagttagtacaactactaaagcaaagcaattttcaacgccaactacttctaaaactgatagcagtaaatctttagtaagtttagcatctacagaacgtaaaatagataaataccaatcgatgactcagttagaaaaagaaacaactgaaggtgtacattggagaaaagatacgaaaaacacagggaatcaagtactcattgtggctccacatggcggaagtattgaacaaagtacaacagaattaactaaaacattagcagataaaggtaattatgattattatgcacttgaaagcattcgacctaaaaacaactctgaattacatgtgacgtctacacattatgatgatccgacattaaatcaaatgattaaaaaccgtactgcaactatttcgattcatggcgcatcaggtactgaggagattatctatcttggtgggccccgttcagatttaagaaatgctatagagaagcaacttgtaggatgtggatttacagttaaagttccaccagagtatctaggtggtcaaaataataaaaacttcattaataaagaagacaataacactggcgttcagttagaattaacgactgctttaagaaaagcattctttaaaaatggagatactagtacaaaaaatcgtaccaataaagaaaattggacaccaacaatggaagcatttattaatgcattatatgaaggtatcaatcaaacgtattcataa

SEQ ID NO: 1625 - DNA, 489 bp, Staphylococcus epidermidis
ttgctaattgggaggaataaatgtatgaagggtagcaaaaaattaaatgagttactagaagataatcagaagaaactaaaaaaattatttaagtacgatcataaaaaggctttggcgtttacaccagaggatagagaaaaagttaaggataagtttggtgtctatgtgattttcgatgagaaaaaaccagtgtttgtaggtcaaactggaggatattcatccacacatcaacctataaatagtgatttgtatacaaaattaggacaatacaattcacgttcagaaacaggtacaactaaatttagaaaagcttatgctcaaaataaggacttaaatccaaatcatttaaaagacattactgcagataaatacggcttcacttttcaatatataaaagtaaaagacgaacctgcgtttattaatgttttagaaattctcgcattagaatatgcaaaaaataaagggtatgaactttataattttcaataa

SEQ ID NO: 1626 - DNA, 6414 bp, Staphylococcus epidermidis
gaaaactatggggagtttattatgacaaagaaagaaaaggattataaaaaaagtcttgagcaacaaaaaacacgggtaaaaatatacaagtcaggaaaaagctgggtaaaagcaagtattaatgaaatagaattgttaaaaacaatggggctaccatttttaagtaaaaacgaaatacaagaaaatgtgactgaaaagacgaaaggtcataaattaaaaaaaagtgcagctaaaacaacagccctagttggtggagcatttacatttaatatgttgaataatcatcaagcatttgctgcctcagaaacaccaatcacctctgaaatttcatccaatagtgagacagtagccaatcaaaattcaactacgattaagaactcacaaaaagaaacagtcaattctacaagtttggaatctaaccattctaatagtacaaataagcaaatgtcttcagaagttacaaatacagatcaatccagtgaaaaagctggaattagtcaacaaagtagtgaaacatcaaatcaatcatctgagttaaatacatatgcctccacagaccatgtagagagtacaactactaacaatgataatactgcacaacaagatcaaaataagtcttcgaatgtaacctctaagtcaacacaatcaaacacgtcatcctcagaaaagaacattagctccaatttaacccagtcaatcgaaacaaaagcaaccgattcattagcgactagtgaagcacgtactagtacaaatcaaatatctaatctgacatcaacatctacttcgaatcaatcgagtcctacttcctttgcaaatttaagaacatttagtagatttactgttttgaatacgatggcagcaccgacaacaacgtccacgacaacaacttcaagtctgacatctaattctgttgtggtgaacaaagataactttaatgaacatatgaatctgtctggatctgcgacgtatgatcctaaaacaggtattgctaccttaacgccagacgcatatagtcaaaagggtgccatatctttaaacactcgattagattcaaaccgtagcttccgttttacaggtaaagttaaccttggtaatagatatgaaggttattctcctgatggtgtaacaggtggagatggcattggctttgcattttcaccaggccctttaggacagataggtaaagaaggggctgccgttggaataggtggtttgaataatgcctttggttttaaattggatacgtatcataacacatcaactcctaaatctgatgctaaagcaaaagcagacccacgtaatgttggtggtggtggcgcttttggtgccttcgtaagtacagatagaaatggtatggctaccactgaggcatcatctgcggctaaattaaatgtacaacctactgacaattcattccaagattttgtcattgactataatggtgatacaaaagtgatgacagtgacgtacgctggacaaacttttacgagaaatcttacagattggattaaaaacagtggtggtacgacgttttctctatctatgactgcctcaactggtggcgcaaaaaacttacaacaagttcaatttggaacattcgagtatacagaatcagctgttgctaaagtacgctatgtagatgcaaatactggtaaggatattattccacctaaaaccattgcaggtgaagttgatgcgactgtgaatatagataaacaattaaacaacttgaaaaattcaggttacagttatgttagtacagacgctttacaaaactccaattattcagaaacatcaggtacacctacacttaaattaactaactcaagccaaacggtgatttataaattcaaagatgttcaaggtcctcaaattagtgttgatagtcaaactagagaagttggaaagaccattaatccaattacaattactacaactgacaatagtaaagacgtattaactacaactgtgacaggtctaccttcagggttatcttttgatcaaacgacaaatacaattactggcacgccaagtgaagtaggaactacaactgtgacagttaatactactgatgctactgggaacgtaacatctaagcaatttacaataacgattcaagatacaatcagccctgttgtaaatgtgacgccaagtcaagcatcagaagttttcacgccgattaatccaattacgataactgctacagataatagtggcaaagtggtaacgcatacagtaactggattgccacaaggacttaaatttgatgcatctacgaattcaattgttggaactccaactcaaataggaacaaatacaatcacgattgagtcaacggatgcgagcggaaataaaactacgactaaaattaattatgaagtaacgagaaatagcgcaagtgactctacttccactagcatagtaaatagtgtttcaacaagtataagtaatagtacatcgctaagtgatagtgtaaaagcgagtcaatcattatcaacaagtaagagtctctcagagtcgttaagtgcgtcgacgtcgaatagtacgtcaatccaagcgagcgaatcagcaagcacaagtaaacaattatcagaatcagcgagtacgtcgacatctgatagtgcatcagagtcagcaagaaagagtgagtcaacgagtaaaagtacgtcattaagtgaatcgacaagcacaagcgtttcagattcagcaagcgtgtcaacgtcagaaagtgcgtcaacatcaacaagtgtgagtggctcaacaagtacaagcatttcagactcaacgagcacatcgacgtctgatagcgcatcaataaaagcgagcgaatcagcaagcacaagtaaactattatcagaatcagtgagtacgtcgacgtctgatagcgcatcaacgtcaacgagcgtaagtgactccaatagcgcaagtacgtcattaagtaaatcgacaagcacaagcgtttcagattcaacaagtacatcgacatccgacagtgcgtccacatcaacgagtgagagtgagtcagacagtgcaagtacgtcattaagtgaatcgacaagtacaagcgtttcagattcaacgagtacgtcgacatccgacagtgcatcaatgtcagcgagcgagagtgaatcaaacagtaaaagtacgtcattaagtgaatcgacaagtacgagtctttcaggctcaacgagtgcgtcgacatccgacagtgcatcaacgtcaacgagtgagagtgagtcagacagtacaagtacgtcattaagtgaatcgacaagtacgagtctttcaggctcaacgagtgcgtcgacatccgacagtgcatcaacgtcaacaagcgagagtgactcaacaagtgaaagtacatcgttgagtgaatcattaagcacaagcgtttcagattcaacaagcgcgtcaacgtcagaaagtgcatccacatcaacgagtgagagtgagtcaaacagtgccagcacatcgttaagtggatcattaagtacaagcatttcagattcaacgagtacgtcgacatccgacagtgcatcaacgtcaacgagtgagagtgagtcagacagtacaagtacgtcattaagtgaatcgacaagcacaagtctttcggactcaacaagtacgtcaacgtcagaaagtgcatcaacgtcaacgagtgagagtgactcaacaagtgaaagtacgtcattaagcgagtcgacaagcacaagcgtttcagattcaacaagcgcgtcgacatccgacagtgcatcaacatcaacgagtgtgagcgactcggaaagtgcaagtacatccataagtgaatcattaagtacgagcgtttcagattcaacgagtacgtcgacatccgacagtgcatcaacgtcaacgagtgagagtgactcaacaagtgaaagtacgtcattaagcgagtcgataagcacaagcgtttcagattcaacaagcgcgtcgacatccgacagtgcgtccacatcaacgagtgagagtgagtcagacagtgcaagtacatcgttaagtggctcgacaagtacgagtctttcagattcaacgagtacatcgacatcagacagtgcatcaacgtcaacaagtgagagcgactcggaaagagcaagtacatccttaagtggctcgacaagtacgagtctttcagattcaacgagtacatcgacatcagacagtgcatcaacatcaacgagtgtgagtgactcaaacagtgccagcacatcgttaagtggctcattaagtacaagcgtttcagactcaacaagtacatcaacatccgatagtgcatctgcatcaacaagtgagagcgactcggaaagagcaagtacatcgttgagtggctcaacaagtacaagcatttcagactcaacaagtacatcaacatcagacagtgcatcaacatcaacgagtgtgagtgagtcaaacagtacaagcacatccataagtgaatcattaagtacgagcgtttcagattcaacgagtacatcgacatcagacagtgcatcaacatcaacgagtgtgagtgactcggacagtgcaagtacgtcatcaagtgaatcagtaagcacaagtgattcagaatcaacaagcacatccacatcagatagtgcatccacatcaacgagtgtgagtgagtcaaacagtacaagcacatcattgagtggctcaacaagtacaagcgtttcagactcaacaagtacatcgacatcagacagtgcatctgcatcaacaagtgagagcgactcggacagtgcaagtacgtcatcaagtgaatcagtaagcacaagcgtttcagattcaacaagcgcgtcaacgtcagaaagtgcgtcaacatcaacgagtgtgagtgactcgaatagtgcaagtacgtcattaagtgaatcgacaagtacgagtctttcagattcaacgagtatgtcgacatcagacagtgcgtcaacatcaacaagtgagagcgactcggacagtgcaagtacatcgttaagtgactcgacaagtacgagcgtttcagaatcgacaagtacatcaacatcaacgagtgtgagtgcctcaaacagtacaagtacgtcattaagtgactcgagaagtacgagtctttcagactcaacgagcacatcgacatcagaaagtggatcaacgtcaacaagtgagagcgactcggacagtgcaagtacatccttaagtgagtcaacaagtacaagcatttcagactcaacgagtacatcaacatcagatagtgcatctacatctatgagtgtaagcgactcaaacagagcaagtacgtccttaagtgactcgacaagcacaagcgtttcagattcaacaagcgcgtcaacatcagaaagcgcatcaacgtcaacaagagagagtgaatcaacaagtgcaagtacgtcattgagtgaatcgacaagcacaagcgtttcagattcaacaagtacatcgacatccgacagtgcgtcaacgtcaacaagtgagagtgactcaaacagtgaaagtacatcgttaagtgagtcgacaagcacaagcgtttcagattcaacaagcgcgtcaacgtcagcaagtgcatcaacatcaacgagcgtgagtgactccaatagcgcaagtacgtcattaagtggctcaacaagtacaagcgtttcagactcaacgagtacgtcgacatcagcaagtgcatcaacatcaacgagcgagagcgactccgatagcgcaagtacgtcgttaagtggctcaacaagtacaagcatttcagactcaacgagtacgtcgacatcagacagtgcgtccacatccacatcagaaagtgcatccacatcaacgagtgtgagtgagtcagacagtgaaagtacatcggtaagtgaatcatcaagtacaagcgtttcagattcaacaagtacatcgacatcagaaagtgcatcaacgtcaacaagcgagagtgaatcaacaagtgaaagtacatcggtaagtgaatcatcaagtacaagcatttcagattcatcaagcacgtccacatcaatgagtacatctgaaactttcacttctcaatctcctataaatagtgaaagtcaatttattggtgatagcttgtctgaagatacaatcgtgactcaatcaaaaaatacgaatatgcttaataaaactggaaaagattatgatttacaagaacaaagaggttatactgattcagaacaacacaatgaaacacaaagtaatcaagctgataatcactcaaacaacctcgatttacttcatcaaaatcgtttacaagataaagtcgttaaacaaccgactaaaggagaagatggagttgtaagcaacggttttatagtagcagtagcaatagtattggctatcttcggtttggcaaaaaaatctagaaaagacgatgatgatcaagatggtagtaaataa

SEQ ID NO: 1627 - DNA, 1137 bp, Staphylococcus epidermidis
gaaaggagtggtctactcatgcatgatgtactaatcattggttcaggagttattggtatgtcaattgctagacacctcagtgcaacacacttagatgttgcagtcatagatagagatgtacctggaaagcatgcgtcatataaagctggaggtatgcttggcgcacaaaatgaatttacagaggatagtgacttgtttcaattagccatcgaatctcgtgctatgtttccacaattaagtaaatcattattagatgaaacaggcatagacattcaatttaaaaattcaggacttatcaaaattgctaatgaacacgatgatatctcatctataaaacgacaatatcaatttctgaatagtcaagaccgtagtgtcaaacaattatcagatgatgatttgctacaacttacacatggtgaagttaaaccttcatacgcggccattcacataccacacgatggtcaaattaatgcacatcattacacactggcattattagaatcaatgaagttaagagatattaagcgttatgagtctacagaggtcacttcaatagaacggcataatggctattattcagtgaaaaccgatcaatcttcaacaattgaagcgcacaaaattatcgttgcaggtggcgcatggtcttcgcaattattaacacaatatcatctacaacgacaagtgattggcgttaaaggtgaagttatcttattagaaaataacgatctttcacttactgagacattatttatgactaatggttgttacatcgttccaaaacaacccaatcgttttttaattggtgcgacgagtgaatttaataattattctgtcggtactacagatgaaggtatggattggcttcttcgccatgcatatcatcgtgtacctcaactaaaagacagtcatatactgaagaaatggtcaggagtaagaccatacacagaaaaagaaatgccagtcatggatcaaattgatgatggcttatacgtgataagtggtcattatcgaaacggaatattattgtcacctattatcggtcgtgacattgccaattggctactttctggtattaaaccatcacgttattcaagttttacagttacaaggaggaataatcatgaagtgtatcattaa

SEQ ID NO: 1628 - DNA, 1584 bp, Staphylococcus epidermidis
atattggtagggaggaggttttggaatatgaaacgatttataccagcttggtatagccgtaacagatggtgggaaagtacctcaagaccattctatctaaaaaaacagtatacagattttgacgatatgattagtttaatgacaatgcatagttcgaataatgtggattatcaattgatagttttaaattttagtccatatcttagaacattcctccatcgatatgatttgtatgaaagtcattattggtctgtatttgatgagatacagggcgttggacatcaaacgcctcaagctattgattatcgcgatctttcatggccagaaggcactgaatttatttttactccctttcaaattcaagcgattacaggtgataacacgttttctaaaattcacttcagccaagaggggtacctgatgtgggtagaggattacaagtatagtacaattcaaagacgatttgtattcgatgacagaggatttatatcggcagtgcgtacttatacacctgatggtgataacaataaaaaacactatttttcaaaagatggggaagaaatatttgttgaagacttaaatgttaatacagtaacgattaataaaaatttccaatcaaaatttaaaagggttacgtattcatctatggctgagttgatagaagagaaattccaatcatatgtagaaagagaattgaatgaagatgattctgttatagtggcatctgatgaacgtcataattcaatgatggcacgcactattgatgcatcgtctttatgtttttctatttttactgagcgaaataaagtggtgacacaagatttatatgactctatttctagagcatattattgtctcgttgatacacaagctaatcaaaatatgattgaacactacgcaggattgaacatgaatgatattaatcttttaagggtaacgccttttgatgcgaagtcattacctaaccaaagtagtcaattgtatgacacttatattggattatggatagatggtttggacgagattgaaatacgagagattgtaaacagcttatttcaatatattcaacataaagatggctataagttgaaaattttaactaagagtagagataatcttacggaaaatcttatagatgaagttgctcatctcaatgatttatatcaccaagagaaaaaggaaataagtgatgtaattgaagacgtgatacagaataaaaaagaaacaatcattgatattgaaacagtaccgtttgaagaagatcttgtaagcgttatttcaaaattaagagttgtagtagatttatctttagagccgaaactttttttacaaatctgttgtattggcgcgggtataccacaaattaataaaaagagaacagattatgttaaacatatgcataatggatatattattgatgacatatcgcaaactgtagaatctttagattattttttggcacatttaaaaaattggaattattcttatgcatattccatgagattaacggatgattttagttcaattaatattattcatcaaattaatcagttatttaaaggtgatgtttcaagtggcacgtaa

SEQ ID NO: 1629 - DNA, 888 bp, Staphylococcus epidermidis
ataggtaaaggagtttatagattgaaaaagataaaaaaagcaataattcctgccgctggtttaggtactcgttttttaccagcaactaaggcgatgccaaaagaaatgttaccaatattagataaaccaacaatccaatatattgtagaagaagcttctaaagcagggattgaagatattattatagtgactggcaagcataaacgtgcaattgaagatcactttgataatcaaaaagaattagaaatggttcttgaaaataaaggaaaagcagacctgcttgaaaaagtacaatattcaacagatttagctaatattttttacgtacgacaaaaagaacaaaaagggctaggacatgcaattcatactgcaaaacagtttatcggtaacgaaccatttgcagtgttattaggagatgacattgtagagtctgatacaccagctattaaacaattaatggatgtttatgaagaaacaggccattcagtaataggtgttcaagaagtaccagaatctgatacacatcgttatggtgtgattgatccttctgctaaagggggaagtcgatatgaagtacgtcaatttgtagaaaagccgaaacaaggtactgccccgtctaatttagcaatcatgggtcgttatgtattaacaccagaaatttttgattatcttgaaacacaacaagagggtgctggaaatgaaattcaattaactgatgcgattgaacgaatgaatagcaaacaaaaagtgtatgcatatgattttgagggtaatcgttatgatgttggagaaaaattaggatttgttaaaacaacgattgaatatgctttaaaagatccagaaatgagtcatgacttaaaagcattcattaaacaactagatatttaa

SEQ ID NO: 1630 - DNA, 681 bp, Staphylococcus epidermidis
agagaggaaggtatgattatgaatcagatgaatcaaacgattattgatgcattccattttagacatgcgacaaaagaatttgaccctacgaaaaaaattagtgatgaagattttaatacgattttagaaacaggtagattatctccaagttcactaggtttagaaccttggcactttgtagtggttcaaaataaagaattgagagaaaaattgaaagcctatagttggggagcacaaaagcaacttgatacagcaagtcactttgtattaatttttgctcgtaagaatgtgacggctcatacagattacgtgcaacatttacttcgtggcgtcaaaaaatatgaagaaagtacaattccagcagttgaaaataaatttgatgatttccaagaaagtttccatattgccgataatgaacgaacattatatgactgggcgagtaaacaaacatatattgcattagcaaacatgatgacaagtgctgcattactaggtatcgactcatgtccaattgaaggatttgatttagataaagtgactgaaattctttcagatgagggtgttttagatacggaacaatttggtatttcagttatggtaggctttggttacagagcacaagaacctaaacatggcaaagttagacaaaacgaagacgacatcattagttggattgaataa

SEQ ID NO: 1631 - DNA, 780 bp, Staphylococcus epidermidis
tacagtagaggagtgacatatatggctttaataacaatgaattacaattcaccaacgataggaatgcatcaaaatttaacgattattttaccggaggatgtaacattctttggtagttcaacaacagcgaaacatttgaaatcaatgttgttattacatggattgtctagcgatgaaacaacttacataagatatacaagtatcgagcgttatgcaaatgaacatcaacttgcgattataatgcctaacgtcgatcatagtggctatgcaaatatggtatatggacatagttactatgattacatattagaaatttacgaatatgtacatcaaattttaccactatctagaaaaagagaagataattttattgcaggacattcaatgggcggttatggaacgattaaatttgcgctaactcaaagtgataaatttgctaaagctgcaccactttcagcagttttcgaagcacaacgtttcattgacttggattggactgatttttcccctcaatctatcacaggcaacaatactcaaattaaaggtacagaactcgatacgtactacttacttgatcaagccatcgatgctaatgtagatattcctgaattgtttatcatgtgtggtaaagaagactttttatatcatgataaccttcaatttattgagacattaaataaaaaaggggtttcttataagtttgaagatggtccaggagatcatgattatgcttattgggatagagctattaaacgtgcgattaagtggtttgtccagtaa

SEQ ID NO: 1632 - DNA, 1542 bp, Staphylococcus epidermidis
tttataggaggtaataaaatgaagaatttttctaaattcgcacttacaagtattgctgcattaactgtggcaagtcctttagtcaatacggaggttgacgctaaggataaagtatcagcaactcaaaacatcgatgcgaaagtaacccaagaatctcaagcaactgacgcattgaaagagttaccaaaatctgaaaatataaaaaagcattacaaagattataaggtcactgatactgaaaaagataacaaaggatttacgcattacacattgcaaccgaaagtgggcaacacgtatgcaccagacaaagaagtaaaagttcatacgaataaagagggtaaggtagttcttgtcaatggtgatactgatgctaagaaagttcaacctacgaataaggtatcgataagtaaagaaagtgccacagataaagctttcgaagcaataaaaattgaccgtcaaaaagctaaaaacttaaaaagtgatgtcatcaaaaccaataaagttgagattgatggagaaaaaaataaatatgtatataacatagaaattattacaacttcaccaaaaatctctcattggaatgtgaaaattgacgctgaaactggtcaagtggttgataaattaaatatgatcaaagaagcagctactacaggtacaggtaaaggtgtactaggtgacacgaaacaaattaatattaatagtgtcagtggtggctatgcactacaagatttaactcaacaaggtacactttcagcttacaattacgatgcgaatactggtcaagcttacttaatgcaagataaagatagaaattttgatgatgatgaacaacgtgcaggtgtagatgcaaattattacgctaaagaaacgtatgactattataaaaatactttcggccgagaatcatatgataatcaaggcagcccaatcatttcactcgcacatgtaaataatttccaaggtcaagataacagaaacaatgcggcttggattggtgataaaatgatttacggtgacggagatggacgtacatttacagcgctgtctggtgcaaatgatgttgttgcacatgaaattacacatggtgtaacacagcaaactgctaatcttgtttaccgttctcaatcaggtgcattaaatgaaagtttttcagatgtatttggttacttcgttgatgatgaagatttcttaatgggtgaagatgtatacacacctggtgtaggcggagatgccttaagaagtatgtctaatccagagcgttttggacaaccatctcatatgaatgattttgtttatacaaattctgacaacggaggcgtacatacgaattcaggtattccgaacaaagcagcttacaacacaattcgtagtattggtaaacaacgttctgaacaaatttattatagagcattaactgtttatttaacttcaaattctgatttccaagatgctaaagcatcattacaacaagcagcacttgatttatatggcgacggtattgctcaacaagtaggtcaagcatgggacagtgttggtgtgtaa

SEQ ID NO: 1633 - DNA, 801 bp, Staphylococcus epidermidis
acgagagggggagtggttcatatggggaaagtatatttagttggagctggacctggtgatccagaattaataacgttaaaaggtttaaaagccattaaagaagccgatgtcatcctttatgaccgacttgtaaataaagaaatacttaattatgcttctccttctactaagttcttctattgcggtaaggatcctcacaggcactccttaccgcaggaagaaacaaataaaatgatggtaaccttagccaaaaaagggcacatagttacacgtttaaagggtggcgatccatttgtttttggacgtggcggagaagaagcagaggaattagcatgtcataatatccactttgaaattatacctggaattacatcgggaattgcagcaccagcatatgctggaattccagtaacacatcgtgattatagttcttctgtagcatttgtaactgcagtgaataaacctggtatggataaaggcaaatactggcaacatttggccaatggtcctgaaactttatgtatttatatgggggttaagagactcagtgaaatttgtgagttgttaatacaatatggtcgttcgtcagaaacaccagtagctctcgtgcatatgggaacgtcaaaacagcaaatgacagtgactgggacactcgatacaattcaagaacgagcacatcatattcagaatccagcaatgattattgtaggcgaagtggttaagatgagagaaaaaattaattggtttgtagaacaggcaactgttcaaaatgaaacgttaacggaaatgtcatcaacttag

SEQ ID NO: 1634 - DNA, 396 bp, Staphylococcus epidermidis
cttttctttataaaagaagggtgtttgttgatgagtcaaatcgaatttaaggatgttagtaaagtgtatccaaatggccatgtgggattaaaagatattaacttaaatatagaaaaaggtgattttgcagttattgttggactgtctggagcaggtaaatcaacattactacgatcggttaatcggctacatgatatttccaaaggtgatattactatcgaaggtcagtcaataactaaagcacgtggtaaaaaattattagaaatgcgtcgaagtataggtatgatttttcaacattttaacttagttaagcgttcaacagtgcttagaaatgttttgagtggccagggtaggataccatcttacttggaaaatgatactgggtctttttcctaa

SEQ ID NO: 1635 - DNA, 234 bp, Staphylococcus epidermidis
ttatactttatcattttattgttgaaaattataagaatttttatgtcgtttgtgacaaagtacgtaaacatacattcaaatttaaaattaatctatttatttaattatcattttatctatatttcctttttattgttagtaggttttatatcattattactatgcggtcacacttacgctagacaaaccgtagccttacctcaaggtgcaataaggagctttgtatttttttga

SEQ ID NO: 1636 - DNA, 891 bp, Staphylococcus epidermidis
aggtgtcttatggactttatagctattttaatcggattagggccactattaggttggggattatttccaactatcgcttctaagtttggtggacgtccagtcaatcaaatctttggtgctactgttggtactttgatcttcgcaattgttctagcactatttaaaggtataggtttaccaggaggtatggcattagtattttcgctcatatcaggtgcaggatgggcatttggtcaaattattacttttaaagcgttcgaattagtaggttcatcaagagcgatgccaattactactgcatttcaattacttggtgcatctttatggggcgtttttgcgcttggcaactggcccggtataacaaacaaaatcattggatttctagctttactcgtaatccttataggtgcacgtatgactgtatggactgaaacaaagcaacaagaatatagtaaaaatctacgaagtgcagtgatcttattacttgtaggtgaaattggctattggatatattctgctgcacctcaagcaacggatattggtggatttaaagcttttttacctcaagctataggaatggtcattgtggctgtcatctatgcgttgatgaatatgtctaaaggtaatgcttttaaagagaaagtaagttggcaacaaataatatccggatttttctttgcgtttgctgctttaacttatttaatttcagcacaacctaatatgaatggtttagcaacaggatttgttctatctcaaacatctgtagtattagcaacgctaacaggcatttttttcttaaatcagaaaaaaacatcaaaagaattaatgattacaattgtgggattagttcttattttagttgcagcatcaatcacagtgtttattaaataa

SEQ ID NO: 1637 - DNA, 324 bp, Staphylococcus epidermidis
gtggtcattatcgaaacggaatattattgtcacctattatcggtcgtgacattgccaattggctactttctggtattaaaccatcacgttattcaagttttacagttacaaggaggaataatcatgaagtgtatcattaatggcgacctcttcactttcgatcagaatcaatcgatacaagaggttttacattcacttgaattagacccaaaacgagtgattgttgaactaaacaaagaacttatcaagcaagacaaatatgaagaatatactgtaagagaagacgacagattagaattactagaaattgttggaggcggttaa

SEQ ID NO: 1638 - DNA, 1485 bp, Staphylococcus epidermidis
ggacgaattatgttcccgccatcaggcggtatgagcaactatgcacagtatactcacggctcattacttggttttattgcagcatgggcgaactgggtatcattagtaacaattattcccattgaagctgtgtctgctgttcaatatatgagttcttggccttgggattgggctaaaccaatgggatctttaatgaaagatggctcaatcagtacttacggtttgattgctgtttacatcattattgcaatcttttcattattaaactattggtcagtaaagttattaacatcatttacaagtttaatttctgtattcaaattaggtgtccctattttaaccataattatgttattagtttccggttttgatacaggtaattatggacactctatcggtacatttatgccttacggaagtgcacctatttttgctgcaacaacaacatctggaattatcttctcatttaatgcattccagacaattattaacatgggatcagagattaaaaatccagagaaaaacatcgcacgtgggattgttatctcacttacattaagtgctatattatatatagttttacaaagtacgttcattacatctatgccaagctcaatgttgcacgagcatggatggagcggtatcaatttcaattctccatttgcagatatggcaattttattaggtcttaactggttagcaatattactttatatggaagcagttgtgtcaccgtttggtactggggtttcttttgttgccgttactggacgtgtgttacgcgctatggaagaaaatgggcatattcctaaattcttaggtaaaattaataaaaagtataatatcccacgtgttgccattgcatttaatgcaattatcagcatggttatggtgacattgttccgtgactggggtacactagctgcggttatttctactgcaacattagttgcatatttaactggtccaactacggttatttcattacgtaaaatggcaccaaaaatgactcgtccattcaaagctaatattttaaaatttatggcacctttatcctttgttttagcatcattagctatctattgggcaatgtggccaacaacagcagaagttattttaattattattttaggtttacctatttatttcttctatgaatataaaatgaattggaagaatactaaaaaacaaattggcggaagcttatggattattatctaccttattgttctcgcatttttatcatttattggaagtaaagagttcaaaggcttaaattggattcactatccatgggatttcttagtcattgtaatcgttgctttaatcttctatcaacttggtacaacaagttactttgaaagtatttatttcaaacgtgcaaacaagttgaataagaaaatgggcgataaattgcgtaaaacacgcaaaaaagcgcgtcataaagattggaaagaacgcgatcgacaagagcaaaatcaataa

SEQ ID NO: 1639 - DNA, 195 bp, Staphylococcus epidermidis
ttcattgttattaaagccatatatgtcactcctctactgtattatctattattttacttattcttttcattaatttatagaaaaaacgcaactttgactatagattatataaatttctatactttccaatgcggaactaaaattttattctctatattaaacaagttgattcagtatcgattgtctaacctttaa

SEQ ID NO: 1640 - DNA, 204 bp, Staphylococcus epidermidis
ccaatccctataaaaattaatcctaaaattaaaaatattattaaccgtacacgtgacttttcatgcgtcttacttttatttttaagcaataactgtaaggagtttttaaatgatattttaaaattgttaataacaaacaatatgatcatcaaactgagtagcatggttaatgtgattttcattgataaaacatcaaatggataa

SEQ ID NO: 1641 - DNA, 630 bp, Staphylococcus epidermidis
atacatcatatatcatcaattcgaaatggggttatcaatgtgaaaaagatttctctaattgcaacgactgtattaacaggattattattatttccaagtgtcaatgacacaacgacacatgcagccgaagtaacatctcatgatgcacaagctgtagcaattcaagctatgaaaaatagtggtggcaatccggacttacaaaatttcaaaaaagttaaggataaaggggattatttcacaattgatataaataataaatctggtgcaggtgtcggtacttataaagtatacaaaaatggagtggtgctatataaaagtggaaattatggagaatatagtcaactcaatacacgacaatgttatgttgcacaagatattgctacaacatcttcacaagtaaaacgacactctactcaacagacacaagcagtggatagtacacgtgagctcaattcatactacgtaggtcaagttcaatcttctgacttaccacaacaaagttcatctgatatgctaccgaatactggtatgaaagataaaaatttcaatacaaatggtataataagtctatttttactcactgctggtttcattacactttaccatcaacctttacgtaaaatgtcatag

SEQ ID NO: 1642 - DNA, 192 bp, Staphylococcus epidermidis
cttaatcatatatttttctttcatataagagaagcatcgataattacaacagtgcctgtttctatagcaataaaatctgtcactgttaaatttaggataaacaaaaacggttatccaccttttgttaaggtgaataaccgttttttaatttatctttctaagataagaacaatacaacatgttttcctgtaa

SEQ ID NO: 1643 - DNA, 2022 bp, Staphylococcus epidermidis
gtgactaatatgactttcaagattttgtggaaaatgattaaacaaaattttgttaatcaacgtcatatcattgttccatttattagcgtaataagtattttattcggtattgaatacatattgttatcgttaacaaccaacatttactttaatgagcatcatcctgaattaaaaatatctgcgattattggaatagtgtttatgacgatgttattattcatatttttaatttatgcaaatcactttgttatgaatcataggaaaaaggaatttgccttaaatatggttcttggtatggagaaaaaacatctaagactcatcatcttgattgaacttttcattcagtttattatatctgcaatattgagcattgttggaggttacttatttggtgagctcttttttatgttatttaataaactagttaatacgcatcaacctcagttgtctgattatccatttgatgttttatcaatgaaaatcacattaaccatgctactcagtttgatgatcatattgtttgttattaacaattttaaaatatcatttaaaaactccttacagttattgcttaaaaataaaagtaagacgcatgaaaagtcacgtgtacggttaataatatttttaattttaggattaatttttatagggattggctattatttagctataaaacctaacacagctatcggttccttggggattatattttttgcgattttgtcaacgcttattggtacctatttgctctttgttagcttaggatcaatagttttagaaatgttacaaaaattagattattattattataaacccaatcattttttctttattgcaggactcaaatcacgcgtaaaatctagtgcgattggtttagctaccatttcatttatgtgtacatttctgattgttacgttaagtatgacagtctcaacttatagaaatatggatcataggtttgaatttgcatttaaaaatgattacgcaggttattatattggtgattttcataaagatagcaaacttcaacgtaagatagaaaatttaaaaaaagatattcgccaagaagttccaactggtcaatttaaaatttatgcacgaggtatggttggagccgaattgcagggaggcttaaaacataaaaagctaaaaagacaaactgtatcgagtggtttatttaatttcggaaataagcaaaaattcaactcttttatttctatatataataaaagtgattataataaaaacaataaaaaaataaaattagatgatgatgaaattgcaataagtacaagtgtgtcattatttaaaaaaatgaaaacgctcaatatatttgggaaaacatatagagttaaatatattgagtctacaaatatagataacttactctatgcagatggtataactttaattgtgaatcaacaacaactgatggatcgtatcgttaatgaatatcgtaatcacaatgatgaaaatttaatcatcactcctaatcaagtccaaactgccgttgaatttaatgtattaaaagaaaaggataagttgaatcatcgtattaagaaaataggtgttcaacacgatattgaatttcaagtgaaaaaacaaaacctattgatgtggaaacaagtcaactcaagtttagtttttgttggaagtgttgtatctctagttttattgataggtatatttcttatgatgtattataaacaagtttcagaaggacatgaagatagagatgcatatataacgatgaaacaactaggattagatgaaattttaatcaaaaaaacaattaataaacaagtaatatgggtatttctcattcctgtaattgttgcaatcatacatacgttagctgcttttcgcatcatatactctgtattaggaatcgttggtcaatatgacttgggactgtatgctacaagttatgtcggtgtgatagttgtatttattattttttattcaataatgtactggattacttctagaatttattatacgatgataaacggtaagcattaa

SEQ ID NO: 1644 - DNA, 1626 bp, Staphylococcus epidermidis
cggatgattttagttcaattaatattattcatcaaattaatcagttatttaaaggtgatgtttcaagtggcacgtaaatttagagtacttcaagtaggtggtcatgatttaggttctttatttaatcaaaaaagtaatgtcgaatgggattattttgatgttggtttgtttgattttgaaagtggctatcaagatgttgtagtacatattttagatgaaaaaggacaatttgattttgtttttgtacgtgaaaaatattctgattcattaatgaaacttttatcattagtcagtacaccgtataatactgtgattgacaatgagtattgggataatcaataccaacaagataagacaatacaacgtaattttataaaaccactcatttatgaaaatgaagaacaattacaacaaaaactagaggcagttacatttcctgggcaatatggagataaagttaaacctattcattgtcgcgttagtattcattttgatggttcttatcaatttaatggaaatgagtctattgaagtatcaggacgatttggggaatcataccaacccctcattacatggagtcaaaatatcattgctgatgccaataaggtgaatcaaatatggccagaatttaaagttgaaggtgatgctaaaatccaatatacattgagattgacgcctgtttattcaactgatcaaccagtagaaaagctaatatatgaacaagacgatttagacactcccatagaactacctgctcgtccttatcaaacatatgtgagtgtatcaatcaaagctaaaggtaaaggaacattatttataggtgctattcataaacgttggtcacgcttggaattagggcagttcatattaggcggaaaacgatatagtgatgaaaataagcaagaatttatacattacttccatcctggagatttaaaaccaccactcaatgtatattttagtgggtatcgtactgctgagggctttgaagggtactttatgatgaaacgtatgaatgctccatttattttaatagctgatcctagaatcgaaggtggtgccttttacctagggtcagagaattatgaacaggcaatccgtaaggtcatccaaaatgctttggattatttgggatttgcgaacaaccaattaattctttctggattatcaatgggatcatttggcgcactttattacgctacaaaattaaatccagcggctgttattgtaggaaaacctttgataaatctcggtactattgctaataatatgaaactcgttcgtccaaacgattttggaacgtcacttgatattttgcgattgaatcaaaatggcataactaacaaagatgttgttcagttagataatcatttttggaagcaaattcagcatagtgatttgtcaatgaccacatttgcgattgcttacatggagcatgatgattatgacaaatatgcatttcaagatttattgcctgttcttacaaaacaacatgcacgtgtgataagtaaaagaattcctggtagacataatgatgattctgctactgttactcattggtttattaatttttatcatttaatcatggaagagcgatttgggagggtaacacatgcaagaagatag

SEQ ID NO: 1645 - DNA, 534 bp, Staphylococcus epidermidis
gaaacaaatatgaaagaaaaacgtagtaatgttcgttggtattttgcaatagggttcttctttattggggttattgcttacatggatcgatctaacatatcttatattgcagtaccgatgatgaaagatttggggttaactaagacacaatttggtttattagcatcatttttctccctaggatatgcattaatgcaagtaccttcggggatgttagcagagaagtttggaccacgtaaaatgattactgtcgctttagtttggtggagtgcatttaccatcttaacagggatgattaaacatcatggtttactttactttattagattcttatttggtgttggtgaagcgccaatgtatccatccaatgcagtttttaactctttttggttcgctaaaaatgaaaaaggtcgtgcatctattgcgttgttagcaggatcttattttggtccagttttagcacctatcatcactatagccattgtcaatgcttttaactggcaagccgttttctatattttcggggttgtatga

SEQ ID NO: 1646 - DNA, 1149 bp, Staphylococcus epidermidis
gtaaaatgtattttttcacaaaaattatatatatccattcaacaaacgtggtataattattgtgaaaaatttcacataataaatggaggtattgatatgaaagcttatgaatacttaaaacctggtcatgcacaacttacggataaagagaagccaactattacgagcagtactgacgctattattcgcatagttaagacgacaatatgtggtacagatcttcatatcataaaaggagatacacctgaagttaaatcacatacgacactaggtcacgaaggtattggaatcattgaagaaattggtgacaacgttaacaacttcaaagttggagataaagtgattatctcttgcatttcatcatgtggcaaatgctactattgcaaaaaaggtatctatgcacattgtgaaaacggaggaggatggatattaggacatttagtgaatggtactcaagcagaatatgttaaagttccttttgcagataattctttatatcacgccccttcaaatttaaaagacgacgcccttgtaatgttatcagatatacttccaacaggttatgaaattggtgttttaaaaggtaaagttaaacctggctgtacagtagccattgtaggcgctggtcctgtaggtttagcagcattacttacagcacaattctattcaccttcaaaaattattatgattgatttagatgataatagattagaaaccgctaaagaactaggtgctacgcatttaattaactctaaagagactgaaaccgcaattaaaaaggtaaaatcgttaaatccacgtggtgttgatgttgctattgaagctgtcggaattccacaaacctttgatttatgtcaaaatttaattggtgtcgatggtacgattgctaatgttggtgtgcatgggttacctgtacaacttgatatagataaattatggattaaaaatattaacgtaactactggtttagtttcaggaaatacaactgaagaattacttgaagcgttaaaaagcaaaataatacaaccagaacaactcgtgacacattatagtaaactgagtgaaatcgaaagtgcctatgatttatttagaaatgcaacagatcataaagcgattaaattaatcatagagaatgatatcacaatttaa

SEQ ID NO: 1647 - DNA, 201 bp, Staphylococcus epidermidis
aggaggcgtatcatgttttctactggtaataaagctaaaaagactatatttggagctatgacttgttcaaaatgtggtaagacactcaataatgatgaaaatattaccatcaaaatcaatactaaagaattaaaaggttatactcacttatcaagttgggctgatgcacagtataaattgtgtgaaaactgctcagaataa

SEQ ID NO: 1648 - DNA, 270 bp, Staphylococcus epidermidis
attatattcatatttaagttatttttatcgttaaacttgaaaacaaataaatatgtatataaaatttataatttaatacacacaaaaaagcaccttaaatgttttcattactcatttaaggtgcttattaaattaaatatttattttaacggttacctacatcatgaccgacatctacagtatttttatctttatcataaacagcaccttggacactgccaaagtttggatcattatgcttttcttcaacaccataaccaagacttttaa

SEQ ID NO: 1649 - DNA, 312 bp, Staphylococcus epidermidis
ataccattcatcaaagcgtcaaaactgtcactgagcaaacgaccgagcagtattaaagcaaaattccaaattgtagtacctattaaagataaagttgtaaactgtataacgttcattcgattaatgccagcaggtattgtaattaatactcgaagtactgggacaaaacgacataaaaatacagcccatgcaccatactttttaaaccaatcatttgcccgtttcaaatctttactttttaacttcatccacttaccatgtcgatcaacgaaacgatataatttctcttctgagataagtctacaaatataa

SEQ ID NO: 1650 - DNA, 336 bp, Staphylococcus epidermidis
gtgtatatcatgtatgagaatatacaaaatattgaagatttttaccgatttataaatgcacacgctttagctgttgttcatattatgagagataattgtacagtatgtcatgcagtattaccccaaattcaagatttactaaaggactatccgaaagcacaattaggtgtgattaatcaatctaatgttgaagctattgccggagaactttctatttttacagtacctgttgatttaatttttttgaaagggaaagaaatgcatagacaagcacgttttatcgatatgcaatcgtttgaaaaacaattgtatatgatgcaaaatgccatcgattaa

SEQ ID NO: 1651 - DNA, 624 bp, Staphylococcus epidermidis
gaggaaatcatcatgaatatgcccttaatgattgatttaagtaacaagaaagtcgtcattgtaggtggaggtaaagtggcaacacgtcgtgctaaaactttattagcttatacaaaacatattcatgttgtaagtccaacaattaccgatacattacaaaaatatctagaaacgaagcaaatcacttatgaaaagaaacacttcgaaccacaagatgttgagaatgctgatgtggtcatcgcggctactaatcaatctgatgttaacaacgatgtgggggcagctttgtctaagaacgtattatttaatcatgcaggacaagcagacctaggtaatataacgttccctaatttcttaaaaagagataaattaacaataagtgtatcaactgatggtgcaagtcctaaattaggtcaacgaattattaaagatttaaaagatacatacaataaagactattcaatgtatattcagtttttatatgaaagtagacaatatattaaatcacttaaaattgagccatctgataaacaagcgttactcgagcaaattttgtcagacaaatatttagatgagaagaagcaacaagatttcatccgatggctaaaatcacaagtcaaatga

SEQ ID NO: 1652 - DNA, 207 bp, Staphylococcus epidermidis
tttttatacataagacacctcgttaatttagtttattggtatttattaaattatacgaaaggtccttatttttcaaagtattttaatataaaattacatatatgcacaaagtattttggcgagactcttgagggaacaggacaagctgaagactacaggctgaagctgtcagataagaaagcgagccaacaatacgaagtattataa

SEQ ID NO: 1653 - DNA, 1542 bp, Staphylococcus epidermidis
gaggcaaacatggaagaaagaattggtttgatagacattggttccaacacgattcgacttgttatatttggctacaataaaaaaactgggctcaatgaaatactgaatataaaaacacctgcacgattaagtcaatatctcactaagtccaatgaaatgaatgatgaaggtattcatgttttaaaagagacattaagcagttttagaaaagttgcggataaatttaacgttgatgcattatatcccatcgcaacagctgctatccgtcaatcaaaaaatcgtgaagctatcattaaagaaattaaacaagatattcatatcgaaattcaaattgtacctgaagaagatgaagcattttacggttactatgcgattacacatactactgatattgaaaatggaatttctgtcgatatcgggggcggttctaccgaagttacccttttcaaagacaagcaacttaaagaggctcatagctttccattcggcgtggtatcacttaagcgtcagttttttggtgataaagcacacaatgacaaaacagccattaaaaatatggaacagtttttacgtgagcaatttagtcagttagactggctatccaaccaacatattgcgcttgtaggagtaggtggttctgcacgtaatgttgcacgcattcatcaatcagcacatgcataccctatcggtggcgttcataactataagatgacttcgaaagatattaacaatgtttatgatttaatccgtaaaagttctcgcgatgaacttacaaatttagacggtttaagccgcgatcgcgtcgatattattctgccagctatctccgtctttaaaacacttttcaaaaaaattgacgccacacaattcaccttctcaagaaaaggaattcgtgaaggatttattatgaaccacatcagcaaacgatatcctgatgagtttaataaaagtaacgtacgtaaagatgcattacgtcatttagcgaatgaatatcatattgaagaaacgagtgctaatcgtcgtgtaaaattagctcaatccttattgaatcaaattataagtgaacgatcacttaatatttcagcaatggaaaaagaattatttattgaaggttcctacatttattacctaggtagtttcattgattcagactcaagttcaccacatacgtattacttaatcgcaaattcaatgattaacggcttttcacataaagatcgtgtgaaattagctttgttagctagttttaaaaacaaatctttacttaaattttattgcaaagaaacacagtggtttagtaataaagaaatagatacaatacaagctttaggggggattattaaatttgcaaacaccttgaatatctcacatactagttttgtagaggaagttaaactaaaagcaaagaaagatgacaaatacgatttattagtttattacaaaggttcacctattgcagaagaataccaagcaaatcgtcagaaaaagcatattgaaaaaattttaaaaggtaaggtttctattatatttacaaaatcttaa

SEQ ID NO: 1654 - DNA, 1080 bp, Staphylococcus epidermidis
aataggagcatttatatgtacaaattagttaagcctttattattcaaattagatcctgaacgagcacatggtttgaccatcaatgcgttgaagtgtgttcaaaaatgttcacccattttacctatcgttaataagttatttacttataacaatccaatattaacgcaacacattcacggtatttcttttgataatcctatcgggttagctgcaggttttgataaatcttgtgaagttccaaaagcacttgaaaacattggcttcggtgcaattgaactcggcggtataacacctaagcctcaaccaggtaatccaaaaccacgcatgtatcgtttactagaagatgatgcactcatcaatcgtatgggattcaataataagggtatgaataaagcactaagtaatttacgtaatcattcatgctcaataccagtaggattaaatgttggtgtgaataaaacaacttcctatgaaaatcgctatcaagattacattaaagtgattgacacatttaaaaatgacgtctcattctttacagtgaatattagctccccaaatacagaaaatctccaaaactttcacgacgaagatgaattttcgatgttatgtgatgctttaaattcatttaaagctaagaacaatattaatgtacctatctttttaaagttaacatctgatatggaattagatggttttaaaaaaatcttgccttcaattacagatacattcgatggggttatgttggcaaatacgacacgacaacgcgatggattaaattcaaaaaataaaatacaaaaaggtggcttgagtggcagaccattattccaaagaaacttacaactggttaaatatgcctatcaacaaacacgaggtaacttcttaattattggaactggtggtatattcagttctgaagatgctatcaaaatgttaagaaacggtgcatcattactacaaatatactcttcattagtcattgaaggaccaggtttgactaagaaaatgaataaagaaattgcgcattatttaactcgacatggttatgctaatgtaagtgatattattggtttagatgcataa

SEQ ID NO: 1655 - DNA, 318 bp, Staphylococcus epidermidis
aacaacttttttcccaaattttttcattttaacgaactccttcataataaagttacacaaataactgtgttagcttatttgtataatatttctattaaaataactagaattttacttcagttcagatataaaaaattcattttaatgacaatttttcaacacttttctgaagcaatcaattcagcgactaactttattacgtttattattatagtacgtgacaaagtattaataaaatacataataacgatgttaaccattcataaaaggaataggtttcctatagaaaaatgtaatactttgtttattcatatatga

SEQ ID NO: 1656 - DNA, 1185 bp, Staphylococcus epidermidis
attattttaatgaggaggcatagcatggaaatgtcagaaaggctagcttcaattcctgatagctactttggcaaaacaatgggccgtatagttgaacatggtcctttaccacttataaatatggcagttggaattccagatggagaaacgccaaagggtattatcaatcatttttcagaggcgctatgtattccagaaaatcaaaagtatggtccatttcacggcaaagatgcctttaaacaagctattgttaacttctaccaaagacattacgatgttgaattagacaaagaagatgaagtttgtattttatatgggactaaaaatggtcttgttgcattacctacttgtgttgttaatcctggtgaaattgtacttttacctgatccgggatatacagattatttagcgggggtcatgttagctgatgctaagccactccctttaaaattgtcgccaccaaattatttgccgaattggaatactataagtgctaaagttcttgagaagactaagctaatttatttaacatatcccaataatcctaccggttcgacagcgacacaagatgattttgatgaagcgattcatcgttttaaaggtactcaaacaaagatagttcatgactttgcatatagtgcttttggatttgacgccaaaaatccaagcatattagcttctaaaaatgcaaaagatgttgctatcgagatattctctttatctaaaggttataatatgtcaggctttcgtgttgggtttgctgttggtaataaaaaaatgattcaagcgttaaagaagtatcaaactcatacaaatgcaggtatgtttggagcacttcaagatgctgctacgtatgcactcaatcattatgataagtttttagaaaagcaaaatgaaatatttagacgtagacgtgataattttgaatcacaactaaaacatgcacatttaccgtttgttcactctaagggaggtatttacatttggttacatacacccccgggttatgatagtgaagcattcgaacagttgttattaaaagaaaagtcaattttagttgcacctggtaaaccatttggtgaaaatggtaatcaatatgtgagggtttcattggcgctcgatgataaacaattagaagaagcggcgaatcgcttaacacaattacggtatttgtatgaaagataa

SEQ ID NO: 1657 - DNA, 447 bp, Staphylococcus epidermidis
attacgctaatcacaataattatagcttatcatagttgggtcataataaatttacttataatttacattagattaaaacaacgatgttacattatatatgaaagatattacgactttaggaggagaggtatggagaagtcagttaaacttgctgttggcatctatctagcaattattttaattatttgtagtatttacctcgcatttatacttattggaagcttaaatggtaaagacatgagtaattctgttctagatactgatcactctcgtatcaacaatacttcaagaaacagtaacgaagatgttacgtcatcaaataatgagtcaaacaatacaaaagcgcactcatttgcaaactctgaatataaagctattaacataaacgaagcatttaaaaataataagcaaattaaaaaagcgaattcgagttatcaatactattga

SEQ ID NO: 1658 - DNA, 744 bp, Staphylococcus epidermidis
ttcgctataatgggtttgaagagaaatcggaggttgagaaagatgtatgtagagagaaagcctgcactttatatcgaagatttacgagacgaattcaaaaatagcttaaaacattttaaagatgatgatgaagcatttaatacattagttggatttgtggaactggaccacctatattcttcagcacttaaagaaataagtacaaaattaagtattttagatgataactttaactatcaatataaacacaatccaattcatcatatggaacgacgagtaaaagagatgcacagtttagttaaaaagttgaatcgtaaaggatttgaagtgagtgcacaaagtgctaaagataacattatggatattgctggtatacgggtcgtatgtaactatttagacgatgtttatgtcattgaaaaaatgttattaagacaagaagatgttaaattattaaaacgtaaagattatatcacacatcctaaagaaaacggctatcgaagtttacatatcgtcgtatctattccagtgtttttagcagattcagtagaagtaacaccagtagaaatacaaattcgtacaatcggcatggatatgtgggcaagtttggaacacaaaattcgttataaaaatgatacagacactgaaaaatataaaggactattagaacaatgtgcatcagaaattacaaatgtagaaagtaaaatgcaacaaatacattcagaaatttcaaatcgagagaagtag

SEQ ID NO: 1659 - DNA, 2661 bp, Staphylococcus epidermidis
tatgacataataaaaaataagaggtggtcaagaatgacacaattcgtttatgcatttaatgaaggaaatatagctatgaaagacttacttggtggtaaaggtgccaatctttcagagatgaagagactcggactaccagtaccagatggttttacaattacgactgaagcttgtattacatatttaaaacaaaatgaagaactacctacagaagtaaagacacaattaattgatcatttagcagctttttctaaacgaacaggaaaagccttttcctctgatgataacttgttattagtatcagtacgtagtggtgcaaaaatttccatgccaggaatgatggatacaattcttaatttaggacttaatgatgataatgtaaaaaagcttgttgacaaaacaaatgatgcacgatttgcatatgattgttaccgtcgtttactacaaatgtttggagaggttgtttatggtattccaatgacagctttcgatacatattttaatgattttaaaacaaagcatcgttatcaaaatgatgctgaaattccggcagaaggactacaaactatatgtgaaaaatataaagaaatctatgtagaagaggcatataaaccttttccccaagaaccgttaaagcaattagaagaagcaattgaagcagtatttaaatcttgggataatgatcgtgcacgtgtatatagagatttaaatgatattccacatgatattggtacagccgtaaatattcaggaaatggtatttggtaatagtggtgaaaatagtggtacgggtgtagcatttacaagaaatccagttactggagaaaatcatttattcggagagtacttacttaatgctcaaggtgaagatgttgttgcaggcattcgtacccctaaggatattgacactttaaaacaacaaatgccagatgtacatcaagagtttgttgatgtaaccaaacaacttgaaaaacattacaaagatatgcaagacatagaatttacaattgaaaatggtaaactttatttattacaaacacgtaacggaaaacgtactgctaaagctgcaataaaaattgctgtggatttagttcacgagcaattaattacacgtgaagaagcagtatcaaaagtagaagtaaaatcaatagaccaattattacatcctaattttaatgaagaatcattaaagcaagcgacagtggtttctaaaatgggcttaccagctagtcccggtgcagcaacaggaaaagtagtcttctctgctgaagaagcaaaacttcaagctgaaaatggtaataaagtagtgttaatgcgaccggaaacatcacctgaagatattgaggggatggtagcaagtgaagcaatcgtaacaactcatggtggtatgacatcacacgctgctgttgtagcaagaggaatgggcaaatgttgtgtgacaggatgttcgaatgtagagatagatacagtgaacaaaacagtatattatcctgaaggtgaattacatgaaggggatatcgtttctgtagatggttcagctggtgatttatatttaggagcaattgaaacagtcaatgctgaacatagtgaagagttcgatcaatttatgacttggtctgaagagattgcaagactgcaagttagaatgaatgctgaaacaccacaagatataaaagctggatataattttggttctaaaggaataggtttagttcgtactgagcacatgttctttggccctgaacgtttaatagaaatgcgccgttttatcttagcttcaaatcatgacgaacgtgtacaagctttagaaaaaattaaaacataccaagtagaagattttgaaacaattttcagattatctcaagatagacctacgattgttcgtttacttgatccaccgttacatgagttcttaccatcatctgaagaagatataaacaatgtttctcaacagctgaatgtatcttcagagttcttacgcaagcgaatcgttgacttaaatgaggtcaatccaatgcttggtcatcgtggttgtcgtttggctgtgacttatccagagttatatgagatgcaagttgaagctatcattgaaagtgttattaagcttcaaaaagagggcataacgtgcctaccagaaattatgattcctctcgtgtcaacagtagaagaatttacaactttaaaagaacgattagttaatacaattacacatttagaaaaagaatcacaacaagatatacaatatatgataggtactatgattgaaacgcctagagcatgcttgattgcgaatgaccttgcgaaacattgtgatttcttcagttttggtactaatgatttaacgcaattgacatttggtttctctagagatgatgcaggaaaattcataaatgtgtatactgaaaataacattttacagcttgacccattccaaactttagatagagaaggtgtaggacgactaattcaattagctgttgaacaagctaaaaatacaaatccagagataaaaattggtgtatgtggtgagcttggtggcgatgcaaaatcaattcgtaaatttaaccaatgggaaattgattatgtttcatgttcaccatttagagttccgggtgcaattttagctacagctcagagtcaagcggaggaaagcgagcgataa

SEQ ID NO: 1660 - DNA, 2889 bp, Staphylococcus epidermidis
aaaagaataatgataattaggagtgtgaaaatgaaaaacgcactaaaactttttatcacggatttaaaaagagttgctaaaacaccaggtgtatgggtcatcttagctggtttagcaattcttccttcattctatgcatggtttaacctctgggctatgtgggatccgtatggtcatacaggacatatcaaagttgccgtagtgaatgaagaccaaggtgaaaaagttcgtggtaagaatattaatgtaggaaataaaatggtcaaaactttaaaaaagaatgatagttttgactggcaatttgtgagtagagaaaaagccgaccatgaaattaagatgggaaaatattatgcaggtatttacataccgaagaaatttacacatgaaatcactggtactttaagaaaacatcctcaaaaggcggatatagattttaaagtaaatcagaagattaatgccgtagcagctaagttaaccgatacgggatcgtcgtttgtgattgataaagcaaataaacaatttaacaaaaccgtagcaaccgctttactttctgaagctaataaagtcggactatcaattgaagataatgtacctacaatcaataaaattaagagtgctgtatatcaagctaataattcattgcctaaaattaatcaatttgcagacaagattattgaactaaataaacatcaagacgatttggatgcttatgctaatcaatttagaagtttaggaaagtataaagggaatgtattagacgctcaagaaaaacttaatgctgttaattcgtctattccggcgcttaatgaaagggctaaattgatacttgcacttgatagctacatgcctaatattgaaagaattttaaatgttgctgctaatgacgttccagcacaatttcctagaatcaataggggtgtcgatattgcaagtgaaggtattgatgcagcgagtggtcagttaaatgatgcaaaaggttatttgactcaagctaaagcgagagtgggagactatcaagaagcagctggccgcgctcaagatgtgaacaaccaagcaaatcaaaatctaagaaatcaaacatcaactacaccccaaagcgctataaagtcatcgcattcggaagggaagagtcattcaagtattaaaacagtacctgtgagtcaatcaggtgagaatcaacccgtttatggtgataacattttatctaacagtgatgtaaaatcaatgaatacagctttaacagaagctttattatcattatctaatcaaacagatcaacaagcacaagctacccaacaagacattaagtcattaaaaaatatagcatatggtgttatcgcttcagataaaccatcagagtttaaagaaccattaaaaaatataaaatcacgcttagaaaacgcatctaagtataatcaacaatttatagatatcttgtcagagttggaaaaaagtgaacatgttgatctatctaatgaaattaagcaagtgaaagaagcaaacaatagcattaatgataatttaaaaagtactaatcaattaatagatgcattgtcaaatggtagctccggacaattagaagcagtcaatgtattacgtgacttacctaacttaaataaaaggttagatacattacgaaattacattaaaaaagaacttaatcgtaatttactagctgtttctaatgagattactgatcaacttaataaaggtcaaaatacattatcgacaatccaatctaaattaaatactattaaccgagtgattaacgctggtcaagatattttaaatagcggtaaaaagagaattgatacgattcaaactgcattgccagcaatcgaaaacgcatatataaatgcaatgcgaactgcacaagcttacttcccaacagctaaaaaagatgtcgcgaaagctgcagactttgtacgtaatgacttgcctggattagagagagaattagctaatgtaacacagtctgtaaaccaaaaaataccatctttatttagtcgttatgataatgctgtagatttattaaacgagaaacagcctcaagcaaaagaagcacttgcttcgcttgccgatttctcagaaaataaattgccagatgttgagaaagacttgaaaaaagcaaataaaatcttcaaaaagttagataaagatgatgctgtagataagctaatagatacattgaaaaatgatttgaagaaacaggcagatattgttgctaaccctattaataaaaaaacgacagatgtgttcccagtaaaagactatggttctggtatgacgccgttctatactgcattgtctatttgggttggaggattattaatggtcagcttattatctgtagataacaaacatgaacacttacaacctattatgacgaagagacaagtgtatcttggtaaatctggtttctttttcttattaggtatcatacaggcattaatagtatctatcggtgatttagttatccttaaagcatcgatagaatcaccgatattatttgtctctattgccgtgtttagttctctcgtatttaattcgattatttacacatctgtatcattgttaggtaaccctggtaaggctgttgctattatcttacttgtgttacaaattgctggtggaggaggtacattcccaattcaaacaacgccagaattcttccaagcgatatctccatatttaccattcacgtattctatcgacgcattacgtgaaacagttggaggtatagttccagagatactgattacgaaagtgatcattttaggtttattcggaatcggattcatggttgtaggttattgcttgaaacctgtgactgaccctattatccgtaaaattgctgaaaaagctgatgaaagtaaagtaactgaataa

SEQ ID NO: 1661 - DNA, 210 bp, Staphylococcus epidermidis
acaataccaatcattttacctctgttttttgctgatgtgagcatcgctgtgagtgctaaaactttcacaataatgagtgaagctgcggcagaagataaaatacgtcctacaactattattccaaaatgtggcgcaatggcaatcataccattcccgaagataaagacaattaacgtccataataatactgatcgcgaagaaaaccgatga

SEQ ID NO: 1662 - DNA, 231 bp, Staphylococcus epidermidis
accaggcaaatagtgcggtttataagttttgttgagacgtctataattgttctcgttcattcaattacactccgtttaatttttaaaatacttgctcttaatattatcacaattacatcctcaattgcattgacatgtcatctttttactttaatattatactttaacaaattaaataggtatacatttattagagcatcttcatataagttgtgtaggcaagcaatttaa

SEQ ID NO: 1663 - DNA, 249 bp, Staphylococcus epidermidis
acatgtaaaataatctataataggtatcataattattgggggctagagaccctaagagaaggtgagacaatgatatttgtaatgttatctccaatattaattattttgtttattgtactaagcgtattagaagaaaaacgtagaaagaaaaattcaaaagaacaaaattcgaatcatgtagatcagcaacaatatgattataccgacaaagaacaacaacaaaataaaaattcaaatgatgataaataa

SEQ ID NO: 1664 - DNA, 1209 bp, Staphylococcus epidermidis
ggtgaaaaaatgtttaagaaattcgaatataaaatcttatataaaagaatattttttacatgcttaattttagttatatatattataggaagtaatatttcaatcgtaagtaatgaaaatttaagaactcataaagactccttttttaagttagctattactaatgtaggtggggatttacatacattaaatatattttcactaggacttgggccgtggttaagttcgatgattattttgacactaataaaccacaaaagtaatgataaggttaaaacacaaactcgtagggaacgacatttcaaagagcgagcgttaacacttatcattagtgctgctcaaggattttacattattcattcatatattaataaacatgcgattaaagatagtaatatgctcattttattattagtcttaattacaggaacgttgttaatggtgtggttagcagatcaaaatacaacgtatggcatttcgggacctatgccaattgttttaatgagtcttgttaaatctatatttaatacaccttttcctaaattaaattcaagcgcatctttaattactatgattattgtcttattagtgctggacttatttatactcttctttattgagttaacagaatatcggatagaatataatgatattatgaatatttctgctaaagatataccatcatatttatcatggaaacttaatccagctggtagtatctctatcatggtgagtttgtcattatttatgttaacgaataatatcgttaatttcataggacgctttatcgtgaatcataattttgaaacacatgtctttaattttacaaatccagttggaattactatatatcttctgttacaaatgattttgggttactttttatcaagattattaattaatacgaaacgtaaatcaaaggaatttcttaaaaatgggaattacttcgagggtatacaacctggacagcagacagaaaaatttctagggagtaaagcacgtcgtatttgttggttcggttcaatagtagtagcgattgtactcgctataccaatgtattcagcgctgcttgtcccccacttacttaaagaagtttactttacaactcaaatgattgtatttgtctatattggaattaatatcgctgaaacaattagagcgtacttatactttgacagctataagcaaattttaaataaatattggtag

SEQ ID NO: 1665 - DNA, 1116 bp, Staphylococcus epidermidis
attgttgaaatcgctttctttagggtgtacgataactatggcctaaaaataaagaaagaaggttttggggaaatggatattattttaggagtagggactttagtactcgttcttattatcatgacgcttttcttaaattttgcgccatatggtaaacaaggtttacaagctttatcaggggctgcttgtgccacgtttttaccacaggcgttcttaagttacgcaattggtggcgtattccatgttaaatttttccaagaaattggtgatctagcagggagtttaagtggtatagctgttggtatattaacttgtctaaagttagaagtgtctccagtatttgcagtcattgtaggtttagtattacatgactcaaaattattacctgcgtttatcgcagcgtatgttgttgcatttggaatcaagtttgttgagaaaaaagttccagagggactagatttaattgttgttattttattggctccagcagttacatttggtcttgcaaacttaatttctccaggggttattgcagtacttaaacaaattggtagtgcaatcacttcagtaggtgataacaacccatatgcattagcagtcattttaggacttgttattcctgtaactggtatgacgccattaagctcaatggtgcttacaagcttattaggtttaactggtattccaatggcaattggtgcattaacatgtacaggagcatcttttgttaatggaatcttatttagcaaattaaaaattggtaataaaggtaatgccttcgcggtatttgtagaaccgttaactcaaattgacttaattgccaaatatccactacaactgtttggtgcgaatgccattattggtgttgtaaatgcttgtattgtcacatacagtggactaattattgatattaaaggtatggcaacacctatagcaggtgctattgtactttatggctttaacgacgctgtaagatctacaattacaattatcgcagtagcaattgcaagtgtgatattagcgtacgttattagtgctattattaataaatttaacttgatgaatgtcggattcaagttaccacgtagaaaaaaccaagttaaggagagtgtttaa

SEQ ID NO: 1666 - DNA, 459 bp, Staphylococcus epidermidis
aataaaatgataggttcagaattatatttctccttattcgtaggtgtcgtactcagtttgatatttgctgagaaatttgggattaatccagcagggttagtcgttccaggttatttagctttgatttttgatcaaccgatcatgttgttatcagtattaatcattagttgcttaacttattttatcgtaagcaacggtattagtaagtgggttattttatatggtagaagaaaattcgctgccatgatactgacgggaatggtgattaaatttatatttgatctcttgtacccattgaccccatttgaaatggttgaagtttcaggtataggtgttgtcattcctggtattattgcgaatacaattcaaaaacaaggtgtagtcattacactttctacaacaatgttattaacatgtattacatatatcatcttatttttatatagttttattaattaa

SEQ ID NO: 1667 - DNA, 1878 bp, Staphylococcus epidermidis
ttaatcgtgattgatagacaaatcaaactcatcaaattgttattaaattatacagatacgtatataagtggccatgatattgccaaacagttaaatgtatctaatagaactatacgtaatgatattaaaactatacatactacatttctaaatgaattaattttaagtgtacaatctaaaggttatatgctaaatacatgtctttatacacctgatgagatacaatctgctttagagtcagttattgtaaaagagaataaattgcttatcacaattgcttataggttatttatggaaaagcatacattcactatcaaagagctatcttcaacttaccatttaacaaaatcaaaagtgattgattatgtaacacgtatacaaacgtgggctataaaatttgatatttatttatcaataaaaaagaagcaaggtatcatgatcgatgcgagtacaacgagtatcagtaatgctgtacttcatatcaatcaacttacagacgatgactttaaagttgaaaaccttattttacaagagttacctcaagcccatactagaaaaataaaacaaattatctcaaagcatatagataatcatcaattatcaacttctgaaaataaaatacaacaattacttgtgcatctaattttaattatcaaacattctcaaccagaggaagaagattggagcactgatacagaatctttaactattgcgaaaaagtgtataaaagatatcaatgaaacccttggatatcaacttaacaataaaacaagtgaatgcttttccttttttattagctaccatttcaataagtttgatttagggatccaacaactatttattcaaagttatatcgatcgactcattgaattaatggagcaacatattggttttcccttttcacaagatacaattttaaaagataatatgaacgtccactttagtcgtacatatttgcgattaatgagtcatgtttatctaaataatccattaacaagtcaaatcaaacgactatatccctttgtctttaatacactatatgatagtattcgacaattatcacaagataccaatatccaattaagcgaagatgagattgcctttttaactatacattttcagtcttctatcgaacgccataagtcatcacatattcatgttgtaattgcttgttattatggcttaggcatttcaacgttgcttgctgagaaaatcaaacaacttaatcatgcaatacagatcgtagatacattaaaacttgaagatattaacaactatcattttgaagggattgacttattaattactactcacgactttgatacaagtcaacttttacaaatacctaaagtcatacaagtatcacctttattttcagatgaagatgctaaaaaaatcgaattctttgtaaaagacatgcaaaacccattatcaaaagatgatatattatcaaaaattcagttgagtgttgagtccaatttcaaaatgaatcattcaaatcacattcttccaatttttgagaaatccaaagaaattttagattatcatcatgcaactctagatggctatatagaaagtgccatagatcgcgaaaaacaatcttcaacatatataggtaaagggatagcactcccacacggcaaccctgaaaaagtactgaaatcacacatgattatatttaaaccttctcaacctataacatggaaacaacatgaagttaaacttgttttctttttagcaatgagtaaaaaagatttaaatattaaccgtaaaattatacaaacaattgctcaattagaagaagatgacatccatcaattatgtcttttagatgatttacaactaaaaaacactttgtatgcacgttttaaagaataa

SEQ ID NO: 1668 - DNA, 222 bp, Staphylococcus epidermidis
aaaggagtgataattatgacacaaaaaatcataaaagttgaaggaatgagttgcgaacattgtagaaacgccgtagaatcggcactagctaaactaaatggcgtatcaagtgctgaagtaaatttagatgaaaatcatgtacgcgttgagtataatgattcaaaagttacatttgaaaatatgaaagaagcaattgaagaacaaggttatgatgttaaataa

SEQ ID NO: 1669 - DNA, 366 bp, Staphylococcus epidermidis
attgaggtgattaattgtatggaaaattttgataaaagttatcatgataaaacgggtgatgtattaggggctttaagttatctaagtgtatttttcgcacctgtattgtttccattaatcgtatggattgttggacaaccaccagcatctacgtattcaagaaatgcattatttaaccatattttgagttgggtgtgtttggtattaggacttatatcatttgctgctggactatccttgattgattcgacaaatggagtcgctgtactagtgataggagtaattattggaggtattctacttatcgcttcgcttgtattatttattattaatattgtgaagggtatcaaattattgatgatatag

SEQ ID NO: 1670 - DNA, 783 bp, Staphylococcus epidermidis
aagtttcagatgtactcattgatgtggacgtgcttgatgaatctgaaatgcttgtacttgatgattcacttaccgatgtactttcacttgttgattcactctcgcttgttgacgttgatgcactttctgatgtcgatgtacttgttgaatctgaaacgcttgtacttgatgattcacttaccgatgtactttcactgtctgactcactcacactcgttgatgtggatgcactttctgatgtggatgtggacgcactgtctgatgtcgacgtactcgttgagtctgaaatgcttgtacttgttgagccacttaacgacgtacttgcgctatcggagtcgctctcgctcgttgatgttgatgcacttgctgatgtcgacgtactcgttgagtctgaaacgcttgtacttgttgagccacttaatgacgtacttgcgctattggagtcactcacgctcgttgatgttgatgcacttgctgacgttgacgcgcttgttgaatctgaaacgcttgtgcttgtcgactcacttaacgatgtactttcactgtttgagtcactctcacttgttgacgttgacgcactgtcggatgtcgatgtacttgttgaatctgaaacgcttgtgcttgtcgattcactcaatgacgtacttgcacttgttgattcactctctcttgttgacgttgatgcgctttctgatgttgacgcgcttgttgaatctgaaacgcttgtgcttgtcgagtcacttaaggacgtacttgctctgtttgagtcgcttacactcatag

SEQ ID NO: 1671 - DNA, 504 bp, Staphylococcus epidermidis
ggaattgagatgattagatttgcgcgactagaagatcttcaaggtattttgacaatttataatgatgccatccttaatacaacagctgtttatacgtataagccacaacaattagatgaacgtcttcaatggtatcaatctaaagcaaaaataaacgaacctatatgggtttatgaaaaagaagggaaagtagttggttttgccacttatggttcctttagacaatggccggcctatttatatactattgaacattctatatatgttcatcaacagtacagaggactaggtatcgcttctcaattattagagaatttaattcgttacgctaaagaacaaggttatcgcactattgttgctgggattgatgcatcgaacatggatagtatcgcattgcataagaagtttgacttctcacatgcaggtacaattaaaaatgtaggttataaatttgatcgatggctcgatttatcattttatcaatatgatttatctgattcataa

SEQ ID NO: 1672 - DNA, 405 bp, Staphylococcus epidermidis
ttattggagatgactatattgattagaacatttatgaactcaaaaatccatagagctagagttacagaatctaatttaaattacgttggaagcataacaatagatgccaatatattagatgcggttgatattttacccaatgaaaaggttgctattgttaataataataatggtgctcgatttgaaacatatgtcattgctggagaacgtggtagtggaaagatgtgtttaaatggcgcggcttcaagactagttgaagttggagacgtcattattattatgacatatgcacaattaaatgaagatgaaatggtagatcactcaccaaaagtagctgtgttaaatgaaaataatgaaattatagaaatgataaatgagaaagaaaatacgatatcaaatgtataa

SEQ ID NO: 1673 - DNA, 1593 bp, Staphylococcus epidermidis
atgaattggatatcgattattttatttattatggtcgtaggtggcatttctttttatgcttatttgcaatcaagaaaaattaaaacgagtagttcagatggttattttatgggaggaaatagccttactggatttacagttgcctctacaattatcatgaccaatttgtcgacagaacaaattgttgggcaaaatggtcaaagctatgcacaaggaatggaagtaatggcttgggaggttacggctgccgtagcagttgtattgttggcttgggtctttcttcctaaatatctaaaatacggtgttaatacaatttctgagtttttggaattacgttatgatacatttactaaacgttttgtctccattttatttatctttacctatgtcgtatctttcttgcctgtagtattgtactctggttccctagtgttcaataaaatgtttaaagttgatgaatatttaggtgtaagtagttcaactgctgtcatcattatttcatctattattggtataattggcattatttacttatttataggtggtttatcgttaagtgcttttagtgattcaatttatggcatggctttaatcataggtggacttgcgattacaatattaggtctaggtcaattaggagatggcaacttcctacatggcttcgacaaaatcgtgcaagacacacctgagaaattgaatggttttggtaaggtggactcggatgttgtaccttggccaaccctattcttcggtatgttctttaacaatttattcttctggtgcgcaaaccagatgatagttcaaaaagcactcgcagctaaaaatttaaaagaatctcaaaaaggtgcaatatatttaagcttatttaaagttttcggaccattaattacagtcttaccaggtgtagtagcatttaactattttaatggtagtattgacaaatcagataacgcttaccctgcacttgtaacttcagtattaccagaatgggcatttggcttatttggtgcggttatttttggtgcaatattgagctcatttgttggctcattgaatagtacaactacactattgacactcgatttctataaacctatttttggaaaaaataaatcagataaacatattgctcgagtaggccatattgctactgtagtcattggagttattgttgtagcacttgcaccagtcatctcattattccctagtggtctttatgcagtagttcaacagtttaatggtgtgtatagtatgccagtgctagctttgattttagtggctttcttttctaaacgcacatctaaattgggcgctaaagtgacactcttcacacatataattttatacgctatcatcagctttgtatttacagaaattaattacctatacacatttagtgtattattctttgtagatttaattattattttgatctttaacaaagttaaaccatctagtgagtttgatttaagcacgcaccaaccgaaagtagatatgacgccatggaaatatcgttacgttgcaggtattattgttcttgcattagtagtagtaagttatattatcttctcaccactcgtgttagcaaaataa

SEQ ID NO: 1674 - DNA, 1509 bp, Staphylococcus epidermidis
aaggtggggattaaaacaatgatatatacagtaacaagcacattacccttagtgcacggaggaagaactaaatcattattaacaagaattcgatttcttgataaagaaatgggcattcacaataaaatattaacaacgaattataacgccaattataacgaagtttatcaaaagttcgaagagaatcaactcataacgaaaaatacgcaaatcgaaaacatatatgattggttatctgatttcaaattactttcaatacctaaaagtagatttaagaaaaaaacgctttactctgaaaaagatagagacatagaaggtttaacttctaaagcattcaatgatggcaatgtgatgagatattatgatcaagaaacttatgttttatatcggaaattttatgaagatacaaatatcatagaatttgaagacgtgatgtcaccaatttctaagaaaaaaattgaacgtagagaatataatcacttcggtcaattgcatagaaagatttacttctcaagccgtacatatcacaaaattttggaagaatattttgacactgagggaagtatttactgtaaaaaattcttcaattcacaaaaggcaaatgaattagattttattcaaatttttaaaaatcaacgtatcatgaaggcttttaaaaacgaaaaagatctctttaaatattatttcgaacatcgctttaaacaaaatgatattgtgtttaatgatgctagacttttagataaaccacttttaaataactgtatgaacacaaaaaatgtgcttgtatttcataatagccacatcgatggcgataatattaaatcttcatacaaaattgcattggaaaattctgataaagtagctcaatacctcttgctcacacatatgcaaaaagacgatatacaacatgcatatggtattagcgatgaaaaaatatcgattgtacctcactttattaaaagctatggacaaaaagatactcatcacaaagaggatagattcgtatttattggtagactaggcaaacaaaaacaagtggaccatttaatcaaatcttataatcaattcttaaaaaatggacatcaaacgaaattagcgatttatggtgcagatgaacaaaatcaaaaacaagtcatactagatttagttaaagaatatcaaattgaagataaagttgatttaaatgattttaccaagcatcctcttgaagaatttaaaaaatctaaagcctcactattaactagtgaatacgaaggttttggtttaaccgttatgcgaagtattgaagtaggttgcccagtcatttcttatgacgtaagatacggtcccggtgaaatcatagagcacggtgaaaatggctatcttgttgagccagataacattgaagcattcgcagcttatatggataaaataattaaaaatccactcaaacatgttaaaacaaaagaaacattaaagtatgaacaagcaaagaataactatcaaaagttgtttgagagagtaaagtaa

SEQ ID NO: 1675 - DNA, 792 bp, Staphylococcus epidermidis
ggagtggttttgttgagtaactcaaaaaaagtagccgttgtcacaggtgcagcacaaggtattggcttgaaaattgctgagcgtctatttgaagatggatatagcatcgcgcttgtagactttaatgaagcggtagctaaagagtcagctgaaaaattatcaaaagaagggcaagaggcagttgcttttaaagcagacgtttcaaatcgcgatcaagtatttagtgtgttaaatcaagtcgttgaacactttggcgatttaaatgtcctagttaataatgctggtcttggaccaatgacaccaattgaatcagtaacacctgaacaatttaatcaagttgtaggtgttaacgtaggtggtgtattctggggtatccaagctgcaattgaacaatttgataaattaggacatggcggtaaaattatcaatgccacatctcaagcaggtgttgaaggtaatgcaggcttatctctatacagcagtactaagtttgctgttagaggattgactcaagtagcagcacgtgatttagctgagaaaaatattacagtcaatgcatttgcacctggtattgttgaaacaccaatgatgaaaggtatcgctgaaaaacttgctgaagaaaacaaccaaccaatggaatggggttggaaacaatttacagatcaaattgccttaaaacgcttatctaaacctgaagatgtagctaatgtagtaagcttcttagcaggtagcgattcagattatattactggccaaacaatcatcgttgacggtggtatgagattccactaa

SEQ ID NO: 1676 - DNA, 183 bp, Staphylococcus epidermidis
gtcttggttgttgtgcgcgttttatttactgtggtagatttttttgctattgtagtttttttagttgatgacgttttgggtgatatagcttgtttggttgatgtagctctttttattgatgtagctctagatttaacagacgtatctttaactgaacgtttaaaattggacgtcgtcttttga

SEQ ID NO: 1677 - DNA, 705 bp, Staphylococcus epidermidis
atgactaatgtattatatcaacacggaacattaggaactttaatggcaggtttattagaaggaactgcttcaattaatgacttattagaacatggtgatttaggtattgctacgcttacaggttctgatggagaagtaatttttgttgatggtaaagcttatcatgcaaatgaacataaagaatttatagaattgacaggcgacgaaatgacaccatatgcaactgttacaaaattcaaagcagactcaagttttaaaacatctaataaaaatcaagaagaagtattcgatgaagttaaaaaacaaatgaaaagtgaaaatatgttctcggcagttaaaatttcaggaacgtttaaaaaaatgcatgtacgtatgatgcctggtcaagaacctccatacacacgtttaattgattcagctcgtagacaacctgaagaaacacgtgaaaatatcaaaggttcaatcgtaggtttcttcactccagaattattccatggtattggttctgcaggtttccatattcactttgcaaatgatgatcgtgattttggtggtcatattttagactttgaagtggatgatgtgactgttgaaatacaaaactttgaaacatttgaacaacacttcccagtagatgctaaatcatttactgatgctgacattgactataaagatatagccgatgaaatcagagaagctgaataa

SEQ ID NO: 1678 - DNA, 1773 bp, Staphylococcus epidermidis
gaaagagatgttaacaaacaaagaaaacaaatcaatttttggaggtctttaacgatgagaagaaaacgcgattcatacgattatgtcatcattggtggcggtagtgcaggttcagttcttggtgcacgcctttcagaggataaagataaaaatgttttggtattagaagctggacgtagtgactatttctgggatttatttattcaaatgccagcagcattgatgttcccatcaggtaatcgtttttatgactgggaatatcaaactgacgaagaaccacatatgggacgtagagtagatcatgcgagaggtaaagtattaggtggctcaagttctattaacggtatgatttatcaacgaggtaacccaatggactatgaaggatgggcagaacctgaaggaatggacacatgggactttgcacattgtctaccatacttcaaaaagttagaaacaacatatggtgcagcgccatacgataaagttagaggccatgatggtccaatcaaattaaaacgtggaccagctactaatccattatttaaatcattctttaatgcaggtgttgaagcgggctatcataaaactgcagacgttaatggatacagacaagaaggttttggaccatttgatagccaagtacatcatggacgtcgtatgtctgcttcaagagcgtatctacgcccagcattaagacgtagaaacttagatgttgaaacacgtgcattcgttacaaaattaatttttgatgaaaataatagtaaaaaagtaacaggcgtgactttcaagaaaaatggtaaagaacatactgttcatgcaaacgaagttattttatctggcggtgctttcaatacaccacaactattacaattatcaggtattggtgactcagaattcttaaaatcaaaaggtatagagccacgtatgcatttaccaggtgttggtgagaacttcgaagatcacttagaagtatatattcaacataaatgtaaacaaccggtttcactacaacctagccttgatgtcaaacgtatgccgttcatcggtttacaatggatttttgcacgtaaaggtgcagcggcgtctaaccactttgaaggtggtggctttgtaagatcaaatgatgatgttgattatccaaacctcatgttccatttcttaccaattgctgtaagatatgatggtcaaaaagcaccagtagcacatggttaccaagtacatgttggaccaatgtactccaactcaagaggtagtttgaaaatcaaatctaaggatccatttgaaaaaccaagtatcgtgtttaattacttatctacgaaagaagacgaaagagaatgggttgaagcaattagagtagcaagaaatatcctaaaacaaaaagctatggacccatttaatggtggcgaaatttcaccaggaccacaagttcaaacggatgaagaaattctagattgggtacgtaaagatggagaaactgcattacatccatcttgtagcgcgaaaatgggacctgcatctgacccaatggcagtagtcgatccattaactatgaaagtacatggtatggaaaatttacgtgtcgttgatgcttcagcaatgcctagaacaacaaatggtaatattcatgcacctgtattgatgttagctgagaaagcagcggacattattcgtggtagaaaaccgcttgaacctcaatatgttgactattataaacatggtattgatgatgaaaaagcaggtgcaatggaagatgatccattctaccaatattaa

SEQ ID NO: 1679 - DNA, 246 bp, Staphylococcus epidermidis
ttagagagtgtgaacaatatgattagtgtaaacaatggggtaaaaaataaaaaatataaagtgaagcatatagggatttcaaataaaaatatgttgtatcgtttaggggcattaggcttaaacattggaagtgaaattagcatcaaacagaaatgtttactcaacggtcctagcgttgttgaagtaaatggtcaacatttaagtttacgacaacgtgatgcacgactcataacattagaggagtag

SEQ ID NO: 1680 - DNA, 615 bp, Staphylococcus epidermidis
atcaggagtgttaaaatgagtgaatcaaatcatattacatggcatgactcagaagttacgaagaaacaaagacagcataaaaatggacacaaaagtgctgttatatggtttacagggctatctgggtcagggaaatcaacggtctctgttgccttagaaaaagaattatttaatgaaggaaaacaaacataccgtttagatggtgataatgtgcgtcatggtcttaataaaaatttagggtttagtcctgaagatcgttcagaaaatattcgacgcattggagaagtagcaaaattaatggtagacgctggagccttaacagttactgcttttatctccccatataaagaagacagagaaggtgttagagcattactagaggataatgagtttatagaagtatatacaaaatgtagtgttgaggaatgtgaaaagagagatcctaaaggattgtataaaaaagcacgatctggggaaatacctgaatttacaggtataagtgcaccttatcaagcacctgaaaaccctgaaattactatagatactgaacacgacactattgaacaatcagtggtacaaattatacgttatcttaaagaacacgaatatatttaa

SEQ ID NO: 1681 - DNA, 915 bp, Staphylococcus epidermidis
gaaacgaccgttgcttataaacaatttatacgttttgcacaacatcatttacattttcatcatctagggaggcattttatggttatttcaaaaaaattatcacttatcactataggtatcttaataagtattcttttaatttctctacttattgatcaaactatctcacatcaattcatgaatcagaattcaattttcggtactttatttcaaaactacggtttatttccgcctacgctcatattaattatttcaactgtaattttaaattattatattttcactacatttcaaaataaattagctaaaatattaacattgcttatatctttcatattcaccctaattaaaaccaatgaattcgtgtcagaaactgctcaatatatgctatcaacttcagcaaacataaaaaatcataaaccaatggggatggcaaataatgaaggaaacgctggaaatgctttatctttaggaatgagtttctttatttctttgattatacttataattatcacttttatttgttatcaattttggttaaaacatacaaataaccaagaactttatcatttattcaaagtttcacttattagctttatgattttatttattggattagaactcgttgatagcttgaaacatttatggggacgttttagaccatatgaaatcactgacaaagctggacatttcactcactggcttacaataaatggaaatactggacatagttccttcccttcaggacacactggaaatggtgcatttctaatgtttatcgcattttactttaaaaaattacgcactcaaaaaatagtgtttagtatcggattatgttatagcattttaatggcattgagcagaattcgtattggtgcacatttcactaatgattattgcagattttatcattaa

SEQ ID NO: 1682 - DNA, 1050 bp, Staphylococcus epidermidis
atgaacaacgttaaagaatccatcattgttgccttcgcctttgtaggcgttgtagttggagcaggatttgcaacaggtcaggaaatctttcagttcttcactagtcatggtatttacagtattggcggtatttttattactggacttatcttaactcttggaggaatattcgtattaaatactggctttcgtcttagatctcaaaaccactccgaatctattcgttattatttacatccaacaatagctaaattatttgatattatacttacagtatttttattttctctagcaattattatgacagccggcggagcatcgactataaatgaaagtttcggcttacctttttggttaagttctttcattttagtgatacttattttgataacattatttctaaagttcgatcgtcttatcgctgttttaggaggggtaacaccatttcttgtggcagtcgtagtaatgattgcagtgtattactttattaccggtgatttaaactttagtgatgtcagtcaatattcaaatcaaaataagtcgatttcacctggttggtggtttgacgcaattaattatgctagcttacaaattgctgctgcatttagctttttaactgtaatgggcggtaaactacgatatcaatcgtccacaatttatggtggacttatcggtggtattattgtgactttactattacttttgattaattttggtcttgttacagaatttaatcaaattaaagaggtagcattaccatcattgctacttgctaagcagatttctccatccattggtattatcatgtctgtcattatggttttagtcatatacaatacagtagtaggtttaatgtacgcctttgcatcacgctttagtcgaccgtttacgaaacgctattatattcttatagttatgatggcgataataacatttgcttgtacttttgtgggattcatttctctcattggtaaagtgttccctatcatgggactttttggttttatcttattgattcctgtgatatacaaaggaattttacgaaaataa

SEQ ID NO: 1683 - DNA, 207 bp, Staphylococcus epidermidis
actgtaatagttagtaagatgattgaacgtcaaattatattagatccatctaaaccagtcaatcgttcaataccagctgagatcatcggcacgcctagagcgagtgatgttgcagcaccaccgagcaaaccgaaaataaataaaatatctacgatttttcctcataatttatccgtatgtccttttaaaattggtcgacaagcttga

SEQ ID NO: 1684 - DNA, 948 bp, Staphylococcus epidermidis
aaagataaagtaggtgaagttgaaatgaataaaaataaagtgattgtaattggatcaacaaatgtagataaatttcttaatgttaaaaggtttccaaaacccggtgagacattacatattaatcaagctcaaaaggagtttggtgggggcaagggagccaatcaagccatagcagctagtagattagcagcagatacaacatttatcagtaaagttggtaaagatggcaatgctaactttatattggaagatttcaaaaaagcaggtattcatacacaatatattttaacttcagaaagtgaagaaactgggcaagcatttatcactgttgatgaagcaggacaaaatacgattcttgtttacggtggtgcgaatatgacattaagtgcaactgatgttgagatgagtgtggatgcgtttattggtgcagactttgttgtagcgcagcttgaagttccatttgaggcgatagaacaagcatttaaaattgctcgtaaacaaaatatcactactgtattaaatcctgcaccggcaattgaattgcctaagtcacttttagagttaactgatataattattccaaacgaaacggaagcagaattattaacaggtatttcaatcaataatgaaagtgatatgaaagaaacagcaacatattttctcgatttaggtatatctgcagtattaattactttaggggagcaaggcacgtattgtgcatatcaagaacaatacaaaatgattcctgcgtgtaatgtaaaagcaatagatacgacagcagcaggagatacatttataggtgcttttttaagtgagttaaataaagatttgagcaatttagaatcggctattcgacttgcaaatcaagcgtcgtctctaacggtacaacgaaaaggagcacaagcttctataccaacacgtaaagaagtagaggcagaatataattaa

SEQ ID NO: 1685 - DNA, 3561 bp, Staphylococcus epidermidis
gaagtgaaagtttcagatgtactcattgatgtggacgtgcttgatgaatctgaaatgcttgtacttgatgattcacttaccgatgtactttcacttgttgattcactctcgcttgttgacgttgatgcactttctgatgtcgatgtacttgttgaatctgaaacgcttgtacttgatgattcacttaccgatgtactttcactgtctgactcactcacactcgttgatgtggatgcactttctgatgtggatgtggacgcactgtctgatgtcgacgtactcgttgagtctgaaatgcttgtacttgttgagccacttaacgacgtacttgcgctatcggagtcgctctcgctcgttgatgttgatgcacttgctgatgtcgacgtactcgttgagtctgaaacgcttgtacttgttgagccacttaatgacgtacttgcgctattggagtcactcacgctcgttgatgttgatgcacttgctgacgttgacgcgcttgttgaatctgaaacgcttgtgcttgtcgactcacttaacgatgtactttcactgtttgagtcactctcacttgttgacgttgacgcactgtcggatgtcgatgtacttgttgaatctgaaacgcttgtgcttgtcgattcactcaatgacgtacttgcacttgttgattcactctctcttgttgacgttgatgcgctttctgatgttgacgcgcttgttgaatctgaaacgcttgtgcttgtcgagtcacttaaggacgtacttgctctgtttgagtcgcttacactcatagatgtagatgcactatctgatgttgatgtactcgttgagtctgaaatgcttgtacttgttgactcacttaaggatgtacttgcactgtccgagtcgctctcacttgttgacgttgatccactttctgatgtcgatgtgctcgttgagtctgaaagactcgtacttctcgagtcacttaatgacgtacttgtactgtttgaggcactcacactcgttgatgttgatgtacttgtcgattctgaaacgctcgtacttgtcgagtcacttaacgatgtacttgcactgtccgagtcgctctcacttgttgatgttgacgcactgtctgatgtcgacatactcgttgaatctgaaagactcgtacttgtcgattcacttaatgacgtacttgcactattcgagtcactcacactcgttgatgttgacgcactttctgacgttgacgcgcttgttgaatctgaaacgcttgtgcttactgattcacttgatgacgtacttgcactgtccgagtcgctctcacttgttgatgcagatgcactgtctgatgtcgatgtacttgttgagtctgaaacgcttgtacttgttgagccactcaatgatgtgcttgtactgtttgactcactcacactcgttgatgtggatgcactatctgatgtggatgtgcttgttgattctgaatcacttgtgcttactgattcacttgatgacgtacttgcactgtccgagtcactcacactcgttgatgttgatgcactgtctgatgtcgatgtactcgttgaatctgaaacgctcgtacttaatgattcacttatggatgtgcttgtactgtttgactcactcacactcgttgatgttgatgcactgtctgatgttgatgtacttgttgagtctgaaatgcttgtacttgttgagccactcaacgatgtacttgctctttccgagtcgctctcacttgttgatgcagatgcactatcggatgttgatgtacttgttgagtctgaaacgcttgtacttaatgagccacttaacgatgtgctggcactgtttgagtcactcacactcgttgatgttgatgcactgtctgatgtcgatgtactcgttgaatctgaaagactcgtacttgtcgagccacttaaggatgtacttgctctttccgagtcgctctcacttgttgacgttgatgcactgtctgatgtcgatgtactcgttgaatctgaaagactcgtacttgtcgagccacttaacgatgtacttgcactgtctgactcactctcactcgttgatgtggacgcactgtcggatgtcgacgcgcttgttgaatctgaaacgcttgtgcttatcgactcgcttaatgacgtactttcacttgttgagtcactctcactcgttgacgttgatgcactgtcggatgtcgacgtactcgttgaatctgaaacgctcgtacttaatgattcacttatggatgtacttgcactttccgagtcgctcacactcgttgatgttgatgcactgtcggatgtcgacgcgcttgttgaatctgaaacgcttgtgcttgtcgactcgcttaatgacgtactttcacttgttgagtcactctcactcgttgacgttgatgcactttctgacgttgacgtacttgttgagtccgaaagacttgtgcttgtcgattcacttaatgacgtacttgtactgtctgactcactctcactcgttgacgttgatgcactgtcggatgtcgacgtactcgttgaatctgaaatgcttgtacttaatgatccacttaacgatgtgctggcactgtttgactcactctcactcgttgatgtggatgcactttctgacgttgacgcgcttgttgaatctgaaacgcttgtgcttaatgattcactcaacgatgtactttcacttgttgagtcactctcgcttgttgacgttgatgcactgtcggatgtcgacgcactcgttgagcctgaaagactcgtacttgtcgattcacttaatgacgtacttgtactgtctgactcactctcactcgttgacgttgatgcactgtcggatgtcgacgcactcgttgagcctgaaagactcgtacttgtcgattcacttaatgacgtacttttactgtttgattcactctcgctcgctgacattgatgcactgtcggatgtcgacgtactcgttgaatctgaaacgcttgtacttgtcgattcacttaatgacgtacttgcactgtctgactcactctcactcgttgatgtggacgcactgtcggatgtcgatgtacttgttgaatctgaaacgcttgtgcttgtcgatttacttaatgacgtacttgcgctattggagtcacttacgctcgttgacgttgatgcgctatcagacgtcgacgtactcactgattctgataatagtttacttgtgcttgctgattcgctcgcttttattgatgcgctatcagacgtcgatgtgctcgttgagtctgaaatgcttgtacttgttgagccactcacacttgttgatgttgacgcactttctgacgttgacacgcttgctgaatctgaaacgcttgtgcttgtcgattcacttaatgacgtacttttactcgttgactcactctttcttgctgactctgatgcactatcagatgtcgacgtactcgctgattctgataattgtttacttgtgcttgctgattcgctcgcttggattgacgtactattcgacgtcgacgcacttaacgactctgagagactcttacttgttgataatgattga

SEQ ID NO: 1686 - DNA, 1344 bp, Staphylococcus epidermidis
aatattgaagtgaaaattgttcggcataagttaggagattcttccatgttattgtttatcatagaaatcataatcatgattctagcgatattattaggattaagaactgctggtgcactgggatgtggcatctttgctatagtagcgcagcttatcatgatatttggattccagttacctccaggttcagcaccagtgacggcagtgttaatcatattatctattggtatagcaggtggtacgttacaagccactggtggtattgactatttagtatacattgcatcacgtgtgattgaacgctttccaaaatcaattatatttatagcgccaatgattgtctttgtctttgtttttggaattggtactgcaaatatagctctttcacttgaacctatcatagcgaaaactgcacaaaaagcacgaattcagcctaaacgcgcattaactgcttcggtacttacagccaatttagccttactttgtagcccggcagcttctgctacagcttatattatttctgtattagcagggtatgaaatatcgatgggcaagtatttaagtattgttttacctacagctttaattagtatgttaatgcttagtacattttgtacatttgtaggacgaaaagaacacgtgcgtgatgagtcagaacgtttagttcagatgccagaagtcgaaatcaaaaatgacttttcattaaaagtaaaaataggtgttatctcattcctattatgtgtcatgggtattttaacgtttggcatatttcctaatctcatgccgcaattcaatgtgaatggagatgtagttaaagttgagatgactgaaattgttcagttctttatgtatctcagcgctacaatcaatttattattaataaaaatcaatacttctgatattctgtcatcgaatattacacaatctgcaatgggagcactttttgcagttcttggcccaggttggttaggtgcaacaatatttaatgctccacataacttaaaaatattgaaaaatgatattgggtcaattattagtgaagtaccttggcttgttatcatacttgtttctgtagttgcaatgattgtcatttctcaaacagctacagcatcaattatggtgccgatagttatgagtttaggtatacctcccatctattttgttgcgatggtacaaacattaaatgtgaatttcgttattccagctcaaccgacactattatttgctgtagaactagatgaaacaggtagaacaagacctacgagctttatgataccaggattttttgttataacagtatccgtcattacaggatttgttattaaaaccattttaggatattaa

SEQ ID NO: 1687 - DNA, 843 bp, Staphylococcus epidermidis
gtatcatttttaagatttgagcaatcaagactatataagcatcgagaggatgatactatgtttatttcaaaacaagaattatatgaaaagttacaatatgttacgccaagaacgtttgcctacttgaatgaaatagattattataacttattaatgataattgaagagcatcaaatatctattccaccgattcatcaacttcgaaaaacattgcgaggaagtaaaattatgaagcctaagaatcgcgtagacaattgttatattcatttaaaggatgaaattccgacccctattaacaatgaacaattaagtttcctgcatttttatccacgtcagcaaatacatttaattttgagtgcttattctagaatgaaaagtctaaagttacaatctcaaaaacattgtttaaagctcaaattccccttagatcagcattctattcgtaaagaaattacaccacctcaaagctctgataaagacaatgatattttaatttgtctattacaaaaattaatcaacgaaattaccaaatgtcaagttcctgtttctctaaagaataattctttcgaaataaaactaccaaactatatcataaaggttgatttaaactatcacgaacagcaagaccatttatatccattacaatatagcatccacgcatggcatagagatttccaatatctcgaaatctcaaataccttcacaataccgtctttgaatgatcttattttccatatacaaaagctttttttacttatatttcaattacctgaacatctcgcgagacaagaatattcattgagtcaatattatttttactcgcaatgccatacaaaaaattaa

SEQ ID NO: 1688 - DNA, 189 bp, Staphylococcus epidermidis
ttaagaaaggttttaattagtttgaattttaaagtatttctaattatcatttttcatgattttcttatttattatgaacacggttttatgtatagccgtttcaaagaacatgctgaacaatcatcacatttatttatattaaaatcacatttaaagccatttccaccatttcgatatacatatgattaa

SEQ ID NO: 1689 - DNA, 411 bp, Staphylococcus epidermidis
agtgtgaaggtgatgaaattgaaaaaggaaattaatgtagtaggtgctattatatattctgataacaaaatattatgtgcgcaaagaagcgaaaatatgagtttacccttaaaatgggagttcccaggtggaaaaatagaaaatggggaaaccgaaaaagacgcattaataagagaaattaaagaagaaatgaaatgtgatttaattgttggtgataaggtaacaaccacaacttatgagtatgattttggaatagttaacttaacaacctataagtgtgaacttaacaataaaaaaccaactttaactgaacataaggaaataaaatgggtaggaaaaaatgaactagataaattagattgggctccagcagacgtacctgctgtaagacgtataatagaggagaattag

SEQ ID NO: 1690 - DNA, 210 bp, Staphylococcus epidermidis
attattgaggtgatgactatgagaaatgctatagaagaattaatcttctccgatgtaagtagttatgacatctatgtaaacacaggcgttaaccaagggttggttggagacataaaagatggatatttgacgattgattctatcccatatattgatgctgaaagattatactattatagtttagagcgcaaagccctcgttacaagttga

SEQ ID NO: 1691 - DNA, 1002 bp, Staphylococcus epidermidis
attgaggaggttggcacattcatgtttaaaaagattgctactataataggttcgacattatttggtacagttttattcgcaaaagtgaaagaaaagcgtagttataaaagttttttacaagagaaaatgattagaatatcaggaatgaaaaagacatttgaaagtatagatgacgcgaaaaaagctttgaatgagactaaatatcaaacttcaggtaaatataatggaacaacatatgaatttaagcataaagttcaaataagagattattatggttctttagtctatgttgttaatgatcatggtcttccagatcaacgcacggtcttatatgtacatggaggcgcatggttccaagatcctttggaaaatcattttgaatatttagacttactcgttgatgcgctcgatgctagggtgattatgcccgtatatcctaaaataccacacagagattatcgtacgacatttgaattattaacaaaaatatataagcgattattgactaaaattgatgaacctgaaaacttggtcatcattggagattcagccgggggacaaattgcattagctttcgcacaaatgttaaaaaaagagcaactcagtcaacctggccatattgttcttatttcaccggtgcttgatgcgacatttaagaatccagaagcaagaaaatatgaaaaagaagatccaatgcttggaattgatggcagtaaatatcttgtagagttatgggctggtgatgcaccactagatgactataagatgtctccaatgaatggtgatttagaaggcctaggacatattacacttactgtaggaaccaaagaaacattatatcctgatgcagttaagttctctcacatgttaaatgataaaggaataaagcatcagtttatcccaggttacaatttatttcatatttatcccttattccctatcccagagcgtcaacactttttagaacagcttaaaaaaatcattgtcacaaaagagttataa

SEQ ID NO: 1692 - DNA, 465 bp, Staphylococcus epidermidis
gtggccagggtaggataccatcttacttggaaaatgatactgggtctttttcctaaagaagataaagtcaaggcattggatgctttagaacgtgtaaacattttagataaatatgaccaacgctctgaccagttgtcaggtggtcaacaacaacgtatatcaatagctagagcgttatgtcaggaaccaaccattatattagcagacgaaccagttgcttcattagatccattaactacaaaacaagtgatggatgacttaaagaaaatcaatgaagaacttggtattactattttaattaatttacactttgtagatttggcaaaggaatacggatcgagaataattggtttaagagcgggagagctcgtttatgatggacccgcgtctgagacaaatgacgaagtatttaatcatatatacggtcgctctattaagaacgatgaaaaattaggggtggaataa

SEQ ID NO: 1693 - DNA, 483 bp, Staphylococcus epidermidis
atactattattattactgtcattaaataaatacattttttgggagaaagaaatgaaattcaaaaaattattatctcgtattattatcgctacaatgattacatttactggaacactctcatatcaagctattgaacaaacgcatatttcccatgctgcacataattattatggtaaaaaacaatgcacttggtgggcatttaaacgtcgtgctcaattaggtaaacctgtatcaaatcgatggggtaatgctaagaattggtatagcaatgcacgtcgatctggttatgcaactggacataagcctcgaaaatacgctgttatgcaatcaacgagaggctattatgggcacgtagcagtggttgaaaaagtatataagaatggaaaaatcaaaatttctgaatataattataatgtgccattaggctacggcacacgcattattagtaaatcgtctgcacgaaactataattatatttattaa

SEQ ID NO: 1694 - DNA, 225 bp, Staphylococcus epidermidis
ggtgagatattgagcttttacgaatttatgcaaaatttcctaggtgatgacacgccattaggtgaattggttgattggattaatcaagatatcaatttccctaaagacgtgacgagccaaaaagaaatcttgacatattttcgaaatcatccatgtccggaaaacataccagtgacgagtatcaaacgggcactagctgttttcaaccaattcactaaagtataa

SEQ ID NO: 1695 - DNA, 258 bp, Staphylococcus epidermidis
ttagcttcattttcatatgtgtcaatggcagcacctgataatgtaccattatttactgcttcaattaaatcaggcgtgtttatcacagctcctcttgcggcattgactaaaacggcaccttttttaacatttttaaacatattgttatcaaataaatggaaactatctttattagcgggtacatgtaatgagataatatcagcatctttaattgcatcctctactgtttctttatattctaagaaagataaagaatga

SEQ ID NO: 1696 - DNA, 369 bp, Staphylococcus epidermidis
gaggaatctttaatggttttacgttatgctacaaatttaaaactagctaaagaattatatgatgcaagtaaacctaaattaaaaggcgatcaaggtatgattgatactttcactaatacatttggtttaccggaaaactcagttaagttagcaggtggcgttgaagctgcagctgctggtttatttgctgctagttttttaaataaaaatatttcacgcttaggctcacttgcagcaatttcagtacttggtgttgcagcttacaaacattttgaagcagggcatggtaaaaagggtgcacaacatgctttagacttattaggtttatcaacacttagcttattagatactttttcttgtaaaaaataa

SEQ ID NO: 1697 - DNA, 201 bp, Staphylococcus epidermidis
agcaattcattgatttgtttagcttgcccttccgtaaaaggactattggtaacacttaagttcaatcttatccacctcttatactttgttattccgatatttgtcattgtttatatatgtctatttttgaaagttattaattatatcttcaattctagtatgtaccatttgttattttcagtaaatgtaatactcaattga

SEQ ID NO: 1698 - DNA, 510 bp, Staphylococcus epidermidis
gttaacacatttgctttagggagtgaggatatggaaacggtatattttgctggtggatgtctatggggaactcaagctttttttaatacgattccaggagttattcaaacagaagctggaagggcaaatggaacgtcgaaatgtttagatgctccttatgatggctatgctgaatgtgtgaagatacactttgatcctgcaaaaacttcaatacttatgctgatggattatttgtttgaaatgataaatccttatagtttaaatcaacaaggtcaagacaagggtcaaaaatatcgaacaggtgtgtatagtgaaagttcgaagcatttaaatgaagcaaaagactacattaagcgcagggaagacgcgaaacaagtaatggtcgaagtacaacctctaagtaattatgtgaagagtgcagaagaacatcagaatcatcttgagaaatttccggaggattattatttatgtcatgttcctccagcattgcttaataaatacaagaaataa

SEQ ID NO: 1699 - DNA, 327 bp, Staphylococcus epidermidis
attcagacattatcgtggcttaatataagaaaagtaacagctcaacgaggtgaaaatcatcaaaaaaattataaaaaagacaatttctatattatttcaatagaaattgtctttatttacttatcttggacctttttgtcccaggctcatttgtatatttatatcgttttttggatgaatcgtatgatggctatcactacaatgacaatcattgaaacgaaagataagattttgaaatgcttactttttgtttctttattagattctccattttccatcatttcctgtagttctcgttctatctcaagatctaaatcagttttttga

SEQ ID NO: 1700 - DNA, 954 bp, Staphylococcus epidermidis
agttttcaattcatttcaccctcaatttcctttattattagcaatagtataatgaatcgtaaaaagaaaggaaagaataaagttatgacaattgccattataggcccaggtgcagtgggtacaacgttagcttttgaattaaaaaaagttctaccagatacggaactcatcggccggcaagataaattaatgacctatttcccagaaaatacttctaatggaagtaatgttaaagtgacttcatttaatcatattaatcaaacttttgatgtcattatcatagcagttaaaacacatcaattggatgacgtcattaaacaattacctaaaatcactcatgacgattcgctcattatcttagcacaaaatggctatggacagcttaataaacttccatatcaacatgtctttcaagcagtcgtctatattagcggacaaaaagttaacaacaatgttcaacatttcagagattaccaactatatattcaagatagcacactaactcgtcaattcaagcaaatggttcatccttccaaaatagaggtggttttacaagaaaatattgaaaaaagcatttggtataaattattagtgaatttaggtataaataccatcactgctattggacaacaaccagctaaaattttaaaatctcctcatattgagtcgttgtgtcgtcgtatattagttgatggtcttaaagttgctagagctgaacaaattgactttgaagatcatatcgttgatgatattttaaatatttataaaggttatccagacgaaatgggaacaagtatgtattacgatgtcattaacaagcatcctcttgaagtcgaggccatacagggttatatatataaatgtgcaaaaaaacatcatttagagacaccctatctagatatggcttatacatttttatacgcttatcaccttgaatacacacaaccagattga

SEQ ID NO: 1701 - DNA, 186 bp, Staphylococcus epidermidis
aaaagacaatttctacattatttcaatagaaattgtctttatttacttatcctggaactttctgtcccagccactcttttaataattacaaaatttttaaatactatgttttgttatagagatgttggtatgttttacagttttgaaaaaagattatacgtagccattaacaaagtgaccgattaa

SEQ ID NO: 1702 - DNA, 804 bp, Staphylococcus epidermidis
ttatttaaatttttaggaggatatttaacaatgaaaaaaatcgctacagctacaattgcaactgcaggaatcgctactttcgcatttgcacaccatgacgcacaagcagcagaacaaaataatgatgggtacaatccaaacgacccttattcatatagctacacttacacaatcgatgctgaaggtaactaccactacacttggaaaggtaactggagtccagatcgtgtaaatacttcatataactataataattataataactacaactactatggttacaataactatagcaactacaataactacagtaattacaacaattacaacaactatcaatcaaacaacacgcaatcacaaagaacaactcaaccgactggtggtttaggcgcaagctattcaacatcaagtagtaatgttcacgttacaacaacttctgcgccatcatcaaacggtgtatctttatcaaacgctcgctcagcatctggtaacttatacacttcaggtcaatgtacatattatgtatttgacagagtaggtggcaaaatcggttcaacgtggggtaacgcaaacaactgggcaaacgctgcagcacgttctggttacacagtaaacaattcgcctgctaaaggtgcaatcttacaaacgtcacaaggtgcatacggacacgtagcatacgttgaaggtgtaaacagcaatggttcaatcagagtttcagaaatgaactacggtcacggtgcaggtgttgtcacttcacgtacaatctctgcgagccaagctgcttcatataactatattcactaa

SEQ ID NO: 1703 - DNA, 213 bp, Staphylococcus epidermidis
tggccgaaattcttggggaaccagaatatccaagttcatcaaactgcaaacaacagatttcttaaagaaagttgttatttactgggaaataatataagtatgggtactttgagacaagaatcatgtgactcttgtctcagtttcatatttttgggtaaacatttaacatatagcaatgataaccaatacaaatttaataagtatacaatctaa

SEQ ID NO: 1704 - DNA, 1533 bp, Staphylococcus epidermidis
gcgattacttcaaatatcactaaaaaaggatgggttttaatgacaaatattaacgtaagaaattatatagatgaaagttacggcttgtttattaacaatgaattccaagctagtgatagtggggaaacattaactgtttctaatccagctaatggtgaagatttagctaaagttgcacgcgctggtaaaaaagatgtagataaagctgttcaagcagctcatgatgcatttgatagttggagtaagatttctaaagaagaacgtgcagattatttattagaaattagtcgacgtattcatgagaaaactgaacatttagcgacggttgaatcactgcaaaatggtaaaccctatcgtgaaacatcaacaattgatgtaccacaagcagccaatcaatttaaatattttgctagcgttttaacaactgacgaaggttcagttaatgaaattgatcaaaatacaatgagtttagttgttaatgaacctgttggagttgttggtacagtagtagcatggaacttcccaattttattagcatcatggaaattaggaccagctttagcagcaggtaatacagtagtaattcaaccatcatcttcaacgcctttatcattaattgaacttgctaaaattttccaagaagttcttcctaaaggagtagttaatgtcttaactggtaaagggtctgaatcaggagacgctattttccatcatgaaggtgtagataaattatcatttacaggttctactgacgtgggttacggtgtagcacaagcaggtgctgaacgtatcgttccgacaacattagaactaggtggtaaaagtgctaatattatctttgatgacgctaatttagagcaagtgattgaaggtgttcaacttggtatattatttaaccaaggtgaagtatgtagtgcaggttcaagattattagtacaatcatctatttacaatgaattgttgccaaaattgaaagaagcatttgaaaatattaaagttggcgatccatttgatgaagatactaaaatgagtgcgcaaactggaccagaacaattagataaaattgaaagttatataaaaattgctgaagaagatgacaaagcgaacatcttaactggtggtcatcgaatcacagataacggcttagacaaaggttacttctttgagcctacaattattgagattaacgataacaaacatcaacttgctcaagaagaaatcttcggtccagttgtagtagttgaaaaattcgatgatgagcaagaagctatcgaaattgcaaatgattctgagtatggtttagctggaggtatcttcactacagatattcatcgtgcattaaatgtagctaaagctatgagaacaggtcgtatttggattaatacttataatcaaattcctgctggtgcgccattcggaggatataaaaaatcaggtattgggcgcgaagtatataaagatgctatcaaaaactatcaacaagttaaaaatatctttattgatacaagcaaccaaactaaaggtttatattaa

SEQ ID NO: 1705 - DNA, 444 bp, Staphylococcus epidermidis
gaaagagagacatatatgaaatacgatgattttatagtaggagaaacattcaaaacaaaaagccttcatattacagaagaagaaattatccaatttgcaacaacttttgatcctcaatatatgcatatagataaagaaaaagcagaacaaagtagatttaaaggtatcattgcatctggcatgcatacactttcaatatcatttaaattatgggtagaagaaggtaaatacggagaagaagttgtagcaggaacacaaatgaataacgttaaatttattaaacctgtatacccaggtaatacattgtacgttatcgctgaaattacaaataagaaatccataaaaaaagaaaatggactcgttacagtgtcactttcaacatacaatgaaaatgaagaaattgtatttaagggagaagtaacagcacttattaataattcataa

SEQ ID NO: 1706 - DNA, 273 bp, Staphylococcus epidermidis
ttagtctatcaaaataaaggggttgggactgttatgagtgataatttgtcattattcattgactatatcaatgataatataatctatggtagtgaaatcaaacgggagaaattagagaatttatttaatcaatttgctataaaaaatgttgaaaagaacattgtctatgatgaactgaaatctttagatattacaatcattgagtcacaggattcatataaaaataaattgaagagattattttcggttctgttgcaaagtaaaaaaatatag

SEQ ID NO: 1707 - DNA, 771 bp, Staphylococcus epidermidis
aaaaataaaaatgcaaggagaggtaatatgctaactgtatatggacatagaggattacctagtaaagctccggaaaatacaattgcatcatttaaagctgcttcagaagtagaaggtataaactggttggagttagatgttgcaattacaaaagatgaacaactgattatcattcatgatgattatttagaacggactacaaatatgtccggggaaataactgaattgaattatgatgaaattaaagatgcttctgcaggatcttggtttggtgaaaaattcaaagatgaacatttgccaactttcgatgatgtagtaaaaatagcaaatgaatataatatgaatttaaatgtagaattaaaaggtattactggaccgaatggactagcactttctaaaagtatggttaagcaagtggaagaacaattaacaaacttaaatcagaatcaagaagtgctcatttcaagctttaatgttgtgcttgttaaacttgcagaagaaatcatgccacaatataacagagcagttatattccatacaacttcgtttcgtgaagactggagaacacttttagattactgtaatgctaaaatagtaaacactgaagatgccaaacttactaaagcaaaagtaaaaatggtaaaagaagcgggttatgaattgaacgtatggactgtaaacaaaccagcacgtgcaaaccaacttgctaattggggagttgatggtatctttacagacaatgcagataaaatggtgcatttgtctcaatag

SEQ ID NO: 1708 - DNA, 390 bp, Staphylococcus epidermidis
attcaactttgcaacagaaccgtattatggaatagagatgttggtaacatttatacaggatcattatacttaagtttaatttcgttattacagaaccacacattccaaccagaagagaaagtatgtctatttagttatggttcaggagcagtaggagaaatctttagtggttcaatcgttaaaggatatgacaaagcattagataaagagaaacacttaaatatgctagaatctagagagcaattatcagtcgaagaatacgaaacattctttaacagatttgataatcaagaatttgatttcgaacgtgaattgacacaagatccatattcaaaagtatacttatacagtatagaagaccatatcagaacatataagatagagaaataa

SEQ ID NO: 1709 - DNA, 1191 bp, Staphylococcus epidermidis
aaatctgattgggataaaggtgatctatataaaactttagtccatgataagttacccaagcagttaaaagtgcatataaaagaagataaatattcagttgtagggaaggttgctactgggaactatagtaaagttccttggatttcaatatatgatgagaatataacaaaagaaacaaaggatggatattatttggtatatctttttcatccggaaggagaaggcatatacttatctttgaatcaaggatggtcaaagataagtgatatgtttccgcgggataaaaatgctgcaaaacaaagagcattaactttatcttccgaactcaataaatatattacatcaaatgaatttaatactggaagattttattacgcagaaaataaagattcatcttatgatttaaaaaatgattatccatcaggatattctcatggatcaataagattcaaatattatgatttgaatgaaggattcacagaagaagatatgctagaggatttaaagaaatttttagaactatttaatgaattagcttcaaaagttacaaaaacatcctatgatagcttggtcaatagcatagacgaaatacaggaagacagcgaaattgaagaaattagaacagcacaaaaagataagacactcaaggaagtggaagcacctaaaggaataattccaaaatataaaaaaggtgtatcaaagactactaaaaatgattcagaaattgaaaaatcaaataaagagaataaattaaccggtaaagttggagaaaaattagcgctaaattactttaatgagctaattgataataaaatagacgaagataagaaagaacagtttaggaatattttaaatgataatccaggctctcaacacggtcatggctatgatttagtagcttttgatccaacaaatacagataaagctgtagaaaaatttattgaaattaaaacatctacatcttctagtattgaggaaccattttttatgtcgctaaatgaaatgtttgctatgaaagaatataagcagaaatatttaatattaagaatatttaatgtttccggtaaagaaccacaattttattttatagatccatatgcaaattattctgaatttaaagatgtagatgatctcattgacaaagtatttaatgtagaagctattcagtataaagtttttggcgaaaaatga

SEQ ID NO: 1710 - DNA, 2028 bp, Staphylococcus epidermidis
  unsure (52): Identity of nucleotide at the above locations are unknown.
tcttatataaggagtatattgatgaaaaagataaaaattgttccacttattntaatagttgtagttgtcgggtttggtatatatttttatgcttcaaaagataaagaaattaataatactattgatgcaattgaagataaaaatttcaaacaagtttataaagatagcagttatatttctaaaagcgataatggtgaagtagaaatgactgaacgtccgataaaaatatataatagtttaggcgttaaagatataaacattcaggatcgtaaaataaaaaaagtatctaaaaataaaaaacgagtagatgctcaatataaaattaaaacaaactacggtaacattgatcgcaacgttcaatttaattttgttaaagaagatggtatgtggaagttagattgggatcatagcgtcattattccaggaatgcagaaagaccaaagcatacatattgaaaatttaaaatcagaacgtggtaaaattttagaccgaaacaatgtggaattggccaatacaggaacagcatatgagataggcatcgttccaaagaatgtatctaaaaaagattataaagcaatcgctaaagaactaagtatttctgaagactatatcaaacaacaaatggatcaaaattgggtacaagatgataccttcgttccacttaaaaccgttaaaaaaatggatgaatatttaagtgatttcgcaaaaaaatttcatcttacaactaatgaaacagaaagtcgtaactatcctctaggaaaagcgacttcacatctattaggttatgttggtcccattaactctgaagaattaaaacaaaaagaatataaaggctataaagatgatgcagttattggtaaaaagggactcgaaaaactttacgataaaaagctccaacatgaagatggctatcgtgtcacaatcgttgacgataatagcaatacaatcgcacatacattaatagagaaaaagaaaaaagatggcaaagatattcaactaactattgatgctaaagttcaaaagagtatttataacaacatgaaaaatgattatggctcaggtactgctatccaccctcaaacaggtgaattattagcacttgtaagcacaccttcatatgacgtctatccatttatgtatggcatgagtaacgaagaatataataaattaaccgaagataaaaaagaacctctgctcaacaagttccagattacaacttcaccaggttcaactcaaaaaatattaacagcaatgattgggttaaataacaaaacattagacgataaaacaagttataaaatcgatggtaaaggttggcaaaaagataaatcttggggtggttacaacgttacaagatatgaagtggtaaatggtaatatcgacttaaaacaagcaatagaatcatcagataacattttctttgctagagtagcactcgaattaggcagtaagaaatttgaaaaaggcatgaaaaaactaggtgttggtgaagatataccaagtgattatccattttataatgctcaaatttcaaacaaaaatttagataatgaaatattattagctgattcaggttacggacaaggtgaaatactgattaacccagtacagatcctttcaatctatagcgcattagaaaataatggcaatattaacgcacctcacttattaaaagacacgaaaaacaaagtttggaagaaaaatattatttccaaagaaaatatcaatctattaactgatggtatgcaacaagtcgtaaataaaacacataaagaagatatttatagatcttatgcaaacttaattggcaaatccggtactgcagaactcaaaatgaaacaaggagaaactggcagacaaattgggtggtttatatcatatgataaagataatccaaacatgatgatggctattaatgttaaagatgtacaagataaaggaatggctagctacaatgccaaaatctcaggtaaagtgtatgatgagctatatgagaacggtaataaaaaatacgatatagatgaataa

SEQ ID NO: 1711 - DNA, 252 bp, Staphylococcus epidermidis
ttttttaaagtttacagtgatatgcttatttttttatcttacgattttgtacgtgcatgcttgcctaggggtatggctcgagccattagtctctcgcacatactattccctcaggcgtcagcacttacaaaatcggttgtaattttcatttttatacgcattcttactgagattatactaataagaggaatagtaaaagcaattctaagtaaaattgcagataagaggtttgttaaaagcagttctaagtaa

SEQ ID NO: 1712 - DNA, 693 bp, Staphylococcus epidermidis
caaaaaggagtcttctgtatgaactatttcagatataaacaatttaacaaggatgttatcactgtagccgttggctactatctaagatatacattgagttatcgtgatatatctgaaatattaagggaacgtggtgtaaacgttcatcattcaacggtctaccgttgggttcaagaatatgccccaattttgtatcaaatttggaagaaaaagcataaaaaagcttattacaaatggcgtattgatgagacgtacatcaaaataaaaggaaaatggagctatttatatcgtgccattgatgcagagggacatacattagatatttggttgcgtaagcaacgagataatcattcagcatatgcgtttatcaaacgtctcattaaacaatttggtaaacctcaaaaggtaattacagatcaggcaccttcaacgaaggtagcaatggctaaagtaattaaagcttttaaacttaaacctgactgtcattgtacatcgaaatatctgaataacctcattgagcaagatcaccgtcatattaaagtaagaaagacaaggtatcaaagtatcaatacagcaaagaatactttaaaaggtattgaatgtatttacgctctatataaaaagaaccgcaggtctcttcagatctacggattttcgccatgccacgaaattagcatcatgctagcaagttaa

SEQ ID NO: 1713 - DNA, 192 bp, Staphylococcus epidermidis
aagaaatactcatgtctatacaaacggggtagtctaaccgtcccacttaacacaagtcatctttataagatttccttaacatctactattatatctacgatgatttacatttctaaattttattatgcaatcaatacttactttcctttatatttgtcacccatgcttcataatagaagcaacgtaatctaa

SEQ ID NO: 1714 - DNA, 198 bp, Staphylococcus epidermidis
gaaattgactcagatttttctgagttagatacacttcctgattctgacaagaactcgcttgtagacgtactttttgattcaatttccgatttgctatttgtattactttcggatgttattgagttagactcggacagagatgaactcattgaatcatttgctgattcagattggttcaaacttgctgtagtgctttga

SEQ ID NO: 1715 - DNA, 411 bp, Staphylococcus epidermidis
attggaggattaaaaatgaagttagcaattattaaattttcagttggtggtttagctgttttaattagttatattgtttctgtcgtgcttccatggaaggaatttggaggtatatttgcaacctttcccgcagtgtttttagtttcaatgtgtattactggtatgcaatttggcaatgaggtagctatgcatgtgagcagaggcgcagtcttcggtatgataggagttttatgtagtatactagcaacctggggattactacaagctacacatatgtggctattgagtattattggtggttttgtagcttggtttgtaagtgcattgattatttttgaaattgtggaattcatagcacataaaagaagggataaacatggctggaagaccaaaagatccaacaatcaataa

SEQ ID NO: 1716 - DNA, 270 bp, Staphylococcus epidermidis
aggagacaatcaattatgtttggattaataggtatgattattgtcggcggtatcattggatggatcgcaggtttaattttaggtaaagacgtaccaggaggtattctaggaaatattattgctggtattgtaggatcatgggttggtactatgattttaggtgaatggggaccacaattaggtaaaattcacatctttccagcattattaggttcaattattttaatctttattatttcattaattttaaaagcactaagaaaaaaataa

SEQ ID NO: 1717 - DNA, 243 bp, Staphylococcus epidermidis
aggagtactttaatgacattattaactaaagttttagatactttaacaggcatatgtgttgctttattgtttaccaagtattttgtaaattatgcaaatgatatgtttgactggcacttaagatggtatttcctagaaaatgtacctcatttagcgctcattttgtttattctagtatttatctttgctgttccttctgaaatgattaaagataaaaataagaaaaagcataatgattcataa

SEQ ID NO: 1718 - DNA, 555 bp, Staphylococcus epidermidis
ttttgtatgtttagttatcaaataaataaaaatattaaattaaaaatattagaagaacgagaagccgaacagttatttaaattagtagatagcaatcgtgactatttagctgaatttctaccttttgttgaacatacgaagaaagttgaagatagtaaacactttatccattcggcgttgcaacaatttatcgatggtaatggatttcattgtggaatatggagtaataaagaattgattggagtcataggattgcattacttagatttagttaataaaacaacttcaattggttattatttagctgaagactttcaaaagaaaggtattatgactaaatgtactaaagcgttaattcgctatgtatatgaagtgtatgatattaatcgtatagaaatacgaatgtctactaaaaataagaaaagcagagctataccaattagacttgggttcacgcaagaaggtatattgagaagtaatgaacgattacaaggggaattctcagatagttatgtttttagcttgttgagggaagaatgtacgtatactagataa

SEQ ID NO: 1719 - DNA, 327 bp, Staphylococcus epidermidis
aagtgcatacctttttattttcaaaagtcttcctcctccataataaagatatcttcaacaggttcaccaaagattcttgcaatttttattgcggttaatatagatggtgtaaaatcgttgcgttctattaaagacaccgtttgtcgtgatattccagcttttttagcaagctctgtttggttatatccatcacgggctcgtaattctttaagtctattgcgcaaattgtatcacttccttacatataaactatataatatatttgtcattatgacaagtatattagtcaaaatgacaaaaataatagactttttagggattgtataa

SEQ ID NO: 1720 - DNA, 1101 bp, Staphylococcus epidermidis
ataatggctttaacagcaggtatcgtaggtttgcctaacgtaggtaagtctaccctatttaatgcaattactaaagctggcgcattagcagcaaactatcccttcgcaacgattgatcccaatgttggtatcgttgaagtgccagattcacgtttaataaaattagaagaaatggttcaacctaaaaaaacaattcctacaacttttgagtttactgatattgcaggtattgttaaaggtgcatctaagggcgaaggtttaggaaataaattcctttcacatattcgtgaagtagatgctatatgtcaggtggttcgtgcgtttgacgatgagaatgtaacacatgtatcagggcgtgttaatccgcttgatgacatagaagtcattaatatggaacttgttttagcagatttagaatctgttgaaaaacgtttaccgaaaatagagaagatggctcgtcaaaaagataaaacagctgagatggaattacgtatattaacacaaattaaagaagcgttagaagacggtaaaccagtacgcagtattgatttcaatgaggatgatcaaaagtgggttaatcaagctcagttattaacatctaagaaaatgttatacattgctaatgttggtgaagatgaaattggagataaagataatgataaagtgaaagcaattcgtgaatatgcagcaaacgaagattcagaagttatcgttattagtgcaaaaatcgaggaagaaatcgctacattagatgatgaagataaagaaatgttcttagaagatttagacatcgaagaaccaggtttagacagactcattagaacaacatatgatttgttaggtttatctacttactttactgccggtgtgcaagaagtgcgcgcttggacatttaaacaaggaatgactgcaccacaatgtgctggaattattcacactgattttgaacgtggttttattcgtgcagaggtaacaagctatgaagattatgtacaacatggtggcgaaaatggtgctaaagaagcgggaagacaacgtttagaaggtaaagattacatcatgcaagatggggatattgttcatttccgttttaatgtttaa

SEQ ID NO: 1721 - DNA, 1143 bp, Staphylococcus epidermidis
atctattacacaaggagaatatatatgaataagaaactattgtggagcatcattggtattgtaattattgtcgtattaatcattgctgcttttatattaaaacaagttaatggttcaggtagtaaagatagtaaggcatacgatacatatacagtaagaaaagaaacacctattagtttagaaggcaaagcgtctccagaatctgtgaaaacttataataataatcaatctgtgggtaacttcttaagtgtttcagtacaagatggccaaacagttaaacagggtgaacgtatcatcaattatgatacaaatgggaataaacgccaacaactagtgaacaaagtgaatcaagcacaatctcaagttaatgatgattatcaaaaagtaaatcaaagtcctaacaatcatcaattacaagttaaattgactcaagatcaaagtgctttaaatgaagctcagcagtcattgtcacaatatgacagacaactcaatgacagcatgaatgcatcatttgatggtaaaattaatattaaaaatgattcagatgtaggtgaagggcaacctattttgcaattaatttcttcaaatcctcaaattaacgcaactatcacagagtttgatattaataaaattaaagaaggcgatgaagtagatgtcactgtaaatagcacaggtaaaaaaggaaaaggaaaaattcttaaaatagatgaacttcctacaagctatgatacaagtgacgatagtacagcatcatcggcacaagcaggggcacaaggtgatagtgaagaaggaactgaaatgacgacatctaatcctacaattaatcagccaacaggtggtaaaagtggcgaaacatcaaaatataaagttatcattggtgatttagatatacccgtgagatcaggcttctctatggatgctaaaatccctcttaaaactaaaaagttaccaaataacgtattaacaaaagataataacgtatttgtcgttgataaaaataataaagttcacaaacgtgaaattaaaattgaacgtaataatggtgaaatcattgtgaaaaaaggattgaaatctggcgataaagtccttaaaagtccaaaaggtaatttaaatgatggagaaaaagtagaggtgtcatcatga

SEQ ID NO: 1722 - DNA, 453 bp, Staphylococcus epidermidis
ccatctccaacaatactaaaccagtctgttgattgttcgagagttttagactctgcaccatatatgaggtgtaatacaatgccaaatacgatacctattgctaaagcggtaaagacacgtttagggaatgagacgtgttttcttgccataatatttaacattactaggaaaacaagtaacacgatgacattaattactgtaaaaagtatttccatatcgatatatagctcctttttaatttttagtattccgacatatgtaataagaataaagggggttaagaagaaattcaagttgttgatttatagttttcagattcatttaaagttgaatagagtgaaggtgattattagaacaatgaaaaatgagaagtttatgtttatcagaaaagtgagcaaagaggacgtaaagaggtttatattaataaaaaagacgcgtgcaatcatgctataa

SEQ ID NO: 1723 - DNA, 300 bp, Staphylococcus epidermidis
actatgagaacatatgaaattatgtatatcgtacgtcctaacattgaagaggatgctaaaaaagcgttagttgaacgtttcaatggtatcttagcttcagaaggatcagaagttttagaagaaaaagactggggtaaacgtcgcctagcttatgaaatcaatgatttcaaagaaggtttctataacatcgtacgtattaaaactgataacaataaatcaactgacgaattccaacgtttagctaagattaatgatgatatcattcgttacatcgttattcgtgaagaccaagataagtaa

SEQ ID NO: 1724 - DNA, 216 bp, Staphylococcus epidermidis
ataataatgacagcaaatgttgtagtcatcacaatgacatttgaattttcagaaccgaatttgaatgttagaggaaacataatggagaaagtccctgcgccaccaatggcaacacatagtgaaatgaataccatacttaaactttgtgtgattagaccgacactaggtacacctgcaagtatcccaactaatgcacacaagagaaaaatagtataa

SEQ ID NO: 1725 - DNA, 1395 bp, Staphylococcus epidermidis
ggaggcgagactcttatggattttgatacgattacaagtatttcaacaccgatgggtgaaggtgctattggaattgtgagattatctgggccacaagctattgaaatcggagatatcttatataaaggaaagaaaaagttatctgaagttgagacgcatacaataaattacggtcatattattgatccagaaacaaatgaaacagttgaagaagtcatggtgtctgtattacgtgcccctaaaactttcacacgagaagatattattgagataaattgccatggtggtattttaacaattaatcgtatattagagttaactatgacttatggtgcacgtatggcagaaccaggtgaatatacaaaacgtgcatttttaaatggtcgtatagatttatctcaagcagaagcggttatggattttatacgttccaaaactgatcgagcttctaaggttgcgatgaatcaaatagaaggacgtttaagtgacttaatcaagaaacaacgtcaatccatattagagatactcgcccaagttgaagttaacattgattatccagagtatgatgatgtagaagacgcaacgacggacttcttactagaacagtctaagcgtattaaagaagaaatcaatcagttacttgaaacaggagcacaaggtaaaataatgagagaagggttatctacagttattgtaggacgtcctaatgttgggaagtcttcgatgctaaataaccttattcaagataataaagcaattgtgactgaggtcgctggtacaacaagagacgtgttagaagaatatgtcaatgttagaggtgtcccgttacgacttgtagatactgcgggtattagggatactgaagatatcgtagagaagattggtgtagaacgttctaggaaagctctaagtgaagcagatttaattttatttgtgcttaataacaatgaacctctgacggaagatgatcaaactttattcgaagtcattaaaaatgaggatgttattgtaatcattaataaaacagatttagaacagcgattagatgttagcgaactaagagagatgattggtgatatgccacttatacaaacatcgatgcttaaacaagaaggtattgatgaattagaaatacaaattaaagatttattctttggtggcgaagtacaaaatcaagatatgacttatgtatctaattcacgtcacatttcattgttgaaacaagcgagacaatcaattcaagatgcgattgatgctgctgagtctggtatcccaatggatatggtacagattgatttaacacgtacttgggaaattctaggagaaattattggagaatcagcgagtgatgaattaatagatcaactatttagtcaattttgtttaggaaaataa

SEQ ID NO: 1726 - DNA, 270 bp, Staphylococcus epidermidis
gagagtgctgctgagaataaactgctcgctttggcgtcagatttaaatattttagaaataactagaaagattaaaaatacaacaacaacactaaagattgttcctatgaaagcacctatagttgtagtcatacgtaacatattttcatccatttggctattagctatcgattggttatctaatagttcattgctagtattatatgtgatgaaagcgctaataatagctaatactatcactatgattgatttaagtatccattttggctga

SEQ ID NO: 1727 - DNA, 1116 bp, Staphylococcus epidermidis
gaggagctagctatgaaggatacagatttagctcaaattgctttaacacaagatcacactggcgcaattgccaatccaatatatttatctactgcatatcagcatcctcacctaggtgaatcaacaggctatgattatacacgaacgaaaaatccaacaagaacagcctttgaagaagcttttgcacaacttgaaaaaggcattgcttcatttgctacttccagtggtatggcggcgattcagttaatatgtaatatattcaaaccaggtgatgaaattctcgttgcatttgacctatatggtggaacatttcggttattcgatttttacgaaaaacaatatggtttgaagtttaaatatgtagactttttaaattatgaagaagtggaaaaaaacatcactccacaaactagagcattatttattgaaccaatctcaaatccacaaatgattgaaattgatgtagaaccatattatatccttagcaaaaaacatcaactattaacaattatcgacaacacttttttaacaccttatctttcgacaccactcgaagaaggtgcagatatcgttctgcattcagcaacaaaatatattggcggacataacgatgtgttagctggagttgtaactgttaaggatgctcaattagctgaacaattgaatcaattccataatatgattggagcaactctatcacctcttgatagttatcttttacaaagaggtctaaagacattacatcttcgcatagagcgttcccaagaaaatgctcaaaaacttgcacaacgatgtcgccagtcagattcaattgatgaagttttatatagtggacgaacaggcatgcttagtttaagactgaaccaagcatatagcgtcgctaaatttttagaaaatttagaaatttgtatatttgcagaaagcttaggtggtacagaaacatttatcaccttcccttatacacaaacacacgttgatatgccagatgaggaaaaagacaaacgtggcattgatgaatatctcatcagattgtccgtaggtatagaagattataacgatatagaagctgacataattcaagcattagagaattctaaagtaggagtgatttcatga

SEQ ID NO: 1728 - DNA, 765 bp, Staphylococcus epidermidis
agatatctttattatggaggaggaagacttttgaaaataaaaaggtatgcacttctatgtttattaggaggattagttggaggcatcatcggatacatcataggagctattaactgggagaagttatttaattatgcacagttcgctaactttaaagttgtgctttatacaaccatcgtagcatcattaataaatgttatacttactgtgtatttatttatagtccaaaacgcgtcacttcactataaagctaaaattgacgcaaatatttcagatgatttagcagatacatatgaaaataaatcatacatcaaatcattgaaagtaagatttatttacacaatgcaattaattgtcgcttttattgcaattttaatacccgtcataggaaattcatctgagaatcacattgctctaataatgattcctttctttattacaatcatttcatccataatgattgggatattttatagaaaatttgatgctcgataccctaaattaggagagaaacattacactgaaaaagcatttaatattatggacgaaggagagcgatacatcacactcgtttccttgtataaagtgcaccagcagaatattgtattactttttataggaattatgatgttgggaatattctcaataactacaggcatgaatcaatcgctaggcataattttgtttatcattttatttatctataattcattgggatatttactgaaagtcagtaatttttataaatcagaacagaaatcctaa

SEQ ID NO: 1729 - DNA, 201 bp, Staphylococcus epidermidis
ttaacatttcttcctttgtgctttaaattacttatttccgcaataaaagtgaaagcaactggactatccattccaatagcaaaccccattatacaacgacatattattagaataattacatttggtgcgagtgccgcaccaagagaggttacagtaagtgttagtaaggcaattgataaaatacgcttgcgtccaaactga

SEQ ID NO: 1730 - DNA, 1200 bp, Staphylococcus epidermidis
ggagatgaatatgacatgtcacgcatagtattagctgaagcatatcgaacacctataggcgtgtttggtggtgtatttaaggatatacctgcctatgaactaggtgcaacagttattcgtcaaattttagaacatagtcaaatagatcctaatgaaatcaatgaagttattctaggaaacgtattacaggcaggtcaaggacaaaatcctgctcgtattgctgcgattcatggtggtgtgccagaagcggtaccttcttttactgtaaataaagtttgcggttctggattaaaagcgattcaacttgcctatcaatctattgtagcgggagataatgagattgttatcgctggaggcatggaaagtatgtctcaatctccaatgcttcttaaaaatagtcgtttcggttttaaaatgggaaatcaaactttagaagatagtatgatagctgatggtttaactgataagtttaatgattaccatatgggtatcacagccgaaaatctagttgaacagtatcagattagtcgtaaagaacaagatcaatttgcattcgattctcaacaaaaagcatcacgtgcacaacaagctggtgtatttgatgctgaaattgtacctgtagaggtaccacaacgtaaaggcgaccccctaattatttctcaagatgaaggcattagacctcaaacgacaattgataagttagcacaactccgtccagcatttaaaaaagatggatcagtaactgctggtaatgcatccggtatcaatgacggtgctgctgctatgctcgttatgacggaggacaaagcgaaagcattgggcttacaacctatagctgtattagatagttttggtgcgagtggtgtggcgccttcaattatgggtattggtccagttgaagcgatacataaagctttaaaacgttctaataaagtgataaatgatgttgatatttttgaattaaacgaagcttttgcagcgcaatcaattgctgtaaaccgtgagttgcaattaccgcaagataaagtcaatgttaatggtggtgcgattgcactaggacatccgataggggcttcgggtgcgcgtactttagtttcattattacatcaattaagtgatgctaagccaacaggtgtggcatctttatgtatcggtggcggtcaaggtatcgctacggttgtatctaaatatgaagtttaa

SEQ ID NO: 1731 - DNA, 2073 bp, Staphylococcus epidermidis
gggaaaaatcttatagaggtgatttctttgacaaataataatagaataaaaagatttagcattagaaagtacgcagtgggagtagtatcaattattacaggtgtaacaattttcatcggagggcaacaagctcaagcagctgaaacttcagtgcaacatgcggatgcacacccagaagactcgcaaacaacacaacaattaaaaaatgataaggtagaagaaacgttaaaagcttcaaaacaaggtaatgctgatagtcaacaagtacaaacaattgatcaatctaaaacaaatcaaaacaaccaacattctgtagctgaaagtgcacaactgaaaagtgatgagacagctaatcagccaaaaaaagaagaaagtagctcagtaaaacaagacgtccaaccgtctaaaaatgtaaatcaacaagacgcagctactcaatcaaatgagagagaaaataatgacataaaaggtgaaggtcaaacttcaaagacgagcaatcaacatattcagagttctaacagtcataatcaatcaacaggaacaaaagacagcgactcagaagaaatcgaccaaccattagtgaaattacaaaagccgtctaatgattctacatatcaaacacaatcaaaaacaaaacaagatagttctaaacaactccctcaagaaaaaacaacaaaacgtcaaattcaaacaactgaaaatgaacagacaactaaagttgattctaaaaaagctaatgacactcaaaatgttgaaaaacatactcaagagcctaaaaatgatacatcaacatcacaaaaaaatcatcatcaagtagctacaaaagaacaatctaatagaagtacaacaaggaagacgcaaaagcaatcatcaaatgctaatcaaaatcatcagtttacacatcaagcacagttcaaaaaccaatatccagtagtatttgtccatggtttcctaggctttgcaggtgataatcaatttagtttagctccaaaatattggggtggtacaaaatacaatattgacagaaatttaactaatgagggttacaatgtacatgaagcaaatattggtgcttttagtagtaactatgatcgcgcagtagaattgtattactatgtcaaaggaggacgtgttgattacggtgcagcgcatgcagctaaatatggtcatcatcgctatggtcgaacatacaagggcatcatgcgtgattgggaacctggcaaaaaaattcattttataggtcacagtatgggtggtcaaaccattcgtcaaatggaagaattcttaagaaatggtaaccaagaagaaatagaatatcaacgtcaacatgggggcactatatccgatttatttacaggtggtaaagataatatggttgcttcaattactacacttggcacaccacataatggtacacctgctgcagataaaattggcacacgtaaacttgtaaaagaaacgattaatcgtattggtagattaagtggtggtaaagatgtagatatagatttaggtttttctcaatggggattaaaacaacaaccaaatgaaagttacattgattacgcggaacgtgtatccaaaagtaagatttggaatactgaagatcaagctgttaatgatctgacaacgcaaggtgctgaaaaaattaatcaacaaacaagtctaaatcctaatattgtctacactacttatacagggtcagcgactcacacaggacctcttggtaatgaattacctaattctagtgaaattcttttattgaacttaaccagtcgtattattggtaaagatgtaaacaaagaaattagaccgaatgatggtgtagttccagttatatcatcacaacatccttctaatcaagcctttaaaaaagttgatgatcatacaccagctactgataaaggtgtttggcaagtgagacccgttcaacatgattgggaccatttagatttagtaggtatggatgcatttgatttaacacatacaggtagagaattaggtcaattctatctaggtattatggataatatcatgagaatcgaagaagcagacggtattacaaataaataa

SEQ ID NO: 1732 - DNA, 897 bp, Staphylococcus epidermidis
ttgatacttcattttagttataataacatcaaaattatatttcatataattgcacttaatattaaattcattataaaggagtcgtttatgttaaagaaattttcttactcaatcatttcactttcaattttcgctactagccttaattttatagatactcaagcacaagcgtcttcatcttctgtaagcgaaaaaggtacaatggggtatggctatcaacaatacttaaaagaccatcctaaaaagcaaactcataaaacacaaaatcgttctactttctctgctgaatctaatattactgaaacaaataatggtgaaagagtcttagatatttctgaatggcaaggacttttaactaatgaacaaataaaacaactaaagaaaaattatgattttattattttaagagcacagtacggttcagaatacgttgataagacttttgaaaaaaatgcagaattattagaacaaaataaaatgaaatacggcgtgtactcttatagcatgtacgaaagtccaaaagatgcacgttatgaagctaaaactttatctcaacgtgctcccaaagccgccttttacattaatgattatgaagaacaaaccgttaaatccggagatgatgaaacagcgacacaagcatgggcaaacgaaatgagaaagcttgctggaaacaagaagatccttttttattcatatgaaaatttcatgttaaatcatgcatcaaatgctgtcagttcatatgatggctactggttagcagcatatcaagctgaggaaccaaaacgagagaaagtgctatggcaatatacagatagttactactctcctgaattaaatcaaaatgtcgatgcaaattatattgacgaaaatgtgaattcgtcttggttcacttcataa

SEQ ID NO: 1733 - DNA, 1527 bp, Staphylococcus epidermidis
aatatgcttaatgctgatttaaagcaacaattacaacaattacttgagcttatggaaggcgacgttgaattcgttgccagcctaggctctgatgataaatcaaacgaactcaaagaattattaaatgagattgctgagatgtcagcacacataacaataactgaaaaatctttaaaacgtacaccaagtttttcagttaatcgccctggtgaagaaacaggtattacattcgctggcatacctttaggccatgaattcaactctttagtattagctatactacaagtgagtggtcgcgcacctaaagaaaagcaatccattatcgatcaaattaaagggctcgaaggtccatttcatttcgaaacctttgtaagtcttacttgtcaaaagtgtcctgacgtcgttcaagcattaaacctaatgagtgttattaatcctaacattactcatactatgattgatggcgctgttttccgtgaagaatctgaaaacattatggcagttcctgccgtcttcttagatggtcaagaatttggtaatggacgcatgacagttcaagatattttaactaaattaggaagcacgcaagatgcctctgaattcaacgataaagatccttatgacgtgttaatcgttggtggcggacctgcaagtggtagtgctgcaatttatacagcacgtaaagggctacgtacaggtattgtcgctgatcgaattggtggtcaagttaatgatactgctggtatcgagaacttcatcactgttaaagaaacgacaggttcagagttctcatcaaatcttgcagaacatattgcacaatatgatattgatacaatgactggtattcgtgctacaaatatcgaaaaaacagattcagctattcgcgtaactttagaaaatgatgctgttttagaaagtaaaactgtcatcatttccacaggtgcaagttggcgtaaactaaacatcccaggcgaagaccgtctaatcaataaaggcgtggctttctgccctcactgtgacggacctttatttgaaaataaagatgttgctgtcatcggtggtggtaactctggtgtagaagcaactattgatttagccggcatcgttaaacacgtaacattatttgaatacgcttctgaattaaaagctgatagcgtattacaagaacgtttacgctcactacctaatgttgatattaaaacgagtgctaaaacaacagaagtaattggtgacgattacgttacaggtattagctatgaagatatgactaccggagagtcacaagtagttaatttagatggaatatttgtacagattggattagttcctaatacatcttggttgcaaaatgctgtcgaattaaatgaacgtggcgaggttatgattaatcgcgataacgcaacaaacgttcctggtatctttgcagctggtgacgttaccgatcaaaaaaataagcaaattattatttctatgggtgctggtgctaatgccgcacttaatgcattcgattatataattagaaattaa

SEQ ID NO: 1734 - DNA, 1200 bp, Staphylococcus epidermidis
cacgtgaataacttttcaaatgtcatatcagttgctattcgttccattttaaaaaacaaacgacgtaatatctttacgatgattggaataattattggtattgcatcagtaattactatcatgtcgttggggaacggttttaagaagtcaacgactgagcaattcaatgatgctggtgctggtaaaaatcaagcttcaatttcttacatgacagaaaatatggaagcgcctaaaaataatccatttaagcaagaggatatgagtgttgttgaacaggttaatggtgttaagagtgctaaagtaaaagaggataaggatagcacatattcagtcaaaattacgaatacacatggcagtagtgatgctagtttaaaaaaggttgataaactgacagatgtagatgaaggaaaaggatttacgaatgatgataatgaagtgctagaaaaagtagccgttatagataaaaaaattgctaaaaaagtattcaataatcatgcaatggggcaatccatctatataaatggagaagggtttaaagtcgtaggcgtctctgatagctcagaagttgatgaaagtgggatgcctattgagtcattaattcaaatacctacaaaatcatttaataaatatatgggcaatttgacacaaggtatgcctcaattattagttacagttgaaaaaggttcagataagaaagacgtaggtaaaaaggtcgaaaaagcgttgaataaaaaaggaactggtgtatctgaaggtcaatatagttatgaagataatgaagcagtaatgaaaacgataggttcagtcttagacacgattacttactttgtctctgctgttgcgggaatatcactctttattgcaggtattggtgtaatgaatgtcatgtatatttcagtcactgaacgaacagaagagattgcaattcgtcgtgcatttggcgctaaaggtcgagatattgaaatacaattcttagtagaaagtgttgtgttatgtctcataggtggtatcatcggattaattctaggtattattattgctacattgattgatctcgtgacacctgaaatggttaagagttccgtcagtctaggttccgtcatcctagctgtaggtgtatcaacattgataggcatcattttcggttggatacctgcacgttcagcttctaaaaaagaattaattgatattattaaataa

SEQ ID NO: 1735 - DNA, 603 bp, Staphylococcus epidermidis
aaacatatcaagggagccataataatgaagaaagaaataatagaatggattgtagccataatcgttgcaattgttatcgtcacacttgtgcaaaagtttttatttgcttcttatacagtcaaaggagcgtctatgcatccaacatttgaaaatagagaaaaagtgatagtaagtcgtatagcaaaaacgcttgatcatattgatacaggagatgtagtgatttttcatgctaacgcgaagcaagattatattaagcgacttattggtaaaccaggtgattcagtagaatataaaaaagatcaactatatttaaacggtaaaaaagtagatgagccttatttaagtgaaaataaaaaacacaaagttggagaatatctaacggaaaactttaagtctaaagatcttaagggtacgaatggcaatatgaaaattcctagtggtaaatacttggttttaggtgataatcgtcaaaacagtattgacagtcgcatggatgaagtaggtcttttagataaaaatcaagttgttggaaaagtagttttgagatactggccatttaatcggtggggcggtagttttaatcctggaacatttcctaactaa

SEQ ID NO: 1736 - DNA, 285 bp, Staphylococcus epidermidis
aaatatttaaagcaggtattttacatgcaacataaaaataaatttcaacgtattaaccaaattatacaagttataggtttcctttcatttttagcaattctcactatcattacacttaacttttttataaaaggacacttacaaggtcattttgaaataggttttaatattcaaagtaatcaagtctatgtagtaacgacactaatcatagttacaatcatctgtactatattatcagctattctaaacatgctttctaataaaaaacaaaattacaaacattaa

SEQ ID NO: 1737 - DNA, 186 bp, Staphylococcus epidermidis
gagtttaaaaagaaagaggtacgcttttcctatactaatctcgaactactttataaacattcgttactcaatctaaatctttgttcttcatttctatcaaaaaggcctactgcatttgaactaaatttcgagttattagttgaattatcaattaattcgtatatcaatgtttctaatcaactctag

SEQ ID NO: 1738 - DNA, 846 bp, Staphylococcus epidermidis
attatggaaaacttattagaagttcagcaactcaataaatcatataagaattcagaatttcagcttactgacatcacattctctgttaaacctggcgaggtagtgggtttaattgggaaaaatggttcaggtaagtctaccctcattaatacacttgtaggaaatagacataaagataatggttcactgaaattcttcgataaagaggtgacagagaacgacttcaaatataaagaacatttaggtgtagtttttgatgatttacgtgttccagataaattaactctacaatatatcaataaagtttttactgaaatatatgatgcttggaacagcgatacattcttttctttaatcaaagcatttgaactaccaacaaataatcaaattaagacattctcaagaggaatgcgtatgaaagcagctttaacaattgctttaagccatgatgctaaattattaatcttagatgaagctacagcaggtatggacgtatcaggacgtgaacatgtgttagaaattctagaggattatttaggagacgatcgtgccatattaatttcatcacatatttctgaagatattgaacagctagctactcagctcgtttttatgcgtgatggtcgaattattttaaaagaaagtaaagaagttttattgagccaatacggcatcatcgatcaaccagttgagcatttcaatatttcaaatgagtatctaatcgcaacgcgcagacgtaatgatcgacaaatcagtttagtgaataactatcaaaaagtacctgatgcacaaccactaaagacaatcgatgatgcaactaaaattattatgcgaggtgaagtataa

SEQ ID NO: 1739 - DNA, 645 bp, Staphylococcus epidermidis
agtataatgaaaggtcttactcttagtatattttatacagctaaaaaatcatttttcatctatttagtagtcggaattattgctgcagtcgttttctcatttttaaatccaacgatgaacagctttcttgctatcatttttttaatatctcctattacggataacttcaaacgtgaaaaggactcaagatggatgaattacatatccacacttcctgttagaagagctgattatgttaaaagttattatactatttttctcttgtgtgcattagttgggatacttgcaggtgtacctagtgtcggtctaatcacacaaagtttaagtatggtattcatttcactatgtgttgccattggtggcgcagggactttctccattatgtttcctctaacattcaaattcggttctgaaaattcaaatgtcattgtgatgactacaacatttgctgtcattattatctatttcttattctatatcgcatcaatgatattgagtaatcaaacaggaagtggctctatgattacaatgctgagcaacacacaaagctatgttgtatattctatttatggaatacttggattgatttcaattattatctcttatattttatcgattaaaatttttaacaaacaagaactataa

SEQ ID NO: 1740 - DNA, 486 bp, Staphylococcus epidermidis
  unsure (16),(17): Identity of nucleotide at the above locations are unknown.
caactggtgaagttgnnaagcgcctctttgccaactatccaaaattctcaagaggtgattcagtcagcacaagaacaacaatctaaagacatcgctaaagctaacgaattaaaagatagtgaattacgtagtcattttgattcaatgtcaaatagcgcttcaatatctcagagcaacgtcgcaagtcaaagcactacagcaagtttgaaccaatctgaatcagcaaatgattcaatgagttcatctctgtccgagtctaactcaataacatccgaaagtaatacaaatagcaaatcggaaattgaatcaaaaagtacgtctacaagcgagttcttgtcagaatcaggaagtgtatctaactcagaaaaatctgagtcaatttctcattctcaatcaacatcagctacaccttcttctcaatcgacttaccaacaacaacctaaagaagagaagaaaggtttctttgcacgtctatttaacttataa

SEQ ID NO: 1741 - DNA, 915 bp, Staphylococcus epidermidis
atgaattatgaaaaaaatgaaagggagggcatattttatatgaatcaacttaaacatattttatcttcattgttcgaacctttaacaaaggttgaaacatatgaaaatttaattactaaagtaataatgattttaatttatatccttgtagcgattgttgttatagcaattttgaataagattattgagcaagcatttaaaattcaaaataaaagcaaaaaaggaaataaaaaacgttcaaaaacactgatttctcttgtacaaaacatagtaaaatatatcgtatggtttgttgttatcacaacaattttaagtaagtttggtattagcgtcgaaggtatcatcgctagtgctggagttgtaggtattgcagttggtttcggtgcgcaaacaatagtaaaagatattattacaggtttctttattatctttgaaaatcaatttgatgtgggtgactatgttaaaatcaatagttcaggaactacggtagcagaaggtactgtgaaatctattggtttaagatcaacgcgaattaatacaatttcgggagaactgactattttacctaatggtagcatgggggaaattacgaacttttcaattacaaatgggactgctattgtagaactaccagtatcagttgatgaaaatatagatcaagttgaaaagaaactcaatcgtttatttgtttctttacgtagtaaatattacttatttgtcagcgatccagttgttgatggcattgatgcgatagaatctaataaggttactatacgaatttcagcggaaacaattcctggtgaaggattttcaggcgctcgtattattcgtaaggaagctcaaaaaatgtttagacaagaaggtattcgcatgccacaaccagtcatttcaaattataatgaagaaaaaagctaa

SEQ ID NO: 1742 - DNA, 213 bp, Staphylococcus epidermidis
aatacatatgaggtgtttttcatgagattaaatttagattggaataaagatttccaagagtttcaagatatcttaaatagtggcattcacccagaatggctatactgcgctaaagcaaatttagttctcgaacccgcatacactggtgaaggcaaacaattttttagtacacaagacatcattaaagcaagcaaaatcattccatttttttaa

SEQ ID NO: 1743 - DNA, 1191 bp, Staphylococcus epidermidis
agtaggagtgatttcatgagtttatctaaagaaacagaagtaatattcgatgtgcgtagaggtaatgactacgactcagctaacccgccactttacgattcatctacattccatcaaaaagtgttaggcggtgagactcaatatgattatgcacgaagtggtaaccctaaccgaactttacttgaagagaaacttgcacgtttagaaggtggtaaatatggatttgcttatgcttcaggcattgctgcaatttcagccgttttactcacattaaacgcaggggatcatgttattttacctgatgatgtttacgggggcacatttagattaactgaacaaatactcaatcgattcaatattgaatttactacagttaacgctacacatatagatcatatcactgaagctattcaatcaaacacaaaactcatctatgtagagacgccttcaaatccacttttcaaaattacagatattcatgctgtagcaacgctagcaaaggaacataagatactattagctgttgataatacgtttatgacacctttgggtcaatcacctttagcactaggcgctgacatagttattcatagtgcaactaaatttctaggtggacatagcgatttaattgcaggtgcagcaattactaataatagagaggttgcaaatgcattgtacttattacagaacggcacgggcacagccctttctgcatatgatagttgggcacttgcaaaacatcttaaaacattaccagttcgttttaaacaatctgttcataatgctgaacgccttgttcaatttttgagtcaaagagaggagatttctgaggtgtattacccgggaaataatcttacacatctcaagcaagcttcaactggaggtgcagtgataggtttccgacttaaagatgaatctaaagcacaaaagttcgtcgattctcttactttaccacttgtatcagtgagtctcggtggtgtagaaactatcctatcacatcccgcaacaatgtctcatgcagcagtgccagaagatgtgagacgtgaacgtggcatcactttcgggttattccgtttaagtgtaggtcttgagaattcagaagaactcatcgcagattttaactacgctttaaaggaggctttcaatgagtcatttactgaaccaattaaagagcaacgttttagtagctga

SEQ ID NO: 1744 - DNA, 660 bp, Staphylococcus epidermidis
aagaaaggtgacaaaatgaaacagctattatttaaaacaagttgcgtaataatggtacttctcacgtcttctttaagtattgtcagtacatattctcatgcaacaacgtcaggaggaacgagtagttccagtttggcaagttctagttcaagtagcagtgcagcttctgcatctagaggttcaacttcttcaagtacaagtatgagtcgttctagtgcaataaatgcgtctcgcaatgcacaacaatctagtcagcgtgctgcccaacaagcaacaaaatcaagtcgtgtaacagcaaccaaaaataaaggacaacaaagtgtatcaagacaaaaagcacaatctcgttctttgatgccgtctcaaagaccttatgattcaagtgcaccatactcatctcaatatattgctacaacttattataataattggttattctattatatttttgcacattcgtttttaaatcaacatgaaaagaaaaacagtgtagatgctcagtttaatatgttgaaacaacaaatgaagcctcatgagaaactttatactgttactgtaaagactaaacaaggaaagcgtgtcgttgttgtacctaaaaaacaatatgacaaaattgaaaaaggaaaacacattaaagttaaaaatggtgttgttcagtaa

SEQ ID NO: 1745 - DNA, 765 bp, Staphylococcus epidermidis
tacgagctagaggtgaggcaaatgtcacagtatccactttggaatcaattaaatactttaaaagaggctcagtgggtcgatttaacacatactttcgacccaaatatccctcgttttagcgaatttgaaaaaggtgaagtctcaacgctattcaatgttaaagatcatgggttttatgtacaacgttggagtatcgtaactcaatatggaacacacattgatgctccaatccatttcgttgaaaatagaagatatttagaagaattagatttaaaagaacttgttttaccattaattgttttagattattctaaagaagctgcacaaaattcagattttatcgtatcacgtaaacatttagaagactgggaacaacaacacggtcgcattgaagcaggtacttttgtcgcattacgtactgattggtcaaaacgttggccagatatagaaaaatttgaaaataaagatgtagatggccatcaacatcttccaggttggggccttgatgcattaaaatttctcattgaagaacgtggtgttaaatccataggtcacgaaacatttgatactgatgcctcaattgatacagctaaaaatggtgatattgttggcgaaagatatatcttaggtcaagacacattccaagtcgaattacttaccaatttagatcaattacctaccagaggtgcaattatctatgcaatcagcccaaaaccaaaagatgcaccaggctttccagttcgtgcattcgcaataaaaccttaa

SEQ ID NO: 1746 - DNA, 870 bp, Staphylococcus epidermidis
attaagatagaaagatgtggaaaagagatggcatatacagatgatcagaggttgaaaatgaataatgatgatagtgtgcaatttattgaactagaattaattagacctaatccttatcagccacgtaagacgtttgaagaagaacgactcaatgatttagcttcatcaattcaacaacatggtatattacagcctattgtattacgtcaaactgttcaaggttactatattgttgtgggtgagcgacgatttagagcatctaagttggcgggattaacagaagtgccagctattattaaagaactatctgatgaagatatgatggaattggcaattattgaaaatttacagagagaagatttaaatgccattgaagaagcagaaagttataaaaaaatgatgacagatttgaatattacacaacaagaggttgcgagacgattaggtaagtcacgtccttatattgccaatatgcttaggttattacagttacctaaaaatgttgctcaaatggttcaacacggggcgttatctagtgctcatgggcgtacgttattaactttgaaagacgccagtaaaataaaaaagacggcaaaacaagccgctcaggagtcttggagtgtaaggtatttagaggagtacgtcaatggtttagtcagtaaagacatctcaaggaaagttgacaaagagactaaggaaagtaaacctaaaatgattcaacagcaggaaagatttttaaaaaagcaatatggtgcgaaagtagatatttcgacatctaaaaatgtcgggaaaatcacgtttgaatttaaatctgaagcagaattcaaacgcttgattcgtcaacttaataaagattataaggaatattaa

SEQ ID NO: 1747 - DNA, 561 bp, Staphylococcus epidermidis
cacataaaagaagggataaacatggctggaagaccaaaagatccaacaatcaataaaaaaatttatactgagattcaacgtttattggaaacgactcattttagagatattactatagatcaaatttctgagaatactggtatttctaaagcaactatttatagacgttggaaggataaatcttcaattatcatgtccgcgtttattgaacaatctcaatatattgtgattcataatcaagataatttatatgatgatttattccagtttttagtgaaaataaaagatatctataaaacaaaactaggtagtgctgtgattgaaatattaattagtcatcaacaaatggaagctagagaaacttttatgactaattactttaatcataatcgcaaagttttaaaagagattgttcgtaagcacatacaagaggaagaacaagatttgtttattgatttaatcttctcacccatctattttaatatattaattaaacctgaaactctggataaaaattacattaaaaagatgttgaatcaagttttacgtatatatcattga

SEQ ID NO: 1748 - DNA, 354 bp, Staphylococcus epidermidis
tgtttaatggaaaaagcatatcgtattaagagaaattcagactttcaagcgatatacaagaatgggaagtctgttgcaaatagacaatttgttgtctatacctataaaaatagagatttaaaacattttcgcttaggaataagtgtctcaaaaaaactgggcaacgctgttacaagaaatagaattaaaagagcgataagagagaattttaaagtgcataagcaaaatattatcgctaaagatattatagttattgcgaggcaaccagcaaaagatatgaatacactggagattcaaagcagtttagagcatgtgcttaaaattgcaaaagtgtttaataaaaagattaagtag

SEQ ID NO: 1749 - DNA, 651 bp, Staphylococcus epidermidis
tacgtaaaggagatatattacatgagtacacaggaattaaaagaaaatgatattcagaactcaagtattccatttgttaatcattttaacaaactaagacatcagccaaaatggatacttaaatcaatcatagtgatagtattagctattattagcgctttcatcacatataatactagcaatgaactattagataaccaatcgatagctaatagccaaatggatgaaaatatgttacgtatgactacaactataggtgctttcataggaacaatctttagtgttgttgttgtatttttaatctttctagttatttctaaaatatttaaatctgacgccaaagcgagcagtttattctcagcagcactctcttattcaatcattattttaggatttacaattattatttctttaattcaaatagtttttggactaaagataacagactataagcttgatagcttaaacattttttcaaaggataataaaacactcatggctttcagtttaactaatcttttaaaagcctttttaactggtgttgtttattactcaacaagtcgtttatctaaaaaaacatctatgatattaggaatcattgcactcatcatattaataggatcaggtatgctaggtggaatgaatggctaa

SEQ ID NO: 1750 - DNA, 642 bp, Staphylococcus epidermidis
aaggagttactcaattctatgaaaaagagagtcattacatacttgatactagcgttgtctttaacacttgcagcatgctcaaatacgaacgataacaataatcaagagcatcacagcaacgctcatgcacctaaaaacgctaaaactttaaaggaaaaagatatcttttcttcaaacaaaaagggacaaaaaattagcgaaaaagagatgaagcaagctttagaaaaatatttacaagcgaatagcgatgtacttgataataagtatgtcatgcaacataaattagataaacaaagtgatagtaatcctaaaatcacagaatcacaagctgatcgtcttagcaagttatccaatttagcagttaagaacgatttacatttcaaaaaatttataaaaaacaatcacatccctgaagaatataaagatccaacagatcgcataattaattattttcacgctttaaatagtaccatttcaaatgtagatgcagacattgagaaattaaactaccaaccacaaaattcaattaacgttgttgatgtacccacaaaatattcaggtgatgtaaataaaaaacaacaagataaaattactactttccttaagaaaaaaggaatagacacagaagtatttaataaataa

SEQ ID NO: 1751 - DNA, 2277 bp, Staphylococcus epidermidis
atcaatcactgccaacaaggaggcaatattatgacaacaattaaaacttcaaacttaggattcccaagattaggtagaaaaagagaatggaaaaaagcaatcgaaaattattgggcacataaaattgacaaagcagaactagatcaaacactgactgatttacacaaagaaaatcttttacttcagaaaaattatcatcttgatagcattccagttggggatttctctttatatgatcatattttagaaacgtctttattgttcaatattatccctgaacgtttccaaggacgcgaagtcaatgatgatttattatttgatattgctcgtggtaacaaagagcatgttgcaagtgcacttattaaatggtttaacaccaactatcactacattgtacctgaatgggacaacgtagaacctaaagttgaaaaaaatacgttattagaacgttttaaatatgcacaatcaattaatgtaaatgcgcatcctgtaattgttggtcctatcacatttgtaaagttatcaaagggtggtcatcaatcgttcgaggaaaaagttgaaacattacttcctttatataaagaagttttacagtcacttgtagatgcaggtgcaaagtatattcaaattgacgagcctattctagtgactgatgacagcgaaagttatgaagacattactagaaaagcatacgactatttcgcaaatgaaggtttaggaaaatatctcgttattcaaacttactttgaacgtgttcacttaaaattcttaagttcattaccagtgggcggtttaggattagatttggtacacgataacggctataacttaaaacaaattgaagatggtgatttcgatcaaagtaaagcactttatgcaggaatcattgatggccgaaatgtatgggcggctgatattgaagcaaaaaaacaattaatcgaaacattacaacaacacacacaacagttagtcattcaaccttcatcatcacttctacatgttccagtatcactagatgatgaaacacttgatgaatctattgcagaaggattaagttttgctactgaaaagttagatgaattagatgcattgcgtcgtttattcaatgataatgacctgtcaaaatatgaacattacaaagcacgttatgaacgcttccaaagccaatcatttaaaaatcttgaatacgattttgaaagtgtaccgacacatcgtaaatcaccatttgctaaacgcaagcaattacaaaaccaacgtctaaatttaccagatttacctacgactacgattggttcattccctcaaactcgtgaagtccgtaaatttagagcagattggaaaaataatcgcattacagacgctgagtatcaagaatttttacaaaatgaaatcgctcgttggattaaaatccaagaagatattggtttagacgtacttgtacacggtgagtttgagcgtaacgacatggttgaattttttggggaaaaacttcaaggtttcctagtaacaaaattcggttgggtacagtcttacggttctcgtgcagttaaaccaccagttatatatggagatgtgaagtggactgccccacttactgtaaaagaaacagtatacgcgcaaagcttaactgacaaaccagtaaaaggtatgcttacaggcccagttactattttaaactggtcatttgaacgcgtagacgtacctagaaaggttgttcaagatcaaattgccttagccattgatgaagaagtgttagctttagaagaagcaggtatcaaagtcattcaagttgacgaaccagcattacgtgaaggcttacctctacgctctgaatatcacgaacaatatttagaagatgctgtacattcatttaaattagcgacatcatctgtgcatgatgaaacacaaattcatacacatatgtgctattctcaatttggacaaatcattcatgctatccatgatttagatgcagatgttatttctattgaaacttctcgtagtcacggagacttaattcaagatttcgaagatattaattatgatttaggaattggattaggtgtttacgatattcacagtccacgtattccaaccgaagaagagattactactgcaattaatcgttcattacaacaaattgatcgttctctattctgggttaacccagactgtggtctaaaaacacgtaaagaagatgaagtgaaagatgcattaacagtgttagtcaatgcagttaaaaagaaacgtcaagaatctgaatcaacaacagcataa

SEQ ID NO: 1752 - DNA, 384 bp, Staphylococcus epidermidis
tctagtttatgtttaaattgcgcagctattttattctggcttatattaaaatcatctggagaagtcatttctaaagttgtattagtattagattgtgtaattgccgcgaagcaaagaatactaaccgtgaaagctgaaatgatagcaataactgtgagagacatcgcatttttcttcattctgtgcatgatagatgatgtaaagacaacgtctgtgatatttacacgaccatgtttgatatgttttagtgttttaaaaataagtgatacagaacttctaaagaataagaaagcaccaacaatagttaaaaaaagtatgctaaaaggtgtaatcaaagcagttgttaaggctttaaaaacaccaaacatttcagtagacatataa

SEQ ID NO: 1753 - DNA, 510 bp, Staphylococcus epidermidis
atgttaaatcgagttgtattagtaggtcgtctaacgaaagatccagaatacagaaccacaccctcaggcgtaagtgtagcgacatttactctagcagttaatcgtactttcacgaatgctcaaggggaacgcgaagctgactttattaactgtgtagtcttccgtagacaagcagaaaatgtaaataactacttgtctaaaggtagtttagctggcgttgatggtcgcatacaatcacgtagttatgaaaatcaagaaggtcgtcgtatttttgttactgaagtcgtatgtgatagtgttcagttccttgaacctaaaaatgcacaacatggtggccaacgttcacagaacaataatttccaagactacggtcaaggatttggtggtcagcaatcaggacaaaatacatcttacaacaacaataattcatcaaactcaaatcagtcggataatccgtttgcaaatgctaatggaccgattgatatcagtgatgatgatttaccattctaa

SEQ ID NO: 1754 - DNA, 183 bp, Staphylococcus epidermidis
aatattatacgtttatctaatataaccgctctttcattgagtgacgcaatacaagttttctttgctatggttaagatgttattaggtacatttaatatgattattaatgttgatatttgctatttggatattttattgcacagaattttttaccgttatactattaaagataatgcactgtaa

SEQ ID NO: 1755 - DNA, 210 bp, Staphylococcus epidermidis
tacaatttgcgcaatagacttaaagaattacgagcccgtgatggatataaccaaacagagcttgctaaaaaagctggaatatcacgacaaacggtgtctttaatagaacgcaacgattttacaccatctatattaaccgcaataaaaattgcaagaatctttggtgaacctgttgaagatatctttattatggaggaggaagacttttga

SEQ ID NO: 1756 - DNA, 237 bp, Staphylococcus epidermidis
agaaaaaagctaatcatcattggaggtcatttcatgacgtcaaagtatggaataaatgatatagtagaaatgaaaaaaccacatgcatgtggaacaaatcgttttaagattattagaatgggtgctgatattcgtattaaatgtgaacattgtcagcgcagtgttatgattccacggcaagtgtttaataagaaaatgaaaaaagttcttgaatctcatcaagacaaagaaagttag

SEQ ID NO: 1757 - DNA, 243 bp, Staphylococcus epidermidis
tcattgcttagaaagaaagtgatgcatttgatgatgatagatcataatggaatttttctatgtaaatttggtaatataatgtggaatgtgtttactgcaattaaagtatgtaatactcatttaaatacaatgaaggtaagagataaactcttaaataatagatttgaatatccaaatataatgacaataagaaaagaaggtttgcttcttccctcatttttagaaaagtataagttatattaa

SEQ ID NO: 1758 - DNA, 711 bp, Staphylococcus epidermidis
tggagaaaaagtagaggtgtcatcatgattgaattgagaaaaatcaatcgacactttaaaaatggaaatgaatcaaatcatattttgaaagacatagatattcatattgatgaaggtgaatttattgctatcatgggtccgtctggttcaggtaaaagtacgttaattaatatcttgggatttattgatcgtggatatgaaggagaatacttttttaacaatgagaattatcaaaaaagctcagataataagctcgcagaaattcgaaatcatactgtaggtttcgtctttcagaattttaaattgattcaaaataacactattttagaaaatgtaagtattccgctaatttataatggtttgagtaataaagcgagaaaaagcaaagttttagacggacttcatgacgtcggtctaaaaggtaaagagaatctcttaccaaataaattgtcaggagggcagcaacaacgtgtagctattgcccgggcaattattaatgaccctaagtttattattgccgatgaacctactggcgctcttgattcgaagacatctcaagatattatggagcttttcgtaaaactgaacaaagaacagaatacaactattattatggtaacgcatgatcgtgaagtggcggaaaaagctgatcgtattatccatattttggatgggcgtgtgcaagaggaagaggtgttgacacgtgaataa

SEQ ID NO: 1759 - DNA, 402 bp, Staphylococcus epidermidis
atggagaaaaggagtattaatatgaaaaaagtatttatgatcataagtatacttaccataactgttactttaagtgcatgtggaggttctggaaaacaaaaagagccatctaaggaaagtcaaaaatctgataaatatgattatgtttattatgaaatattaaatgatggagattctgaaacgccaaatgttgagattaaatataaagataaaaaaggtaaatcacatatagaaaaagctgatttagatcacgtgtatgaacatatactaggtgatggtaataaaaaaccatatattgtaaaggatgggaagaaaattcatgtatatcgaccaccatatatgatttatggtgatgatgatgttgaaggcaaagccgtttcgaaagatgaagttacgaagtaa

SEQ ID NO: 1760 - DNA, 273 bp, Staphylococcus epidermidis
aataaaatgagtcaaaggaggcagttaaccatggcaggtggaccaagaagaggcggacgtcgtcgtaaaaaagtatgctatttcacagcaaatggtattacacacatcgactataaagacactgaattattaaaacgttttatctcagaacgtggtaaaattttaccacgtcgtgtaacaggcacttcagcgaaatatcaacgtatgttgactacagctatcaaacgtgctcgtcatatggctttattaccatatgttaaagaagaacaataa

SEQ ID NO: 1761 - DNA, 399 bp, Staphylococcus epidermidis
aaagaaatgaggaaaatcattatgaagatacgtttaacatttattatcttagcaatactatccaccatcggcttagtacttgttttagcaaaatatccaacaggcccacacacaatcaactataacgaaccttatacagtactcatagccattacgacaatagttataatggctttaccagcactcatattaggtatatttaatcatcttgcatgtagaatcatatcggcgatattacaaataagtgcactgatgatgtgggggtttttagtaatcattagcttaattatgggacaaattgtcattatgcttatggcttccttaacgatacttgcattacttgttagttctattgtcacactttcagtgcacccatctacttcagataaaataaattaa

SEQ ID NO: 1762 - DNA, 381 bp, Staphylococcus epidermidis
atatggatgagaagggttattgtgtttggtatatcaatttctagtgctatactacatttcgttatcggaggatttgctgttgcacttgcatcaattatggctgataaagtaggaggaaaattaggtggcattattgccacaatgccggcagtctaccttgcagctattatagcgttagctatagaccataaaggacagcaacttattcaaatgtcaattcatttaagtacaggagcaattgttgggattgtctcatgtattgtaactgtgttctttacttcaatttttattggtaagaaaaattatagaagtggaacagtatttgcaattctttgttggtttgtgatttctgttgcgattttcttagtcagacatatttaa

SEQ ID NO: 1763 - DNA, 771 bp, Staphylococcus epidermidis
aggagtgagaggatggctattttaacagcaaatcaattatcaaaagtatatggtcacaaacaaaaatatcgagctttaaataatataagtttttcagttgaaaaaggggaatttgtagctgtcatgggtccttctggatcaggtaaaacgactttactcaatgtgttaagttcaatagatactatttcaggaggaactgtagaagttgaaggcaaagaaattaataaactgagccacaaagaagtggcaaattttcgaaaacaacatctcggttttatttttcaagattatagcgttttacccacattaacagtaaaagaaaatattatgctaccactctcagtacaaaaattccataaatatgaaatggaacaaaattataaagaagtggctgaggcattaggtatttataacctgggaaataaatatccaagtgaaatttctggcggtcagcaacaacgtacggcggcagcccgggcattcgtccataaaccaacgattattttcgcagatgaacctactggcgcattagattctaaaagtgctcaagatttgttacaccgtctagaagatatgaataaacaatttaattcaaccattatgatggtgacacatgatccttcagccgctagttacgctgagagagtcattatgttgaaagacggtgatatacactcagaaatctaccagggtaacgattcaaaacaaacattttaccaagaaattatgaaacttcaaaccgcattaggtggtgtcagtcatgacatttaa

SEQ ID NO: 1764 - DNA, 591 bp, Staphylococcus epidermidis
cttttcaggaggaatttatctatgtctttaattaacaaagaaattttacctttcacagcacaagcttatgatccaaaaaaagatgagtttaaagaagttactcaagaagattttaaaggttcttggaacgttgtatgtttctatcctgctgacttctcattcgtatgccctactgaattagaagatttacaaaatcaatacgctaaattacaagaattaggtgttaacgtgtactcagtatcaacagatacacacttcgtacacaaagcttggcatgaccattctgatgcaatcagcaaactagaatacagcatgattggtgatccttctcaaacaatcactcgcaatttcgatgtgttggatgaagaatctggtctagcacaacgtggtactttcattatcgaccctgatggtgtggtacaagcagcagaaatcaatgctgacggaatcggacgtgacgcaagtacattagttaacaaaattaaagccgctcaatatgtacgtcaacatccaggtgaagtttgcccagctaaatgggaagaaggttcagaatcattacaacctggtttagacttagtaggtaaaatctaa

SEQ ID NO: 1765 - DNA, 861 bp, Staphylococcus epidermidis
ttgagagggagagaatggataatgaagaaacctttttcaaaattatttggtttaaaaaataaagatgacatcattggttatactgaagaagaacgtaataataatgtagaatccattcatattgaacgtatcgtacccaatcgttatcaacctagacaagtatttgagccaaataagattaaagaattagcagagtctattgaagagcatggattattacagcctatagttgtacgtccaattgaagaagatatgttcgaaattatagccggcgaacgacgatttcgagcattacagtcgttgcataaacctcaagtagatgtcattgttcgagatatggatgatgaagaaacagcggtagttgcattgattgaaaatattcaacgtgaaaacttatctgtcgtcgaagaagcggaagcttataaaaagttacttgaaatcgggggaacgactcaaaatgaattagcaaaaagtctaggcaagagccaaagcttcattgctaataaacttagattattgaagttagcacccaatgtgattaagagattacgtgaaggtaagattacagaaagacatgcacgagcggtattagtattacctgataaaacacaagaagaattaatcgagcaagttattagtcagaagttgaatgtgaaacaaactgaggatagagtacgtcagaaaactggaccagagaaagtaaaagcgcagactttccaattttctcaagatgtaacacaagcaaaagaagaactaggtaagagtattgaaacgatagaaaaatcaggtatacgcgttgaacaaaaagataaagaacatgaagattattatgaaattaaaataaagatatataagaaataa

SEQ ID NO: 1766 - DNA, 237 bp, Staphylococcus epidermidis
acatttaatggtaatgcacctgcacttgaacgtgaagtaaatgcaaagattagtacttctattgtctttttcacgtatttaacgggattgatacctaagacactcagtataattaaatggataatatacattgtgattagagctgcgtatgaagcaattaagaatttacctaacgtccaaattgcagaaaaatcacttgtcgcaagagtagaagccataatagctaaaatgccataa

SEQ ID NO: 1767 - DNA, 777 bp, Staphylococcus epidermidis
attttgataggagtgggtatagtgtcagattatgtttatgagttgatgaaacaacatcattcagttagaaaatttaagaatcaaccacttggttctgaaacggtagaaaaattagtagaggcgggacagagtgcttctacatccagttatcttcaaacttattctattattggtgttgaagatccaagcattaaagcgcgtttaaaggaagtgtcaggtcagccttatgttttagataatggttatttatttgtatttgttttagattattatcgtcatcatttagtagatgaagttgcggcgtcaaatatggagacatcatatggttctgcagaaggactattagtaggtacaatagatgttgcattagttgcgcaaaacatggcagttgctgccgaagatatggggtatggaattgtttatttagggtcattgcgtaatgatgttgcgcgagtgcgtgaaattttaaatttacctgattatacgtttccgttatttggtatggcagtaggtgaaccttctgatgaagaaaatgggtcacctaaaccgcgcttgccatttaaacatatttttcataaagaccagtatgatgcaaatcagcatcaacaacgtaaagaattggaagcatacgaccaagtagtgagtgaatattataaagaacgtactaacggtgtgcgtacagaaaattggtcacaacaaatagaaacatttctaggacgtaaaacacgtttagatatgttagatgaattgaaaaaagcaggatttattcaaagataa

SEQ ID NO: 1768 - DNA, 1896 bp, Staphylococcus epidermidis
cttttgggaggtaaaagagtggttcaagaatatgatgtagtagtcattggtgctggtcacgccggtattgaagcaggtttagcttcagctcgtcggggtgctaaaacgctgatgttaacaattaatttagataatattgctttcatgccatgtaatccatctgtaggtggtcctgcgaaaggaatcgttgtacgtgaaatagacgctttaggtggacaaatggcaaaaactattgataaaactcacattcaaatgcgtatgcttaatacaggtaaaggtccagctgttagagctttacgtgctcaagcagataaagtattatatcaacaagaaatgaagcgtgtacttgagaatgaggataatttagacatcatgcaaggtatggttgatgaactcattatagaagataatgaagttaaaggtgttcgtactaatattggtacagaatatcgttctaaagctgtcattattacaacaggtacattcttacgtggagaaattatactaggaaacttaaaatattctagtggccctaaccatcaattaccatctgtaactctagcagataatttaagaaaattaggatttgatatcgttagatttaaaacgggtacaccaccacgtgtaaatgcgagaaccatcgattattctaaaactgaaatccaaccaggtgatgatataggtcgagcgtttagttttgaaacaaccgaatttattttaaatcaattaccttgttggttaacttatacaaatggagatacacatcaagtcattgatgataacttacatttatctgctatgtattccggtatgattaaaggtacaggtcctagatattgtccatcaattgaggataaatttgtccgctttaacgataaaccaagacatcaacttttcttagaacctgaaggacgtaatacgaatgaggtatacgtgcaaggattatctactagtttacctgaacatgttcaacgtcaaatgttagaaaccattccaggtcttgaaaaagcagatatgatgcgtgcgggttatgctattgaatatgatgcaatcgtgcctactcaattatggccaacgttagaaacaaaagcgatcaaaaacttgtatactgcaggtcagattaatggaacatcaggatatgaagaagcagcgggacaaggaatcatggcaggtattaacgctgctggtaatgttttaggtacaggtgaaaaaatactcagccgttcagacgcatatattggtgtacttatagatgatttagtcactaagggtacaaatgaaccgtatcgattattaacttcacgtgcggaatatcgattattactacgtcatgataatgctgatttacgtcttactgatatggggtatgaattaggtttaatatcagaagaacgctatgcaagatttaatgaaaaacgtcaacaaatcaaagatgaaatacaacgacttaccgatgtacgtattaaaccaaatgaacatacgcaagcaattattgaagctaagggtggttcaagattaaaagatggcatattagcgattgatttattacgtcgtccggaaatgaactacgaaacaattttagaaatcttagaagaatcacatcaacttcctgaagcggttgaggaacaagttgaaattcaaacaaaatatgaaggttatatcaataaatctttacaacaagtagaaaaagttaaaagaatggaagcgaaaaaaattcctgaggatttagattatagcaaggtagatagtttagcatctgaagcacgcgaaaagttagctgaagttaaaccattaaatattgcacaggcttcacgaatttcaggtgtgaatccagcagatatctcaattctacttgtttatttagaacaaggtaaacttcaaagggtgaaacaataa

SEQ ID NO: 1769 - DNA, 741 bp, Staphylococcus epidermidis
acttcaaagggtgaaacaataatgagtattgaatggttatcagagaaattaagcgagcaaggcatagaactatctaatacgcaaaaagagcaatttcaaaaatattataaattacttgttgaatggaacaaaaaaatgaatttgacaagtattactgatgaacatgatgtttatttaaaacatttctatgattcaatagcgcctagtttctattatgattttaacggtcaattaagtctttgtgatatcggtgctggtgcaggttttccaagtatacctttaaagatagtataccctgaattgaaagtaacgattgtagattctctaaataaaagaatacaatttctaaatcatttagctgcagaactaggtcttgaagatgttagttttgtgcatgatcgagcagaaatatatggcaagggtgtctacagggagtcttatgatattgttacagctcgtgcagtagcgagattgactgtcttaagtgagttgtgcttacctttagtaaaaaaaggtggacagttccttgcacttaaatcatcaaaaggtgaagaagaattgcaagaagcgacatttgctattaacattttaggtggtaatgtgaaagagactcatacttttgaattacctgaaaatgccggtgagcgacaaatgattattattgataaacgtagacagacatcaaaaaaatacccaagaaaaccaggtacgccaaacaaatctccactagttgaaagttaa

SEQ ID NO: 1770 - DNA, 600 bp, Staphylococcus epidermidis
tttcaaatcataattaaggagtttaaagcaatgaatgttagcaatcaaatcaaaaaatttagagaaagagatgggtattcacaagaatttttggctgagaaaatgtttgtttcaagacaaactatttcaaattgggaaaatgataaaagttatccggatattcataatttacttattatgtgtcaactcttcaaggtatctctagacgaactagtggaggatgatttgaaaaacgtgcaaatcaaaaatattaaaaaagaattagacttttggacatggatgatgataattacaatggtattaggaagtgttctcataggtcctatgattcattactttcattggttaggaataggaataacatatttagtatttttaataggtatcattgcttctacaaaattagaaaaaattaaaataaaaaatgatattgaaacatacgacaggatattagcatttattaatggtaaagatcctaaagaggtgcaaaaaagtaagtttagagatatatggacatcctcaatttcttttattttctttgttggtgtgatcatcggtataagttacttaagtatcattttaactgattattttttataa

SEQ ID NO: 1771 - DNA, 675 bp, Staphylococcus epidermidis
tatgtaataatgaattgtaaaacgacatcgaggaggtttcttatggacggtttaattacatttatcattatcacattattgattattatagtacctgggccagatttcattattgtaatgaaaaacactattaattcaagtaaaatgaatggttttatggctgcatttggtattactacggggcatattttatactcttcattagctatttttggaattatatacatacttacgagtttacactttgtttttttaacaataaaaatattgggtgcttgttatcttatttatctcggaatcaaaagtattttgagtgcgcacagttctgttgattttagtaaacaagctttagctgatgtcagaaatgtgagttatatcacttcttttagacaaggttttttaagtacaagtcttaaccctaaggctttattattttatgttagtatattcccgcagttcctttctaacggtaatatacatatgaaatctgaagttgcgttatttgctttttcagttgttgtagttatatgcttatggtttttattttgtgtattcatctttcaatatattaaattattattcagcagaccgagattcaaggctatatttgattatattgtagggtttgttttaattggcttatctattaatttattattaagtaaaagtagctaa

SEQ ID NO: 1772 - DNA, 600 bp, Staphylococcus epidermidis
ggagacagaatggaaatttatttagtgaggcatggtgagtcacagtccaattatgataataaacacgggtatctatatttttgtggacagttagacgtccctttgacggaaaggggtataaaaagcgctaaagaactatctgtttattttaaaaataaatacattgacaatgtatatgtatcagatttaaaaagaacaaggcaaacgtatgaggagctatttccttatgatattccaacaatatatacaaagacgttaagagagcgttcgttaggtgtttttgaaggtaaaaataaagaagaagtttgtaaagacaaacggttcgaaaaatatttccgtgatcctaattataaatactttagacatagcttttcgcaaaaagcaccacaaggagaaagttatcaagatgtctatgatagagtggttactttcattgaaaatgagcttaatcaacagcagagacgtgtagtgatagttgcgcaccaagttgtaattagatgttttttcgtctattttaaaatgataactaaggaaaaagccttaacgacggaaattcataattgctatccatatttaattaaagaagaaatgaagttttga

SEQ ID NO: 1773 - DNA, 1413 bp, Staphylococcus epidermidis
cgaccttggattacgattgaaaagaagatgaaaataagggatgaaaatatgaatttcgttaaatcaaaaactgacttatttagactcatagacaatgaagctcaaacatcgacatctaaggtggttttattcttaatattaggaactatatttttagatgcatatgatattactattttaggtacaatgactgatcaactcactcaacagtttcatttatcaccagcaacgctatctatagtaatgacctctttacctattggtgcattatttggtgcattacttggtggtacattagcatatcagtttggacgcaagcgtattttatcaattgccttactaacacttactgtaacctctcttggtgcggcactcgcaccaaatgtaattattctaataatatgtcgttgtataatggggtttgctattggaatggatagtccagttgctttcacttttattgcggaaataagtaatttaaagcacaaaggaagaaatgttaactattggcaagtcgtttggtatgttgcaatagttacttctgctttagtggtcactgcgttctttatgctaggggctggtgcacatttgtggagatatgcagttggatttggtgcacttattgcttttgtcttgtacatcttgcgaattaaatatttacacgaaagtccgacatgggtgattaatcattattctttagaaaaagcaactgaatttataagaaaatattatcataaagacatccacctagagggaacgcttgaagatgatttaaattctgatgtgacttcgccacataattcttggacagacttatttaaaccgagatatataaaaagaattatcctagcgactgcgatttcaacattacaaggtatgcagtactatggtgtcggtttatacatacctattattgcaacttatcttattagtaaggataaaataggtgtattattaggtactgctatagtcaatatagcaggtattctaggcgcatatttaggtgctcaattgacttataaattaggtacacgcaagcttacaatgataggcttcacacttgtattactttcaatggtatgtgtaggactcttttatcatcatctaccaatgcttcttaacactttccttattggattatttttatttggccattcaggaggtcctggtactcaaggaaaaacaattggtgccttatcattcccgactcatttacgttcacaagctactggctttgtagaatctgtaagtcgtactggtagtatcataggtacttttgtctttccaatcattcttgctgcagtaggtctaacgaatactatgttaatcttgtccattgtccctttactcggaattatcataacagtatctataaaatgggaagctgtcggtaagcatattgaagtagaataa

SEQ ID NO: 1774 - DNA, 207 bp, Staphylococcus epidermidis
aggacggtttttattatgaaattcaaagaattaatcaaacaatcatatgaggatttaaaaaacttaacagttaattggtttaacgtactcagtttaactgtaatcatatttattttaagtaacattgtcacaccgcttattggtatatctgtgggtttactcggtggtgcatatatcctaaagagacgtgaagagaaaaataaataa

SEQ ID NO: 1775 - DNA, 1476 bp, Staphylococcus epidermidis
atcaacaacttgaatttcttcttaaccccctttattcttattacatatgtcggaatactaaaaattaaaaaggagctatatatcgatatggaaatactttttacagtaattaatgtcatcgtgttacttgttttcctagtaatgttaaatattatggcaagaaaacacgtctcattccctaaacgtgtctttaccgctttagcaataggtatcgtatttggcattgtattacacctcatatatggtgcagagtctaaaactctcgaacaatcaacagactggtttagtattgttggagatggttatgttgcactattacaaatgattgtcatgccactaatattcatttcaattgttgccgcttttagcaaaatacaaattggtgaaaaattcgctaagatcggttcttatatttttatgtttttaattggtactgtagccattgcagctatcgttggaattttttacgctttgatctttggtttagatgcatcgtctattgatttaggtagtgcagaacattcacgtggtacagaaatttcaaaacaagccaaagatttaactgcaaacactttaccacaacaaattctcgaagtattcccaagcaatccatttttagatttcacaggacaacgtacaacttcgacaattgcagttgttatttttgcaacgtttgtgggctttgcttatcttagagttgcaagaaaacagccggaacatggaagcttacttaaacgtggtatagaagcaatctattctatcgttatggctatcgtaacttttgttttgcgattaacgccttatggcattttagctattatggcttctactcttgcgacaagtgatttttctgcaatttggacgttaggtaaattcttaattgcttcatacgcagctctaatcacaatgtatattatccatttaattatactgagtgtcttaggtatcaatcccgttaaatacgtgaaaaagacaatagaagtactaatctttgcatttacttcacgttcaagtgcaggtgcattaccattaaatgttcaaacgcaaacaaaacgtttaggtgtacctgagggaattgcaaacttctctgcaacttttggtttatccatagggcaaaatggctgtgcaggaatctatcctgctatgctagcagttatggtggcaccagtagcaaatgtagaaattgacttccaatttgttgttacacttattgctgttgttattataagttcatttggcgttgcaggtgtaggtggcggggcaacattcgcatcaatactcgtattatctacacttaatctaccagttgctctcgcaggggtactgatatctatcgaacctctcatcgatatgggtcgtacagcacttaacgttaatgactcaatgctagctggaacaggtaccgcacgcttaacgaatcattgggacaaaaaaacatttgactcaaatgattacggcgatttatctgcaaattaa

SEQ ID NO: 1776 - DNA, 258 bp, Staphylococcus epidermidis
aaccccttagtgcatattttcaatgacatacgtactaaggggttttttaatgcttattctacttcaatatgcttaccgacagcttcccattttatagatactgttatgataattccgagtaaagggacaatggacaagattaacatagtattcgttagacctactgcagcaagaatgattggaaagacaaaagtacctatgatactaccagtacgacttacagattctacaaagccagtagcttgtgaacgtaaatga

SEQ ID NO: 1777 - DNA, 510 bp, Staphylococcus epidermidis
tgggtatttttagtaataccatcgatatatgaaaggagtaatatgatgagtaatatcacagtttataatgtcattgaattgggcgtaaacaatcttttagccgattatgacaattggaatgttgaagaagtattagataaagaaactcaacatttcccaaacactttacattggcaatatggtcatgtattaacaatctttgaacaagcattatcattaggcaatcaacatgtagtagatgttgaaaaatataataaattgtttggatatggttcaaatcctagagactggaagggacaagatgtacctgctatcaacgaaatcaaacaacacattcaaacattaccagaacgtgctaaaaaattaacacacgagcagttagctcaaaaattagaccaacctatcgcaggttgtaacacacttgatgaattattaatgttaaatgctatccatgtgccattacacaccggtaaaattgaagaaatgacacgtgtacttcgtgaaaaataa

SEQ ID NO: 1778 - DNA, 1893 bp, Staphylococcus epidermidis
gtggtgtcagtcatgacatttaaccaacttatccttaaaaatttaagaaaaaatattaagcattatggaatgtttctattttcattattgattagcattatactttattttagtttctcaactttaaaatattcaaatagtattaataactcagattcttcaactattattaaaaatggtgctacaattggtgccacaattctttttatcattattgttgttttcttaatgtatgcaaatcatttatttattaaaaggcgtacaaaagagtttgccttataccaactgataggtttaacacgtggaaatattctaagaatgctcaatatagaacaactagtattttttattgtaacgggaattttaggcactttaattggtatttttggttcaaaacttttacttgttatcgcttctaaattaatgaagttaaacacacatatctctattggctttgaaccccaagctatacttattactatcgtaatgttagctgtcgcttttttattgataatgatacaaaattacattttcttaaaaaaacacagcattttagctttgatgaaagacaattataccccggaagctacccaaaaacggataactacgtttgaagcaatcggcggcattttaggaattataatgatagtatttggatattatatgtctactgaaatgtttggtgtttttaaagccttaacaactgctttgattacaccttttagcatactttttttaactattgttggtgctttcttattctttagaagttctgtatcacttatttttaaaacactaaaacatatcaaacatggtcgtgtaaatatcacagacgttgtctttacatcatctatcatgcacagaatgaagaaaaatgcgatgtctctcacagttattgctatcatttcagctttcacggttagtattctttgcttcgcggcaattacacaatctaatactaatacaactttagaaatgacttctccagatgattttaatataagccagaataaaatagctgcgcaatttaaacataaactagatcaagaaaatttaaaatatcatcagcggacttatgaagtaatcaatccaaaaacattaagcgaccacgtcatgaagagtaaaaatggttctgatatgtctactaatacaacatcactaatgatgaactcacatctcaaaggtcatgaagctaaaataacgaatatacaatcatcaacaggattaatagatattcatttaaatcataagattacagttaaaggaaaatctaaacaatctattatcgttaaagacaaagataactctaaaatatatccatcccaattatcatttggagctcctatagttgaggtgagtccggaggtatataacacattaaaaactgacaatattgttaataagatgtacggttttaatttcaacactcacaaagatgtgaaaaaagcagaaaaaattgcctcaaaagttaatcgtaatattgtatcgcacgatgaatataagaaatttataaaccaaagcaatggcatacttatctttgtaacatcattcttaggaatagcatttttaatggctgctggttgtattatttacattaaacaaatggatgaaactgaggatgaacttgataactttaagatattacgtcgtataggatttacctacactgatatgtctaaaggtttactattaaaaattgcatttaattttggattaccgcttctcattgctttattacatgcattatttgcagcacttgcatttatgaaacttctaggaaatgtctcaatgtcacctatattcatagtaatgattatatatacaattgtttatttcatttttgctatgatttcatttatacactcgagtcgtatgattaagcattctatttag

SEQ ID NO: 1779 - DNA, 213 bp, Staphylococcus epidermidis
gaggttagggtattgagcttttatcgttttatgaagaattttgaaggtgaaaaaagtcattttggagatttgtttgaaggtatgaaagatattaattttcctgaaaacattacgactccaagggaaattatggaaaagttccaacattggttacaagaacctagtttacacgatacgatacaagatgcgattaagcagtatcaaaataaataa

SEQ ID NO: 1780 - DNA, 816 bp, Staphylococcus epidermidis
tataaattttcagataatttaggggaggggtacaatatgacactaacaaataaagaagttgctaaagttttatttaaagcttatagatataaaaaacccatcgatttcattagtgagaactatcaattaaacgaagaagaagcatatcatgtacaagaagaactaattgaccaattaactttcaaagaccgttcgactgttacagggtataaagttagtatgactagcaaggcaacgcaagcaattgctaacactaacgaacctgcatatggaacactcttatctaaccaaattgttaatgatggtgcctcagtctctctttcagaattattttcaccattactagaaccagaaattatctttatagtgcaggaagacttaccttatgatgctgatttagaaacaattagatatcatacccgtatcgcgccaggcattgaaattccagatgcaagatataaaaattggtttccaaattttactttatcagatttaatatcagataataccgcaacaggacttgtcgtagtaggtgaccctgtagacggacttgataacgatgcatttgctaatgtacatttaaatttatataaagatgataaatgcattgccacaggagaatcatccgaagtactcggaaatcctttaaacgctattcattggctaattaaaaaactacacacgcacggtaaacaacttaaaaaaggagatatcatttcatctggaacttttatatctccactaaaattagaatatggcacgtaccgtgctgaatatagtggtatcggtaaggtatcattttcggttaataaataa

SEQ ID NO: 1781 - DNA, 1851 bp, Staphylococcus epidermidis
aggaggctttcaatgagtcatttactgaaccaattaaagagcaacgttttagtagctgatggcgctattggaacaatattctactcggaaggtcttgatacttgtccggaagcatacaatcttactcatccagataaggtcgagcggattcatcgttcttatatcgaagctggtgcagacgtcattcaaacgaatacgtatggtgctaactttgaaaaattaaagtcctttggtcttgaacataaagttaaagaaattcaccaagctgcagttcaaattgctaaacgtgcagcaaatgaggacacaattatacttggaacggtaggtggattcagaggcgtccggcaagaggatatcagtctttcaacaattcaatatcatacagaacttcaaatcgatacattaattgatgaaggtgtagatgcccttctatttgaaacttattacgatttagatgaattaactcgcatcgtcactgctacacgacaaaaatacgatattccaatcatcgctcaactcaccgcttcaaatacgaattacttagttgatggcactgaaattaatgccgcattgaaatacgtagttgaatgtggcgccaatgtagttggattaaattgtcaccatggcccacaccatatgcaacgatcattttcacatatagaacttcctaaacatgcgtatttatcgtgttatccaaacgctagtttattagatatcgagaatagtgaattcaaatatagtgataatgctcaatatttcggagatatagctcaagaattaattaatgagggagtcagattgataggtggttgttgtggtacaacacctgaacatattcgctatattaaatcagcagttaaacatttaaaacccgttaaagataaaaaggtaatccctattaataaagcttcatctcaaaagcaaacgcgagttcttaaacaaaaccttacttctaaagttaaaaatggcccaacagtcatcgtagaacttgatacacctaaacatttggatactgatacatttttcgataatgtaggcaaattagatgaagctggcatagatgctgttacattggcggataattcattagctaccgtaagagtaagtaacatcgcagcggcaagtttaattaaacaacgctacgatattgagcctcttgtacatgtgacatgtcgtgaccgtaatttaataggattacagtctcatctcctaggtttatcactcattggtgtcaatgaaatactagctattaccggagatccttctaaagtaggccatttgcctggagctacaaatgtctatgacgtgaactcaaaaggccttacagaacttgcactaagatttaacaaaggtattaacactgacggcgatgcgctgaaaaaacatactaactttaacatcgctggtgcgtttgatcctaacgtacgaaaattagatggagccattaaacgacttgaaaagaaagtagcaagtggcatgagttatttcataactcaacccgtttatagtaaagaaaaaattattcaagtatatgaagaaacaaaacatttaaatacacctttcttcataggtatcatgccaatcgcaagttataacaacgcacttttcttacataatgaagtgcctggcatcaaaatgtcagacgatgtacttaaccaattcaaagctgttaaagatgataaagaaaagactaaagaattaagtttaagactttccaaagaactcattgatacagtacatgaatacttcaacggtctgtacattattacacctttccaaaaggtagattattcattggaactcgcagcatactctaaatcaatcactgccaacaaggaggcaatattatga

SEQ ID NO: 1782 - DNA, 237 bp, Staphylococcus epidermidis
ggtaagtcttcctgcactataaagataatttctggttctagtaatggtgaaaataattctgaaagagagactgaggcaccatcattaacaatttggttagataagagtgttccatatgcaggttcgttagtgttagcaattgcttgcgttgccttgctagtcatactaactttataccctgtaacagtcgaacggtctttgaaagttaattggtcaattagttcttcttgtacatga

SEQ ID NO: 1783 - DNA, 654 bp, Staphylococcus epidermidis
aggaggtatcctcgtgagatgaataaacttatagacttttctaaaggattagtaccagtaattttgcaacatgcacaaacggatagcgtattaatgttgggatatatgaatgaagaagcttatcaaaaaactctgaaagaaaagaaagtaaccttcttctctagatctaaacaacgtttgtggactaaaggtgaaacttctggtcatttccaacacgttgagagtattcatctagattgtgatcaagatgcgatcttaatcaaagtgatgccacaaggtcctacatgtcacactggaagtctgagttgttttaatagtgaaattgaatcacgttttaaaattcaagctttagcacaaacgattcatcaaagtgctaaagccaatcaatctaactcttacactcaatatttgttaaaggaaggcatcgagaaaatatccaagaaatttggtgaagaggcatttgaagttgtgataggtgcgataaaacataatcgtgaagaagttattaatgaaacagcagatgtcatgtatcacctttttgtgttactacatagtttagatattccattttcagaagtagaacaggtactagcgcatcgccatcaaaaaagaaataattttaaaggcgagcgcaaagaggttcgagaatggtaa

SEQ ID NO: 1784 - DNA, 621 bp, Staphylococcus epidermidis
aacgccatgttacgagttgcattagcaaagggtcgtttattaaagagttttatcgaatatttacaacaagttaatcagatagatattgcaactgtacttttaaatagacagcgacagttattgcttacagtcgacaacattgaaatgattttagttaaaggaagcgatgtgcctacttatgtagaacaaggtattgctgatgtaggaatagtgggaagtgatattctgaatggtcaaaaatataatattaataaattactcgatttgccatttggtaaatgtcattttgcgttggcggcaaagccagaaacatctcgctataaaaaagtagcaacaagctatgtacatacagctactcaattctttaataaagaaggtatggatgtagaagtgattcaccttaacggttcagttgaattgtcatgtgtagtggatatggttgatgctattgtagatattgtacaaactggttctacgcttacagctaacgggctcgttgagaaaaagcatatcagtgaaattaacgctaagttaattacaaataaagaatcatattttaagcaatcatctgaaatagagagactaatcaagcagttaggagtgtctattaactatgcttag

SEQ ID NO: 1785 - DNA, 1308 bp, Staphylococcus epidermidis
aaaaggctaacgcataggaggtgtatcacaatgagtgaaaatattattatgccaaagcttggaatgacaatgaaagagggaactgttgaagagtggtttaaatcagagggtgacaccgtaaaacaaggagagagtattgttacaataagctctgaaaaattaaccaacgatgttgaagcgccggcgagtgggacattgttagaaattaaagtgcaagccggagaagatgcagaggttaaagcggtattaggtataattggagaagaaggggaagctattgataaagatgaagatgatttagcatcagaaaaagtaaaagaagacaacgagcatgagaaggaaacgcaagaagttaaagatacatcacaaccgtcttccgataataaagataattcgcctaaaagcgcagcacgagaaagaatctttatctcacccctcgcacgtaatatggctgaggataaaggattagacattaacaagataaaaggcacaggcggtaatcatcgtattacaaaactagatattcaacgtgttgaagcaaatgggtacgactatgctagtgatacgacatctaatgaagatacaagtcatgttccaacacagactgtggatacaagtgcgattggtgaaggattgaatcctatgcgtcaacgtattgctcaaaacatgagacaaagtcttaatagtactgctcaattaacattacatcgtaaggttgatgcggatcgcttgctagatttcaaagacagattagctacggaacttaaacaagcagatcaagatgttaaattaactgttactacattattagctaaagcagtagtgcttgcacttaaagaatatggggcaatgaatgctcgctatgaacaaggcgagttaactgagtatgaagatgttcatttaggaatcgcaacgtctctagatgaaggccttatggtgccagtgattaatcatgcagatacaaaaagtatcggcactttagcccatgaaattaaatcatcggctgaggctgttcgggaaggaaacacaggagcagtacaattagagggagcaacatttacaattactaatatgggtgctagtggtatagaatactttacaccaattttaaatttaggtgaaacaggtattctaggcgttggtgctttaactaaagaagtcgtgctagaagcggataacattaaacaagtttcaaaaattcctttaagcttgacatttgatcatcaaattttagatggtgcaggtgcggccgattttcttaaagtactagctaaatatatcgaaaacccttatttattaatgttatag

SEQ ID NO: 1786 - DNA, 537 bp, Staphylococcus epidermidis
atgttagaaacacatagattaaagctagtgaagcctaatttgagttatacagatgaactttatcaattgcatacaaataaggtagctacaaagtatacacctaaaggtattcatcagaataaagtagcaacccaagattttattaaaggatggatgaggcattgggatgaatatcaatttggttacttcattttaattatgagagataatcacgaagtagtggggatagcgggatttgagtatcgtacaattcatcaacaacagtttcttaatgcgtattatagaatctttccatcgtatactggtgttggtttagcttttgagtcaatggaggagattgcccgtcatttaaaaaagcatgataccataacaccaaaattaattcgaacaaatcaatataatacaaattctattaaattagcacaaaaactcggatataattatgatgctaactgggacgatgtaattaataaaggagatcgttgttttttaacctacaagcgttggataataactaaaagcatgatgaattcgtag

SEQ ID NO: 1787 - DNA, 183 bp, Staphylococcus epidermidis
aatacaagaacacatattataaatgcctgggacacattaaatgtctcaggcatatttatttatggcaatcgttgcattaatagaaaatacaatgagttgtatcaaattttcaaattaagctatacgagtgaggaacataaagttttattcaacctttgttctacttcttttatttatacataa

SEQ ID NO: 1788 - DNA, 993 bp, Staphylococcus epidermidis
ctaaaattgactaaagaggagcacagatttatggattatagagtactactttattataaatatgtaactatagatgaccctgaaacttttgcagccgaacatttgaaattttgtaaggaacatcatttaaaaggaagaatactagtttcaacggaaggcattaatggaacattatctggaacaaaagaagatactgataaatatatagagcatatgcatgcagatagtcgttttgctgatttaacttttaaaattgatgaagctgaaagtcatgcgtttaaaaagatgcacgtgcgtccaagacgtgaaattgttgcacttgacttagaagaagatattaatccacgtgaaattaccggtaaatactattctcctaaagaatttaaagccgcactagaagatgaaaatactgttatattagatgctcgaaatgattatgaatacgatttaggacatttccgtggagctattcgtcctgatataacacgattccgtgacttacctgaatgggtgcgtaataataaagaacaactcgacggaaaaaatattgtcacatattgtacaggtggcattcgttgtgaaaaattttctggttggttagtaaaagaaggatttgaaaacgtaggtcagttgcatggtggtattgctacatacggtaaagaccctgaaactaaagggctatattgggatggtaagatgtatgtatttgatgaacgttttagtgtcgatgtgaatcaaattgataaaacagtcatcggcaaagagcattttgatggtacaccttgtgaacgttatattaattgtgcaaaccctgaatgtaataaacaaattcttgtttctgaagaaaatgaagaaaaatatttaggtgcatgttcgtatgattgtgcaaaacatgagcgcaatcgctacgttgcccgtcatcatattagcaatgaagaatggcaacgtcgtttaaataatttcaaagatgtgcctgaacacacacatgcataa

SEQ ID NO: 1789 - DNA, 966 bp, Staphylococcus epidermidis
gaggaattgacaatgaaaatggaaaaagaacaagcacattggatttataaaacgatgaacgaaattcgattttttgaagaaaaggtacacaaaatttttagtgatggtagaattccaggattcgtacacttatatgtaggtgaagaagctgttgcaacaggtgttatgtctcaattaaatgatgatgactatattacaagtacacaccgtggtcatggtcatgcgattgcaaaaggatgcgatttaaatggtatgatggcagaaattatgggtaaacgtgacggattaggtcacggtaaaggtggctcaatgcatgttgcagaaattgacaaaggaatgctcggtgcgaatggtattgtcagtggtggttttgggttagcaattggtgcaagtatttctatcattaatcaaggtaaagataatgttgccgtatgtttctttggtgatggtgctgcaaatgaatgtaatttccatgaaggtcttaattttgcttcaattttagatttacctgttctttttatatgtgaaaataaccaatttgctgaaggaacaacacatgactacgcaagtgcttctgaaacaattgcagagcgtgctgcggcttataatatgccgggtgtacgtgttgatggcatggatgttatggaagtatataaagcaacacaagaggctgtagaacgcgctaaaaaaggtgaaggaccaacgttaattgaatgtgatacgtatcgtaaatatggacattttgaaggtgatgagcaaaaagtaaaatcaccagatgatcgtaacgcagataaaaatgcgacagtagaatttagaaaaagagcaattgaagaaaattggctcactgaaaaagaagcagatgaaatagaaaaagcagctgaacaagctgtagaagatgctgtgaaatttgctgaagaaagcgaattaccagatgaggattcattatacaaggatgtttttgcttaa

SEQ ID NO: 1790 - DNA, 597 bp, Staphylococcus epidermidis
agaaatggagcgtatgttatgaactatcaaatcaaaagaaacactgaagaaactcagcttaatatttcactggctaataacggaacacaatctcatattaatactggtgtaggatttttagatcatatgttaacgctatttacttttcatagtggattaactttatctattgaggccactggagatacgtatgttgatgatcatcatataactgaagatataggtatagttattggacaattacttcttgaattaataaagactcaacaaagttttacaagatatggttgctcatatgtacccatggatgaggcgcttgctcgaacagtagtggacattagtggtcgtccatatttctcatttaatagcaagttgagcgctcaaaaggtaggaacttttgacactgaactagttgaagaattttttagagcattgataattaatgcgcgattaaccgttcacattgacttattaagaggtggaaatacacatcatgagattgaggcaatatttaaatcttttgcaagagcattaaagatttctcttgcacaaaatgaagatggacgtattccatcgtctaaaggagtaattgaatga

SEQ ID NO: 1791 - DNA, 237 bp, Staphylococcus epidermidis
ctttattctcattttataaaaatttatattaaatgtcattatagctacacgactacacttttattcatatatgaaaaccaccacatcttatatcggtcaaatgacggatttataggctatcttattgaaagcaattctcattttgatacaatattaaaatgtctaatttttaaacttcaatcactatcatttttttatataaattcaaatacttttaaattaactaaaattgactaa

SEQ ID NO: 1792 - DNA, 1542 bp, Staphylococcus epidermidis
ttatttttgcacgaattcttaaaccaaagaaaggtgagcaaaaaaatggctaataaagagtcaaaaaatgttgttattattggcgctggtgtcttaagtacgacatttggttctatgattaaagaattagaacctgattggaacatcaaactctatgaacgcttagatcgtccaggtattgaaagttctaacgaaagaaacaatgccggtacaggacatgcggcgttatgtgaattgaactatacagtacaacaacctgatggttcaattgatatagaaaaagccaaagaaatcaacgaacaattcgagatttcaaaacaattctggggtcacttagtaaaaagtggtaacatcagtaaccctagagatttcattaatccacttcctcacattagtttcgtaagaggtaaaaataacgttaaattcttaaaaaaccgttacgaagcaatgcgtaacttccctatgttcgataacatcgaatatacagaagatatcgaagaaatgagaaaatggatgccattaatgatgacaggtcgtactggtaacgaaatcatggcggctagtaaaatcgacgaaggtacagatgttaactacggtgaattaactcgtaaaatggcaaaaagtattgaaaaacatccaaatgctgatgttcaatacaaccacgaagtaattaatttcaatcgtcgtaaagacggtatttgggaagttaaagttaaaaaccgtaattctggagacgttgaaactgttctagctgattatgtatttatcggtgcaggcggtggcgctattccactattacaaaaaactggtatcccagaaagtaaacatcttggtggattccctatcagtggtcagttcttaatttgtacaaaccctgatgtaattaatgaacatgacgtcaaagtatatggtaaagaaccaccaggcacacctccaatgactgtaccacatttagatacacgttatatcgatggtgaaagaacattattatttggaccatttgcaaatattggccctaaattcttaagaaacggttctaacttagacttattcaaatcagttaaaccttataacatcacaacattactagcatctgcagttaaaaacttacctttaatcaaatactctatcgaccaagtattaatgactaaagaaggttgtatgaaccatctacgcacgttctaccctgaagctcgtgacgaagattggcaattatacactgcaggtaaacgtgttcaagttatcaaagatactaaagaacacggtaaaggattcattcaatttggtacagaagttgttaactctaaagaccactctgttatcgcactattgggtgaatcacctggagcatcaacttcagtatcagtagccctagaagttttagagaaaaactttgctgagtatgaaaaagattggactccaaaattacaaaaaatgatcccatcatatggtaaatctcttatcgatgatgttaagttaatgagagcaactcgtaaacaaacatctaaagatttagaattaaattattacgaatctaaataa

SEQ ID NO: 1793 - DNA, 495 bp, Staphylococcus epidermidis
tcccaatgcaaattacttatatttgtcagtaaccttcctcctcaggtcgtccatcatttcaattttaaattgaggagggacttatctatgaaattatctatttttcatgatggtcaattttttgtaggtgtcgttgaataccaaaaaggcttcattcataaatatctaaaagttacatttggcaatgaacctagcgatgaaacagtgttacgattcataacttttaaacttattcctttattaaatcaaacacacggtaagaagaaacctattcaaaagcataaaaagattaatccaaaacgtttacaacgtaaaatcgctaaagaacaaaaagagaccaatttaactacatttgctcaacaagcgattaaagaagaacaagagttgaataagctaaagagtaaaaaacttcagcgattagaaaaagaacgacacagacaatacaaaagaatgttaaaaagaaaaaaagcacatgaaaagcacaaaggtcactaa

SEQ ID NO: 1794 - DNA, 627 bp, Staphylococcus epidermidis
aaagccgtaaatttaatgagagcaaaaaaattgataagtcatcttactgtatctagaataacaagtacaagaaacgtaattattgtaataaagagagaaggggttataataatgacaaaatttaactttgatcaagttcacagtgatattcagtttaaaattaaacatcttatggtgtcccaagtaaaaggaacatttaagcaattcgatgttcaattagatggagatattaatgatttaacttcactaaaagcaacagctactattattccaagttcaattgacactcaaaatgaggacagagacaaccatttaagatcaaacgatttctttggtacagaagacaacgataaaatgacatttgtaactaaagaaattaacgaaaatcaagtagttggagatttgacaattaaaggtgaaactcatgaagagacatttgatgttgaatttaatggtgtaagtaaaaatccaatgaatggacaacaagtcactggttttatcgttagtggaacaattaaccgcgaaaaatatggtattaattttaaccaagctttagaaactggtggcgtgatgttaggtaaaaacgtaaaatttgaagcatcagcagaatttagcatcgacaattaa

SEQ ID NO: 1795 - DNA, 519 bp, Staphylococcus epidermidis
tacattatgaaaaggtttgcaaaagcatttgtcgtaagtggtattactttaggtgcagttttaggtttaaacgtaacagagcataatggtgtatctaatgaagcaaaggcacaaacagcacacagttactggtataaatataatggttatactgcatcgggtggcgactttgtacttagcaattcattttatcaaggtttaaaagctggaaacgttacatttaatggtattaaggtaaatcaaaaatatgaatctaagactgctactaaaaaaatatacgatcagacatttcaacaaattaatggaaataaagcaaacaacgtacaatttaaaattgcttccagaactgttactttagatcaagttaaacaaaagtatggaaaaaattataattatcagccgtcattatctaaaaacaaaacaagtaagacagatggcttgtacggttatcaagtcggaaaaggaaacatcgttttccacgttaaagatgggtatgtcacaagtgctacattgtcataa

SEQ ID NO: 1796 - DNA, 1617 bp, Staphylococcus epidermidis
aaagggatgaataaaaatattaaaatgaaaaacaaacgaaaaataaacaatacgcttgtttatactatctctgttttaattattgttgttattactcttattgcgggtatctttcctaaagcatttgggatgtatgcgcagagcgtttatgattggattacaaattggtttggttggctattccttatcattgtctttattttagatgtatttttaatattcttagctttttctagatatggtcgatttaaacttggttcggatgaagaagaaccagaattttccatgctatcttggattggcatgttattttcagcaggtcttggcgtcggtatagtcttttggggtgttgcagaacctttaacgcattatctccattcacccttccctggaaaaattgcagatcactctgaagaatcagcacgtgttgcgatgggatatacattcttccattggggtatttcacaatggtcaatatttgcaatttcaggattaatcgttgcatactttcaatttagaaaacaacgtaacgggcttatttcaacagctatggaacccgtttttggtgaagcttataaacgtcctttcaggaatattattgatatattagctattatcgcaaccgtcatgggaattgctacgtcgattggtttgggaattatgcaaatcggtggtggattaaaccatctctttgatgttcctaataataatttcactaaaatcttaattactattttgatggtagccatatttttaggatcttcattaactggcttaaatcacggtgtaaaatggttaagtaatttaaatattttattaggtgctattttacttatatttattttgatttttggagatttaaaatttattttagaatcatacacactagcaatttctgattatttgcagcattttatagaatatagtttacgcgtaaatccatactcaggagatgatagttggattcaacagtggactgttttctattgggcttgggttatttcttggtccccttttattgggggctttgtagcaagagtatctcgaggacgtacaattagagaatttgtcgtaggtgtactcattattcctcctctaatttcgtttacatggattgcaggttttggaggtacagctattaaacttgctttaaatcataacgacaagcttgttcatattgtagataaagattatactgttgccttgtttgaattattatcacattttccattgtcggaagtcactagttccttagctattgtacttattttcatctttattgtaacaagtgctgattcaactacgcatattgttgcaggtatggctacaggtggttctatcaatccaactttaaaacataaagtcctatggggtctacttattggggcgatttcagttgctatgacaattgcaggtggtcttaaaagtttacaaactgcatcagttattacaggtctaccattctctatcattttattattaatgatattctcactcatgagggctttaaaaagagaacccatccatcattttaaaatgacatcaattgatgatgaaaaagattactctatttcattagaagagcgtgaaaaacaggacgaacaagataacaagtaa

SEQ ID NO: 1797 - DNA, 213 bp, Staphylococcus epidermidis
ttcgctaagaaagaatataaaaaatcctccaacgaagttggctcgacttcgttggaggtatcaggggtaggggttaattttgtttctaaatttatttactctaatttaatattaattaaggttttgagtatagggagaaatattttatacttatttattttctcttcatcatttttatattttacagggaaagtattttatttagattcgtaa

SEQ ID NO: 1798 - DNA, 972 bp, Staphylococcus epidermidis
  unsure (124): Identity of nucleotide at the above locations are unknown.
ggcacgactgaatatcgtggctcactaggttcacttaatcaactaatgattacaattggtattttagcaccatatttagtcaactatgcatttgcggatattgagggttggcgttggatgctangattagcagttgttccatcggttattttacttgtgggtatttattttatgcctgagagtccaagatggttacttgaaaatagaaacgaagaagccgctcgtcaagtgatgaagattacttatgacgatagcgaaattgataaagaacttaaagagatgaaagaaattaacgctatctctgaatctacatggacagtcattaaatcaccatggttaggtagaatattaattgtaggttgtatatttgctattttccagcaatttattggtatcaatgcagtcattttctattcatcttcaatctttgctaaggctggactgggtgaagcggcgtctatattaggttcagttggtataggaactattaatgttcttgtaacaatagttgccatttttgtagtagataagattgatcgtaaaaaattacttgttggtggtaatattggtatgattgcctcattattaattatggcaatcttaatttggacaattggaattgcttcatcagcgtggattattattgtttgtttatcattatttattgtattctttgggatttcttggggacctgttctatgggttatgctacctgaattattcccaatgcgcgcacgtggcgctgctacgggcatttcagcgcttgtgctaaatatcggaacgcttatcgtgtcattgttcttcccaatattaagtgatgcattaagtacagaatgggtatttttaatctttgcgttcataggtgttttagcgatgattttcgtaattaaattcttaccagaaacacgcggacgtagtttagaagaaatagaatatgaattacgtgaacgtacaggggcaagaactgaataa

SEQ ID NO: 1799 - DNA, 306 bp, Staphylococcus epidermidis
ataccgagtgaggttaaactcaaaaagttcctaaaaatcattcaaaaaacaattcattacatcaatcatcatttagaaagtgcaattgaaatttactcaacgtatactcaaaccgatatctctaaccaattaaacaaagatacaattgaagcaacagctaaatgttttacaaatgatttgtctatgagttccgactactacaatgatttacagttgtggcttaaagaagtcaatgatattaaagacacgattaacccaactttatattttacaaatcaactactattcagtcgatatacaaaataa

SEQ ID NO: 1800 - DNA, 1437 bp, Staphylococcus epidermidis
gtaaaggaagatggtgtcgtgggaagtactgttaaatatcgtaagtttattctacctattgtcgttggtttaattatctgggcattgacgcctattaaaccagatgccttaaatgatcaagcttggtttatgtttgctatttttgtgtcaaccatcattgcttgtattacccaacctatgactataggtgcagtatcaatcattggttttacaatcatgattttggttggaattgttgatacaaaaactgccgttcaaggcttcggtaatagtagtatttggcttattgcaatggcctttttcatttcaagaggatttgtaaaaacagggctaggtcgacgtattgctctgcaattcgttaaattatttggaaagaaaacgcttggtttggcttattcacttgttggtgttgaccttatcttagctcctgctacgccaagtaatacagcacgtgctggtggtattatgtttccaatcattaagtccttgtcagagtcatttggttcatcgccgagagatggttctgagagaaaaatgggtgcgtttttaatctttactgagttccaaggtaatttaattacttcagctatgtttttaacagctatggccggtaaccctatagcgcaaagtttagctgaaaaaacggcacacgttcaaattacatggatgaattggtttgttgctgctattatacccggattgatttctctcatcgttgtccctttcattatttataaattatacccacctactgttaaagaaacgcctaacgctaaaaaatgggctactgaacaactagaagaaatgggacatatgtctatagccgaaaaattgatggttggtgtctttatcatagcattggctttgtgggtattaggaagcttcattaatgttgatgccacgctcactgcatttattgctttagcattgttactattaacaggtgtattagcgtggtcagatattttaaatgaaacaggcgcatggaatacactcgtttggttctcagttcttgtattaatggcagaacaattaaacaagttaggctttatcccatggttaagcaaactcattgctcaaggtttgaatggctttagttggcctatcgttttagttttactcatcttgttttatttctactcacattatttattcgcaagtgcaacagcacatgtcagcgccatgtacgccgcgttactcggtgttgcagtcgcttcgggtgcaccgccattattcagtgcattaatgttagggttctttggtaacttactggcatcaacaacacactatagtagtggaccagcgcctatattatacgcagctggctatgttacacaaaagcgctggtggactatgaatattgtacttggtatagtctattttattatttggattggtgtaggttcactatggatgaaactcattggtatgatgtaa

SEQ ID NO: 1801 - DNA, 792 bp, Staphylococcus epidermidis
ttagtaatggatatacaaaagtttgaatcttatttaaaaattaagcattcatattattcaaacccttctcttgaagcattgaattactatgtaagacgctttatgataactgtgccatttgaaaatattaatgtacaaaacaagattcctatctcaatcgatatcaaagatttatacaataaaattgttattcaacggcgtggcggtttttgctatgaattaaatcatttgtttgctacgtatttagaacataaaggcttccacgtcactcgtgctgcggcaacagttcacacaccaaatggtgggcgtagtcctgaaggctcgcatatgtcactttacgttaatatcgaaggaacactttatattactgatgttggatttggtgatttacctacaagtattatcgagataggttctaaaacacaattcattccaacatatgataaaaatggagtttactgtgctgtttggattaatgacaatcaatatgccttacagaagcttagacaaaataaatggatgacactctatgaagcgcatttaaaacctcaaagcattaaagactttaaagataaaataagctacaatgagcatcatcctcattctatttttgtacgacatttgcttattacacaaccacaatcgtttggacgtgcaacaatgacttatcattctttaactttaagcaatgacagtactaaacataaatatgacgttactaccaataactacaagtattttttaaaaaaatattttaatttaaatgtatcaatcatcccatttgaaccataa

SEQ ID NO: 1802 - DNA, 450 bp, Staphylococcus epidermidis
atttatagtttacttattaataataaggagatttgcccattggacctaacaaatcaaaaaatcctacacttacttgagcaaaatagtaagctatcgctttctgaaattggaaaggaagtaaatttatctacaccctctgttcgagaacgaatctataaacttattgattcgaaaatcattgaacgatatacaatcgatattaattacgatgcattaggtttcgatattaatgttttgatagaagtaactataaaaaataacctatataaagatttcaaagcatttatttcagttcaaaacaatgttgatttttgctatagaatttctggagatagttgctttatatttaaagcgcattttaaaaagatgagcgaagtcgaaacactcatcaacgaaatccaatattatggtcatacaaaaacacattttatattttcagaaacaaaatag

SEQ ID NO: 1803 - DNA, 1062 bp, Staphylococcus epidermidis
ccacataaggaggtttttacgatgagtgaagaacgcaagttaacatttatgggggctattaatgaagctattgaccaatctatggaaaaagatgaggatgtcattttaattggtactgatgtctcaggtggtgcaaaagtagaccacatcaaagatgacgatacattcggtggtgtatttggtgtaacaaaaggacttgcaaaaaaatatagtcgtaaacgtgtaatcgatacaccaattgctgaacacattacattgagcacggcagtaggagctgctgcgacagggctacgtccaattgctgaactcatgttcaacgactttattggatttggtttagatccaattttaaatcaaggggcaaaaatgagatatatgtttggtggaaaagccaaaatcccactagttgtacgtactgttcatggagcaggggcaagcgctgctgcacaacactctcagtctttatataatatgtttgcagcaattccaggagttaaagttgttgttccatctaatccatatgatgcgaagggtctactgatgtcagctattcaagagaacaatcttgttgtcttttcagaagataaaacattattaggacaaaaaggtaatgttcctgaagaaccttatactatagaaattggtaaagccaatgtgacgcgtgaaggtgacgatttaacaattgtggctattggaaaaatggtagctgtagcggaagaaactgctgaaaaacttgcagaagaccaagtatcagttgaggtcatcgatttacgctcagtgtcaccatgggatcaagaaacagttttagattctgtgaagaaaacgggtcgcctaattgttattgacgaatctaatccacagtgtaacattgctggagacgttgcttcagtgattggagatgtaggatttgattacttagatggtccaattaagaaagtgaccgcaccagacactcctgtaccatttgcagcgaacttagaggcggcatatatgccgaatgctgataaggtattagacattgcatctgaattaattgatgatttaaaaaaggctaacgcatag

SEQ ID NO: 1804 - DNA, 363 bp, Staphylococcus epidermidis
gtagcatcactattagaatgtattgttactgcaccagccggtttaatctatgttatttacctatggcagcaacaacacataacatttggattaaatatatcatcattttggctactattttcaggtgcaattacagcaataccattgattctgttctcagcaggtgctaagcgaattccattatcgttaactggcttcattcaatatgtagggccgacaatcatgtttatcttaggtatctttgtctttaaagagccatttaacactgatcaattgattacctttatttttatatggataggtattgtgttatatagtatttctcaatatgttcaaattaagaagaacccagttgtaaaatag

SEQ ID NO: 1805 - DNA, 531 bp, Staphylococcus epidermidis
actttgagactaaaagtaaaggggagtatgaagatgaagtcttcagttcgattgttgaatcacatcataaagataatgaacttacaacaatcattaattataagagatgaacagtggaatcaatcttatgaggcatacaatttcaatattaatggctacgtatttaaaagtaggttagctaagaaaacaacaaagaaaaaaggatattttttatcgctttgggaaaaagataaaacaaagaaaaatcgagcatttgactatgagtcatttcctgggaaattaattgtacacgtgttggatgattctcaagtaggtcagtttatttttccaaaacatgtactttttcataaaggtattttaagaaatcatgcatctaaagggaaaatggcttttcgagtgtatcctacatgggagaaagatttaaatcgtgtcgctcacaagacacaagagtggcaaaaacaatactttatagatatgtctcaaacaattgatgtaccaagtattaaacgtgcttattttaatgaagattga

SEQ ID NO: 1806 - DNA, 642 bp, Staphylococcus epidermidis
ttaaatggatggaggaatttttttatggacaaattaacagtaggtttagaatggtttttaaatcctgatcatatgccgttaatcttaggtatcgaaaaaggttggtttaaagaagaatcattagaaattgagatgattgaaccaaaggaacactttgacgcactagacgagattgaaaatggttcaatggatatcgcgattactgaacctattcatctggttcaagatagagctaaagaacaaaaagtcatcgggtttgcgagatatcttcacactaatggaggtattatgtataacaaagataaaaatatcgctcgccccaaagatttaatcggtaaacggcttcaatatcccggtgctcccggtccaggtggtattgctatggctaaaacgatgattgaagctgatggtggtacatttgaagaaggtgacatcacaccagttaatcatagtttttatcatactgatgcacttttaactgataaagctgatgctgctacactcattttcgaaaattttgaaattcttgaagctagaaatcaaggacttaatgtagattattttccacttaaaaattataatgtacccgatttttgtcaactcattttcattacaacacctgaagtattaaataccgagtga

SEQ ID NO: 1807 - DNA, 660 bp, Staphylococcus epidermidis
gtctacttaaggagtgtttgcatggaaatattagtcacagcatttgaaccatttggagatgaaaaaattaattctgcactagaggctgttagccatttggaaactaaaattggctgtcataaaattgatcgattgatacttcctacagtatttcatgactctgcggatatgattgctaaagtgttaaaatctaaaaattatgatgttgctctagctatcggacaagcaggtggtcgtagtgaaatcactcctgagcgtgtaggtataaatatagatgacgcacgcattaaagataatcaaggacaccaacctattgatcaagttatacgtcacgatggcgcacctgcttatttttctaatttacctatcaaaagaatgacaatggcaattcaaaaggctggtcttcctagcagactatctaattccgctggaacatttgtatgtaatcatatcttatatcaactcggatatatggcagaccatttttaccctgacttattatttggatttatacacgtgcctttgattcctgaacaaacaatcaatcattctcaacaatcttcaatgtccgttgaagatatcgtaaaaggattaactgaagcaatcaaagctatcgacttcgttgaagataacaagatcgcattaggagaaatccaatag

SEQ ID NO: 1808 - DNA, 831 bp, Staphylococcus epidermidis
gggaggggtggcttaagtatgaacaataccatcatttcaatgaaagaaaaggaattacgttttttaaagttttttcatcaacaaaaatataatgttgtagattttaacttaattgaagaattggattggcaacgattgactcatgaagatttgcaacaaatggatgaaagaagcttttggcaacaaaataaatctatctatgcattaagaaatgattttaccgatcaattattcagatattattcgaactatccaacacattttaaaaaagtagcttatgcaggggatattatcagagataacagagttataaagcaagtcggcattgagaattacgagccacaatttgataatatcactcaaaatttcttagatttccaatattttattcaaaacgtacttcatgatgacattcaatttatcattttaggtcactatcaattgattgatgcacttttagagaaaaatcatcaaactagagaagttatggagatgatagaagaacgtaatttatcagggcttattcaaacactaactttcaatcatcccatcattcaaattcttaaagagaacacattaaatcaacttaaaatactctctcattatttaccagagcgacaccctgcaatggtggcaattcaatcttggtcacaatggtttactgatcatgggattactgaaatccaccttgatgtaactgcacaagcgcctagatcttattacaaaggtatttttataaaatgtcatcttaaaaatactgctcatagcgttttgacaggtggatattatcacggttcactagaaggttttggtttaggattaacactttaa

SEQ ID NO: 1809 - DNA, 999 bp, Staphylococcus epidermidis
ataaagagagggattcaatcgatggcaaatcaaaaattaccaacattaaaatatactggtaaatcagaaagtgcagtgccaattgtgtcagaaagtgaattgcaaacggtaacagcagagccgtgggtgaaaatttcagataaagggttacaactagaaggacttaattttaatcgcgaaggtcagttattcttattagacgtgtttgaagggaatatttttaaagttaatcccgcaacaaaagaggttacaacaaaatttcagtctgttaaagataatccggcagcgattaaagtacataaagatggtcgtttatttatctgttatctaggtgattttaagacaactggaggcatatttgcgacaacagaaaaaggtgaacaaatagaagaaattatttctgatttaaatacagaatattgtattgatgacatggtttttgacagtaaaggcggattttatttcactgattttagagggtattctacacaacctttgggcggtgtttactatgtagatccagactttaagacggttacgccaattattcaaaatatttctgtggcgaatggtattgctttaagtacggatgaaaaagtgctatgggtaactgaaactacaactaatcgacttcaccgaatcgcattagaggatgatggcgtgactattgcaccatttggagcgacaataccatattattttacaggtcatgaaggaccggattcttgttgtattgatagtaatgataatttatatgtggctatgtatggccaaggacgtgtattagttttcaataagagaggttatcctataggtcaaattttaatgccaggacgtgatgatggaaagatgttacgtacaacacatccacaatttatacctggtacaaatcaacttataatttgtactaatgatattgaaaaccattctgaaggtggatctatgctttatacagttaatggttttgctaaaggatatgagagttatcaatttcaataa

SEQ ID NO: 1810 - DNA, 777 bp, Staphylococcus epidermidis
attctgggagggattatcttgattaaaaaaagagtgattccatgtttagatgttaaagatggacgcgtcgtaaagggtatccagttccagtcattaagagatatcggtaatccagttgatttggctctttattataatgaagccggtgcagatgaactagtctttcttgatatttcgaagacggaagcaggacatgatcttatgatagaagtgatagaagcaacggcaaaacaattatttatccctttgacagtaggaggagggattcaaaatttagatgatattacacaactattaaatcacggagcagataaaatatcactcaattcaagcgctttaaaacatccagaattaattcgacaagcaagcgagaaatttggtcgtcaatgtatttgtattgctattgatagcttttatgataaagacagagaggattatttctgtactacgcacggtggtaaaaaactaactgatgtcagtgtatatgattgggtacaagaagtagagcatttaggtgctggggaattgcttataactagcatgcatcatgatggaatgaaacaaggttttgatattgaacatttagcaaaaattaaacaattagttaatattccgattatcgcctctgggggtggaggaaatgcacaacattttgttgaattatttcaacaaacagatgtttcggcaggtttagcagcaagtattttacatgatcaagaaactacagtggcagaaattaaagataaaatgcgtgaaggaggtatcctcgtgagatga

SEQ ID NO: 1811 - DNA, 771 bp, Staphylococcus epidermidis
ctgtcaatgggttggaatgagtctcattttttaatcatttatattgagggagggttaatggtgtcttcggagtataaaaaaggaatatttttagctttaggtgcttatattttatgggggattttacccatatattggcgtttaattgatgaaataggcgcttttgaaattttggcattccgtattattttttcagtgatatttatgatttttgtgctcattataggaaaaaatcaacggaacgcttttttaagagatgttaatcagttggtatcgcatcccgtgcaacttattgccatcatagttgcagggtatgttattacagtgaattgggggacatttatttgggcagtatctaatggtcacgtgctacaatctagcctaggttactacattaacccactagtgagtatcgtcttggcgcttatatttttaaaagagagatttaataaattcgaatggttagccatcatttttgcattaataggcgtactttatatgacaataaaaatcggtgaatttccatttatttcacttctgttagcattttcttttggtatttatggtttattaaaaaagattgtgcatatcgatgcgataagtagcatcactattagaatgtattgttactgcaccagccggtttaatctatgttatttacctatggcagcaacaacacataacatttggattaaatatatcatcattttggctactattttcaggtgcaattacagcaataccattgattctgttctcagcaggtgctaa

SEQ ID NO: 1812 - DNA, 591 bp, Staphylococcus epidermidis
aagtatgatattaacgagatgggtgacaaaatgtataaatatttaaaaagaaatcgattctcaacgcagacttcaattataaaaaatgacgctcagcaacctgttggtatgatatcgaaagtgtataaaaattttattcaaaaatgtattggttatttgaccttaggtttaaaattaaatcaatatgagatatgtgatgtgaataataatagtgtagcttatattaaggtatcgcgatatatggagaaaaaacattttaaagttgaatatcatgattcaaaaggtaggcagtgtgaagcgttatttgataagcaaagtaatggttatgaggagacgtatggaatattaaaaattgacggtataatattaaatattcatgctaatgagaaacatcatactactatcaaagatataaagcgagatacacaaattgcgagttggaaacaaattggtgattatgcttatgcagaagggaatgatgggctatttaaagaacatcaattactctatattcttatcatgcacgcttttgctaatacatatgtgagcaaacgtcaaacgagcttgatgttcccagggccacctgtttaa

SEQ ID NO: 1813 - DNA, 417 bp, Staphylococcus epidermidis
atggctataattaacttatctcatcgtggtgatacttcttttgacaaacttctcggacatctccctagtgttcaagaaaaatggaatgcattggaagatatattaaaaaatgaggggcaattatctgttgatttaaaagaagaaattaggaaaatactagctcaaaacagtggttgtctatactgcaaatctaaaggaaaacccaataagaaatttaccgatgaaaaatctttagtttgcataggatttgttgatgtttatgtgtcacaaaatggacgggttccacaatctacaatacaggttttaacaaagacactaactgatatagaaattgtagaattgttagcattcatatcatttacccactgtcaacaagaatttggtgccatgatgaatttacaacctagcaataactga

SEQ ID NO: 1814 - DNA, 234 bp, Staphylococcus epidermidis
aaattgataattaagaacgtagaaagatttcattataaaagaaagaattttccgaaaaatacttgtcagataacttgtaacatgttagtgtattactacatttttactttaatgtattatcgaactaaagaattcggcgtgagggaggggtggcttaagtatgaacaataccatcatttcaatgaaagaaaaggaattacgttttttaaagttttttcatcaacaaaaatataa

SEQ ID NO: 1815 - DNA, 579 bp, Staphylococcus epidermidis
atgattgcgattattgattatggattgggaaacataagtaacgtcactcgagcaattcaacatttaggatatgatgtgattttgacatgtgatgataaagacgtgcaaaaagctgaagctatcgtacttccaggtgttggacattttcaggatgcgatgcattctatagaagaaaaaagcattaaagatatgcttaaaaatatacatgataaaccgataattggaatatgtttaggtatgcaattactttttcaacatagcgcagaaggtgacgttagtggattggaacttgtcccgggaaatatagtgccaatccaatcatctcatcctattcctcatttgggttggaatgaattaaagagtacacatcccttactgcaaagtgatgtgtattttgttcattcatatcaagcagaaatgtcagaatatgtagtagcttatgctgactatggtacaaagattccgggagtcattcaataccgaaattatataggtatccagtttcatcctgaaaaaagtggaacgtatggattagagattctaaatcaagcgcttaaaggagggtttattaatgattga

SEQ ID NO: 1816 - DNA, 504 bp, Staphylococcus epidermidis
ttaccgcctgtgccttttatcttgttaatgtctaatcctttatcctcagccatattacgtgcgaggggtgagataaagattctttctcgtgctgcgcttttaggcgaattatctttattatcggaagacggttgtgatgtatctttaacttcttgcgtttccttctcatgctcgttgtcttcttttactttttctgatgctaaatcatcttcatctttatcaatagcttccccttcttctccaattatacctaataccgctttaacctctgcatcttctccggcttgcactttaatttctaacaatgtcccactcgccggcgcttcaacatcgttggttaatttttcagagcttattgtaacaatactctctccttgttttacggtgtcaccctctgatttaaaccactcttcaacagttccctctttcattgtcattccaagctttggcataataatattttcactcattgtgatacacctcctatgcgttagccttttttaa

SEQ ID NO: 1817 - DNA, 732 bp, Staphylococcus epidermidis
atcaagcgcttaaaggagggtttattaatgattgatttatggccagctattgatttaattaattcaacaagtgttcgattaacagaaggcaaatatgattcaaaagaaaaaatggaaaaatctgtagaagacagtatccgattttatagtcaatttaaatgtgtgaaacgtatacatattgtagatttaattggggctaaagcaaaagaggtaaaagaattcgactacatccgttccttaagaaagttgaccactaagcctatagaagtgggtggcggcattcgttcaaaacaaacaattgaaaattatattcattcaggaatagactattgtattgtaggtacaaaaggtatccaagatatagagtggttaacacatatgacacatcaatttccaaataaactctacttatctgtagatgcttttggagagaaaataaagattaatggatggaaagaggatgctaaactcaatttatttgattatgttgccaaaattgagcatttacctttgggtggtgtgatttataccgatatttcgaaagatgggaaactttctggacctaattttgatttgacaggtcgtctcgcactttatacatcgttacctgtgattgcttcaggaggtattagacatcaagaagacttgtttcgattagaatcgttaaatgttcatgctgctattgtaggaaaagcagcacatctggatgaattctgggagggattatcttga

SEQ ID NO: 1818 - DNA, 207 bp, Staphylococcus epidermidis
tttaagccagttaatgaagatcctaaaaatatggctaccatcaaaatagtaattaagattttagtgaaattattattaggaacatcaaagagatggtttaatccaccaccgatttgcataattcccaaaccaatcgacgtagcaattcccatgacggttgcgataatagctaatatatcaataatattcctgaaaggacgtttataa

SEQ ID NO: 1819 - DNA, 1722 bp, Staphylococcus epidermidis
acgttggaggttgaaaatatgaaaagtgcccaagcacttaaacagaatttaacatcgttagacggtcaaaagtacggtgcgtataagcaaataaaagacctatacgaatttaatttatttaaactacgtattaatcatatccaagctgatccatttgcgccaccatctaagatgagtgttgttatagatcgccaacaagcaaaatttcctgattctttattaaattctgaactgaaacaacgggctgtgagtgattacttaacgcgcgtgtttcataagcagattcaatcaatagtagcccaagataaaaaagtaagtaaaattcaaattgatagttgtggccaagaaatcttagagcgtaccgcaatagtaattaagaatcatcaaattgaagcacgtattgaagttggattaccagcacgaggacgtaccatattaggtagaatagcaagacatacacttattaatgtattacctcaaatagtagaacatgccttatgttatcgcaacattaatggttcacaattgcaacaacaagttgaattaatgatggatcaagaggagattagacaacagttagtaaaacgtgaccttgttgcatttgtagcaaatggtgctattttaccaagaaaaagtggtgtttcagatctccctatgaataacgctattgaatttaaaagtcctaaacaatatgagattgtaatgaaactatcgagtggcaaagttattaagggtatgggtattcctaaaggcattacactaatagttggaggcggttatcatggtaaatcaacattacttgaagcgttagaacgaggtgtatataatcatattgctggtgatggtagagaatatgtgattacaaatcaagatgcaatgaaaattcgtgctgaagacggaagaagtattcaaaatgttaatatccagccatttattgatcatttgccaggtgaaaaagatactacacatttttcaactgaaaatgcgagtggtagtacgtctcaagctgcaaatgtcatggaagctttagaatcacaagcatcattgttactcattgatgaagatacatctgcaacgaatttcatgattcgtgatggtcgtatgcaacgtttaattgctcccgaaaaagagccgattacacccttttctaataaggtaaaagcattatatgacgaccataacgtgtcgactattctaatcgttggaggttcgggagattattttgacgtggcagatcaagtattgatgatggatgaatatgtgttgaaagatgttacgcaacatgctaaagacattgcgcagtcagatggttatcaaagaaggctttcttctcactatcagttcggtcacattccatcaagaattccgttgagagcgagttttaatcaaaaagggaaacgtgatcgctttaaagctaaaggattgaatgtagtaacgtatggtaaggaaactattcatatttctggcttagaacaacttgtcgatgacagtcaaacacaaggtttagcgatgatgttaagttatgtaaaaaatgaattgctagatgacaaaagtacgattgtagaattgaccaatagtttgtatcaacggattgagaaacacggattagatgttatatcaaatcatcaggggcatcctggtcatttagcgctacctagaaagcaggagtttattgcgacacttaatcgatatcgtagattaaaaataaagcaaagggaataa

SEQ ID NO: 1820 - DNA, 1425 bp, Staphylococcus epidermidis
aatttcttattcctcatgcaaatgaaattgggatggcacaacgtactattggtgaaaggaggcatttattatatgagtaaatcatatgacttaatcgtaataggagctggacctggtggctatgtagctgcaatacgtggtgcgcaacttggtaaaaatgttgcagtcattgaaaaaaataatgctggaggcacgtgcttaaatgtaggttgcatcccctctaaaacgttgttagaacacggcgagaaagcacacagcatacgagttgcaaacgattggggaatcacaacgaaagacttaaaaattgattttactcaatttgtccaacgaaaaaagaaagttgtacaaacacttacgggtggcgtgaagcagttgttaaagaaaaataaagttacttatattgaaggggaagcacgaatttctaaaaacttaaaagtggacgttaacaatgaaacgtatcaagcgaaagatataattttagcaactggcagtcagccgttcattccaccaattgatgggttagatcaagtcaattatgaaacaaccgatacatttttcgatttagagaagctaccaaaacagttagcggttatcggtgggggtgtgattgcaacagaactcgcatcctcaatggctgatcttggggttagagttacgataatagaagttgcagatgacattttattaactgaaatcaacgaaactagagaaatgttaaaagcacatttagataatcaaggtattaagatactgacgaaagcaaagataaaacaagtaaaggaatcgaaaataatattagatgggcaagatgatgttagctttgatacccttcttgttgcaacaggtagacaaccgaatacgcaagttgcaaaagatttaaatttggaaatggatggtaaattctttaaagtcaatgaacattatgaaacgagtcaaaaacatgtctatgctataggagatttaattaaaggatatcaacttgcacatgcagcaagtgcgcatggcattcatgttgtcgaaacaataatgaacaaacagccgtcacttgtgcgtcaagaagatattacgcgttgtatatacacaagacttgaagcagcatcagttgggttatcagaagagcaagctaaagaggctggttatgatgtgaaagtgactcaatcagcatttcaagggaatgcaaaggcgttaatcaaaggagaaaatgaaggatttattaaacttgtcgttgataaaaagtatggagaggttcttggtgcttttattgtaggaccacatgctacagatataattggagaacttttaagtgtcaaagcatcagagggtacgattcatgaactttctcaaattattcaaccacacccggctttattagaagcaataggtgagagtgcagatgcattttttgattctgcaattcatatgtag

SEQ ID NO: 1821 - DNA, 1260 bp, Staphylococcus epidermidis
gagtgtctattaactatgcttagcgcacaacaatttttaaaagaatttaataatgttgaatctctagatgaatctttgtacgagatagtgagtcagatttgtgaagaagttaaattacagggagataaagctttaaaaaattataatttacaatttgatcaagtggaaactgagaagcttgaattagagcaaagccaactaaaaaatgcatacgacatgctagataatgaaacacgagatgcattagagcaaagctatcagagaattaaagtgtaccaagaaaatattaaggtaaaacaggaatcatctcaacaaactgaatgttatgaacgataccatcctatcgaacgtgtaggtatttatgtgccgggaggtaaggctagctatccgtctacagtattaatgactgcaacacttgctcaagtagcaggtgttaatgagattactgttgttaccccacctcaaaatagcggtatatgtcaagaggtgttagccgcttgttacattacaggcgttcatcatgtttatcaagtcggtggagcacaaagtattgcggcgctaacttatggcacggaaactataaaaaaagtcgacaaaatcgtaggtccagggaatcaatatgttgcttatgccaaaaagtttgtattcggtcaagtaggcatagaccaaatcgcaggaccgacagaaatagccttgattatagacgaaagtgctgacttagacgcaatcgcttatgacgtatttgcacaagcagaacatgatgaaatggcttgtacttatgtgattagtgaaaatgaaaaggtacttaatcaattgaacactataatacaagagaaacttcagtatgttgaacggcaagatatcatatcacaaagtattgctaaccatcattatctaatattagctcaagatactgaagaagcatgtttaattatgaacacgattgcacctgaacatgcatctattcaaactcgagcacctgaaatgtatatagataaagttaaatatgtaggcgcactttttttaggtcatttttctcctgaagttattggggactatgtggcaggtccaagtcatgtacttcctactaatcaaacagctagatttacaaatgggctttctgtgaatgactttatgacacgacattcagtcattcatttatcacaaaaaacatttaacgaagtggcagaatcagctgagtatattgcacatatagaatctttatttaatcatgaaaaatcgattcacgtacgccgataa

SEQ ID NO: 1822 - DNA, 252 bp, Staphylococcus epidermidis
ttaatatcctccttagggaaaaagatgggtagtaatgttaaagattctaaaattacaccgaataaaataagtttatttaccggttctttagttactaatgaaataactacgatagtacaatataaaaatatggagagtattttttttcgctttacaagacgtctaggtataggttgtttcttagttgctgcaggtgcgtataaaatcgtaataattaatccgactaatgccatagataaaagaacaaaatag

SEQ ID NO: 1823 - DNA, 216 bp, Staphylococcus epidermidis
atgtcattatctaatgaagaaatgatttgtaatataagacaaaaattaaatattgtaaatcaagcattacttaatccggaaaaatttaaatcaacacctcatcaagacataagcgaaatatatgaattcgtaatgtctaaagattcattctcgcctagtgaggttacggctattgctgaccatttaggacagcttagacaagatatggaggattaa

SEQ ID NO: 1824 - DNA, 1497 bp, Staphylococcus epidermidis
atatttaagtcgattggagatgttaaagtgtaccaatataacgacgatagcttaatgttacacaatgatttatatcaaattaatatggctgaaagctactggaatgatggtatccatgaaagaatagcagtgtttgatttgtattttcgaaaaatgccatttaatagtggatatgcggtattcaacggattgaaacgcgttgtgaatttcatcgaaaactttgggtttacaaatgaagatatcacatatttaaaatcgataggttacgaagaagattttctaaactacctaaaagatttgaaatttacagggaatattaaatctatgcaagaaggtgaaatttgttttggtaatgagccattattaagagttgaagcacctttaatccaagcgcaacttattgaaactattttgttaaatatcattaatttccaaacattaattgcaactaaagccagccgaattcgtcaaatagcaacgcatgacactttgatggaatttggtacaagaagagctcaagagatcgatgctgcactgtggggcgctagagcagcctttattggagggtttgattctacaagtaatgttagagcaggaaaactttttaatatacctgtatttggcacacatgcacacgcactagtacaaacatatggtgatgagtatatagcattcaaaaagtatgctgagcgacataaaaattgtgtgttcttagttgatactttccatactttaaaatcaggagtaccaaccgcaattaaggttgcaaaagagttaggagatactattaattttataggtatcagattagattctggtgatattgcgtacctatctaaagaagctcgtagaatgttagatgaggctggttttacagaagctaaaattatcgcatcaaatgatttggatgagcagactattacaagtttaaaagcacaaggcgctaaagttgacggatggggagtaggtacaaaactgattacaggatatgatcaaccagccttaggcgcagtttataaattggtttctattgaaacagatgatggcacaatgagtgatcgcattaaattatcaaataatgctgagaaagttactacaccaggcaaaaaaaatgtttatcgtattattaataataaaacaggcaaggctgagggcgactatattacgctagaaggtgaaaatcctaatgacgaatctccattgaaaatgttccatcctgttcacacttacaaaatgaagtttattaaatcatttaaagcggttaatctacatcaatctatatttgaaaatggcaaacttgtataccatcttccagatgaatatgaagctcaggactatcttaaaaataatttaagtattttatgggaagaaaataaacgatatcttaacccgcaagattatccagtagatttaagcactaaatgttgggaaaataagcataagcgtatttttgaagttgctgaacacgttaaagagatggaggatgaaaatgagtag

SEQ ID NO: 1825 - DNA, 759 bp, Staphylococcus epidermidis
agaagcattccactttatatatcatatgagtgctgtagcatagaaaggtggcgaaatatgacacgcaaatatatatcaactgaaatgttgattatttttactgctttaatgattattgctaatttttactatatattttttgaaaaaattggctttttactagtactcctattaggatgtgtacttgtatatgtagggtatgtgtattttcataaagtaagaggactactatctttttggataggaaccttattaattgcttttacacttttgtctaataagtacacgattattattctatttatatttttaattgtagtcatcatacgttatttggtttataagtttaaaccattaaaagtgattgctacagatgaagacatcacatcacccatttttattaagcaaaaatggtttggtgaacaacatacaccagtgtatgtatataaatgggaagacgtacagattcaacacggtataggagacatacacattgatatgacaaaagcggcaaatattaaggaaacaaataccatagttgtgcgtcatattttaggtaaagtacaagtagttgtacctcttaattataatataaatttacatgcgactctcttctacggcactgcttatgtgaacgataaatcttataagattgagaataaccatgttcaaattgaagaaaaaacgaaagatgataattatactgttaatgtttacgtttcatcattcattggagacgtagaggtgatttacagatga

SEQ ID NO: 1826 - DNA, 1377 bp, Staphylococcus epidermidis
aaacgaacttttcttataaaaaatgtgataatgtacagtttttgtaggagctataatacatacgataggagtttacaaagaatgatagaacgttattcaagagatgaaatgtctagtatttggacggatcaaaatcgctatgaagcatggttagaagtagagattctagcgtgtgaagcatggagtgagttaggttatattcctaaagaagatgtaaaaaaaattcgtgaaaatgccaaagtaaatgttgaacgcgctaaagaaattgaacaagaaacacgacacgatgtagttgcatttacacgccaagtttctgaaactttaggtgatgaacgtaagtgggtacattatggattaacttccactgatgtagttgacactgccttaagttatgtaattaaacaggcaaacgaaatccttgaaaaagatttagaaagatttatagatgtattagctgccaaagctaaaaaatatcaatatacattgatgatggggcgtacacatggagttcatgctgagcctacaacttttggcgtaaaaatggctctttggtatactgaaatgaaacgtaatcttaagcgttttaaagaagtgcgtaaagaaatagaagtagggaaaatgagtggagcagtaggaacatttgccaatattccacccgaaattgaggcttacgtatgtgaacatttaggaatagacactgcagctgtttctactcaaacattacaaagagatcgtcatgcttattacattgctacattagcactaattgctacatcaatggaaaaatttgcagtagaaattcgtaatttacaaaaaactgaaactagagaagtcgaagaggcatttgcaaaaggacaaaaaggatcatcagcaatgccacataaaagaaatccaatcggttctgaaaatattacaggtatatctcgtgtgattcgaggatatattactactgcatacgagaatatacctttatggcatgaaagagatatctctcattcttctgcagaacgtatcatgttaccagatgttacaattgctctagattatgcacttaatcgatttacgaatattgttgatcgactaacagtttatgaagataatatgagaaataatattgataaaacgtatggtttaatcttctcacaacgcgtactactagcattaattaataaaggcatggtacgtgaagaagcttatgataaagttcaacctaaagcaatggaatcttgggaaacaaaaacaccatttagagagctaattgaacaagattcatctataactgacgttctatcaagtgaagaattagatgattgcttcgatcctaagcatcatcttaatcaggtcgacactatattcgcgcgtgctggtttatcttaa

SEQ ID NO: 1827 - DNA, 507 bp, Staphylococcus epidermidis
ttgaagatgttaagtaaagaactattagcagctttaaatgaacagatgaatcaagaatattttgcagcgcatgcatatatggcaatggcagcatactgtgacaaagaatcttatgacggatttgcaaatttttatatagaacaagctaaagaggaacgtttccacggtaaaaaaatctatgactatatcaatgatcgtggcgaacatgccatctttgatacaattaaagctcctaaagtagaattttcttctattttagaaacatttaaagatagtttagctcaagaacgtgatgttactcaacgtttctataatctatcagaattagctcggaatgataaagattatgctacaatttcatttttaaattggttcttagatgaacaagttgaagaagaatctacatttgaaactcatatagattaccttactcgtattggcgatgattgtaatacactttacctatatgaaaaagaattagcagcgcgttcattcaacgaacaataa

SEQ ID NO: 1828 - DNA, 303 bp, Staphylococcus epidermidis; identical to SEQ ID NO: 234

SEQ ID NO: 1829 - DNA, 213 bp, Staphylococcus epidermidis
acattaacgtttcctaaatgtatatctaaaggtgctacgtataaatatagaagacattgttttttcatctcaacacatcccactttccacattttctttagcgttttagaaggaaatgctcatcactttgttcatgaccttttgttaattaaccatcggcataagttatttacaattcagtcattaactgctaatacgttaaaatgcccctag

SEQ ID NO: 1830 - DNA, 840 bp, Staphylococcus epidermidis
cctttatttacgataaaatacataatatacatatatagatggagggaaaagtttttctttttaaatttggcacaaaaaacgcgttttgttaaattgcggtatcccctattaacccgtttctattctcacggtttagctcaaatactacctgggttggttttaggtagccatttacttggagatatgtataaaatgcaaactgcccaaacaatgagtatcatgcaagtatctatctttatcatcgctgcattgttaatcattttcatgcaagcaaccattaaaaatcctactcaattagaacaaggacataaggaacctaaaagatatattttcgcctgggttctattaggattttgtattgtgatgatttaccaaatcatcatcagtataattttatttgccatcaatggcagtccgcaaagaagtccaaacactgaaaggttaatggctattgctaagcaaatgccgatatttatcgttttaatatccatagtaggtcccattttagaggaatacgtttttcgtaaagttatcttcggagaattgtataactttataaagggatcacgtgtggtaagctttatcattgcttctatagtaagttctctaatattcgctttagcacataatgacttcaaatttataccggtatattttggaatgggagtcattttctcacttgcttatgtttacacaaaacgaattgctgtacctataggcatacacatgcttatgaatggttcggttgtattaactcaagttgtgggtggagattctattaaaaaattgcaagaactaaaggcccccaacatttatattccatcttatattttaaaataa

SEQ ID NO: 1831 - DNA, 840 bp, Staphylococcus epidermidis
aagggtgagtttgagaaaaggagaaaacccatgaaaagaagcgataaatatacggatgattatattgaacaacgttatgagtctcaacgacctcattacaatacatattatcaaccaatagggaaaccaccgaaaaagaaaaaaagtaaaagaattttcttaaaagcaattatcactatattaattttattgattatattttttggtgtcatgtactttatttcttcaagagcaaatgtagatgatttaaaatcaattgaaaataaaagcgattttgttgctaccgaaaatatgcctaactatgtaaaaggcgcatttatttcaatggaggatgagcgtttctataaacatcatggctttgatataaaaggaacgacaagggcattgttttcaactattagcgatagagatgtgcaaggtggaagtacaattacgcaacaagttgtaaagaattattattacgataatgaacgatcctttacaagaaaaatcaaagaattgtttgtagcgcgtaaagttgaaaagcaatacagtaaaaatcagattttaagtttctatatgaataatatttattatggtgataatcaatatactgtagaaggtgctgcaaatcattattttggtgtaacggtcgataaaaacaattcaaatatgagtcagattagtgtgttacaaagtgctatattagcaagcaaagtaaatgcaccaagtgtgtatgatgtaaatgatatgtcgaataattacatcaatagagttaaaaccaatttagagaaaatgaaacaacaaaattttattagtgaatcacaatatcaagaagctatgtctcaacttggaaattaa

SEQ ID NO: 1832 - DNA, 1155 bp, Staphylococcus epidermidis
atagtgtatacttatactattaaaattagaaatgagattattatgaaaatagtagaagtaaaatctaagaatggtaccaattttatgattttagatggtaataatgaacctatagtagatgcagtaagatatttgaagtatctggatagtgttaagaaaagtttaaataccaagaaaacctatgcctatgcactaaaaaatttttttgtttacttagaaagtaaaaagatatgctataaagaagttagttttgataactttgttgattttataagatggatgaaaacaccttttgaatatgagaatgtcctctcttatcaccgaaaagaaaaaagcattagtcctaagacaattaatctgactatgactgtagtatctaatttttatgattatctctataggagtaaaaaattagatgttaatttctatgattttatgcatatggaaagtaaatactctaaaaaatataaaagtttcatgcatcacataaataaggactatagaacgttgaaaaatattttgaaagttaaagaaccaaagaaaaaaatagaagtgttaactaatgcggaggttaagaaattattagaggaagctaataatattagagataaattcttaatacaattactatatgaaaccggattacgtataggtgaggtattatcattacgtattgatgatattaaatttgactttagaaaaggccatcaaatagttttgaaaaatagatttaatgataatggtacttatttgaaaactggggaaagaaaaatatttatttcccaatcgttaattgatttatacgatgattatgtctacgaaataattgacgaactttcaatatgttctgattatctttttgtaaaaataaaggggagaaatgtaggagaagctatgaattatagtgatatatattcattatttaaaaggctaaaacataaaacatctataaatgttcatcctcatttatttcgccatacacatgcaactgttttttataatgaaactaaggatataaaacaagttcaagaaagacttggtcatagtaatatacaaacgactattaatttatatgttcatcccactgaagaagatatacgtgaagattggaataaagtaaagcatcaatttcaagtttttaataaaggggaatga

SEQ ID NO: 1833 - DNA, 1089 bp, Staphylococcus epidermidis
gaggcacatacaactatgaaagacaacaaacctaataattcgaaattaattcaaacatatttaagtaagaaaactttaagatatggtacagcaagtgcattaacattggcactctatttatttaacagtaacgtaactgtgtatgcggatgaaaatactgcaaaccaaaatcaaggaacatcaccaaaaatttcacagacagcacctacaaataatactgaaaatacagatgccacagccataacaacagatcaaaataataatgatgaagaagaatacgatgcgtcatatgaacttccaattctttatgtaactgtctggctagatgatcaaggaaatattattaaagatgctgtggaagatgctaaaacccctgcttcagaaaggcaaccggtgaaaattcctgggtaccaacattatagaacttctgtgagtgacggaattactaagtttatttatcgtaaaattagcactgcacaatcacctatagttgaaaataatcaacaagataataatacaaataaagttgttgaaacaaccaatcaaaataaagatgaagtgaatggaaaagaacaaaatcaagcaaatacttcagtaacaaatacacaaattaccaaaaacgagaaagacgaagacacaaaaacactaaagaaagataaagatgagaaagaatctaaagacacaaaaacaccaaagaaagacaaagaaaagaaagacataaaaactccgaagaaagatagagaagagaaaaaaccagtaataccaagtaacggtaaagtcgagaaagacgaagacacaaaaacaccaaaaaaagacaaagaaaagaaaatcacaaaaactttgaagaaagatagagaggagaaaagcccagtaataccaaaaagcggcaaagacgagaaagacacaaaaataactaagaaagacaaagaagacgaaattacaacaacttccaagaaagataataacaatgatgtacaagataaattaccggaaacaggtaaaacaaaagatattcaaaatcctgctttaataatgttacttactggattaggtttattaggattatttagaaataaaataagagaatag

SEQ ID NO: 1834 - DNA, 711 bp, Staphylococcus epidermidis
ataaaggagtttcataaaatgtacgacataaccaagtggaaacatatgtttaaattagatccggctaaatcaatttcggatgaaaatttagaggcactgtgtatgtctaacactgatgcaataattattggtgggacagatgatgtaacagaagataatgttattcatttaatgagtagagtaagacgttatccgttaccacttgtcttagaagtttcgaatgtagaaagtgtgatgcctggttttgatttctattttattccaacagtcatgaatagtaaggatacaaaatatcataacgaaattttactagaagcccttaaaaaatatggacatgtgattaattttgatgaagtttttttcgagggatatgtcgttctaaacgcaaatagtaaagttgcaaaaattaccaaagcttatactcaattaggtatagaagatgtcgaagcatatgcacaaatggcagaagaattatatcgatttccaatcatgtacgtagaatatagtggcacatatggagatgttgataaggttaaagcgattgcaaatatgcttcaacatactcaattattttatggcggtggtataacaaacattgacaaagctaacgaaatgtctaacattgcggataccattgttgtcggcgatattatatataacgacattaaaaaagcattaaaaactgtaaagataaaggagtctaataaatga

SEQ ID NO: 1835 - DNA, 579 bp, Staphylococcus epidermidis
tctaaatggttaaatacgataaaggtggtgtggagtatggtaaaggaatccatacctaaagaaggagaaaacattaagattcaaagttataaacatgatggtaatattcatcgtgtctggtcagaaaccacaattttaaagggaacggaacatgtgattattggtggtaatgatcacactttagtaactgaaagtgatgggcgtacatggattactcgagaaccagcaattgtgtactttcattctgaatattggtttaatgttatttgtatgtttagagaagatggtatttattattattgtaatttatcttcgccttttgcatgtgacgaagaagcgttaaaatatattgattatgatttagatatcaaagtttatccgaacggaaaatatcatttacttgatgaagatgagtacgagcaacatatgaaccaaatgaattatccacacgatatcgatattattttaagaagaaatgttgatattttacaacaatggatagaacaaaaaaaggggccttttgctcctgactttataaaggtatggaaagaacgttataaaaaaattagagattattaa

SEQ ID NO: 1836 - DNA, 303 bp, Staphylococcus epidermidis
ccattcgcaactttaccagaacagtttgaaacaatttatcaatatatgatagatcaaaataaagtgagcagaccagtgctttcagacgaccaactttcgcaactaaatatacatttacatgaagcactacaacaatcacgcccagtcaatatcaaatattacgaagaaggatatattaactttatagagctcattgtacatcggattgattcaataaattatgagattgaaggtactgctcctcattcaagagaacgtcataaagtttcatttttagatattatagatatttcttttatataa

SEQ ID NO: 1837 - DNA, 1209 bp, Staphylococcus epidermidis
atgaagcgaacaatatttttactcatgtcgatactgttattattaacggcttgcggagatggacataaacaaacttcatcagataaagaacaaagtgaacataaggataaccataataaaaatcaagtgaaacaaatagcgactgataaaaaagttcaaggtgataactataggactatattacccttcaaagaaagccaggctcgtggattattacaagataatatggcaaatggttataatggagaagattttgaaagtggtttactagaattaagtaaagaaatctttccaacaaataagtatttatatcaagatggacaatatttagataaaaaaacgattaatgcatacttagatccgaagtatacgaaaaaagaaattgacaagatgagcgaaaaagaaaagaaaagcaaaaatgctaatgagaatcttggactcaatccatctcacaatggtgaaacagatgaagagaaaatagctgaaaattctccagcctatctttcaaatatactcgagcaggatttttatggaaatagtgattctaaaggtaaaaatataaaagggatgacaattggtttagccatgaatagtgtttattattacaaaaaagagaaagatggcgaaacatttagtaaagatttatctgataaagagattgaaaagcaaggtaaacagatggctagtgaaatgctttctcgtttacgtgagaatagtgatttgaaagatattcctattcattttgctatctataaacaatcaagtcaagattccattacaccaggtgaatttatagttggtactacggttgaagagggtaaaactaaaattaactcttgggataatattaatgaaaaagcagccttaattccttcgtcaactgcagctgattatgatgaaacgctgaataataactttaaacagtttaatgataatttgcaatcgtatttttcaaacttcacacaagcagttggtaaggttaaattcgtaaataaaaaagctaaacaacttacagttgatttgcctatagattattacggacaggcagaaacgataggtattacacaatatgttacagagcaagccgaaaaatattttgataaactagatgagtatgaaattagaatcaaagatggaaatactccacgtgctctcattagtaaaactaaagacgataaagaaccacaagttcatatctatcataattag

SEQ ID NO: 1838 - DNA, 2076 bp, Staphylococcus epidermidis
aggggaatgactatgtcaataccaattaatttacctacaaacagtactatgattaatgaattatgtacattacaaagtagaaccatcaatataaaaggagaggttttaataactgaaatatatgatgattacttttttaaaaatgatgagtggcacattacagcttttaacaaattcaagcaatttcaagatagtatcaagaactatagagacaaaagaaaaaatgttttctttaggattaaaagtaaaaatttgaatttagaatttaaatacctttttttgaaactgatagttaaagaggattggtccttatctaatttatttaatactggagcagtaaagcttaataagattgctaagttctttaatgaagtttatccaaatttaaattctttacttgattgtgatataaatacattagaaaagcactggtttaattggctgactgaaaataatataccaataaaaagaagatcatcaacaatagtttttggtgattatgaatacaaaagcggactggcttcttttttaaagaatatgtacattaatctaattaagttcattgataagcgagaagaatgggaaaaagataaatgggatattagaaatttagaaaaatatggattgagttataataaaacactaactggcaattatttaaactttgaaaaaattgagtcaattaaaatgcgagaattagcaaaaaaatatttaaaaaatcgtttgataactggtgatatagcatttgctacagcaaggttttatataagagttttaactaggttttttcaaaatatatctaaaaataaagaaacaaggaatagtttaaatgaactagatagatgtcatatcgaagcatatatagaatttttgtttgaatatgcagctaataaacatttgcaaagtactaagaattttgtgagagaagaattaaaaacaattagaaggttcttaaacgatattataactcaaaactatgctatagcaccgtaccaagatatacgatttttaatttatcctcaagacttacctaaacacgaaaagaaaaatagtagccaaattgattatatcccagattttgtattggaacagctttttgagcatataaatgatttgcataaagatttaatacctgtagtttggatagcttttaaaacaggattaagaatttctgatgtattgacattacaaaataattgccttgcaaaagttaatggaaagtattcaataatcacagatattgctaaaacttttgttaaaggacatagaataccaattgataataaattagctgatataatagcagttttaatagccgattctaaaagtaaaagtacaaaagataataatcctaataattatatttttgctatttataaaggaaaaagaaagggaatgccctttacacaacatatggtcagagcacacttaaatcatttatcaaagactaaaaatattattgatgaacaaggagaaatcttccatttcaaaactcatcaatttagacatacctatgcagtaaaattgttaaatggtggagcagatatattaacgatacaagaattattagcacactcctcaccagaaatgactctaagatatgctaagttacttgatgatacaaagagaaaggcttttgaatcagttattgatcaaggagcttttagttttgatgttgacggtaaaattaaaaatatacagcatagtagtgaactatctgaaaaagcattgaattctttatggcaagaacataaattaaacgcaatggacaatccttatggcacttgtcatgctagattgagtggtgattgtccatacatggaagctccgccatgcctgacttgtaattctgggaaaccatgtaaggatttagctattggattttctgatttagatgttgaaaaatatgaattacatatcaaatcaacggtcaaatctatagaattagctaaaaataataatagacaagatatggttgaaaagcatataaatatattaaataaatatgaagaaatactaggtaatataaaagatggaaacattatattcgggagaagtaatagaataaaagtatag

SEQ ID NO: 1839 - DNA, 249 bp, Staphylococcus epidermidis
tcaccgaagacatatgtaaagacaacagcaaataacgcaccaataactgttgctggcaaccttttataccccttttttaatgatgctttagcagtaggttcaattgtaacaattgcagtaagtatggcaaaaattggagtgaggtttaacaacatacaaaataaagacgtaaaaaaagtagccaaaccagttttaatagttcgcgctccaattatatgtctataccatttatcattcatatcatactga

SEQ ID NO: 1840 - DNA, 1476 bp, Staphylococcus epidermidis
atggggaggacgcttaagatgagtattcgttttgaatctatcgaaaaattaactgaattaatcaaaaataaagaaattaaaccttctgatgtagtaaaagatatatacgcagctattgaagaaactgatccaacaatcaagtcattcttagctttagataaagaaaatgcaataaaaaaagccgaagaattagatgaattacaagctaaagatcaaatggatggtaaactatttggaattcctatgggaatcaaagataatatcatcacaaaagatgtagaaactacatgtgcaagtaaaatgttagagggatttgtacctatttatgaatcaactgtaatgaacaaactacatgatgaaaacgcggttttaattggtaaattaaacatggatgagtttgcaatgggtggctctacagagacttcatattttaagaaaacattaaatcctttcgatcacacagcagtaccaggaggatcttcaggtggttctgcagcagcggttgcagcaggtttagttccttttagtttagggtcagacactggtggttctattagacaacctgcatcttattgtggtgttgttggtatgaaaccaacttatggccgtgtatcacgtttcggtttagttgcatttgcttcttctttagatcaaattggaccaatcacgcgtaatgttaaagataacgcattagtacttgaggcaatttccggtgtagatgcgaatgattctacaagcgcacctgttgatgatgtagattttacttctgatattggtaaagatattaaaggtcttaaaattgcattacctaaagaatatttaggtgagggtgtaagtgaagaagttaagacttctgtaaaagaagcggttgaaacgttaaaatcacttggtgctgaagttgacgaagtctcattaccaaatacaaaatatggtattccatcatattatgttattgcgtcatcagaggcttcagcaaatttagcgcgatttgatggtattagatatggatatcattctaaagaagcacaatcgttagaagaattatataaaatgtctagatcggaaggctttggtgaagaagtcaaaagacgtatcttcttaggtacttttgctttaagctcaggttattacgatgcatactataaaaaatctcaaaaagttagaacgttaattaaaaatgattttgacaaagtatttgaatcttatgatgttgtggttggaccgacagcacctacaacagcatttaatattggcgaagaaattgatgatcctttaacaatgtatgcgaatgacttattaactacaccagttaatcttgccggtttacctggtatttcagttccttgtggacaatcaaacggacgcccaattggtttacaattaattggtaaaccttttgacgaaaaaacgttatatcgtgtcgcttatcaatttgaaacacaatacaacttacatgacgcatacgaaaatttataa

SEQ ID NO: 1841 - DNA, 921 bp, Staphylococcus epidermidis
actattgacgcgaatattacaattgtaatattattgatttatagaaattacaactgtaatattggagggtatattttgaaaaagttaatacttttaattgcaattgctttagttttaagtgcatgtaattcaaccagttcacatgctaaagagttaaataatttagaaaagaaatataatgctaatattggtgtctatgcattagatactaaaagtggtaaggaagtaaaatttaatgccgataagagatttgcctatgcttcaacttcaaaagcgataaatagtgctattttgttagaacaagtaccttataataagttaaataaaaaagtacatattaacaaagatgatatagttgcttattctcctattttagaaaaatatgtaggaaaagatatcactttaaaagaacttattgaggcttcaatgaagtatagtgataatacagcaaacaataaaattataaacgaaatcggtggaatcaaaaaaattaaaaaacgtttaaaaaaattgggagataaagtaacaaatccagttagatatgaaatagaattaaattactattcaccaaagagcaaaaaagatacttcaacgcctgctgctttcggcaagactttaaataaacttatcgcaaatggaaaattaagcaaaaaaaataaaaatttcttacttgatttaatgttaaataataaaaacggagacactttaattaaagatggtgttccaaaagactataaggttgctgataaaagtggtcaagcaataacatatgcttctagaaatgatgtagcttttgtttatcctaagaaccaatctgaacctattattttagtcatttttacgaataaagacaataaaagtgataaacctaatgataaattgataagtgaaaccgccaagaatgtaataaacaaattttaa

SEQ ID NO: 1842 - DNA, 447 bp, Staphylococcus epidermidis
gggggcagagcattggcaagtattagagaagatgtccaatttagtaatccaaccatatcggaaagtagttttaaaataaatgaaaactttgactcagaaaatttcgaaggatttggtgatattaagttgaatctgaaaaaatattattatgaagaaaataatgagattgataataataataataataatggttcagcacttttaagtttagaaataataataggcgatattgactggaagtatccttttatgtttaaagtagaaatcgaatctttttttgaatgggaaaatttcaaaggaactgatatagataaatttttagaaattaatggagctgctattttgtattcatacagccgtgcacatataagtcatattactaatacaagcaaatacccttcatttgatttacctttttataatttcacagacaatgattatcaatag

SEQ ID NO: 1843 - DNA, 1113 bp, Staphylococcus epidermidis
ttaaaaggagcatttaatttgagacttggagctcggattttcaaaactggtatagccattatcttagctatgtctatcgcttctttacttcctgataatattggtctaaaaacgttagcaggtgtcagtgcagtagttgccatgcaaccgagtgtttatcgctcaatcaaaactgtttctgaacaagctattggtaatgtgattggtgcattacttgcagtaacaatggtaacgatattcagtaataatttcattatcatgggcgttaccgttattttactcattgcaattttgttccaatttaatcttgcccatgtagcaacacttgcaagcgtaactgcacttataattatggggcaacacactggttctttctatgttgccgcattttttagatttgtactagtgatgattggtgtattgagttcttctgttgtcaatctaatttttttacctcctaagtttgaaacaaaaatttattataattctatgaatatttcttctgatatatttgtttggtttaaacttgtactcaatgacacatcagaatttcataatattaaacaggatggtgatcaactaaactcacgcatcaataaattagaaaagattttcgactattacaatgaagaaagaccattaacaaaaaaacatatttatcaacagaatagaaaaaaaatactatttagagaagtagttagaacgaccagacaagcatatgaagtgctaaaacgaatgtcacgatatcaaaatgatttatatcaactaaataatcaattacttttacaaatcaaattagaacttgattcattagttactttacatgaacaaatatttaagagtctatcaaaaaaagctagatatgatgtcactcaattagattatgaagttgacaatcctcagaagaaaaacttgatggatgcttttcagcaagaattaattaaaaacccacatcagacgcaatattcttatagcaatatgatgcaaattattgctgaaattgaagaatacagatatcaacttgaacacttagatagaatccgtttaagtttctttacctatcaccgttctgatactgatatagacatttcagatgaggactttgacttataa

SEQ ID NO: 1844 - DNA, 318 bp, Staphylococcus epidermidis
ggaggcttttatttaatgactaaagtaacacgtgaagaagttgaacatattgctaatttagctagacttcaaatttctcctgaagaaacagaagaaatggctaatactttagaaagtattttagattttgcgaaacaaaatgatagtgccgatacagaaggtattgagccaacttatcacgtattagatttacaaaacgtattacgtgacgataaagcaatcgagggcattcctcaagaattagcattgaaaaatgcgaaagaaacagaagatggtcaatttaaagtgccatccatcatgaatggggaggacgcttaa

SEQ ID NO: 1845 - DNA, 648 bp, Staphylococcus epidermidis
gcatgctttctaaaaaatgttgcgcaaaattgtataatgacacctgaggagagtagtaaacaagtgaaaatcatcgataaaaaaattgagcaatttgctcaatatttacaacgtaaaaataacttagatcacatacagtttttaaaaattcgtctaggaatgcaggtactagcgataaatattgaaaagtctatagttgtgtatgggctagcaataatctttcatactttcttttacacacttttaactcatttaagttattttttaattaggagacatgcacacggtacacatgcaaattcgtcattgttatgtcatattcagaacataattttctttattatttttccatacttaataataaagttagatattaactattttgttcttttatctatggcattagtcggattaattattacgattttatacgcacctgcagcaactaagaaacaacctatacctagacgtcttgtaaagcgaaaaaaaatactctccatatttttatattgtactatcgtagttatttcattagtaactaaagaaccggtaaataaacttattttattcggtgtaattttagaatctttaacattactacccatctttttccctaaggaggatattaatcatggaaaacatttttaa

SEQ ID NO: 1846 - DNA, 300 bp, Staphylococcus epidermidis
gtcgtccttctggaagaagggttacaaaaattaatagataggcatcatattacagcaacaataaatcgaatctatggctcactgacattgtatttcacaaatgaaaaagttacacattatgaacaagttgaaaactctgatggagatgctttcgctcaattctttaaattaatgttgaaccaaggcattaatctcgcgccttctaaatttgaagcatggttcttaactacagaacatactgaagaagatatcgatcgcacactagaagcagctgattatgcatttagtaaaatgaaataa

SEQ ID NO: 1847 - DNA, 1083 bp, Staphylococcus epidermidis
caatacattcttatgaagctaatagagaggaaaggttttatgtatctagaaaattcttttaaaaaagatattgaagattggtttcataaaaatcaaagagatatgccttggagagaaacgactaatccttattatatatggctaagtgaagtgatgttacaacagacgcaagtaaacactgttatcgattactactatagatttatacataggttccctacaatacagtcgttgagcgaagctaatgaagatgaagtgctgaagtattgggaagggttgggctattatagcagagcgcgtaatttccatactgccgtaaaagaagttaataataattatgatggtgaggtaccatacgatcctgaatcatttaaaaagttaaaaggtgtgggtccatatactcaggcggcggtcatgagtatagctttcaatcatcctttagcaactgtcgatggtaatgtttttagagtatggtcacgattaaacaatgactatcgtgatataaagttacagtccactcgaaaagcattcgaacaagaattacacccgtatgtgttgaaggatgcgggaacatttaatcaagcaatgatggagctaggggcgttagtatgtacgccaaaatcaccattgtgtttgttttgtcctattcaagaacactgtgaggcatttcatatggggactacacaagaattaccagtaaaaaccaaaagtttaaataagaaaaccattgagcaaaaagtttttcttattcgtaatgataatggtcaatatttacttgaaaagcgtaaagaaaaacttcttaatggtatgtggcaatttccaatgagagaacaaacaaatgcaaacgatgtgatatctgatgatttaggaaaaagtatcgaaacaattaacgaaccagtatttaaattaaagcatcaatttacccatcttacatgggaaattaaagtatacaatgttacagcacctcttaatataaaggaaaatgatttacctaaacaaatgacgtggtttaatttagatgatagggagcagtatacatttcccgtaccaatggataaaatatataagtttattgaaggttaa

SEQ ID NO: 1848 - DNA, 291 bp, Staphylococcus epidermidis
agatacatctatcgatactttcgcctttcaatattatcagtcgcttgtgtgatgttcttctttagattgatgattgatattatacgtgtcatcttcattagagatatctacatctttgctatcttcatagtattcataagtcgtattttcgttatagtgattttcattgttatcatcatgtttaatagcggcttcttcaggcgtgtgaccagctatgacttttctttggtgaataattgcattgatttcagcaccgataataataataaagcttgtgatatacaaccataa

SEQ ID NO: 1849 - DNA, 336 bp, Staphylococcus epidermidis
cactctatatatcaaagtgctaaatcacatgtaaatgaaggaggaacaatcatgcttaaaccattaggaaatcgtgtgattattgagaagaaagagcaagaacaaacaactaaaagtggcatcgttttaacagatagcgctaaagaaaaatcaaatgaaggtgtgatcattgcagttggacaaggtcgtttattagacaatggcacacaagttgctcctcaagtcagtgaaggtgacacaatcgtcttccaacaatatgcaggtactgaagtaaaacgtggcgacaaaacatatttaattttaaatgaagaagatatattagctattatagaataa

SEQ ID NO: 1850 - DNA, 249 bp, Staphylococcus epidermidis
gagatatctctttcatgccataaaggtatattctcgtatgcagtagtaatatatcctcgaatcacacgagatatacctgtaatattttcagaaccgattggatttcttttatgtggcattgctgatgatcctttttgtccttttgcaaatgcctcttcgacttctctagtttcagttttttgtaaattacgaatttctactgcaaatttttccattgatgtagcaattagtgctaatgtagcaatgtaa

SEQ ID NO: 1851 - DNA, 339 bp, Staphylococcus epidermidis
tttatcttgtacatcattgttattatctttcttggaagttgttgtaatttcgtcttctttgtctttcttagttatttttgtgtctttctcgtctttgccgctttttggtattactgggcttttctcctctctatctttcttcaaagtttttgtgattttcttttctttgtctttttttggtgtttttgtgtcttcgtctttctcgactttaccgttacttggtattactggttttttctcttctctatctttcttcggagtttttatgtctttcttttctttgtctttctttggtgtttttgtgtctttagattctttctcatctttatctttctttag

SEQ ID NO: 1852 - DNA, 957 bp, Staphylococcus epidermidis
caatatatgtataaggagatattgaaaatgacaaaaacttttattttcgggcacaaaaatccagatactgatgctatttcttcagctttaattatggctgattttgagcaacaaactggtaatactgaagcaaaagcttatcgtttaggtgaaataagtgcggaaactcaatttgcactagattattttaacgtagaagctccagaattattaaacgaagatttaaaaggacaagatgttattttagtcgaccataacgagtttcaacaaagtgcagatactatttcaaacgctacaattaaacatgtgatagatcatcacagaatttctaactttgaaacagctggccctttatactatagagcagaaccagttggttgtagtgcaacaattttatataaaatgtataaagaacgtggatttgaaattaaaccagaaatcgctggacttatgatttcagctataatttctgatagtttattatttaaatcacctacctgcacaaaagaagatgtagatgctgctcaagcacttaaagatattgcaaatgttgatttagaagcatatggtttagaaatgttaaaagcaggtgcttcaactacagataaatctgctgaaacacttgtcaatatggatgctaaatcattcaatatgggagattatgtaacacgtattgctcaagtcaatactgtagatattgatgaagttttagatcgtaaagaggaatttgaaaaagttatgttagaaatgagtgccaatgaaaaatacgatttattcgttcttgtagttactgatattattaacagcgattctaaaatccttgtagttggtgctgaaaaagataaagttggagaagcatttaaagtacaactagatgatggtatggctttcttatctggcgttgtatcacgaaaaaaacaagttgttcctcaaatcactgaagttttaactcaataa

SEQ ID NO: 1853 - DNA, 492 bp, Staphylococcus epidermidis
tatatacagtatattcctgatgaaatagagatttctactaatttttcgaaatcactttacaaaagtgtgtatattgtatatattatgtatatacagaagaaaagggggacatcaatgaaaataattttgaagaacaatagtgaaagtcctatatatgaacagattaagcaacaaattaaagaaaatgttttgaaaggttatgtttcccctggtgaacatcttccatcaatgcgtgagttagctaaagatttaaaagtgagtttaataacgacaaaacgagcatatgaagatttggaaaaagatggatttgtaacaactattagaggtaaaggaacctttgtaaaggaacaagataattctattctaaaggaaaagcaattttttgttattgaaaatttagctcactctatgtcaaaagaagccaaaacaattggaatgcctttagaggaattaatagaaatattgactatgatttatgaggaggacgactaa

SEQ ID NO: 1854 - DNA, 192 bp, Staphylococcus epidermidis
gtggtagctcaaatgagcaaaaagtttagagttgaagataaagaaacaattgcagattgtctcgacagaatgaaaaaagaagggtttatgccaatacgtcgtattgagaaaccagtttataaagagaacaaagatggcagtatagagattttaaaacaggatattatatttgtaggtgctttaatccaataa

SEQ ID NO: 1855 - DNA, 1137 bp, Staphylococcus epidermidis
gcacacaatcattatttaaaatatatgaggagttataacatgtttatcaatgcaaaagatttcggattaaaaggaaaaagtaaatataaggatacaagagcgattcaaaaagcattaaattacgcaaaaaaaggcagacacactgtttatatacctaaaggaacttattatatcagaaaagctttagttatttatgattctacaacattgttattggaagaaggtgcaacacttttaagaaaagggaaagatgcattattaaaaaatggtagacgcttaaagctatatcatggctataatggaaatagtcacatttatattaaaggaggaacttttgatatgaatggaggcgaatatccatataataatacagccatgtgcatgggacatgcagaagacattcaaattttaggtgtaacattcaaaaatattgttggagggcatgcactcgacgcatgcggaatcaatggtttacacatatcagaatgtgaatttaaaggatttcttgatattgatggagatcgttctttttctgaagcagtacaattggacatacaagtacctggtgcttttcctaaatttggaactacagatggaacgattacgaaaaatgttgtcattgaaaaatgttattttggctgttcagatcatcctaaaatgaaagcgtggaatagagctattggctctcatgccagtagatataactgctattatgaaaacattcatatcaatcaaaacatctttgataatttaaatgagtatgctttaactcctctaaagtcaaaagacacatttattacaaaaaataaatttataaattgtaatggtggaataagatttcttggagtgaaggatggtaaaaatgctgccgatcctattacaggacaagtgatggaaactcaagctggtgagaatttcaatgtgataggtaatacttttattggtaagatgaaaagagatgcgattcatattagaagttatcatcacgtccaacatcaaaacgtttttatagcggcaaatcaatttgaagatgcttcacaatcaatacatttagaaaatattaatggacttactttaaatcaggaacaaacaaaaatcaaaatcaagagtattgatgtgaaaaacatcagtaattaa

SEQ ID NO: 1856 - DNA, 546 bp, Staphylococcus epidermidis
atgaaactacattgtgcatatgctatattaattagaacaagagtgaaagtggtgactcaggtgcgaattcaaagtagatggttaatattcgctatttttttaactggagctatttctttattgataggtttgacttattacaaaagtataaaatctgtggatttatctggttacagtgtgaatcaaattagtttaaatcatggttttaatcaaaaaggatttgtggttaataagaaaattaaattagatagatataccttttacaatgataaaaatcataaagattttacagtaaaagtaaaaaataaaacgcataaggttaaaggcatggttttagtcaaagatgataaagttgaaacaaattttggtattaaaatgggtgacccaattgataaagtcatcaataaattgggagaaaactacaagattaataaagtagggaaaaattatcactcaatgacttatgtagaccgttttaataaattaaaattaaacattttatataaagataacattgttaaaagaattgagttctttagtaaataa

SEQ ID NO: 1857 - DNA, 687 bp, Staphylococcus epidermidis
cagacttttaaattaacaataattttctggcaaggggtgagcagcaatatgaaagccactagagtatttaatgttgtagtatttttacaattttccacctatttactatttggtatgaatatacaacttctttttgacaagaaagaatctgattaccttttctttattatacctttattttttacatatatatttgataactcatatacagtattaatagatttttgtaaaccaactgaaaaattaaaaaaagttgaaagtaataacataagatttataaatataattatgcttctagctataattatatatgcgtatatatataaaaataaaaaaattagatggttcaaggatttagtagattcagccaatgaaaactggtgtttatcaataattttaataataattatgtcgcttttaatttcatatatttggtctaaatattttattaaatcagattatatagaaaaattaaaagaagaagattttgatattcttggaatagaaaatgttattaattggttaacaaaatcaaatattaaaagtaaagatatttcagaaggtacaaatgttgagattgaaaaaatagaattacttcttaaagatgaaaaaaatattgatgatttttcttatggagaagtaaaatccattttggcttatgttaaatatgttagagaaagtaaataa

SEQ ID NO: 1858 - DNA, 1305 bp, Staphylococcus epidermidis
aaagaggttaagacaatgatgaatccattagcccaaaaattgaatgatgaaataaagcaatcaagtccagaagtattagatatgatgtcacaattaggtaaagatatgttttatccaaaaggaattttatcgcaatctgccgaagcaaaacgcacaacatataatgctactattggtatggcaaccaaaaaagaaggtaaaatgtacgcaaattcacttaaccaaatgtttaatgaccttacaccggatgaaattttcccatatgcacctcctcaaggtgtagaggaattacgtgatttatggcagaaaaaaatgcttaaagaaaatcccgacttaaagtctaaatctatctctcgtcccatcgttacaaatgctctcacgcacggtctttctctagtagctgatttatttgtagatacagatgataccgtcttattaccgacacacaactggggcaattataaacttgtatttagcacacgtcacggtgctcatatcgatacgtattctatttttgataactcaggtcacttcactacatctgaacttgtaaaaacattaaaagaatataaaaaagacaaagtgattattattttaaattatcctaataacccaactggttacacaccaaataaagaagaagttaatactattgtaaatgcaattgaagaactagctaataaaggtactaaagtagtaactgttgtcgatgatgcatactatgggttattttatgaagaagtttaccaacagtcgattttcacggctttaacacaggtgaaatcttcaaaccttttaccagtgcgtttggatggagctactaaagaattcttctcttgggggttccgcgttggctttatgacgtttggaattgatcatgaaacgttaaaaaatgcgctagaagctaaagtaaaaggattaattcgtagcaatatttcaagttctccactaccttctcaaagtgcaatcaaacatgtacttaaacatcatgagcaatttgataaagaaatcgatcaaaatatcaatattttaaaagaacgctacgaagtaactaaacaagtagtgtatgataataaatatgccaaatattggcaagcctatgactttaattcaggatactttatgtcattgaaattaaatcaagtcgatccagaagaattacgtgaacatttaattaataactattcaattggtattattgctttaaatagcacagatattcgtattgcctttagttgtgtagaaaaagaagatattccttatgtctttgagtctattgctaatgcaattgatgatattaaataa

SEQ ID NO: 1859 - DNA, 534 bp, Staphylococcus epidermidis
tttatggctaacacaaatagaaaaagcaaaaaaatgtcagatgctaaatgcatcaaaacaagacaggtatatccacaagataccaatcatcatcacacaatgttcggtggaactttaatggcaaatattgatgaaatagctgctattactgctatgaagcacgctggcaacccagttgttactgcatcaacagattctgttgactttttaagacctattacaactggagatattttatcatatgaagcaatggtttcttatgcaggaacaagttcgatggagatatgtgttcaaattgttattgatgatgtttataaaaacgagcgccacttggccgctttaagttttttaacttttgtagcattggatagtgatggaaaaccaacatcagtacctgatgttgaacctgaaacatctgtagaaaaatggttccatgaaactgcgccacaacgtgttgctagacgtaaagaacgtcgtaaagaaagtatagatacaattgaatatttatctagagttagacatatcgaaaagtaa

SEQ ID NO: 1860 - DNA, 627 bp, Staphylococcus epidermidis
catgattataaaaagatgaaaacttcctatagaaatcaattagaaaaaaattatgactccagaattactggtaaaagattaaacgaagagactttattattcttgggaactggtgcgattgcacaaagggctgcttatttagccaaagcttttggaatgaaagtaataggggttagtaagtcaggaaaaaatgttgaacattttgatgaagtttatacaattgaagagttagatgatgttattgaaaaggcaaatattattgttaatgcattacctgaaacagaagaaacaatttacttattaaaaagaaaagatttcatacaaatggacaataatgccttatttataaatgtaggaagaggaacaattgttgatgaggaagtgctcatcaatgtactcaaagatcgattaatcagacatgcttatttagatgtttttgaaaaagaaccacttagtaaggacaatcctttatatgatttagataatgtgaccataactgctcatattacaggtaatgattctaataataatagagaagctacggacattttcaaaaagaatcttgagcattttctcaataattatgatgtaattgagaataaagtagacttagattatggttactaa

SEQ ID NO: 1861 - DNA, 381 bp, Staphylococcus epidermidis
atggccaataagcaagttgaaatatctatggctgaatgggatgttatgaatataatatggaataaaaaatcagtatcagctaatgaaattgtagttgagattcaaaaaaataaagaagttagcgataagacgattagaacattaattacaagactatataaaaaagagattataaaacgctataaatataataatatttatttttactcatcaattattaaagaagatgatattaaaatgaaaactgctaaaacctttcttaataaattgtatggaggggatatgaaaagtttagtgcttaattttgcgaaaaatgaagaattaaataacaaagaaattgaagaattgcgagacattttaaatgatattagtaaaaaataa

SEQ ID NO: 1862 - DNA, 297 bp, Staphylococcus epidermidis
aaatcttgtaaagaggtgattgaaatgaatttagaaaaaatatatgaagaaatttcaaacgaaattaaggcaatgacagatgatgaaataaaagaagtcagtgatattttgtatgaatctaaactcttgaatgtagattattcaaatctaaaaagtttcaaagcagatacaaagcatagttataaagttaaggaaaatgagtataatgtgattgaaaaaaatatcaatgagaagccgaatttagaaaatcatgaagttaaccaagttaaaaataataatataattattgcagcatag

SEQ ID NO: 1863 - DNA, 303 bp, Staphylococcus epidermidis
aagagaggtaattcaactatggaaaataaattagtacctggtattttaattggtgccgtaattggtggcgcggctgctcttgctgataaatctacacgtcattctttaaaacaatcattcaaagacatcaaagaaggaaatcgtacacgtaaaccttcaaaaataagtagcatcaaagatgaagtaatgtattggaaagatacattagatgaaatacgtcgtaataatcctgaattagaacgttctattaaagatgccaaagaaacttttgtaaatcgtaaaaatcaacgcttaggtaaataa

SEQ ID NO: 1864 - DNA, 1395 bp, Staphylococcus epidermidis
tttggaggtaattttatgacaataattagagataaatttaacaatagtaaagctttttttaatacgcataaaacaaaaaaccttaaatttcgaaaacaacaacttaaattactaagtaaaaatatcaaaaatcatgaaaatgaattattagatgccttatataaagatttaggtaaaagtaaggttgaagcatacgcaactgaaattggtatgcttttgaaaagcataaagctaatgcgcaaagagttaaaaaattggtcgaaaaccaaacaaacggatacaccactctacttattccctacaaagagttatattaaaaaagaaccttacggtacggtgcttattataggaccatttaattatccggttcaattagttttcgagcctctcatcggagcaatagctgccggaaatactgctatagttaaaccttcagagttaacacctcatgttgccattgtgatcaaggacatcattgaagatacatttgatgaagcatacgtttctgttgttgaaggtggtattgaagaaacccaaacgttattaagtctaccatttgattatatgttctttactggcagtgaaaaagtcggaaaaattgtctatgaagctgcagcaagaaaattaattccagttactcttgaacttggcggtaaatcacctgtcattgtcgatgatacagccaatatcaaagtagcgagtgaacgtattagttttggtaaatttactaatgctggtcaaacatgtgtcgctccagattatatattagttcagcggaaagttaaaaatgatttaataaaagctcttaaaaaaacaattactgaattttacggagaaaatattgaaaaaagccctgatttcggacggattgttaatcaaaaacactttaatcggttgaatgacttgattcaaattcataaagataatgttgtttttggaggtaatagttctaaagaagatttatatattgaacctactttattggataacataaccaatgacaataaaatcatgaaagaagaaatattcggtcccattttgcctattattacttatgataatttcgatgaagtacttgaaatcatccaaagtaaatcaaaaccactaagtttgtatctttttagcgaagatgaaaacatgacacatagagtggttgaagaattatcatttgggggcggtgcaattaacgatacgttaatgcatttagctaatcctaacttacctttcggtggtgtaggttcttcaggcataggtcaatatcatggtaagtattcttttgatacatttagtcatatgaaatcatacacatttaaatctacacgtctagaatcgagtttatttttccctccatataaaggtaaatttaaatatattaaaaccttcttcaagaactag

SEQ ID NO: 1865 - DNA, 201 bp, Staphylococcus epidermidis
accacactcaatagcatcactttatataatattgtttgcggtctatttagtacaatgttacaatttaattgtatccacgtattatactacacaaccccaagtctggtaccagcagacttggggttttttggtcatctatttgcctttccattttatttccaaccaaatacgaaagacaatgagtatgccaccggtaattaa

SEQ ID NO: 1866 - DNA, 588 bp, Staphylococcus epidermidis
cgctttttaaacacatattgggaggctgttctaatgagtaacaaagcattaatcattgtagattactcttttgattttattgacgataatggtaaattaacatgtggcaaacctggacaagaaattgaaacttttattactcagcgtataaaaaattatcataataatcaacaggaaatatttttcctaatggacttgcattatgaaaatgataaatttcatcctgaaagtaaattattccccaatcataatattcatcaaacaccaggtcgtgagttatatggcgaggtaggtagattatacaactcaattaaagaccaaatgaatgtacattatttagataaaacgagatacgattcattctacggtacaccattagatagtttattacgtgaaagacaaatcaatgatattgaaattgtgggtgtttgcacggatatttgtattttgcataccgctgtttcagcatacaatttaggttataacatcactatcccaattagaggcgtagcatcttttaatcaagatggtcatcaatgggcactctcccattttaaaaattctcttggtgcaaaagtagaagaataa

SEQ ID NO: 1867 - DNA, 387 bp, Staphylococcus epidermidis
  unsure (110): Identity of nucleotide at the above locations are unknown.
atgaaaataaaacagttttcttttcaacacatattatttctgatttggaaaaaattgcagattatatcgttttttctcagtgagggtgaaatcatattcaatgagtctanggataaactatcgcaaaaataccaaatccttaatggttctaatgaacacggacatgaagagttggacgaacttttgatttacaaagaaagtaagcaaacaggctatattggtttaacagaatattatcaaacatttaatgaattgtttggtagtggtgttgaaataaaagatgcatctatagaacaattgatgatttatttagaaaaaagtaaacataaacgaaatacaaattcaaaatacaaagtgagatttaactatgaagcaattaatgattag

SEQ ID NO: 1868 - DNA, 1623 bp, Staphylococcus epidermidis
actatggcaaaagatcttaaattctctgaagatgcgcgtcaagcaatgttacgtggtgttgataaattagcaaacgctgtaaaggttacaattggacctaaagggcgaaatgtggttctagataaggattacacaacacctttaattaccaacgatggtgtaacaattgctaaggaaatagagttagaagatccatatgagaatatgggtgcaaaattagtgcaggaagttgcgaataaaacaaatgaaatcgctggggacggtacaactacagcaacagttttagcacaatcaatgattcaggaaggtcttaagaatgttacaagtggtgcaaatcctgtaggcttaagacaaggtattgacaaagcagtgcaagtggctatagaagcgcttcatgagatttctcaaaaggttgaaaataagaacgagatagcgcaagttggagctatttcagcagcagatgaagaaatcggtcgctacatttctgaagcaatggataaagtaggtaacgatggcgttatcactattgaagaatcaaatgggtttaatacagaattagaagtagttgaaggaatgcaatttgatcgcggttatcaatcaccatatatggtaactgactcagataaaatgatagctgaattagaacgtccatatatattagtaacggataagaaaatttcatcattccaagatattcttccattattagaacaagttgtgcaggctagtcgaccaattttaattgttgcggatgaagtagaaggcgatgcacttactaatattgttttaaaccgtatgcgtggaacatttactgctgtagcagttaaagccccaggatttggtgatcgacgtaaagcaatgttagaagacctagcaatattaactggtgctcaagtcattactgatgatttaggtttagaacttaaagatgcatctcttgatatgctaggtactgctaataaagttgaagtgactaaagatcatacaacagtcgtagatggtaatggtgatgaaaataatattgatgctcgtgtaggtcaaattaaagcacaaattgaagaaactgattcagagtttgataaagaaaaaattacggaaagtttgggaaaactacctgggggggtagctgttaatcaagtatggggtggcagtgaaacagagcttaaagaacgtaaattaagaattgaagacgcattaaattcaacacgtgcggcggtggaagaaggtatcgttgctggtggtggtactgcgttagtcaatatatatcaaaaagtaagtgaaattaaagcagaaggtgatgttgaaacgggtgttaatatcgtattaaaagcattacaagcacctgttagacaaattgctgaaaatgcaggattagagggttcaattattgttgaacgtttaaaacatgctgaagcgggcgttggtttcaatgcagcaacaaatgaatgggttaatatgttagaagaaggtatagtagatccaactaaagtaactcgttcagcgttacaacatgcagcaagtgtagctgctatgttcttaacaactgaagcagtcgttgctagtattccagagccagaaaataatgaacaacctggaatgggtggcatgccaggtatgatgtaa

SEQ ID NO: 1869 - DNA, 354 bp, Staphylococcus epidermidis
aacaataaaaaatattctggagggttaattttgaaaattgttagcttaaatagattaaatgaaatagaaaatgaattaagaaaacaatttccaaacgaagaatttaaattttatgacaaagctataaatatccctattaatgatagaaaaactatggacattttaataggttatgatggcaaaatagatcgtacctttattgaacattgtatcaaccttaaatggattggatggtttgcaacaggtgtaaataatttaccgttaaattatattaaagagcgagatatcattctaagaaatggtaaaggtatacaagctaaacaagtgtctgaatatataaagacattcatttag

SEQ ID NO: 1870 - DNA, 840 bp, Staphylococcus epidermidis
agaatgaaaaagctttttattagtggtttaatcatatttattattttctttgctagtggtgctatgacgtggtttactatagataaaaataaatacgataatcgacattataccaaaacaataaatagcaaaattgaacatttatctataagtacagtaacaaccaatgttaatataatttctggaaaaaaattagctgtttattttactggagataataaaataaatgttacaaaaaataataaaaggttaagtattaaagaaaaacgtgcagtagatagaggatatggattaaattttaatccatttcactcaaacaatagaaagctaacaattgttgtaccagaaaaagaccttaaatctcttaatattcaatcgttattgggagaaattgatttaaatcaagtgaatttgaaacatgtttcattggaaacagatagaattatacaacttaaacgatctgaactcaatcaggtaaacatcgaatcttctaaagcaaatttttatattacagactgtttaatcagggaaggtcgtatgaagcttgataagggtataactcatgttaaaaatagtacattaagtgatactgttttcttggttaatagaggagatatttctatgacggacatgaaatctaacaatgatataaaagcttctacacaaagaggtaatattaattatcattttggcgaaaaacctaaaaacactttgcttaaacttcatcctggtcatggaaataaagaaattaaaaatcgatatttcgataaaggaaaagtgggaaatagcgataatatattggaattttacactgtagatggcgatattaaaattgaataa

SEQ ID NO: 1871 - DNA, 327 bp, Staphylococcus epidermidis
gaaaaagaaaaaacaaaggtaccaaacgaatatttaagaatttttgatactattcagaactcaacagataagtatataactaagtccaagatacttaacttaatggggtacgagtataattcatctaatgaaagatggttaagaaatgctataagcaaattgattgatgattatagttaccctataggatgtagctataaaaaacatgaacgtggttattacatcatcactactgatgaagaaaaacaacaagcaatgcaaagtattaaaagattagcagacggtagtatgaaacgttatgaggctttaaaacgtattaaattataa

SEQ ID NO: 1872 - DNA, 642 bp, Staphylococcus epidermidis
gaaaagaggaataatatgtcagcaattgctcaaaatccatggttaatggtcttagcaatttttataattaatgtatgttatgtcacatttttaacaatgagaacgatattgactttgaaaggttatcgttatgttgcagcagtagttagttttatggaagtcttagtttatgttgttggtttagggttagtaatgtctagcctagaccaaatccaaaatatttttgcttatgcattaggattctcagtcggtattatagtaggaatgaaaatcgaggaaaaacttgcgttgggttatacagttgtcaatgttacttcatcggaatatgagttagatttaccaaatgaattaagaaatttagggtatggtgtaacccactacgaagcatttggtagagatggaagtcgaatggtaatgcaaatattaacaccaagaaaatatgaattaaagttaatggatactgtcaaaaacttagatcccaaggcatttattatagcgtatgaaccaagaaatattcacggaggattctgggttaagggtgtacgtaaacgtaaactgaaagcttatgaaccagaacaactggaagttgtagtagatcacgaagaaatagtaggtggtagctcaaatgagcaaaaagtttag

SEQ ID NO: 1873 - DNA, 576 bp, Staphylococcus epidermidis
actgtaattgaaccatacaataaatataggagtgaaaatatgaagatttttaaattgacgtcattgacactagctgctttaacgttagcctttccgttttcacatgtcgcacaagcacatacttacttagaaaagcatcaccaaacaaacgaaaccaaacaatctcatagcttttctttagaaggtgaggctggtgaaaatccaacatttttaactcaacctcaatttattaattccctagataatggtcatttaaatattaatggttatcagattcagcaagatgatactaatgatattgaatacaaaaaggtttatgatcaagaaattagagctacaagcaatcatacagcgataagtgtacgtttcagtattaataatcaatcactatcacttgaaagtatgaaagatgcatacccaaatgagagattgaatcatattccacatacaagcaatgattcacaatatccagaagacggtatatatgtctatcacggtaaaatgattaaattacaatacaaagtgacacatggatttgttacgagcgtgacgataggtgaaggtgtagacgaatag

SEQ ID NO: 1874 - DNA, 432 bp, Staphylococcus epidermidis
aatgatgatgaggtggtaaacatgattccaaatcctaatgcgccagatgaatataaatatgaaactgattatagaaaaataccaagaaaatatttaaaccctaaaatccctcaagggcgtggaaaaatcaaatggcaagcttttgcgactctcccgcaacagtttgaaattttagaacaaattataaaggatcaaaataaaatagaaaaaccattgctaacacatgattcattagataatttagatcagatttttcaaataaaaattcaaaatgatgagttatgtacaatctcatattgggaagacggtaacatttcaaaatatacaggaaaaattttaaaaaaggatgaaattagtaatacattttccttttctgatactaacaataatatatataatttaaataatgctaacgtttgtagtatcacttaa

SEQ ID NO: 1875 - DNA, 1293 bp, Staphylococcus epidermidis
gatatggatgatattaatttatttccgtttgcaggcctacaaatctttttaatgatttgggttactaaagttatcattaatatgaaatttaattttagggattacataatcgtttttacgattgtaatcccttctgctataatgtattacttttggcaaagtaaagcattaatagttttggttataataatcataattttcttttatacaaaaataaaactttattcaatattagttgtattattcacgactatgatcttatatataactaatttcataactgtatacatacatttaactataaaagattatattccgtttaaatttgttttacagttaatacattttaccttttttgtaatcataactctaatcattgcttatttaactcaactattgttcaataaattaaaagtatcctatctgtcactcaataaaagatacttattcataataacaattgtactttttatatcatttattttactttatatggtgtcacaaactgatatgcgaggaaatgatacacttaaattatatgccatcttgttgatgggtattatggtttttttaagtgtagtgattttagtgatgtccaattttacacttcgtgaaatgaggtataaacgtaatgtaaaagaaatcgaagcatattatgaatacacgttacgtatagaaagcattaacaatgaaatgcgtaagttccggcatgattatgtgaatatcctcaccactctttcagattacattagagaagatgatatgcctggattacgtaaatattttaatgaaaatatcgttccaatgaaagataaattaaaaactcgctctattaaaatgaatggtattgaaaagttgaaagtgagagaaattaaagggttgattactactaaaattattcaagctcaagaaaaacgtattccaattagtattgaggttcctgatgaaattgatcgtatcgatatgaatactgttgagcttagtcgtattatcggtattatagttgataatgctattgaagcttcagaaaatcttgaggaaccactcataaatatcgcattcatcgataatgaggaagctgtcacttttattgttatgaataaatgtagtgatgatattcctaaaattcatgagttgtttgaacaaggtttttctactaaaggtgataatcgcggtttaggtttatcaactttaaaagaactgacagactcaaacgagaatgttttattagatactgtcatcgaaaatggttactttgtacaaaaagtagaaataaataataaggaatcataa

SEQ ID NO: 1876 - DNA, 1092 bp, Staphylococcus epidermidis
tgtttacgtttcatcattcattggagacgtagaggtgatttacagatgaatcactacataagagctataggctcaatgcttatattagtatatagtatgcttattgcttttttatttattgataaagtgtttgtaaatattatcttttttcaggggatgttttatacacaaatatttggaatacctgtttttctatttttaaatttattaattgttcttttatgtattatagttggatctgttttagcttataaaattaatcaacaaaatgattggattatttcacaaatagaaagatcaatagaaggacaaacagtaggtatcaatgatcaaaatatcgaattatatacagaaacgatagatatttatcatacactagttccattaaatcaagaattacatcgacttagaatgaagactcaaaatttaactaatgaaaactacaatattaatgatgtaaaagtcaaaaagattatcgaagatgagcgacaacgacttgccagggaattacatgattctgttagtcaacaattatttgctgcgagcatgatgctatcggcgataaaagagtcgaaattagaaccacctttaaatcaacagataccaattcttgaaaaaatggttcaagactcacaacttgaaatgagagctttgttattacatttaagaccgataggtttaaaagataagtctttaggtgaaggaattaaagatttagtcatcgatttacaaaagaaagtaccaatgaaagttgtgcatgaaattcaagattttgaagtgccaaaaggcattgaagatcacttgttcagaattacacaagaagctatttcaaatacattgagacattcaaatggtacaaaagtaactgtggaattatttaatcaagaggattatcttttactaagaattcaagataatggaaaagggtttaatgtagatgaaaaatttgaacaaagttatggtttgaaaaatatgcgagaacgagcgttagaaattggtgcgacgtttcatattgtatctttacctgattcaggtacacgaattgaagttaaggcaccattgaataaggaggagaattcaagtggcgattaa

SEQ ID NO: 1877 - DNA, 474 bp, Staphylococcus epidermidis
gaaataggtgagtatatgattagtaaaggtgaacaatttccctctttttctttagaaaatcaagatggcaattttatttcaaatgaaacaattaaaggtcgtaaaacgattctttatttttatccaagagataatacaccaacgtgtactactgaagcttgtgaatttagagatcacattgaagattttaatcaacttgatgtagatatatatggcataagcgcagattctaaaaagaaacatcaaaattttataaaaaaacaccaattgaattttgacttactcgtagataaagattatcaacttgctaataaagttggggtttaccaattgaaaaaatcatttggcaaggagaatatggggattgtaagaacaacatttattctcgatgaaaatggtaacattattgatgtgattgaaaaggtaaaggtaaaaacacaaattgaaacaataaaaaatattctggagggttaa

SEQ ID NO: 1878 - DNA, 1029 bp, Staphylococcus epidermidis
agtcttttcgaatttccttttcttaagaggagtcagtatgatatgaatgataaatggtatagacatataattggagcgcgaactattaaaactggtttggctactttttttacgtctttattttgtatgttgttaaacctcactccaatttttgccatacttactgcaattgttacaattgaacctactgctaaagcatcattaaaaaaggggtataaaaggttgccagcaacagttattggtgcgttatttgctgttgtctttacatatgtcttcggtgatcaatcaccgttaagttatgctttaagtgctacatttaccattctgatatgcactaaacttaatttacaggtaggaacaactgtcgcagtattaacttccgttgcaatgattccaggtatacatgaagcatatgtgttcaatttcttttcacggttacttacagctcttataggacttgttacagctggattagtcaattttatcatcttaccacctaagtattatcatcaacttgaagagcaattagcccttagtgagaaaaaaatgtatcgtttattttatgaacgctgtaatgagttattattaggaaaattcagctcggaaaagactagtaaagaattatcaaaattaaatattattgctcaaaaagttgaaacattaatgagttatcaaagggatgaacttcattatcataaaaatgaagataattggaaattattaaatcgccttacaaatcgcgcttataacaaccgtttatttatttcacatttatctaacattatttatttacccaaacatacgtctattgcttttgatgctaatgagaagatagcattgattaatattagtaatagtattaatggcatcattcaaaaaggaagctttgcacgtcaaaaaaaatctattgcaacactaaagtcttctgttaaacagatggatgagtttgaccaaaatcaaatgaaaagtacactcatatatgaaattctactcatatacaaaattttagattcacgttatgcaaaataa

SEQ ID NO: 1879 - DNA, 315 bp, Staphylococcus epidermidis
gggttgttcgagatgcaaattgaaaaattaagaggtcagtcattagatgaattatttgatgcgatcttagcactagaaaacagagaagaatgttatcagtttttcgatgatttatgtactgtaaatgaaatacagtcattatctcagagacttcaagttgctaaaatgattaagcaaggttatacttatgcaactattgaagaagagtctggtgcatcgactgcaacgatttctagagtaaagcgttcgttacaatggggtaatgatgcttatacaatgattttggatagactaaatattgaaacaaaggcataa

SEQ ID NO: 1880 - DNA, 1272 bp, Staphylococcus epidermidis
gacagcttagacaagatatggaggattaatatgacgaattatcataataagttaaaacaatatgcagaattattagtaagagtgggaatgaatgtacaaccacagcaacctgtttttatacgttcatctgttgaagcgttagaattaactcatttaatcgtcgaggaagcatataaagcaggggcagaagatgttcgagtgagctacacagacccgaaattaaaaagattaaaatttgaaaacgaatcagttgaacactttgaaaaacaagaactcaaacaatatgatattgaagagcgtctggattatgttaatcgtggcgcagcgaacttggcgctcattgctgaagatccagagctattaaatggaatagatgcgcaaaagttaaaagcgtatcaaactgtatactcaaaaggatttaaaccatatatggaagcaagtcaaaaaaaccaatttccatgggtagtggctgcgttccctactagggattgggcacgtcgtgtctatccagagttggatgttgaatcagcatatattaaattcattgatgaagtatttgatattgttcgtgtagatggacaaaatccaattgaaaattgggaaaaacacattaaagatttaagtgttcatgctaaacgattacaagagaaaaactatcaagctttacattacatatcagaaggcacggatttaatagtagggttacctaaaggacacatatgggaagatgcaacaagttatgtaaatggggacggtcaacctttcattgctaatatccctacagaagaagtttttacagctccagatagaaacaatgttaatggatatgtaaccaataaattacctttaaatcttaatggtaacattatagacgggtttacattgacttttaaagatggtgtgataattgatgtcaaagcagaaaaaggtgagaaattacttaaagatttaattgcaactgatgaaggtgcttgtagattaggtgaagtagcactagtgcccgatgattcaccaatatcaaatcgacgcacaatattctataacactctttttgatgaaaatgcatcatgccacctagctatagggtcagcttatagttttaatatcaaaggtggtactgaaatgactacagaagaaaaaattgcaaatggactcaatgattccaatattcatgaagatttcatgattggtagtcctgatttaacaatttatgggatattgcaagatgaaacaaaagaattagtttttaaaaatggaaattgggctaaatag

SEQ ID NO: 1881 - DNA, 1068 bp, Staphylococcus epidermidis
atgctaatagataaagcaagatcatttattcagaccatgtatagcgaattaaaatataatactaatgaagttgaaaatagaatgaaagagattgagcaagaaattaacttgactggtagttacacacatacttatgaagaattatcttacggtgcaaaaatggcatggagaaactcaaatcgttgtattggtagactgttttggggttctttaaatgttaaagatgcccgagatgtatgtgacgaaaaagaatttataaaatttatacatacacatattaaagaagctactaacggtggaaaaatcaaaccatatattacaatttttagtcctgaagatacacctaaaatttataataatcagttgattcgttatgctggttatgaaaatgttggcgatccatctgaaaaaaaggttactcgtttagctgaacatctaggttggaaaggtaaaggttcaaattttgatattttacctctgatttatcaattgcctaacgacactataaaaatacacgaacttccaagtgatattgtaaaagaagtttctatacatcatgaacactatcccaagctttcaaaattaggtttaaaatggtatgcggtacctattatttcaaatatggatttaaaaatcggtggtattacttaccctacagcaccttttaatggatggtatatggtaaccgaaattgctgtacgtaatttcacagacacctatcgttataatcttttagaaaaagttgcagaagcttttgaatttgatacacttaaaaataattcatttaataaagatcgagcactcgtagagttaaatcatgctgtgtatcattcatttaaagctgatggtgtttctattgttgatcacttaactgcagcgaagcaatttgaaatgtttgaacgaaatgaacatcaacaaaacagagatgttactggtaagtggtcttggctggcacctccactttcaccaactttaacttctaactatcatcatggatatgataatacaatgcatcatacgaatttcttctataaaaaagaagaacctatgaagtgccctttccattaa

SEQ ID NO: 1882 - DNA, 318 bp, Staphylococcus epidermidis
tttgtgatagagcagtatttccttagagatggtaagttcgttcaagatgtagatatgaaagatgggggaccagaggatagtactattcttactttacaaaaagatgactttaataaagctttagattctctttctgaaaactttaaagtacagcagtctcaaaaagaatcgggagaaattatcattaaagctcaaaatgattatagagagttacttaaatcgttatcccaactagatatttatccaaaatatattgaaacacgtaaaagttcactacgtgatacttactttaatattaatcaaagaggtgataaataa

SEQ ID NO: 1883 - DNA, 744 bp, Staphylococcus epidermidis
aacgagcaagacaagaaaaacttttacaagcaaattaaaaagaaagaggtatgtattatgacaacaactacttatcaaggtacatcacaagacgtatggaatgtattattcgataacagaaaatataaaggtctattagatgaagtaaataaattaattgaagatactaaacgtttatacaagcaaggctatcgtttagaggctatagacgaacaacaaaagcccaaagttactgaactcgaaaataaattcaaacagtttgctacagatagattaaatgaaatagagcaacgttgtaatgagattgagaaagaaagccaacaagataatgttaaagatccacaaaccgaaattattaaacgtcagaatttagaagctagattatctttctataacgataatgagattgtagactacatcaatagtaaagatgtaacgagcactgacatttatgaattaagcttgttgcaacaaaaatatgacaatcaattaaacgaatcacaacaacgtcaagttgcatttaaactcgaagaattaaaacaaggtgttttatatccatacactacaaatgaagagtacaagaacttaatgtttgaatatagtgtcataaaccaaactggaatggctaaaactggtgtagttattactaagaatgaacagtatggtggcgttgaaatcaaacaacttactgaacgttataaaaatgctattaacgaagtgaaacaaagtaataatagaagataa

SEQ ID NO: 1884 - DNA, 981 bp, Staphylococcus epidermidis
gcatttatggacacagccacacatatcgttatgggtgtgggtcttacagctttagcaacgcaagatccagttatggcagaatcatttgctgctactgcgacgactttaatcgcaggttctttaataccagacggtgatactgtattgaaattaaaggataatgcgacatatatttcacatcacagaggaatcacacattcattaccttttacaatattatggcctatattaattacattttttatatttgtaatatttagccaaacgaatcctttacatgtatggttatgggcacaactagcagtgtttttacatgtctttgtagatatttttaattcttatggtacacaagcattacgtcccataactaacaaatggattcaattaagcgtgattaatacctttgatccgataatattcattattttaagtaccggtgtcttattgtggatattaggtattcacccgtatattgttttctttccaattatattaattctcataggctattatattgtaagatttaagatgcaagcagcaattagaaaacaagcactccaaaaaattgagcaatcgcatacaccagtaaaagtattcgtagctccaacaataaaatttcatgtatggcgggtcgcaatacaaacagataagcatgattatgttggtgtttccaaatggaaaaatgtagatttcactgataaagttaaacgccagtctatgactcctgattcgatattatggaaagttaaaggtaataaagatatatatacatttttaaacttttcttcaatttaccgttggcaaactacaccattagatgatggcacaacagaaattcgacttatggatttacgatacttaaataaaggtcgttattcttttgtagctattgcacatttaacacttgaaaatgaaattgatcactcttatattgggtgggtatttagcgaagataaattacaacgtaaattattttcataa

SEQ ID NO: 1885 - DNA, 453 bp, Staphylococcus epidermidis
gtgagtgcggaacttgaatctattgatcatgaacttgaagagtcaattgcttcattaagaaaagcgggcgttcgcattacaccccaaagacaagcaattatgcgttatcttatatcttcacattcacatccaacagcagatgaaatatatcaagcactttcacctaaatttcctaatataagtgttgctactatctataataatctaagagtttttaaagatattggtatagtcaaagagttaacatatggtgattcatctagtaggtttgattttaatacacataatcactaccatattatatgtgaaaaatgtggtaaaatcgttgacttccattatccacaattagatgaagtagagcaattagctcaacatgtaacagattttgatgttactcatcatcggatggaaatatatggagtatgtaaagaatgtaaagaagaaggaaattga

SEQ ID NO: 1886 - DNA, 777 bp, Staphylococcus epidermidis
tttataaaggaacgggataaaatgattgttaaaactgatgaagaattacaagcgttaaaagaaataggttacatttgtgcaaaagtcagagatactatgaaagaagctactaaacctggagtgactacccgtgaattagatcacattgccaaagatttatttgaagagcatggggcgatatcagcgcctattcacgatgaaaacttcccaggtcaaacttgcattagtgttaacgaagaggtcgcgcatggaatccctggtaaacgagtaattcatgaaggtgacctagttaatattgatgtatcagctttaaaaaatgggtactatgctgacactggaatttcatttgttgtagggaaatcagatcaaccacttaaacaaaaggtttgtgacgtagccacaatggcttttgaaaatgctatgaaaaaggtgaaaccaggtacaaaattgagtaatattggaaaagctgttcatgcaactgcacgccaaaatgacttgactgtgattaaaaatttaactggacatggtgttggacaatcacttcatgaggcacctaatcatgtcatgaattattttgatcctaaagataaaacattattaaaagaagggcaagtcattgcagtagaaccattcatatcaacacatgctacatttgtaactgaaggtaaaaatgaatgggcttttgaaactaaagataaaagttatgtcgctcaaattgaacacacggttatagttacaaaagatggtccgttacttacaactaagattgatgattaa

SEQ ID NO: 1887 - DNA, 1197 bp, Staphylococcus epidermidis
aaagcaaaggagattgttatgtcaaaaaaagagaaaacaacttctaaatatcttaattcaatagaagataaagagcataaaaagaataaaaaaatagaagttgaccgtacatatatagaacctcaagaattccaatctaagaaacctaaaaaaaagaatcaagtattttttgtttcccggctgaataaaccagcaaaatacaccgaaaactctaatttcttttcttacctgatttataggataggtaaagatgacgctgcaggtttagcagcacagatgacatatcattttgtattagcacttttcccaatgctaatttttttacttacgctacttggtcaatttatcacgattgatgctaatcagattaatcaaaaagtaagtcaatatgtccctgatcaagaaacagctagcatcgttggtggaattgttaaagatatctctgacactgccagtggaggtattttgtcagttgggttaattttagctatttggtcagcatcaaatggaatgtccgctattattaactcatttaatgttgcttatgacgttgaggattctcgaaacggtgtagtagttaaattattaagtattctatatacacttgttttaagtgcagtatttgttgttgctgtagtacttataacactaggtccagtcattaataaatttttatttggaccactaggtattgataatcaaattgaatggatttttaatttagtacgaattgttattccattgattattattttcatcatatttactgtactttattcagttgcacctaatgttaaaacaaaattacgttctgttattcctggcgctattttcacttccattatttggttactagggtcctttgcattcggttactatatttcaaactttagtaactattcgaaaacatacggaagtttagctggtattatcattttattcttatggttgtatatcacaagctttattattattatcggtgctgaaatcaatgcaattattcaccaaagaaaagtcatagctggtcacacgcctgaagaagccgctattaaacatgatgataacaatgaaaatcactataacgaaaatacgacttatgaatactatgaagatagcaaagatgtagatatctctaatgaagatgacacgtataatatcaatcatcaatctaaagaagaacatcacacaagcgactga

SEQ ID NO: 1888 - DNA, 198 bp, Staphylococcus epidermidis
aaagatgaactaacaaattaccgttgttgttacacttcatttatgaatttttatagattacttttacaatataaaatattttattcttatttacatctattttgcttaataatctctaatttttttataacgttctttccatacctttataaagtcaggagcaaaaggcccctttttttgttctatccattgttgtaa

SEQ ID NO: 1889 - DNA, 624 bp, Staphylococcus epidermidis
ggaggacgactaatgaacgcgatagaacttaaagatgttaattatcgatctaacgcatttcaattgcaagatgtctccttcaatgttcctaaaggatatgttacaggttttataggtggaaatggtgcggggaaaactacaataatacgattaattatggatttaattcaatctgaaagtggtacaatctctgtttttgagaaagatataaaaattcatcctcgtgaaataaaaaataaaattggatttgtgtattctgagatttattttaatcaaaaatggacagtaaaaaaattagaaaatatcattgcccctttttatgatcgttgggatcatgaaatatttataaagtatttaaaattttttcagctgccatataaaaataaaataaaaactttctcaaccggtatgaaaatgaaactatcgttagcaattgcattcagtcatcatgcagaattatttatcttagatgaaccaacttcagggttagacccattaataagaaatgaattacttgaaattattcaacaagaattgatagatgaaaataaaacagttttcttttcaacacatattatttctgatttggaaaaaattgcagattatatcgttttttctcagtga

SEQ ID NO: 1890 - DNA, 1476 bp, Staphylococcus epidermidis
ctgatattacgcctgataagcaataaaattattacgacatcaaatttaaggttaggaatgccacacattatattcctaacctttttgtatgtgggagggaaaaaattggaaacaattaagaaaaacgaagttaaaacgggaaaggttattgatttaactcatgagggacacggagttgttaaagttgatcgatatccaatttttattcctaatgctttaattgatgaagaaattaaatttaaattaattaaagtgaaaaagaattttgctataggaaaattgatagaggtcataagtgaaagtgatgatagagtgacaccaccttgtatttattatgcaaagtgtggtggttgtcaattacaacatatgacatatagagcgcaattggatatgaaaagagaacaagtagttaatctttttcatagaaaaggcccttttgagaatacggttataaaggaaactattggcatggtcaatccctggcgataccgtaataaatctcaaattcctgtaggtcaaagtaactcgaatcaagttataatgggattctatagacaacgtagccatgacattatagatatggatagttgtcttatacaagatagacaacatcaagaagtaatgaatcgagtgaagtactggctcaatgaattaaatatatctatatataacgaaaaaacaaaaacaggtttaatacgtcatttagtagtaaggactggttatcataccgatgaaatgatggttatctttgttacaaatggagcaacatttaaacaatcagaactattagtaaacaagctaaaaaaagaatttccaaatataacaagtattaaacagaatataaacaatagccattctaatgttataatggggcgtcaatcaatgactttatatggtaaagataaaattgaagaccaattaagtgaagtaacttatcatatttctgatttatcattttaccaaattaactcatcacaaactgaaaaactttatcagcaagctctgaattatgctcaattaacaggaaaagaaatagtattggatacgtattgtggtataggaacgattggtctatatatggcaccactagcaaaacatgtttatggtgtagaagttgttccgcaagccataaaagatgcggaagacaatgcgactaaaaaccaacttaaaaatacgactttcgaatgtggaaaagcagaagatgttatcttaacatggaaatcacaagggattaaaccaggcgtagtcatggtagatccacctagaaaaggatgcgatgaaactttcttaactactcttttaaaattaaatccgaaaaggattgtttatatatcatgtaacccttcaacgcaacaaagagatgcgcaaatattggctgaacaatacgagttagtagaaattacaccagttgatatgttcccacaaacaactcatattgagactgtagcattatttgtacgtaaagacgaagagtga

SEQ ID NO: 1891 - DNA, 2190 bp, Staphylococcus epidermidis
atgaatgcgctagtaaaaaatatgaattcagagcaaagtgaagcggttagaacaacagaaggcccattgcttattatggcaggtgctggatcaggaaagacacgtgtgttaacacatcgcattgcgtatttattagatgaaaaagatgtatcaccttataatattttagctattacgtttacaaataaagcagctaaagaaatgaaggcgcgtgtcgaacatcttgtgggagaagaagcgcaagtgatttggatgtccacttttcactctatgtgtgtaagaattctgagaagagatgctgatcgtattggcattgaaagaaatttcactatcattgatcctaccgatcaaaaatcagtgattaaagatgtattgaaaagtgaaaatatagacagtaagcgatttgagccacgtatgtttattggtgcaattagcaatttgaaaaatgaattaaaaacacctgaggatgctcaaaaagaggcgaatgattttcactctcaaatggttgcaacggtttacaaaggttatcaaagacagttatcacgtaatgaagcactcgactttgatgatttaattatgacaactattaatttatttgaacgtgtacccgaaactctagaatactatcaaaataaatttcaatatatacatgtagatgagtatcaagataccaataaagcacaatataccttagtaaaactattagcaaacaaatttaaaaatttatgtgttgttggtgattctgaccaatctatttatggttggagaggagctgatatacaaaatattttatcttttgaagaggactatcctgaggcaaagacaattttcctcgaacagaactatcgttcaactaagaatattttaaatgctgcaaatgaagttataaaacataattctgaacgtaaacctaaaggtctatggactgcaaattctggaggagacaaaattcagtattatgaagctatgactgaaagagatgaagcagaatacgttgttaaagaaataatgaagcatcaacgcagtggtaaaaaatatagtgaaatggctatattatatagaacaaatgcccaatcacgtgtacttgaggaaacatttatgaaatcaaatattccttatacaatggttgggggtcaaaagttctatgaccgtaaagaaattaaagatttacttagttatttaagagttattgctaatagcaatgatgatattagtttgcaacgtattattaacgtgcctaaacgtggtattggaccttcatctgttgaaaaaatccaaacctatgcacttcaaaataatataagtatgtttgacgcattggctgaggtagattttataggtctctctaaaaaggtaactcaagaatgtatcagtttttatgaaatgattcaaaatttaatcaaagaacaagaatttctcgaaattagtgaaatcgtagatgaagtactacaaaaatcaggctatagagacatgcttgatcgagaacaaagtattgaatcacgaagtcgattagaaaacttagatgaatttatgtctgtacctaaagattatgaggaaaatactcctttagaggaacaatcacttattaattttctaacagatttatcattagttgctgatattgacgaagcagatacacagaatggtgtaacattgatgacaatgcattcagcaaaaggtcttgaatttcctatagtttttattatgggaatggaggagtcgttgttcccacatatcagagcaataaaaagtgaagatgatcatgaaatggaagaggaacgtcgtatttgttatgtagcaattacacgagcagaagagttgctttatatcacaaatgcaacgaccagaatgttgtttggtcgttctcaatccaatatgccatctcgatttttaaaagaaatcccagaagacctacttgatagtcataccggtcaaaaaagacaaactatatatcccaaatctcaacctaaaagaggttttagtaagcgtactacatcaactaaaaaacaagtttcatcatctgattggaaagtaggagataaagttatgcataaagcatggggtgaagggatggttagtaacgtgaatgaaaaaaatggatctgtagagttggatattatatttaaatcagaaggtccaaaacgattattagctcagttcgcaccaataacaaagaaggaggactcatag

SEQ ID NO: 1892 - DNA, 807 bp, Staphylococcus epidermidis
aacgataggcgggtgaatatattgaaaatccaaatacttcaattcaatgtagaacgtggaaatgttgataaaaatatgcaaaatatcaaaactaagtttaatcaatacttagataaagataccagtgtcgtcgtgcttccagaaatgtggaataacggttatgcattagaagaattagaacaaaaagctgataaaaatcttaaagacagctctctctttataaaagacttagcacatacatttaatgtagatatcattgcaggttcagtatcaaatataagagaaaaccatatatataatactgcttttgcaattaataaaaacaaagaattgattaatgaatatgacaaagtacatctcgtgccaatgttacgtgagccagactttttatgtggtggaaatgtagtccctgaacctttttatttatctgatcaaacacttgtgacgcaaatcatttgttatgacttacgatttccagagatattgcgctatccagctagaaaaggtgctaaaattgctttttatgtagcacagtggcctagctcaagactagatcattggttatcattactaaaagcgagagcaatcgaaaatgatatttttattgtagcttgtaatagttgtggtgatgatggtcacaccaattatgctggaaattcaattgtcattaatcctaatggtgaaattttaggccatttagatgataaagaaggtgtactaacaacacatatcgatgtagacttagtagatcaacaaagagaatatattccagttttcagaaatctaaaaccacatctttataaatag

SEQ ID NO: 1893 - DNA, 1749 bp, Staphylococcus epidermidis
gagggaaggcgcatgataaaacgatatttaaagtttgtaaaaccttatagatatcgtattattgcaacaattatagtagggattattaaattcggtattcccatgctcatacctttattgattaaatatgctatagatggcgtgattaataatcattcgcttacaaatcaagaaaaatttagtcaccttggtgtagcaataggaattgcattatttattttcttaattgttcgcccgccgattgagtttattagacaatatttagctcaatggacaagtaataaaatactatatgatattcgtaaacaattgtataatcacttgcaagcactaagtgttcgcttttatgcaaataatcaagtcggtcaagtcatttcaagagtgattaatgatgtcgaacaaacaaaagactttattcttactggattgatgaatatctggcttgactgtataacgattattatcgcactttctattatgttcttccttgatgtaaaattgacgtttgctgcaatttttatttttccattttatattttaactgtttattttttctttggaagattacgaaaacttacacgtgtgcgctcacaagctctagcagaagtacaaggtttcttacatgagcgggttcaaggaatgtctgttattaaaagttttgctattgaagacaatgaagctaaaaattttgataaccataacaagaattttttacaacgagccttccaacatacaagatggaacgcatattcttttgctgctattaatactgttacagatttaggcccaataattgtgattggcgtgggttcatatttggcaattacaggatcgattactgtcggaactctagcagcatttgtcggttatctagaacaattatttggaccacttagaagactagtatcttcatttactacacttacacaaagttttgcatctatggacagagtatttcagttaatggatgaggattacgacatcaaaaatggcattggagcacagccaattaaaatcagtaagggtcaaattgatttaaaacatgtgagtttcaaatataatgaaaatgaaaaagaagtattacacgatattaatttaacaattaacaaaggcgaaactgtagcatttgtaggtatgagtggtggtggaaaatctactttgattaatcttataccaagattttatgatgttactcaaggtgaaatacttatcgatcatcataatgttaaagatttcctaactggtagtttaaggaatcaaataggcttagtacaacaagataatattcttttttctgatacggttaaggagaatattttgttgggtaggcctgatgcgactgatgatgaagtcgtagaagctgcaaaaatggcgaatgcccatgattttatttcaaatttaccgaatggatatgatactgaagtaggagaacgaggagttaaattatctggtggacaaaaacaaaggttgtcaattgcacgtatctttttaaataatcctcctgttttaatattagatgaagcaacaagtgcattggatttagagagtgaagctattattcaagaagcacttgatgttttaagtaaggatagaacaacattaattgttgcacatcgtctatctaccattactcatgcagatagaatagttgtaatggaaaatggacgaattgttgagactggcacacaccaacaattaattaataaacgcggtgcttatgagcatctttatagtattcaaaatttataa

SEQ ID NO: 1894 - DNA, 414 bp, Staphylococcus epidermidis
agcttaatcagtgacgaggtgatatcattgaatattttagatttatatttacaacaatttataaaacgaattactaaaaaaagtatcaatgactataaaatgtcattagataagcaaattaaaaatattgatacttatattaattatttaagagaaaaaagattacaattaaagaagttaattgacaccctcacgctctcattagaaaataaatatatagatttagtaaacaatcaagcaatctattgtgctgaggaaatacatgataatgatattgatatgattaaatcacaattaaatgatgctgagtcttattatgcgagaattgaagcggatataaatttacaatctagaatgaaaataactactgaagaagcattccactttatatatcatatgagtgctgtagcatag

SEQ ID NO: 1895 - DNA, 591 bp, Staphylococcus epidermidis
atgggtaggctcattctagttataaggagtgatgatatggacaaattaacgccaaaacaagaacgttttgcgaatgagtatataaagacactcaacgttactcaaagcgctataaaggcaggatatagcccgaatagtgcacatgtaactggtagtcgattactacgcaaagagaaagtggataaatatattaaaagtaagaaagacgagattatggacgatactattttatcagccaaagagttactgtatctattaactcaagcagcagttggcgacgaaactgaaacaaaggaagctgtagtaaagaaaggtacatttgaacgtaatccagacagtggaagaatgaacctcgtatataatgagcatgtggaaactgttgaaatacctattaagccaagtgatcgattaaaagcacgtgatttgcttggcagataccatagcttatttacagaaaaggtagacttaaatgtagcaacaccagtatttattgatagtattgatgaagatgatgagaagaatgagagagatattgaaaatttaagtaaacaatatccgaatgcagagtttcatattgatgatattaggtag

SEQ ID NO: 1896 - DNA, 1521 bp, Staphylococcus epidermidis
ttgatgggaagctcaatagttttaaaattactcaaggtaacacattactatagaaatcataattcaaaaaaatggtatcgaccattaggttatgatgctgaggacatcaacctaaataatatttctttgcatatatatcaaggtgaagcattaggtataatcggagaacctggatcttctaaaactttgattggtagaattttaagtggttcagtgaaacctgataaaggtaaggtcgtccgaactaaaaacttatatttcggtgatattgatgatcgaaagattaataatttaactgtgagccaatatgtgagcgaactcgtacaactttttccttatgaagtaactgagcataaagttgaacaaattattcaatgggcacatttaggtgattacatagaagaaaaggtttctaatttaagcgaaaaatcatacgcacaacttttacttagtattgcacgttcttcaaaaaacgatattatcattttaaatcatgttttatcacatttagatgaaacatttatagaaagagctacagttttatcaaaagattatattgaggctaataaaacactagtcttaattgataatgatgtagaaaagataagcaaaacaagtaactacataacatgggtatcacacggccagatacgcaaggaaggttctctaaatcaggtattaccaacttttagagaacatgaaaaagatcgtactagtttaaaatcagaaatggaaattgagaactttgattatgattggaagcagaatcgctctcgtattcctgaaatgacttataattttaaaagaatagaacgttataatcatgctaagccaccaagatttctagtgagattttggaccttatttgtcagctttttgattgggcttgttttaatgagcgtacttttctttaacaacttaggtatggtcaaactagggaacattaatacccaagcatccatacagaatcagaataaagatacttacgaagaaaaacttgcatatggattagcattagatggatcagttactttaaacgggtctaaagatttaaaagtacctaagtatagtttaattacaattactggagaaaataacaaaagatatcgggtcgaaatgaatcaaaggagatatagtgttagtaaaaatcaagtgttttatttcaatccagctgggttatacgaatctcatacttttaagaaattgtcaccttatataaaatcaaattatagtacttacgtagagtactttaacagtcacttacatcaaaaacatgataaagtaacagaaacgcttagacctgataaagataaaaagtatgttgtaccgatcacgcaacaacctataaaaatgatatttggtgataatgataaactgtctggatttgttattccaatgacaaataaaacggaattgaaaaaaacatttaatatcacgaaagatgtatggattacaaaaagtggaagcggttattttatcgctgatatgaaagaagaaaaatggatttatattgaattgtag

SEQ ID NO: 1897 - DNA, 582 bp, Staphylococcus epidermidis
ttcagattgagagcgtgcgtaaatatggataaaataaccttcttaaatgaattagaattagctttagatgatttacctagggaagaaaaagatagtattatgcacaagtatgaaaacttgttctatgaagaagaattgaaagggattagtgaatcacaaattataaaaaagttaaatgatccttatcatatttccaaagaagtaaaagctagaagtgctattcattatgctagttacaaaccaaccttagcaaacatagtaagagcaatactagcatcgttaagtcttggtattttgtcgttatttattattttaataccggttgttatcattgcattacttattctattctgtttccttatttctatttgttttatctttgcaccatttgttttattattttattcagtattacatggtttcgaaaatgctataagtaatgtgtttttttcaatttcttttacaggtttaggaattatgtttattgttattactttgaaaattggtgaaataattcataaacttattttgaaatatcttctttggtatataaagactgttaaaggaagcgttaaagaatga

SEQ ID NO: 1898 - DNA, 735 bp, Staphylococcus epidermidis
ataatgaagagcttacaattagtcaaatatgatttaattagtatacttaaaagtccgtatacttatttagcatttatacttgtaattggaatgacggtattccaagctagcatgatggcaaattatagttctgcacataaagttaatatagatatggtttttaatttagctaattggcttttcttgtttgctggtcttttattcattataaaaacaataacaagagattactcacaaggtactatacaattgtttatgagcagaataactagcagaatgggctatatcattactaaaacagtatctattgtattaatttcattcttatttacaattattcactacttggtaataattattatacaatctacaactaaaagtgaaaaaatggatggagatagatttttaaataatatttggttttaccttattttctttttattctttggattattcttattactaatcactttaatagtagaaaaacctgctgtcatatttactctaggtatttttttaatactcatcgttccgtttattcagccatttattccaatgattccgaatattggcgatgatattcaggattcatttaaatatataccatttacgtatttaactgaaaaaatgactggtgagattaaattctctaattggcaatggtttatctctattgcatcaatagtggtcttatttattgcaaatatgttatatgcatcaaagagggatatttaa

SEQ ID NO: 1899 - DNA, 648 bp, Staphylococcus epidermidis
ataaggaggagaattcaagtggcgattaaagttttatttgttgatgatcatgaaatggtaagaatcggtatttcaagctatctttcaactcaagaagatatagaagtagtaggtgagggtgcttctggtaaagatgctatcaccaaagcgcatgagctaaaaccagatttaatattaatggatttacttatggacgatatggatggtgtagaagcaactactgaaataaaaaaagatttacctcaaattaaagtagtcatgttaacaagctttatagaggataaagaagtttatcgtgcacttgattctggagtagatagttatattttaaagacaacaagtgcaagtgatatagctgacgctgtgcgtaaaacgtatgaaggtgaatcagtatttgaaccagaagtgttagtaaaaatgcgcaatcgtatgaaaaaacgtgccgagctttatgaaatgttgacagaaagagaaatggagatcctattacttatagctaaaggatactctaaccaagagattgcaagcgcctctcatatcaccatcaaaacagtaaaaactcatgtaagtaacatactaagtaaattagaagtacaagatcgaacacaagcagtaatatatgcgttccagcataatttaattcaataa

SEQ ID NO: 1900 - DNA, 207 bp, Staphylococcus epidermidis
tacttaggtggtaagatgataaaattgactaatccagctgtaacaagtcctataagagctgtaagtaaccgtgaaaagaaattgaacacatatgcttcatgtatacctggaatcattgcaacggaagttaatactgcgacagttgttcctacctgtaaattaagtttagtgcatatcagaatggtaaatgtagcacttaaagcataa

SEQ ID NO: 1901 - DNA, 504 bp, Staphylococcus epidermidis
tataacattttaaattattcaagggaggggttttatataagaaatttagaaacttattttaataaaagtcaaacactcaatgaattcattaataaaatacaagaaagtaaagacaatttattatccatttataatttcttccacctgccacttaatgatgcacgtttaaatcaattaagagaatcgaattattataaggtgcttataattaaagaggattggtgtggcgatgccatgatgaacattccaatattaaagcatactattgaatttctgaacatcatagcaagagtatttcatagagatgatgatacacatctgattgatcaatatttaacaaatggtaaatcaagggctatccctatctttgtattcatgaacgattcattcgaacaattgacagtttggagaccaagagcaaaaaagtacaaagttttgtcaataaaattagaagtaataaattgccagataaaacccatcctaattttgatttttactcaataa

SEQ ID NO: 1902 - DNA, 2001 bp, Staphylococcus epidermidis
gggatgcaaggtgttaaaaagcgtgtggaaaaattacatgacttattgaatcaatatagttatgaatattatgtacaagataatccctcagtgcctgacagtgagtatgataagttattacatgagctgattgaaattgaagaaaaatatccagaattcaaatcgacagactctccaacagtgcgtgtgggtggcgaagctcagtcttcttttgaaaaagtaaatcacgacacgcctatgttaagtttaggtaatgcttttaatgaagaagatttaagaaaatttgatcaacgtattcgtgatagtattggtaaggtcgaatacatgtgtgaacttaaaatagatggtttggctgtttcgctcaaatatgaaaatggtcgttttgttcaaggacttacacgtggtgatggtacgacaggtgaggatatcactgaaaatctaagaactatacatgctataccactaaaaattaaagaacctctcaattttgaggtccgtggggaagcttatatgccacgtcgttcattcattcatttgaataatgaaaaagaacaaaatggtgaacaaccttttgcaaatccacgaaacgctgctgcaggctctttaagacaacttgactctaaactagctgcgaaaagaaagttaagcgtcttcttatatagtgtgaatgacctaaccgagtttaatgcaacaacacaaagtgaagcgctagaggaattggaccaattaggttttaaaactaaccaagaacgtgaacgagtatcagatattgagggcgtacttaattatatagagaaatggacaagcaaaagaggatctttatcttacgatattgatggtattgttataaaagttaacgatttatctcaacaagaggaaatgggttatacgcaaaaatctccaagatgggcgattgcttataaatttccagctgaagaagttattacaaaattattggatattgagctaagtattgggcgtacgggtgttgtgacaccaactgcaattctagaacctgtaaaagtagctggtactacagtttcaagagcctcacttcataatgaagatttaatacatgaaagagatatacgtatcggagatagtgttgttattaaaaaagccggggacatcatccctgaagttgtaaaaagtattttagatagacgacctaacgaatcggaaatttatcatatgccaacacattgtcctagttgtggacatgaattagttcgtattgaaggagaagttgctttacgttgtattaatccaaaatgtcaggcacagcttattgaaggacttatacatttcgtttcaagacaagcgatgaatatagatggtttaggtactaaaattattcatcagctatacgaaaatcagttaatcaaagatgtcgcagatattttctatttgaaagaagaagatttattaccattagagagaatgggaaagaagaaagttgataatcttttattagcgatagaaaaatctaaagaacagtcattagagcatttattatttggactgggtattagacatttaggtgtaaaagctagtcaagtacttgctgagcgatatgaaacgatggatcaactttttaaagtaactgaaagtgaattaattgaaattcaagatattggagataaacttgcacaatctgttgtaacatatctcgaaaatagtgatattcgttcattaattgaaaaattaagtaataaaaatgttaatatgtcttataaaggaattaaaacaactgaaatcgaaggtcatcctgattttagtgggaaaacaattgtattaacagggaaactcgagcaaatgacgagaaatgaagcatctgaatggttgaaaatgcaaggtgctaaagttacaaacagcgtgactaaaagtactgatattgtcatagctggagcagatgcagggtctaaattagccaaagctgagaagtatggtactgaaatttggactgaagcagcatttattgaaaaacaaaatggaatctaa

SEQ ID NO: 1903 - DNA, 822 bp, Staphylococcus epidermidis
tttaaacgaggtggcataatgcatttatattatctaggacctaaaggaactttttcatatctagccgctaagcaatttgaatcacatgaacagtatgacttcattccattatctaacttgcatgaagtcattcaatccgtatctaaagataaacaggctgtcggaattgtccctattgaaaactctattgaaggtactattaacattgtcgctgattcattagcacatcatgatgtatacgcacatggtgaaattcaactagatatagatttttcactttacggtcatcattcaaattcacttgatgatattcataaagtatattcaattgctccagcaatcagtcaaacaataaactacattcatcgtcaacagtttgactatgattatgtagatagcactattcaaagccttaacatgataaaagatggtattggagcaatagctcctcttgggagtggggaaacttatggctaccatactttagatcaacatatacaagattaccctcataatgtaactagatttttagtagtgaaaaatcatactcattttattgaacatccaaacacaactatcttccttatcacgcctaagtatgataagccaggacttttagctagtgttttaaatacttttactttattcaacataaatttatcgtggattgaatctagaccacttaaaactcaattaggtatgtatcatttttatgttcaagccgatactgctataaataatgatgtgaataaaattatttcaattttagagactttggattttcaagttaaaattatcggcgcttttaataagaaaaactaa

SEQ ID NO: 1904 - DNA, 561 bp, Staphylococcus epidermidis
agaactggaggggtgaatgtgcataaaatagatttatcaggcaacaaatttcaaatccaacgatttgttctgttgcaaattgtattggcgctatttacaatactatttacttataaatgggcttatcaaacaacgcatatcattgaacaaaatcttgtcatgaatcttatttttggatttgtaggtttcgcagtactagttattttgcacgagtttattcatcgtattttgttcattatattttctaaaggtgaaaaaccatctttaaaatatgataaaaacaaaattattgtacagttctctcagacttgttttcatcggtggcaatttacaattatcatgatagcaccacttgttatcataagtgcgaccttactagcacttattcaaatatattccttttcatctttaatctttatgtttagtatacatacaagttattgtatgatagatgtgtttttagtagcattggcattacaaagcaaattcaaatatatacaaacctatggagaaggtttgtatctttatcatcaaaagcctactcaaacctattatgaataa

SEQ ID NO: 1905 - DNA, 1047 bp, Staphylococcus epidermidis
ttttatggaggttttggtatgacattaggttatataggttcttatactaaaaagagtggtaaaggtatatatcgcttcaaactaaatgacgaaacaggagttattgaagcgttagaaactggttatgaaattgaagcgtcaacttatcttactcgtaatgaatcgtttttatatgcgattactaaagaaggtgaagaatgtggtgtagctagttttagtattaaagaagatggacaactggaattaattaataaatgtctagcatcaaaacagggaactggttgttacattcaagtgtctagtaatggtaaatatttatttgaagcggtttatggtgcaggacttgcaaggatttataaattaaatccaattacgggagcaatagagaaattaatagaagaacttgagcatgaatttccaactggctcacatgaaagacaagattcatcacatgttcattttttaaatgaaacacctgatcataagtatgttgtagctactgatttaggtacagatagagttgtaacatacaaatttggtgaggatggtttaaaacaatatgcagtttctcaattcaaaaattcagacgggcctcgccacatcgcttttagtaatgatggacgacacgcgtatatcgttcacgagctatcaaatgaggtgagtgttacagaataccaagacggtaagttcattgagctagagagacattcaactattccaagtgactttaacggggaatcgaaattagcagcagtgagactatcacatgatgggaagcacttatatataagtaatagagggcatgatagtattgctatatttgaagttttagaagatggcagatcactgagaagtattgaaatacaaccaagttacgatgcctttccaagagactttaatataactgaatcagataactatttaatttgcgcacatcaagaaggagaatcaaaagtttcaatttttgagcgtgataacataactggtaaactttcattaaaagataaaaaagctatagcaaatgaaggtgtttgtgtactactataa

SEQ ID NO: 1906 - DNA, 564 bp, Staphylococcus epidermidis
atagaaatggggaaattgggacaacaaattattggttatcattgtaatgatgaggttaaaatagataaattcaaaaatagagaagtatctttgcttataagttatgaagatgatatctggctaggtaatggaatgtatttttgggaaaataaaagcaacctggattattggaaaagaaacagggaaaggaattacccagacaaaaatttctccagtgtagaagtaatgttgtctttagactttttgttagatttaagtgataaagagcatagaaaattttgcaagaaagttttgagcgatttaattgaaagagggaaagataacggtatagatgaaagcattttcaataatgatttaggtgaggtaattaatgtattattttctaaaactgatattttagcatcacattttaatgtgttaagaacacatggtttatacaattggtcagaggacaaatttttggtaggaaatgataacaaataccaaagtgtaaacagaccaacttcaaatgttaaaactatctattgtgtaaaaaatgaaagggcgattttagaaatcttgtaa

SEQ ID NO: 1907 - DNA, 1557 bp, Staphylococcus epidermidis
ttaataaagggagtgttaattatgttaacattaggtacagctctcagtaatcaaattgatgcaaattggcagacttacgttatgattattgtctatttcataatccttctaattattggcttctatggttatcgacaagctactggaaacttaagtgaatttatgttgggaggacgtagtatcggaccatatatcacagctttatcagctggtgcctctgacatgtctggatggatgattatgggacttccaggttcagtatacagtacaggtttatccgccatttggataaccattggattaaccttaggtgcatacattaattattttgttgttgctccaagactacgtgtttatactgagattgcgggagatgctattacactcccagacttttttaaaaatagactagatgataagaaaaatattattaaaattatttcaggattgattattgtcgtatttttcactctatatacgcattcaggtttcgtttctggcggaaaactctttgaaagtgcatttggattgaattatcatgctggactcttgatagtggctattatagttattttttacactttctttggtggctatttagctgtatcaattactgatttttttcaaggtgtgattatgcttattgctatggtaatggtacctatcgttgcattgcttaaactcaacggttgggatacatttcatgatattgctcaaatgaaacctacaaacttagatttatttagaggaaccactgttttaggcattgtttcattattctcatggggactcggatattttggtcaaccacatattatagtaagatttatgtctatcaaatcacataaattactaccaaaagccagacgtctgggaataagttggatggcagtcggtctattaggagcgattggtgtgggattaacaggaatttcatttatatctgaaagacatattaaattagaagatcctgaaacactatttattgtgatgagtcaaatattatttcatccgcttgtaggtggatttttattagcagccatccttgctgcaataatgagtactatctcttcacaattactagtaacatcaagttctttaactgaagatttctataaactaatcagaggttcagataaagcatcatcacaccaaaaagagtttgttttgattggacgcttatcagttctacttgttgcgatagttgctattacgattgcttggcatccaaacgatacaatactaaatttagttggtaatgcttgggctggttttggagctgcatttagtcctttagtactctactctttatattggaaagatttaacacgtgcaggagctattagcggaatggtagctggtgctgtagttgttattgtttggatttcttggataaaacccttggctacaatcaatgcattctttggtatgtatgaaatcattccaggtttcatagttagcgtattgattacgtacatcgtaagtaaattaacaaaaaaacctgatgattatgttattgaaaatcttaataaagttaaacacgtcgttaaagaataa

SEQ ID NO: 1908 - DNA, 717 bp, Staphylococcus epidermidis
atgaaaatttttgtttgtgaagatgaccaaagacaaagagaacatatggtatcaatcattaaaaactacataatgattgaagaaaagccaatggagttagccttagcaacaaatgatccttatgaggtcttagagcaatcaaaagaacttaatgacattggttgttacttccttgatattcaattagaagctgatatgaacggtattaaattagccagtgaaattcgtaaacatgatcctgttggtaatattatatttgtaaccagtcacagtgaactgacttatttgacgtttgtttataaagtggctgctatggattttatttttaaggatgatccatctgaattaaaaatgagaatcatagattgtcttgaaacagcacatacacgactcaaattattatcaaaagaaagtaatgtagatacgattgagttaaagcggggaagtaattcagtatacgttcaatatgatgacattatgttttttgaatcatctacgaaatctcatagactcatcgcacatcttgataatcgacaaattgaattttatggaaatttaaaggaattagcacagcttgatgaacgtttctttagatgtcataacagttttgtgataaacaggcataatattgaatctattgattcaaaagaacgtattgtttactttaagaatggcgaaaattgtttcgcttcagtacgtaatgttaaaaaaatataa

SEQ ID NO: 1909 - DNA, 210 bp, Staphylococcus epidermidis
gataatattatcgtagtaaatacaagtaaaaaggagttccaatatttaatgagtgaacagcaaacgattgatcaaattaaaacacgattaaacaaatttattgaagacattgatcatgtaaatccggatgaggtacgtgtagaagatattgatgagtggattggtttacttgatcagttggaagaaaaagtgaaacaagtttcaaaataa

SEQ ID NO: 1910 - DNA, 528 bp, Staphylococcus epidermidis
tgtcacattatggcaaaaaaagtagcaattattctagcagatgaatttgaagatatagaattaacaagtcctaaagaagcattagaaaatgctggatttgaaacagaagtgattggtgatacagctaaccatgaagttgttggtaaacacggtgagaaagtcactgtagatgttagcattgctgatgctaaaccagaaaattatgatgcattattaattcctggtggattttcacctgaccacttacgtggtgatgaagaaggtcgctatggtacttttgctaagtatttcactaaaaatgatgttccaacatttgcaatttgtcacggaccattagtattagttgatactgacgatttaaaaggacgtacaatcacgggtgttattaacgtacgcaaagatttatcaaatgctggtgcgaatgttgtagatgaatcagtagtggtagacaacaacattgtaacaagtcgtgtacctgatgatttagatgacttcaatagagaaattgttaaaaaattagaagcataa

SEQ ID NO: 1911 - DNA, 669 bp, Staphylococcus epidermidis
gatttaactatgaagcaattaatgattagaaacttaaaattacgtacttggacactaattatttacgcattattgcttttattctttcccatttatcatttgttaaataaagatacaccactatattcaattatctcaggaccaatcggattaatactgacgatgatatgtttgatagatataggtcatttattcagagttaatcgtagattacgtggttcatcttcatattatttcttttatagtttgcctgtatcaaagagagatttgcttaacgctaattacatgacatgcattttattaacttttataggtgagcttatcattagtttatatggatactacacaagcacaataaaaacagattcgatttatttttcgacgactttttcattcatagtagggaatttcttttctatacctatagcgtttagtaagagtactgaacgtaaagatcgagatattccatatatagcttatattgtaggaattatggtggttctgccatttactttatcggtcatttttatcttaatcaattatcttacacacaatgatagccatatcccaatgatatactcatatttcttaaattatggtctattagttgtaagtagcattttcttagtcattaattatttgattcaaattaaaaaaataaagtattaa

SEQ ID NO: 1912 - DNA, 1401 bp, Staphylococcus epidermidis
tttttttatatacttgaactaacaaaagattgtaatggggaggtggttgaatttatgaaaaagtttaacattaaacattcatttatgcttacgggctttgctttcatggtaactacatcattattcagtcaccaagcacatgctgaaggtaatcatcctattgacattaatttttttaaagatcagattgatagaaatacagctaagagcaatattatcaatcgagtgaatgacactagtcgcacaggaattagtatgaattcggataatgatttagatacagatatcgtttcaaatagtgactcagaaaatgacacatatttagatagtgattcagactcagatagtgacttagattcagatagtgattcagattcagatagtgattcagattcagacagtgactcagattcagatagtgactcagattcagatagtgactcagattcagacagtgattcagactcagatagtgactcagattcagacagtgattcagactcagatagtgattcagattcagatagtgattcagattcagacagtgattcagattcagatagtgattcagactctggtacaagttcaggtaagggttcacataccggaaaaaaacctggtaaccctaaaggaaatacaaatagaccttctcaaagacatacgaatcaaccccaaaggcctaaatacaatcaaacaaatcaaaacaatataaaccataatattaatcatacacgtactagtggagatagtgcgccttttaaacgtcaacaaaatattattaattctaacttaggtcatagaaatcaaaataatataaatcaatttatatggaacaaaaatggcttttttaaatctcaaaataataccgaacatagattgaatagtagtgataataccaattcattaattagcagattcagacaattagccacgggtgcttataagtacaatccgtttttgattaatcaagtaaaaaatttgaatcaattagatggaaaggtgacagatagtgacatttatagcttgtttaggaagcaatcatttagaggaaatgaatatttaaattcattacaaaaagggacaagctatttcagatttcaatattttaatccacttaattctagtaaatactatgaaaatttagatgatcaggttttagctttaattacaggagaaatcggctcaatgccagaacttaaaaaacctacggataaagaagataaaaatcatagcgccttcaaaaaccatagtgcagatgagataacaacaaataatgatggacactccaaagattatgataagaaaaagaaaatacatcgaagtcttttatcgttaagtattgcaataattggaatttttctaggagtcactggactatatatctttagaagaaaaaagtaa

SEQ ID NO: 1913 - DNA, 501 bp, Staphylococcus epidermidis
gatgggcatataaatacatggtttggagtgatactaatgatacatgtagcatttgtatgtctcggtaatatatgtcgttctccaatggctgaggctatcatgagacaaagactacaagaaagaggtatttcagatataaaagttcattctagaggaacaggacgttggaatttaggcgaacctccacataacggaacacaaaaaattctacagaagtaccatattccttatgatggtatggtgagtgaacttttcgaacctgatgatgattttgactatattattgctatggaccaaagtaacgtagacaatatcaaacaaatcaatccaaatttacaaggacaattgttcaaattgctagaatttagtaacatggaagagagtgatgtaccagatccatactacacaaataattttgaaggtgttttcgagatggtgcaatcatcttgtgataatttaatagactacatcgtaaaagatgcaaatttgaaagagaggtaa

SEQ ID NO: 1914 - DNA, 1827 bp, Staphylococcus epidermidis
atcaataatattacaattgtaatattcgcgtcaatagtttattataaatatttgaaagaaggtgttgaaatggctaagttattaataatgagcatagtaagcttttgttttatatttctattgttattattttttaggtacatattaaaacgctattttaattatatgttaaattataaagtttggtatctaactcttcttgcaggattaattcctttcatccctattaaattctctttttttaaatttaataatttgaataatcaagagcccacagttgaaagtaattcacacaatttgaatcctaacataaataccactaaacctgttcatgagtttacaacagacatccataagtttaattgggattcaatagataatatctgcacagttatttggatagttttagttattattttaagttttaaatttttaaattctttattatatcttaagtatttaaagaaacagtcactttatctaaatgaaaaagaaaaagataaaataaacaagatacttttcaatcatcaatataaaagaaatattgtgattcgaaaagcagaatctattcattctccaataactttttggtatggaaaatatattattttgattcccagtttatattttaaaagtataaatgacaaaaaactaaaatatataatattgcacgagtatgctcatgctaaaaacagagatactttgcatttaattatctttcatattttttctattgctatgagttataatccactaatacaaattgtaaaaagaaagatgattcatgacaatgaagtagaagccgatagatttgtccttaataatattaacaaaaatgaatttaagtcttatgcggaagctattatggattccgtattaaaaacctcatttttcaacaaaaatatattaagccattcatttaatggtaaaaaatcattactcaaaagaagattaattaatataaaagaaggcaatctgaagaagcagtcaaaattaattctaatttttatttgtatttttactttttttatcatgataattcaaagccagtttttaatggggcaatccttaactgattataattataaaaagcccttacaaagcgattaccaaattttagatgaaagtaaaaattttggttcaaatagtggatctttcgttatgtacagcatgaagaaagacaaatactatatttataatgaaaaagaaagtagaaaaagatattctcctgattcaacttacaaaatttatttagcactgtttggacttgaccgtcatattataagtgataaaaattcacgtatgtcatggaatcataatcattatcctttcgattcttggaataaggatcaagatttaaatacggcaatacaaaactcagttaattggtacttcgaacgtattagtaatcaattatcaaagaactatacttctgatcaactcaagcaattaaattatggtaataaaaatttgggaagttataaagcctattggttggaagatagtttgaaaatatctaatcttgaacaagtaatagttttaaaaaatatgatggaacaaaataaccattttagtaaaaatgaaaagaaacaattatcttcttcgttattgattagaaaaaatgaaaattatgaattgtatgggaaaacaggtacaggtatagtaaacgggaaatataataatgggtggtttgtaggttacgtaattacaaatcatgataagtattatttttctacacatttatcagatgaaaaagcctctggtgaaaatgctaaattcataaatgaaaaaatattaaaagaaatgggtgttttaaatggccaataa

SEQ ID NO: 1915 - DNA, 1068 bp, Staphylococcus epidermidis
agtaaaaatataaggagagattataaaatgcaaaaagtacgttctgatataatgactcatcgtggttctcactatgatttaggagtaaagactgctctttggttacaaaccactcctttattaaaaaatcgaaataaagaatggcgaaagagaattccacgttttgatattgatgtcaaggaaacctatgatatatttcaaatctattcgccacagatttgggaagaaataattggtatgcaagatgtattgaatctacctacaaaacaaatgattttaaattttggccattatcgatttactgatttaaaggacagtggttgcacagtatataaaggtcgtgattttttagtccgaaattatgattatcatcctgcaacatatgatggtagatacttattatttcaacctaatgacgggggattatctcaaataggaccgacttcaagagtgactggtagaatggatggtatgaacgagtatggtttagttatggcatataattttatgcatcgtaaaaagcctgcaaatggatttgtatgttacatggttggtcggctaatacttgaaaattgcaaaaatgtaactgaagcaatcaaatttttaaaggaagtaccgcatcgtagttcattcagttatatactaatggatagacattcgaattatgccattgtcgaagttacacctcgatcaatagatgtaaggtatgaacatatatgcacaaatcattttgaattgcttacccatgaaaatagaaactatacaagagaatctaaagaacgcttaaatcgtgtaataaataaaacaactccttctacaaacaaagatatcgcattcaaattatttaacgacccgcaatacgaaatctatagcaacctatttaaaagttggtctggtacaattcatacttcactatatgaacctaattcattaatagcatggatggcattaggtcaaaacagtcatccaacctcaatcaatttttctaattggttaaaaggaaagaaattgaatataaattactttgaaggcgaaatagatacaccattaacttttgccacatactaa

SEQ ID NO: 1916 - DNA, 387 bp, Staphylococcus epidermidis
aataaaagtatagaggttaagatggaaaaatttaatagacaagaacaattaaaacagttgcatgcagaacgaaaagttaaaaccgagaaaaaagttgataaagcaataaatgatttagttcaaaaaaataaagaaattaactttaacatcgtttctaaacattcaaaagtttcgaaagctacattatataaaaataataaaattcgaaagaaaatagagaagttacgtgaacaaaacagagaaatatttgttcataaaaataaaaatgacggtaaagatgcgttaatctcctctttaaaaagaaaagtaaattctttagaaaaagagaaaaaaatgttgaaagaagaaattagcgttttatattctaggctgtatgaggatatttaa

SEQ ID NO: 1917 - DNA, 1383 bp, Staphylococcus epidermidis
ttgagaatcttttttgttataccatttacgtgttataattactcgagtgcaaattggaggaggaaacgcatgagacaatggactgcaacccacatggctaagttagcaaggaaagcaagtatagctgtaggtaaaaagggtacagacttgccgggacagattgcaagacgtgtggatcataatattttaagaaaattagctaaacaagtagatgacattgtttttataagtgggactaatggtaaaacgactacatctaacttaattggacatacattaaagaaaaatcaaataaacattattcacaataatgaaggagcaaatatggcagcagggataacttctgcttttattatgcaaagctctaagaatactaatattgcgataattgaaatagacgaaggatctattccacgtgttttaaacgaagtcacaccttctatgatggtgtttacaaatttctttagagatcaaatggatcgatttggtgaaatcgatattatggttgataatattgcaaaatcaataagtaacaaagggataaaattattattaaatgcagatgatccgtttgtgagtcgcttgaaaattgcaagtcattccattgtgtattacggaatgaaaaaatttgcgcatgactttgaacaaagtacaatgaatgaaagtaaatattgtcctaattgtggacgattattgcaatatgactatatacattataatcaaattggacattatcactgtgaatgtggatttaagcgagaagaacctacatatgaagtgtcatcatttgatgcttcaccattcttaaaaatgataataaaccaaagtgagtttaatatgaaaattgcaggagattttaattcttataatgcaatagcagcctataccgtattaagagaattaggattaaatgatgatgcaatacgcaaaggatttgaaacatatacgtctgataatggtcgcatgcagtatttttcaaaaaataagaaggaagctatgattaatctagcaaaaaatccagctggaatgaatgcaagtctatcagtaggcgagcaaattgatgataaaaaaatttatgttattagtcttaatgacaacgcggcagatggtcgagatatttcatggatatacgatgcagactttgaaaagctagctacccaagatatcgaagctatcattgtaagtggtacacgtgctgaggaactacaattacgtctcaaacttgctgaagttgaagtgcctattaaggttgaaaaggatatctacaaagcgactgcattaactatgaaatacagttcatttacggtagcaattccaaactatacatcattaacaccaatgcttgaacaacttaatcgctcatttgaaggagggcaatcgtaa

SEQ ID NO: 1918 - DNA, 306 bp, Staphylococcus epidermidis
tctgatttaataaaatatttagaccaaatatatgaaattaaaagcgacataattattattaaaattattgataaacaccagttttcattggctgaatctactaaatccttgaaccatctaatttttttatttttatatatatacgcatatataattatagctagaagcataattatatttataaatcttatgttattactttcaactttttttaatttttcagttggtttacaaaaatctattaatactgtatatgagttatcaaatatatatgtaaaaaataaaggtataataaagaaaaggtaa

SEQ ID NO: 1919 - DNA, 858 bp, Staphylococcus epidermidis
tgtgtcataatatatgtaagaaaaacgtttgaatatagaagtagggatagtaaaatgccaaaggtaactaaaatagaagtacaaaaaaagaataaagaacgctttaatctctttttagatggagaatttgaaatggggatagatattgatacattagttaaatttaacttaaaaaaagatcaaatacttgaaccgtcagatatgcagaatattcaagaatatgatcactaccgtcgaggtgttaatcttgcaattcaatacttgtcttataagaaacgtactgaaagagaagttatacagtatttagaaaaaaacgatattcaaagtaatgctattcaagatgtcattgactattgctataaggaaaaatttattgatcatgaagactacgcagaaagtttaaaaaacaccatgatacacactacagataaaggaccagaaatatatagacaaaaactctatcaattaggtattgaagttacgattattgaaaaatatgtcgaagcatatgaacaacaacaaccattagatgacgtcatcaaagttgctgaaaaagtgatgaagtctaaaaagggtcctgaagcaaaggtaaagcaaaaagtaacacagtcacttctccaaaaaggatataagtttgaaacaattcaactagttatgaatgaaatagatttttctcaagacgaagaaacattagaccatttattgcaacgtgatttagagaaagtctataataaaaattgtagaaaatatgacagtgataaaagtgttattaaaaccatagaggcactcatgagaaaaggctataattatgataaaattaaatctaaattagaagaaagcggtatatctaatgaataa

SEQ ID NO: 1920 - DNA, 582 bp, Staphylococcus epidermidis
cgaaaaataattgaaaggaatgaaataatggtacaaaatgcatttgttgcactggactttgaaactgctaacagtaaacgaacaagtatttgctctgtaggtatggttaaagttattgataatcaaataacagagtcatttcatacccttgtgaatccttttgactactttactgaaacaaatattactgtacatggcatccatcccgaagatgtgcaagatgctcctggattcaagcatgtctatccatatatgctaaaatttattgatcaacttcctgttgttgcccataatgctgcttttgatatgaatgtgttacatcaaagtttaaaaagtcataatatagatacaccttctttgacatacttttgttcatatcaattagctaaacgaacaattaatgcatatcgatatgggctaaaacatttaatgaatcattaccatttagattttcacggtcatcatgatgcgttaaatgatgctaaagcttgtgcaatgattacctaccgcttattgaaacattatgatgatcttcaaagcatgttgagtatatatggaaaaaatctcaaagataaaggctga

SEQ ID NO: 1921 - DNA, 1146 bp, Staphylococcus epidermidis
attatgataatatcaaacaaatcccctatttctatcaacaatgatccatgggaagcatataatgatattttagaacataaccaattaacattaagtaatatagaatttacaactacaaatttatgtaatatgcgttgcagtcattgtgcagttggttacactttacaaactaaagatcctgatcctcttccgatggatatcatctatcgacgtttggacgagatacctaacttaagaacattgtctattacaggtggagaaccaatgttttccaaaaaatcaatcaaaaacgtcgttaagcctctacttaagtatgccaaacatcgtggtatttatgttcaaatgaattcaaatttaactttacctcaagaccggtatttagatattgcagaatacatagatgttatgcatatttcacataattggggaaccattcaagagtttactgatgttggctttggtgcaatgagaaaacaacctcctctaaaagccaagttgaaattatatgagcaaatgcttgaaaattccagcactttatcagaccaaggcatgttcgtatcggcagaaacaatgcttaatcaaagcacagtcccttatctaagtaaaatacataacgaagtggtaaatgacatgaaatgtagccgtcatgagattcacccaatgtatccatctgattttgctagccaattaaatgtattatctcttaaagaaatgaaagaagctattcatcatttgttagatatacgtgatgaaaacacatggatgttgtttggtactctacctatctatccatgtttaaatgatgaatatgatcaacatttattgcaacgtttaagaaaatcgaagaatgttacaatgagaaatgaccctgatggtcgtagccgtttgaatgttaatgtatttactggcgatgttattgtgactgattttggtgatgaaaatggtacaatatctaatatacaaaaggataaattgacagatgtattcaaccagtggttaaatactgaccttgcacaatctttaaattgtcattgtgcagaatatcaatgtctaggtccgaatgttttagttaaaaatatgtattacccaaatactgatttcaagaaaaaagaacaaatcatgcatcaacatcaaatattttcataa

SEQ ID NO: 1922 - DNA, 1440 bp, Staphylococcus epidermidis
ggagtggaaatcatgcattttgaaacagtaatcggacttgaagttcatgttgagttaaaaacggactcaaaaatgttctctccatcacccgcacattttggagctgaaccaaattcaaatacaaatgttatcgacttagcttatccaggtgtattaccagtagttaatagacgtgcagtagattgggcaatgagagcttcaatggcattaaatatggatattgctacaaattcaaaatttgatcgtaaaaactatttctatccagataatccaaaagcatatcaaatttctcagtttgatcaacctattggagaaaatggctatattgatattgaagttgatggagaaacaaaacgtatcggtattacacgtcttcatatggaagaagatgcaggtaaatcaacacataaagatggttattctctagtagacttaaaccgtcaaggtacgccattaattgaaattgtatctgaacccgatattcgttcacctaaagaagcatatgcttatctagaaaaactacgttcaatcattcaatatacaggtgtatctgattgtaaaatggaagagggatccctacgttgtgatgctaatatttcacttcgtccatatggtcaaaaggaatttggtacaaaaactgaattgaaaaaccttaactcatttaactacgttaaaaaaggtttagaatatgaagagaaacgtcaagaagaagaattattaaatggtggagagattggtcaagaaacacgtcgatttgatgaatctactggtaaaacaattttaatgcgtgtgaaagaaggttcagatgattatagatatttccctgaaccagatattgtaccattatatgtagatgaagattggaaagcacgtgtaagagaaacaattccagaattgccagatgaacgtaaagctaaatacgtaaatgatcttggactaccagaatatgatgcgcatgtattaacattaactaaagaaatgtctgatttctttgaaggcgcaattgaccatggtgcagatgttaaacttacttccaactggttaatgggaggtgttaacgagtatcttaataaaaatcaagttgaattaaaagatacgcaactaacacctgaaaatttagctggtatgattaaattaatagaagacggaacaatgagtagtaaaatcgctaaaaaagtttttccagaactagcagaaaatggtggagatgctaaacaaattatggaagataaaggtttagtacaaatttctgatgaagcaacactacttaaatttgtaacagatgcattagataataatccacaatcaatagaagattataaaaatggtaaaggtaaagctatgggattcttagtgggccaaattatgaaagcttctaaaggtcaagctaacccacaaaaagttaatagcctattaaaacaagaattagataaccgttaa

SEQ ID NO: 1923 - DNA, 1080 bp, Staphylococcus epidermidis
ggtgagtcgatgactgaaagaagaattattcatatagatatggattatttttttgctcaagttgaaatgagagataatcctaaactaaaaggaaaacctgtcatcgttggcggtaaagcgagtcatcgaggcgtagtttctacggcatcatacgaagcaagagcttatggtgttcactctgctatgcctatgactcaagcacataagctatgccccaatggatattatgtaacaagccgttttgatacttatagagaggtatctggtcaaatcatgaaaatattcagaagttatacagaattagtagaacccatgtctttagatgaagcttatttagatattacacatttagtgagaccggatttaccagcatcaaccattgcaaattatattcgcagagatatatacgaagtaacaagtttaactgcgtcagctggcgtgtcttataataagtttttagcaaagttagcgagtggtatgaacaagccgaatggtttgacagtaattgattacaataatgtacatgaaatattaatgcaattagatattggagattttccaggggtaggcaaagcttcgaagaaaaaaatgcatcaacatcatatatatacaggtcaagatttatataataaagatgaatttgaattaatacgtttattcggtaaaagaggacgaggtttgtataataaagctcgaggtatagaccataatgaagtaaaggcgagtagagttcgtaaatctgttgggactgaaaggacattttctacagatgttaacgatgatgatgttattttaagaaaaataagagagctttcaggaaaaacagcagaacgtttaaataaaattcaaaaatcaggtaaaacagtcactgtaaaaataaagacctatcaatatgaaacaatctcaaagcaaaaaagtttgagagatcctattcgtactgaaactgatatctataatattgcctatactttatataacgacttaaaagatccagagattccgattcgattaataggtgtaacggtcgggagtttagagcaatctgattttaaaaatttaacaatatatgattttatttaa

SEQ ID NO: 1924 - DNA, 435 bp, Staphylococcus epidermidis
atatcttttgttttacctgtttccggtaatttatcttgtacatcattgttattatctttcttggaagttgttgtaatttcgtcttctttgtctttcttagttatttttgtgtctttctcgtctttgccgctttttggtattactgggcttttctcctctctatctttcttcaaagtttttgtgattttcttttctttgtctttttttggtgtttttgtgtcttcgtctttctcgactttaccgttacttggtattactggttttttctcttctctatctttcttcggagtttttatgtctttcttttctttgtctttctttggtgtttttgtgtctttagattctttctcatctttatctttctttagtgtttttgtgtcttcgtctttctcgtttttggtaatttgtgtatttgttactgaagtatttgcttga

SEQ ID NO: 1925 - DNA, 903 bp, Staphylococcus epidermidis
gcactaaatgttgggaaaataagcataagcgtatttttgaagttgctgaacacgttaaagagatggaggatgaaaatgagtagattgcaagatgttgtggttaatgaaatgaaagtaaaaaaacaaattgacagtgtagaggaaatccaggaaattaagcaatttattaaagcgtatgtaaaatcacattcatttatacaaactcttgttcttggaatatcaggtggtcaagactctactctaacaggtaagttagcacaattagcagtaaatgaattgaaagaagagggacgtaactgtaaatttatagcagtgaaattaccttatggtgtgcaacaagacgctcatgaagtagaagatgcacttgagtttattaatcctgacacaacatatacagttaatattaaaccagcagttgatcagagtgttcaatcacttagtgaagcaggcatcaaacttactgattttcaaaagggtaatgaaaaagcacgtgaacgaatgaaagttcaattttcaattgcttctaatactcaaggtatagttttaggaactgatcactctgccgaaaatattacaggattttacactaaatatggagatggtgctgcggatattgcgcctatctttgggttaaataaaagacaaggtaaacaattactagcttatctaggagcacctaaacacctttatgaaaaagtgccaacagctgatttagaagatgataaacctcagttaccagacgaggaagcactaggcgtatcttatcatgatattgatgattatttagaaggtaaagaaattcctggaactgctcgtgaaacaatcgaaaaacattatgttagaaatgcacataagcgtgaacttgcttatacacgatattcatggcctaaatataacaaatga

SEQ ID NO: 1926 - DNA, 846 bp, Staphylococcus epidermidis
attgtaggtgtgaaaatgatagataatttaattgtatatattaaaaacttaccacatctttttagtttttgtactcaaaggcttaagcaaacatggaagtggtttgcaattagcctaattataggactagtaattattctagcattagagggattttttaatttcaaccatactaccgatattgttcaagtgcgttggttattcagaatttcatcattcatcatattcagcattattatacaatctatttatatagcttataagtactatatcagagatttcgttgtcatgaagtcatttcatatatctgcagttacacctactatagttatagcgatgttaggtttaataacaatacttattctggggatagttattattattcttaagcctgtgaattttgaagcatcaatactttcatttttatattatttagtaattttagcaatttttatcagtgtgacttcgataatattgggcttgctgagttatgcaattaaacatgtaaaactgatatttattatagtaagtgctatcagcttctttatggttccaattacatacatccctaatacaaatttaaatgtggttaatcatattatgatgttaaatcctctgtattatttcgtaaatggtagttcgcaagctatagtatttggtacaatcagcatgagcaatttaccttatcatttatatattattattttaattggaatcatctgtgtgattaattatgcgcttgtgcgtcacatagcatttgataaatatcaaaaccaatctaaccaaaagaattattcaaaaaagaataaagaaaaggaatgtttaaacgtaaaattagataagtaa

SEQ ID NO: 1927 - DNA, 777 bp, Staphylococcus epidermidis
caccaatgcttgaacaacttaatcgctcatttgaaggagggcaatcgtaagatgaatgaactaacggtttatcatttcatgtcagataagcttaatttatacagtgatattggtaatatcatggcattaaaacaaagagctaaaaaaagaaatattaagataaatgttaaagaaatcaatgagactgagggagtcacatttgatgattgtgatattttcttcattggtggtgggagtgatagggaacaagcgcttgccacgaaagaattaagtaaaattaaaacttctttaaaaaatgcaattgaagatggtatgcctgggttaactatatgcggtggttatcaatttttaggtcataagtatattactcctgatggtaccgagttagaaggattgggtgttcttgacttctataccgagtctaaaaaagaacgcttaactggagatatcattatagagagtgatacttttggcacgattgttggatttgaaaatcatggtggtagaacatatcatccgtatggaacattaggccgagtaacgtatggttatggtaataatgataacgatcgaaaagaaggtatacactataaaaatctattaggttcttatcttcacggcccaattttaccaaaaaatcatgaaataactgattatctacttgagaaagcatgtgaaagaaaagggatactatttgagcctaagaagatcgataacacagaggaagaagctgctaagcaagttcttattaaacgtgcaaaagaaaataaaaaataa

SEQ ID NO: 1928 - DNA, 357 bp, Staphylococcus epidermidis
attcagatagtgattcagattcagatagtgattcagattcagacagtgactcagattcagatagtgactcagattcagatagtgactcagattcagacagtgattcagactcagatagtgactcagattcagacagtgattcagactcagatagtgattcagattcagatagtgattcagattcagacagtgattcagattcagatagtgattcagactctggtacaagttcaggtaagggttcacataccggaaaaaaacctggtaaccctaaaggaaatacaaatagaccttctcaaagacatacgaatcaaccccaaaggcctaaatacaatcaaacaaatcaaaacaatataa

SEQ ID NO: 1929 - DNA, 618 bp, Staphylococcus epidermidis
aaaaataaagtattaacatttttaaggaggtctatgatgaaattacaacatattaccaaaaaatatggtcaaaatactgttttagacgatatagattttgatttcggcgagagtcaaatcgttggtcttatcggtaaaaatggagttggtaaaacaactttgatgaaggtcatgaataataacatcattaactatcaagggaaagtcgacatgcctaaaagtgagaatgttggttatttaattgagcatcctaagttatatggaaacaagacaggtttatttaatttaaaattatttgcacaagtattaggcgatggtttcgataaggaatatgcaaatcatattattgaagcttttggaatgaaaccatatatcaagaaaaaagttaacaaatattcaatgggaatgaaacaaaaattatcaattgcagtttcattaatgaataaacctaaatacttaattttagatgaacctacaaatggtatggatccagatggttcgatagatgtattaaagacaattcaatcacttgttcaacaattagaaatgaaaatattaatctcaagtcataaattagaagacattgaattgatttgtgatagagcagtatttccttag

SEQ ID NO: 1930 - DNA, 537 bp, Staphylococcus epidermidis
catttgggagtagaacaaagatatgctgttattcaactcaaaacaaagtacaatgctacattcttaaaaagtgagtttgataaatgggaacaacacattgaagatatgtacgctttacattatccaagaatgtttattgatccatacactatgcagttgtcctatgaatcaaatcacattgaagatttggcattaagtattattgaagaacgtgagaagctagaaaaatttaagcataaatctaatcatgatttaaagaagtttaacattatactatctaactatagtgatagtgaacaacgtcagataaaaagatatcaaagagatgacatattagctgatgagagccttatattacgcatatgtgaggacataagcaacatagatagtaaggacaagaataatagaaatactgctatacaagaagaaattaaagctgataaagagcgacgtagggcagaaggtaaggcaagaaaagaaagaattaaagctcgtatgaaacgagcaagacaagaaaaacttttacaagcaaattaa

SEQ ID NO: 1931 - DNA, 333 bp, Staphylococcus epidermidis
aagaaagcggtatatctaatgaataaaaagaaaatgagtgaaatgtccgagcaagaactaagacatgaaatacaattatttaaagaaaaaatgcgtaaagcagagatgaatggcattatgaatgaatatgatgtttatcaaagcaaagtgattatagcagaaagctatcttgtggatcgcaataaaattgaacctggaaaaatctataaactcaatgatggtagtaaacagtactttaaagtagaacgactcaagggtgtatttgcatggggatttagaataaacagtagtgaacctgaggaaggtctaccattagcattattaaaattttag

SEQ ID NO: 1932 - DNA, 375 bp, Staphylococcus epidermidis
ggttaccaggtttttttccggtatgtgaacccttacctgaacttgtaccagagtctgaatcactatctgaatctgaatcactgtctgaatctgaatcactatctgaatctgaatcactatctgagtctgaatcactgtctgaatctgagtcactatctgagtctgaatcactgtctgaatctgagtcactatctgaatctgagtcactatctgaatctgagtcactgtctgaatctgaatcactatctgaatctgaatcactatctgaatctaagtcactatctgagtctgaatcactatctaaatatgtgtcattttctgagtcactatttgaaacgatatctgtatctaaatcattatccgaattcatactaa

SEQ ID NO: 1933 - DNA, 468 bp, Staphylococcus epidermidis
gaaggtctatttgtatttcctttagggttaccaggtttttttccggtatgtgaacccttacctgaacttgtaccagagtctgaatcactatctgaatctgaatcactgtctgaatctgaatcactatctgaatctgaatcactatctgagtctgaatcactgtctgaatctgagtcactatctgagtctgaatcactgtctgaatctgagtcactatctgaatctgagtcactatctgaatctgagtcactgtctgaatctgaatcactatctgaatctgaatcactatctgaatctaagtcactatctgagtctgaatcactatctaaatatgtgtcattttctgagtcactatttgaaacgatatctgtatctaaatcattatccgaattcatactaattcctgtgcgactagtgtcattcactcgattgataatattgctcttagctgtatttctatcaatctga

SEQ ID NO: 1934 - DNA, 948 bp, Staphylococcus epidermidis
ttgaaaatattaaataaaaagaggttgatagatatgaaatttactgaaagcgaacgtcttcagcaactttctaatgaatatattttgggaggtgtgaattcaccttcaaggtcgtataaagcagtaggtggtggggcaccagtagtaatgaaagaaggtcatggcgcttacttatatgatgtagatggtaataaatatatcgactatctacaagcttatggtccaataataactggtcatgcacacccacatatcaccgaagctatccaagatcaagcagcaaaaggcgtactttatggtacccctactgaattagaaataaatttctcaaaaaaacttagagaagcagttccttctttagaaaagattcgtttcgtgaactctggtactgaagcagttatgacaacaattagagttgctcgtgcttatactaaaagaaacaaaatcattaagtttgcaggctcttatcatggtcattctgatttagttttagtggcagctggaagtggaccttctcaacttggttctccagattctgctggtgtcccccaaagtgttgcacaagaggttattacagtaccgtttaatgatatagaatcatatagagaagctattgattattggaaagacgacattgctgcagtattagtagagccgattgtgggtaattttgggatggtcatgccacaaccaggtttcttagaagaagtatataaaatttctcatgataatggaacattagttatctatgatgaagttatcactgctttttcgttccattatggtgcagctcaagatttattaggtgttaaaccatacctcactgcttttggtaagattgttggcggtggtttaccaattggaggctatggtggtcgacaagatattatggagcacgttgcaccatttacgtccagccttatccagcaaggaacaatgggcgggtaa

SEQ ID NO: 1935 - DNA, 294 bp, Staphylococcus epidermidis
tatatacaattaaattatctatcattttcacacctacaattcaatataaatccatttttcttctttcatatcagcgataaaataaccgcttccactttttgtaatccatacatctttcgtgatattaaatgtttttttcaattccgttttatttgtcattggaataacaaatccagacagtttatcattatcaccaaatatcatttttataggttgttgcgtgatcggtacaacatactttttatctttatcaggtctaagcgtttctgttactttatcatgtttttgatgtaa

SEQ ID NO: 1936 - DNA, 1422 bp, Staphylococcus epidermidis
aagaagaaattagcgttttatattctaggctgtatgaggatatttaaaataatggacaataaaattgaaaagattctagaagatattaataaattacaaggctataaagtaacatatcaatatgctactgctataaatataaaagataataacatgaacccttggtttgaaaaaattgaggaaattctattgaatgtaaaaggagttatacgcattttatctcctgacaaccccccggtaaattatgattattggattttacctggaagatataaaagacatacaaaagaatatcacgaaaaactagaaaaatttttagaaaaatttgctactaatgcaaatattaatgatggattgtttgatcaaaataatatacatggatacaaatataaaaaatatatattcactccacatattgaaattactcatgagaacactttgaatttattttttttaaccttaactatatttaacaatggtacatttgttatagaaatcattgaagacttagagagtataaactttggaagcgacttgtatagtactttctcatgtgtaaaagataagatatatcctctaattaatcaagaaaaaaataatagacaaagacagtatcaattttatggtaatagacattgtaaaaatattagagatgtttctagacaaattaatagaattataaaaattaatagtaaggatatttttgaatataaagtatctaaaaatatgggttttgaagtttattatttagctaatgaaaatgaatttactgatgatcctttctatgaggacgtgaagattcaagagtggttagtaaatgcgcctattttttcatttgaaggaaaaagtaaacattttaggcaagatggttatagcgataattatataaacttcttgaataaagcatctgtttttgtagtttggatggatgagcaagaagaagatgttttagaaaaatgttctcaaatggcactttatttcaatagttctgctaatttctttttcttagaaactatgttaaatgaattacaattgtatgggtatcaacaatataatttaaatggaaaaaaagaagccctatattttagacaatggatactaaatttcaagagatctattgcaattatttatagaacagagcttttacctagtttatatttatatttgtatctaaagaataataatgattttaaatctccacaatatattgaagaattaaacaaagaagaattatcactaattgaattggagcagtcatataaggaagaagaaagaagcgaaaaattaaataaacttttgttaataataagtcttttatcaattttccaagtagtagaaatttttttcagtgataaaaataatatatttaatatcagtatgatacttataatgattttgctagaagtatttcgaaaaaggtaa

SEQ ID NO: 1937 - DNA, 975 bp, Staphylococcus epidermidis
gtatatgaatttgagggattaactatgagaaaacgtgcaagaattatatataatccaacatcaggaaaagaactttttaaacgtgtattaccagatgcactgattaaacttgagaaggcaggttatgaaacgagtgcatatgcaactgaaaaaattggtgatgctacttttgaagctgaaagagcactagaaagtgaatatgatttactcattgcagctggaggtgacggtacgttaaatgaggtggtcaacggaatcgccgaacaacccaatcggcctaaattaggtgtaataccaatgggcaccgttaatgactttggaagagcacttcatttaccaagcgatataatgggggcgattgatgtaatcattgatggtcacacaaccaaggtagatattggaaagatgaataatcgttatttcattaacctagctgcaggggggaaactaacacaagtatcttatgaaacaccaagtaagttgaaatcaattgtaggaccgttcgcgtattacattaaaggattcgaaatgttacctcaaatgaaagcagtagatgtacgtatcgaatatgatgataacatcttccaaggagaagctttactattccttttaggtttaacgaattcaatggctggctttgaaaaattagttccagatgcgaagcttgacgacggttatttcacgttaattattgtagaaaaagcaaatcttgctgaattgggtcatattatgacactagcgtctcgaggtgagcatacaaaacatcctaaagtcatttatgctaaagcgaagtctattaatatttcatcatttactgatatgcaacttaatgttgatggtgaatacggtgggaaattacctgcaaatttccttaatttagaacagcacatagaaatttttacacctaaagatgtatttaacgaagaactattagaaaatgatacgataactgatattacgcctgataagcaataa

SEQ ID NO: 1938 - DNA, 2055 bp, Staphylococcus epidermidis
ttcatcatgtcaaaagttcatcttattgagagcccatatgcattagataaaattaaaggtataggtccgaaacgtttagcgttgttagaagaattaaatattaaatcagttgaagatttagtattatatttaccaacacgttatgaagataatactgttattgacttaaatcaagcagacgatcaagcaactgtaacagtgcaaggtgaggtttattccagtccaactgttgctttttttggtcgtaataaatcgaaactaactgtccatcttatgataaatcatatcgctgttaaatgcgtattttttaatcaaccttatttaaaaaagaaacttgaactaaatagtattgtcactataaaagggaaatggaatcgtaataaacaagagattaatggtaatcgtatattttttaaagatcaaaaaaatcaagaggatactcatttagaaccaatatataggattaaagaaggaataaagcaaaagcagttacgcgataatattagacaggcgcttagtgatgttacaattcatgaatggttaactgatgacctcagagaaaagtataaattagaaactttagcttatacaatacaaacactacatcatcctattaataaacaaaatttgctaagagctagacggacttatgcatttacagagctatttatgtttgagctacgtatgcaatggttaaatcgcttagaaaagacatcagatgaggctattgaaattaattacgatataaataaagtaaaacaatttattgatagtttgccatttgagttaactgacgctcaaaaagttagtgtcaatgaaatatttcgtgatttaaaggcgcctattcgtatgcatcggttgttacaaggtgatgttggatctggcaaaactgtggtagcagcaatttgtatgtacgccttaaaaactgcaggctatcaatctgcattaatggttcccacggagattttagctgaacagcacgctgaaagtttaatacaactatttggtaatacaatgaacgtagctttattaactggttctgttaaagggaaaaaaagacgacttcttttagagcaattagaaaatggaactatcgattgtttgattggtacacacgccttgattcaagatgatgtagtcttcaataatgttggattagtcattacagatgaacagcaccgatttggtattaaccaacgacaaattctaagagaaaaaggtgcaatgacaaatgtattgtttatgacagcgacaccaatccctagaacactcgctatttctgttttcggtgaaatggatgtatcttcaattaaacaattaccaaaagggagaaaacctataaaaacaagttgggccaaacatgaacaatatgatcaagtacttgcacaaatgtcgaatgaattaaaaaaaggtagacaagcctatgtcatctgtccattaattgagagctctgagcatttagaagatgtacaaaatgttgtggcactttatgaatccttacaaagtgattatggtaatgaaaaagttggattattacatgggaaaatgtctgcagaagataaagatcaagtcatgcaaaaattcagtgaacatgaaatagatattttagtttctactactgtagttgaggtaggtgtaaatgtacctaatgcaacgtttatgatgatttatgatgcagatcgattcggtttatctacattacatcaattacgtgggcgtgttggtcgtagtgaacatcaaagttattgtgtattaattgcatctcccaagactgaaacaggtattgaacgtatgaccattatgactcaaactactgatggattcgaattaagtgaaagagatttagaaatgagaggtccaggggatttctttggagtaaaacaaagcggtcttccagactttcttgtagcaaatgtagtagaagattatcgtatgcttgaagttgctagagatgaagcagcagaacttatacaatctggccaatttttcgaacaacaatatagtcatttaagagagtttattaaacaaaacttacgccatattcgtttcgattag

SEQ ID NO: 1939 - DNA, 207 bp, Staphylococcus epidermidis
cttagcactttcatattatgtttagtacgtggattgttatacatatttacattcattgcgggtgcaacgaattttggtgttgttgtagcaagtaatgtagaagtaattaaatcatcagcaattccaacacttaattttgcgatagtattagcagttgctggcgcgactataatcgcatctgcccagtctcctaatgatacatgttga

SEQ ID NO: 1940 - DNA, 750 bp, Staphylococcus epidermidis
agacatatgttaaacgcacaatttttcactgatactgggcaacatcgtgagaaaaacgaggacgctggcggtatattttacaatcaaacacagcaacaaatgctagtattatgcgatggcatgggtggacatcaagctggagaaatagctagtcagtttgttacttatgaacttcaaaagcgttttgaagaagaaaatctaattgaaataaatcgtgctgaatcgtggttgcgttcgaacattaaagaaatcaattttcagctgtacaactatgctcaagaaaatgaagattacagaggtatgggtacaacgctcgtttgtgccatcatttatgacaaacaagttgttgtagcaaatgtaggagattcgcgcgcttatgtaattaatcagagacagatggatcaaattacgagcgaccattcatttgttaatcacttagtaatgactggacaaattactaaagatgaagcatttcatcatccacaacgtaatattattactaaagtcatgggaacagataaacgtgtttctccagatttatttatcaagagaactcatttttatgattatcttcttttgaactctgacggacttactgattatgtcagagattatgaaatccaagaactactaagttcaaataattcattagacgtccatggtaatgagttattggacttagcgcttgcccatgattcaaaagataatgtcagctttatccttttaaagttagaaggtgataaagtatga

SEQ ID NO: 1941 - DNA, 540 bp, Staphylococcus epidermidis
gatataatgttaagtgttgctttagatgacattaaaaagaatggaggcacttctttgaaaaagaaatactatattagcatctctttacttatgacaatcattgtattagttttcgatcaagtttctaaatggcttattacaatctcaatgaaggttggagattcatatgaaattatccctaactttttaaatattacatcccatagaaacaacggtgcagcatgggggattttgagtggtaaaatgctatttttctatattattactatcattattttaatcgttttagttattttttatattaaagaagcacaatttaatttgtttatgcaagttgcaataagcctattatttgctggagctttaggaaattttattgatcgcgtattacatggcgaagttgtggattttattgatacaaatatattcggatacgattttcctatctttaatattgcggattcaagcttaacaattggagttatattcgtaatcatcgcactcattaaagatgcaatcataaataagaaggaggtctag

SEQ ID NO: 1942 - DNA, 240 bp, Staphylococcus epidermidis
aaaaatgttactggaggtcaaaaaataatgttaaatccaccgttaaaccaacttactgcaaaagtgaattcaaaatatcttattgccactacggcggctaaaagagcacgtgaattagatgaaaaacgcgaaacagcgcttttagatcagtaccattcagctaaacctgttggaaaagctttagaagaaattgctgatggtaaaatagaacctgttgtaccgaaagagtatttaggataa

SEQ ID NO: 1943 - DNA, 564 bp, Staphylococcus epidermidis
agatatgagtttttttatattaaaagaggtgaaacaatgtctgaacgaattattttagatgaggcagcgatacaacgtacaattacacgaattgctcatgaaattctagaatataacaagggaactaaagatttagttctattaggcattaaaacaagaggtgcttttttagcacatcgtatacaagataaaataaattcaatagaacaacaattagtaccaacaggtactatcgatatcacgcattttcgagatgatgttgataaggtagtgcaacaagctgatcaatacgcttttgatattaatgtagatattaataacaaagtggttgttatcattgacgatgttttgtataccggacgtacagtaagagcctcattagatgcgattttattacatacaagacctattaaaatagggcttgcagcacttgtggatcgtggtcatcgtgaactccctatacgcgcagattttgtaggaaaaaatatacctacagcacgagatgaatctgtttcagtttatttagaagaaattgacgatagaaatgcagtcgtcattgaataa

SEQ ID NO: 1944 - DNA, 912 bp, Staphylococcus epidermidis
attaagctttatttctataggaggcgctttatggaacacttattatcaatggagcatttatctaattcagaaatttatgatttaattactatcgcttgccaattcaaatctggtgagcgaccattacctcaatttaacggtcaatacgtatcaaacttattcttcgaaaattcaacgcgaacaaagtgtagctttgagatggcagaacaaaaattaggattaaaacttattaattttgaaacaagtacatcatctgtaaaaaagggtgagtcactttatgacacatgtaaaacacttgaaagtataggtgttgatttacttgtcatacgtgactcccaaaattcttattacgaagaactggatcaattaaatattccaattgctaatgcaggtgatggaagtggacaacatcctactcagagtttattagacataatgacaatatatgaagaatatggttcgtttgaaggtttgaatattctaatatgtggggacattaaaaattctcgtgtcgcaagaagtaattatcatagtttaacatcattaggtgccaacgtaatgttctcaagtccaaaagaatgggtagataatacattagaggcgccttatgttgaaattgatgaagtcattgataaagtagatattgttatgttgcttagagttcaacatgaaagacatggaatttcaggtgaagctaactttgctgctgaagaatatcatcaacaatttggtttaacacaggctagatatgataaattaaaagaggaagccattgtaatgcatccagctcctgtaaatagaggtgttgaaattaaaagcgagctagttgaagcacctaagtctcgaatatttaagcagatggaaaatggaatgtatttaagaatggcagtaataagtgcgcttttacaatag

SEQ ID NO: 1945 - DNA, 195 bp, Staphylococcus epidermidis
tgggtagatttctcacactcatcttctccttttaacttctatcataaagattatacatttctcatagtaaacgtcatgctttcaatgacatttgttaaagcactggcagtatccagtgatgttaaacaaggtacaccattttcaactgttgtacgtcgaatttggaatccatctcgttcgatatcttttccttga

SEQ ID NO: 1946 - DNA, 933 bp, Staphylococcus epidermidis
gaaggaggtctagttttggaaaattataattttaatattatcgaacaatcacaagttggacaacgtatagataaacttgtttcagatttaaataaagattggtcacgtagtcaacttcaagattggattaaagaaggtttagtcaaggtaaatggtaaagtaattaaatcgaactataaggtcaagttaaatgacaaaattgttgtaaccgagaaagaagtcgtagaggcagatataaaacctgaaaacttaaatttagatatttattatgaagacgaagacgttgctgttgtatataaaccaaaaggtatggttgtacatccatctccaggccattatagtggaacattagtaaatggattaatgtatcaaattaaagatttatcaggaatcaatggcgaaatacgtcccggcatagttcatagaatagataaagatacgtctggtttattaatggttgctaaaaatgatgttgctcatcgtcatttagttgaacaacttatgtctaaaactgttaaacgaaaatacacggcgttagttcatggtaatatccctcatgattatggcactattgacgcaccaattggtcgaaataaaaacgatagacaatcgatggctgtggttgatgacggtaaagaagctgtgacacactttaatgtattagagcattttaaagattatacattgatagaatgtcaattagaaacagggcgtacacatcaaattcgtgtacatatgaaatatattggttatcctcttgtaggggatccgaagtatggacctaaaaaaacgttagatatcgatggacaagctttacatgctggtataattggtttcgaacatcctgtaacacatgaatacattgagaagcatgcaacattacctaacgattttgaaaagttactagatgatataagacgtagagatgcataa

SEQ ID NO: 1947 - DNA, 735 bp, Staphylococcus epidermidis
gtggaaaaacaaaaaagaacaagttacacattcattatcaaacactatttaaatagctatcaatcaaggaggattatcatgccttttacaccaagtgagattaagaataaagaatttacacgagtaaaaaatggtttagaacctacagaagttgcaaattacttagagcaactaagtaatgaaatcgaacgtttaaaagaagataaaaagcaacttgaaaaagtcattgaagatagagattctaatattaaatcatataaagatgttcaccaatcagtaagcgatgcacttattcaagcacaaaaagtaggagaagagacaaaacaagcagcaactaaagaagctgaagccgttttatcaaaagcacaagtacaagctgacagtattgtgaatgatgcaattgaaaaagcgcgtcgtctagctttccaaactgaagacatgaaacgacaatctaaagttttccgctctcgtttccgtatgcttgttgaagcacaacttgacttactcaaaagtgaagattgggattacttactcaattatgatttagacgccgagcaagtgacattagaagatattcatcatcttcatgataatgatttgacacctgaagaacgtgcaatgaaacaaaagcaaaatcaagaaatatcggctaatcagccttctacatcaagttcagaatctgtgagtcaatcaaatgcaaataacgaatcatcacaatcaacatcaaataattaa

SEQ ID NO: 1948 - DNA, 1203 bp, Staphylococcus epidermidis
ataatgaaacatattttattagctgttacaggcggtatcgcagcatataaagcaattgatttaacaagtaaattaatacaatccggctatgatgtaagagttatgctatctgatcatgctcaagagtttgttactccgctagcttttcaagcaatcagtagaaatcctgtttacacaaatacatttaaagaagaaaatcctgaagagattcaacatgtatcattaggagactgggcagatgcgattatagtcgcgccagcaactgctaatactatcgcaaaattaagtgttggaattgctgatgatttaattacttctacattacttgctacaacaacaccaaaattcgttgcacccgcaatgaatgtaaatatgtataacaatccacgtactaaacataatatgaaagtgctaagtcaagacggatattattttattgaacctggtagtggctatttagcatgtggttatgtagcaaaagggcgaatggaagaacccatgcaaatcctatctgttattaataaattttttactcaacagaagaatgttgtcaaaagctctttttctggaaagcgcgcattagttacagctgggcctacagttgaagttattgatcctgttcgatacgtatcaaatcgttcatcaggaaaaatgggatatgctatagctgaagcattacgagataagggagcaatcgtaactttaattagtggtcccacccacttatctctacctgaagggattaatgtagtaaaagttgagagtgcagatgatatgtttcaagctgtaaccgaacgctttgcgaaacaagatatagtgattaaagcagcggcggtgtctgattatacaccaatggacatacttgaacataaattaaaaaaacaagaaggaggattatctgttcaatttaagcgtacaaaggatattttaaaatacttaggagaaaataaaacgcaccaatatcttgttggttttgctgctgaaacacaaaatattgaacagtatgctctagacaaactcaaaagaaaaaatgcagatgttatcatttcgaacaatgtaggtgatacatccataggctttagttcagatgacaatgaattaactatgcattttaaaaataatgaaaaagtaaatattaagaaaggaaaaaaatcagctttagcacatcaaattatagaaattttagaaactaggtggcagtaa

SEQ ID NO: 1949 - DNA, 204 bp, Staphylococcus epidermidis
atggaagttaataaagtcatttatattttactagcagtctttcttggtagttttggcatccacaaattttatgctggtaaaccaattcaaggattattgcatattctattttgttggactgctatcccgcatgtgttagcaattattagtgcagttttaacattattcaaacctgccgacgcaaacgggaacgtcagaatgtaa

SEQ ID NO: 1950 - DNA, 741 bp, Staphylococcus epidermidis
gttgtggctaaccagaaaaagaaagaaatggtacatgattttcaacaaaaatttactgataaaatgaagtcgttaggattacattttaaaaatattgatttatatcaacaggcattctctcattcaagttttattaatgactttaatatgaatcgtttagaacacaacgaacgcttagaatttttaggtgatgcggtattagaattgacggtttcacgctatctttttgacagacatcctcatttaccagaaggtaatttgacaaagatgcgcgcaacaattgtttgtgaaccttcacttgtgatatttgcgaataaaattaaattaaacgaactgattttattaggtaaaggtgaagagaagacaggaggcagaacaagaccttcccttatttcagatgcatttgaagcttttgtaggtgcactatatttagatcaaggtttagattcagtatggacctttgctgaaaaagtcatctttccgtatgtagaagatgacgagcttgttggtgtcgtagactttaaaacacaattccaagaatatgtgcatagccaaaataaaggagatgtgacataccaattaattaaagaagagggtcccgcacatcatagactatttacatcggaagtgattttagaaaataaagcagttgcagagggtaaaggaaagacaaagaaagaatccgaacaaaaggcagcagaacaagcgtataaactaatgaaaaataaaaaatcattataa

SEQ ID NO: 1951 - DNA, 810 bp, Staphylococcus epidermidis
aaggaaaataagatgtttcataacaaaaatgcaaattttgtaaatggtgtaactatcaatattaaagataaagaaacaattaaaacattttatgagaatgttttaggatttaatcttatcaatgaatctgaaactgctgtacaatttgaagttggcgattcaaatcaatttattacttttattgaaatacagaatggacgagaaccgttaatgtctgaagcaggtcttttccatattggtatattgttgcctactttgactacattagctgatttactcgtacatttaagtgattttgaagtaccagtgaacggtggacaacaaagtgttgcaacatgtttatttattgaggatccagagggcaatgctataaagttttatgtcgatcgtgagacagaatcatggattgatgagaaagaaggcagaattagaatggatattgctccaattaatgtacctcgattactgcaaaacgtctctcatactcaatggcagggcataccagatgaaactaaattaggttcattacatattaagtccattcgaatttctgatgttaaatcatattatttaaattattttggactagaagaatcagcatatatggacgattattctctatttttatcttcaaacgagtattataatcatttggctgttaatcagtggttatctgcgacaaaacgagtagataatgaacatacctatggtttagctatgatagattttcactatccaaaaacaacacataaaaatcttaaaggacctgatggtatttattttagatttaatagaataaaagaagtgtga

SEQ ID NO: 1952 - DNA, 648 bp, Staphylococcus epidermidis
aggaatgataatgtgaagattaatttattatgttctcaacgtttattacctaatcatatttttgaaaaagaaaaagattctaattgggcaggtattgatagaggtgcgcttatactcgtaaaacaaggtattcaacctatattttctgtaggtgattttgactcagtgaataatgaagaacgtttgatgttgatgaaaaatcttcaaatcgaaccggttgaagctgaaaaagatgatactgatttagctttaggagtagctcaagcagttgaaagaggatacacagaaattacaatttatggtgcaacaggcggtcggttagaccactttatgggtgtgcttcaaattttacaaaaacctcaatacttacatcaatctataaaaataaaagtcattgatcaacaaaatcatattcaattattaaatgaaggtaagtatgtaatcaacagagatagtacttatccatatatatcgtttatccctctaaatgataaaactatattaactttacagggtttcaaatataatttaaatcaagaacacttaaatttaggctctacactcacaatttcaaatgaagtaaaggttaatgaagcaatcattcgagttgaacaaggaacagttttaaaaatacgtagtcgtgactaa

SEQ ID NO: 1953 - DNA, 633 bp, Staphylococcus epidermidis
gtaatagataaagaaagtgttatgatatttaaggaatatttaagacttggtactaaaatgaggggtgagcgtttgaaattaaagaaaaacgatagacgagtagccattaaagaggctatcgaattaaaccccttcatcactgattatgaattgtgtgagaagtttgatgtaagtattcaaactatacgtttagatcgcacgcatttaaatattcctgagttacgtaaaagaattaaattggtagctgaacaaaattatggacgaattaaatcaatagaagccaatgaaattataggtgatttgattcaagtgaatcctgatgttagcgcacaatctttaattgaaattacaattgattctgtttttgcaaaaagtgagattgctagagggcacgtcttatttgcacaagctaactcattatgtgtagctcttatacataaaccaatagtattgacacatgaaagtcaagttgaatttaaagaaaaagtaaaattaaatgatacagttcgagcagatgcccgtgtcatagatataacagataagcattatattattgaagtgaattcttatgtttcagatatgttagtttttaaaggtaaattcaaaatgtactatacaagtgaggatgaatga

SEQ ID NO: 1954 - DNA, 627 bp, Staphylococcus epidermidis
ggcatggataaggaaaaaggactgttaattgttctttcaggcccttcaggtgttggaaagggaactgttagaaagaagatatttgaagacccaactacttcatataagtattctatatcaatgacgacacgtcatatgcgtgaaggtgaaattgatggtgtagattacttctttaaaacaaaggaagaatttgaggcgttaattaaagacgaccagtttattgagtatgcacaatatgtaggtaattactatggtacacctgtacaatatgtaaaggatactatggaagaaggtcatgacgtctttttagaaatcgaagttgaaggtgctaagcaagtaagaaagaaatttccagatgcgttgttcatatttttagcgcctccaagtttagatgacttgaaagaacgtcttgttggtagaggaactgaatcagatgaaaagattcaaagtcgtgtgaacgaggcacgaaaagaagtagaaatgatgaatttatacgactacgttgtagttaacgacgaggttgaactcgctaagaatcgaattcagtcaatagttgaagctgagcatttaaaaagagagcgaatcgaagctaaatatagaaaaatgttactggaggtcaaaaaataa

SEQ ID NO: 1955 - DNA, 192 bp, Staphylococcus epidermidis
cacgaattcaaaatggagaagtgcaaattgtttttttttttttttattcaaggaaaagatatcgaacgagatggattccaaattcgacgtacaacagttgaaaatggtgtaccttgtttaacatcactggatactgccagtgctttaacaaatgtcattgaaagcatgacgtttactatgagaaatgtataa

SEQ ID NO: 1956 - DNA, 246 bp, Staphylococcus epidermidis
ctattactaaatgtaactttcaagttggacaaagaatttttgtctgatttcaagcttgttttatacgctattcaactattttataatttactagtaattaaaaaacctaggacaatttttatgtcccaggctctaccaatattaataaaactttatcctaaatactctttcggtacaacaggttctattttaccatcagcaatttcttctaaagcttttccaacaggtttagctgaatggtactga

SEQ ID NO: 1957 - DNA, 3114 bp, Staphylococcus epidermidis
aggatttcaaagaaaaggagcgtcaaatcaatgcctaaaagagatgatattaagacaattttagtagtcggttcaggcccaattattattggacaagctgcagaatttgactatgcaggaacacaagcttgtctagcattaaaagaagaaggctacagagttattttagttaattctaatcctgcaacaataatgacagataaagaaattgccgataaagtctacatagaaccattaacgcacgattttattgctcgtattattagaaaagaacaaccagatgcattattacctactttaggtggtcaaactgggttgaacatggcgattcaacttcatgatagtggtgtgttagaagctaataatgtaaagttgttaggcacagagctagagtctattcaacaagccgaagatcgtgaaatgtttagaacattaatgaatgatttaaatgtacctgtaccagaaagcgatattgttaatacagtagaacaagcatttgaatttaaagaacaagttggatacccgttaattgtacgtcctgcatttacgatgggaggtactggcggtggtatttgccataatgatgctgaattaaaagaagttgttagtaatggtttacactatagccctgctacacaatgtttaatagaaaaatcaatcgcaggttataaagaaatcgaatatgaagttatgcgtgataaaaatgataacgcaatcgtagtatgtaatatggagaacatagatcctgtaggcattcatactggagattcaatcgttgttgcaccgagtcaaacactgtcagatgtagaatatcaaatgctacgagacgtatctttaaaagtaattcgtgctttaggtattgaaggtggatgtaatgtgcaactcgcgcttgacccacattcattgaattattacatcattgaggtcaacccacgtgtgtctcgttcatcagcattagcttcaaaagcgacgggttatcctattgcaaaattagctgctaagattgccgtaggtttaacattagatgaaatgcttaaccctatcacaggaacttcatatgctgcatttgaaccaactttagactatgttatttctaaaattccacgtttcccatttgataaattcgaaaaaggtgaacgtgaacttggaactcaaatgaaagcgacaggcgaagtcatggcaatcggtcgtacatatgaagaatctttactgaaagccattcgttcacttgaatatggtgttcatcatttaggtttaccaaatggagaaagttatgaattagattacattaaagagcgtattggacatcaagatgatgaaagattgttctttatcggcgaagcaattcgtagaggaacatctcttgaagaacttcataatatgacaaaaattgactatttcttcctaaataagttccaaaacattattgatattgagcatgaacttaaaaatcatcaaggtgatttagagtatttaaaatacgctaaagattatggttttagtgataaagtgattgctcatagatgggataaggaagaaaaagacatatatcaactacgtatgagtcaaaatattaaaccagtttataaaatggttgatacatgtgcagctgaatttgaatccacaacgccatactattatggtacgtatgaatatgaaaatgaatctatagtaactgataaagagaaaattctagtactaggttcaggaccaattagaattggccaaggggtagaatttgattatgcaactgtacatgcagtatgggctattcaaaatgctgattacgaagctattattgtgaataataatccggagactgtatctactgacttttcaatttctgacaaattatattttgaaccactaacagaagaagatgttatgaatatcattaacttagaacaacctaaaggtgttgtagtacaatttggtggtcaaacagcaataaacttagctgataagttagcacaacatggtgttaaaattctcggaacatcattagaagatttaaatcgagctgaggatagaaaggaatttgaagcgttattacgtgaaatagctgtacctcagccacaaggtaaaactgctacatcacctaaagaagctcttgaaaatgcaagagaaataggctatccagttgtagttcgtccttcatacgtgcttggtggccgtgcaatggagattgtagataatgatcaagaacttgaaaattatatgactcaagctgttaaagcaagtccagaacatcctgtattggtagaccgctatttaacaggaaaagagatagaagtggatgctatttcagatggtgagactgtcgtgattccaggaattatggaacatatagagcgtgcaggtgttcacagtggagattctattgcagtttatccaccacaaacactgactcaagacgaaattaatacactcgaagactacacaattaaattggcaaaaggtttaaatattaaaggtcttattaacattcaatttgtcatagctcacgacggtgtttatgtgttagaagttaatccgcgttcaagccgtacggtaccattcttaagtaagattactgatattcaaatggcacaattagcgatgcgtgcaattatgggtgaaacgcttgccgaaattgggttcaaacaaggtatccaaccatactctgaaggcgtatatgttaaagcgcccgtatttagttttaataaattaaaaaatgtagatataacgcttggaccagagatgaagtctacaggtgaagttatgggtaaagacctaacacttgaaaaagcgctatacaaaggtctcactggtagcggatttgaagtgaaagatcatggtacagtattgatgactgtaagtgataaagataaagatgaaatagtcaagattgcacatcgattaaatgaaataggctacaaaatattggctactcgtggaacagcacaaaagttaaaagatcataatattccagttgaggtcgtaggaaaaatcggtggcgaggatgatttactgacacgaattcaaaatggagaagtgcaaattgtttttttttttttttattcaaggaaaagatatcgaacgagatggattccaaattcgacgtacaacagttga

SEQ ID NO: 1958 - DNA, 1014 bp, Staphylococcus epidermidis
aggagggcaaacgttatggcatttgaaggattatccgatcgcttacaagccacgatgcaaaaaatgcgtggtaaaggaaaagtaacagaagcagatattaaaacgatgatgcgtgaagtgagattagcgttattggaagccgatgttaacttcaaagttgttaaggaatttgttaagaatgtttcagaacgagcgctaggttctgatgtcatgcaatctttaacacctggccaacaggttattaaaatcgtacaagaagaacttactagtttaatgggtggagaaaatacttccattaagatggcaaacaaaccaccaactgttgtcatgatggtcggcttacaaggtgcaggtaaaacgacgacagcaggtaagttggcattattaatgcgtaaaaaatataacaaaaaacctttacttgtggcaggagatatttatcgtccagctgctattgatcaattacaaacagtaggtaaacaaattgatatccctgtgtatagtgaaggtgatcaagtatcaccacaacaaattgttgaaaatgctttaaaacatgctaaagaagaacatctagatttcgttatcattgatacagctggtcgtttacacattgatgaagcacttatgaatgagcttcaagaagttaaagaaatctctaaaccagacgaaattatgcttgttgttgatgcaatgacaggtcaagatgctgtgaatgtggcacaatcatttgatgaacaattagatgtttcaggtgtaacattgactaaattagatggtgatacacgcggtggtgcagcactttcaatccgttccgttacccaaaaacctattaaatttgtaggtatgagtgagaaattggatggtttagaattattccatcctgaacgaatggcctcacgtattttaggtatgggtgatgttttaagcctcattgaaaaagcgcaacaagatgtagatcaagaaaaggctaaagatttagagaagaagatgagagagtcatcttcttctctaaatctt

SEQ ID NO: 1959 - DNA, 417 bp, Staphylococcus epidermidis
cgctttaaaaataaaactctgaaattttcaggaggaacagatatgacattagaaatttcaaatgactacggtaaaattgatatttcaaatgatgtaattgcatcagtagttggtggcaaagccgttgaaagttatggaattgttggtatggcatcaagacaacaagttagagatggtatcgctgaaatccttggacacgataactatgctaaaggcattaaagttagagaagacaacggaattattgatgtagacatgtatatcatcgtgagctatggtgtgaaaatttctgaagtagcaagcaatcttcaatcaactgttaaatatactttagaaaaaacactaaatgtgaaagttaattcaataaatattttcgtacaaggtgtacgtgtaaatgagacagtgaaaaaggtttag

SEQ ID NO: 1960 - DNA, 612 bp, Staphylococcus epidermidis
atggctaaaaatattgctaaagcattgttagacatagaggcagtttcattatctccaaatgatttatttacttggagctctggaattaaatcgcctatatattgtgataatcgaataactttaggctaccctgaagtgcgtaatgcgattagagatgggttaattcaattaattaaagaacatttttctaacgttgaaattatctcgggtacggccactgctggtatccctcatgcagcttacatttctgaaaaattagaattacctatgaattacgttagatcaaaaagtaaaagccatggtaaacaaaaccaaatagaaggtgcaaaaagcgagaataaaaatgtcgttgtagtcgaggatttaatttctactggaggttcttcgattacagctgtcgaagcattggaagaagcgggagctaatgtgcttggggtcgttgctatattcacatatggtcttgcgaaagcagacaagacatttaataaggctcatattccgttttacactttaagtgattataatgagcttatagaagttgcgaaagatgaaggtaaaatctctttaaatgatatccaaacattagttgattggcgagataacttatcgtaa

SEQ ID NO: 1961 - DNA, 1122 bp, Staphylococcus epidermidis
caagataaaaagaaaggaaagttagagatgataactgcagaaaaaaagaagagaaacaaattcttacctaatttcgaaaaacaatcgatctactccttaagatatgacgagatgcaacaatggcttattgatcacggacaacaaaaattcagagcaaaacaaatttttgaatggttataccaaaagcgtgtgaatactattgatgaaatgactaacctgtctaaagagttacgtcaaattctcaaagatcattttgcaatgacgacattgaccactgttgttaaacaagaaagtaaagatggaacaatcaagttcttatttgaattacaagatggttatactattgaaactgttttaatgagacatgaatatggaaattctgtctgtgtaacaacacaagtaggatgtagaattggttgtacgttttgtgcttccactttgggcggattaaagcgtaatttagaggccggagagattgtctctcaagtattaactgtacaaaaggcactagacgaaacgaatgaacgtgtatcacaaattgtcattatgggcataggtgaacctttcgagaattatgatgaaatgatggatttcttaagaattgttaatgatgataacagtttaaatattggtgcacgtcatattactgtatctacttcaggaattattccaagaatttatgattttgccgaagaagatatacaaataaattttgctgtgagtcttcatggtgctaaagacgaaataagatcaagattaatgcctatcaatcgtgcttataacgttgataagttaatggaagctattcgttattatcaagaaaagacaaatcgccgtgttacttttgaatatggattgtttggtggtgttaatgaccaacttgaacatgcgagagatttggcacatttaattaagaatctcaattgccacgttaatttaataccagttaaccatgtcccagaaagaaattatgtaaagacaccaaaagatgatatttttaaattcgagaaggaattaaagagattaggaattaatgctacaattagacgtgagcaagggtcagatattgatgctgcgtgtggacaattaagagcgaaggaacgacaagtagaaacgaggtaa

SEQ ID NO: 1962 - DNA, 1101 bp, Staphylococcus epidermidis
atgcttgaaaaacgttatcttgtactggaagatggctcttattacgaaggatatcgcttagggtcagatgacttatctataggcgaaattgtattcaacactgctatgacggggtaccaagaaacaatctctgacccgtcttacacaggtcaaatcataacttttacgtacccactaattggaaactatggtattaatcgcgatgattttgaatcattaacacctaaattaaatggggtagtagtaaaggaagcaagtacacaccctagtaactttagacaccaaaaaactttacacgaaacacttgctcaatatcatattcctggtatatcgggggtagatactagaagtattactcgtaaaattagaaattatggtgttttaagagctggatttacagataataaagataacattcaggaacttgttgaacagttgaaaactgctgaattacctagagatgaagttcaaacggtttctacaaaaacaccatatgtatcaacaggttccgatttaagcgtcgttttactcgactttggtaaaaagcaaaatatcgttcgtgaattaaatttacgtggttgcaacgtcacagttgtaccatatgatacgtcagctgaagagattttaggcatgtctccagatggtgtcatgctatcaaacggacctggtgatccagacgaagttgacgttgctttagatatgatcagaggcatattaggaaagataccattctttggtatctgccttggtcatcaactttttgcattatcacaaggcgcaacttcattcaaaatgaaatttggacatcgtggtgcgaaccatcccgttaaagatttaagaacaggtaaaatagatatcacgagccaaaatcacggctattctattgattgtgactcgctaaaaaatactgaccttgaagttacacacattgctttaaacgatggtactgttgaaggactaagacataaagaacttccagcgttttcagtccaatatcatcctgaagcaagaccaggtccaagtgattctaattacttatttgatgagttcatagcaatgatgaaggatttcaaagaaaaggagcgtcaaatcaatgcctaa

SEQ ID NO: 1963 - DNA, 1692 bp, Staphylococcus epidermidis
gacagtgaaaaaggtttaggaggacaacgtgaaatgattagcaaaataaatggtaaattatttgccgatatgattatacaaggggcacaaaatttatcaaataatgcagacttagtggattcattaaacgtctatcctgttccagatggagatacagggacaaatatgaatttaactattacttctggtcgtgaggaagtcgaaaataatttatctcaaaatattggagagttaggtaaaacattttcaaaaggattacttatgggggctcgtggtaattcaggtgttattctttctcaattattcagaggtttttgtaagaatattgaagaagaaaaagaaataagcgtgcaacagtttgctgagagttttcaagctggagttgaaacagcttataaggcagttatgaaaccggtagagggaacgattttaacagtagccaaagatgcagcaaaagcggcaatggattacgtggatcaagctgaagattgcgttgatttaatggcacatctgattgaagctgcaagcgaatctctagataatacgcctaatttattagcagtacttaaagaagtaggcgttgttgatagtggtggtaaaggtttattatgcgtttatgaaggcttcttaaagggtcttaaaggcgaaaaaatagaagcacaagcacctaaacttgatactgaatcatttgttaatgatgatcatgattttcatggggttattaatacagaggatattgtttacggttattgtacggaaatgatggttcgatttggtaaaaataaaaaagcattcgacgagcaagaatttcgtaatgatatgagtgaattcggtgattcgttattagtaattaatgatgatgaaattgttaaagtgcacgtacatacagaacatccgggtgatgtatttaattatggtcaaaaatatggtgaactaattaaacttaaagtagaaaacatgcgtgaacaacatcgtgaagttattcgtaaggaacaagatggacttcaaagtaaagaagctaatgaatccaaaacagttgaaacagctattgttacaatttctgtaggcgatgggattgctgaattatttaaatctatgggagcaacgcacattattagtggagggcaaacaatgaacccttctactgaagatatagttaaagttattgaacaatcacaatgtaaacgtgcaattatcttaccaaacaataaaaatattatgatggccagtgaacaagcagctagtattgtagaagctgaaactgtagtgattcctactaaatctattccacagggaatatcagccttattccaatatgatttagaatctagtttagaagataataaacgccatatgagtgatgctttggaaactgttcaatctggttcaattacttttgcagttagagatactaaaatagacggtattgaaatcaagaaagatgaattcatgggtctagctgaagacaaaattgtgacaagtgatgttaatcaatttcatgcagtaaaaggtctactcagcaaacttcttaatgaagatagcgaaattttaacaatgatttcaggcgaagatgctgataattcaattacaaaccaaatcattaattggattgaatcggagtaccctgatgtagaagtggaacaacatgaaggtggacaacctatttatcaatatttcttcgcagtagaataa

SEQ ID NO: 1964 - DNA, 798 bp, Staphylococcus epidermidis
  unsure (32): Identity of nucleotide at the above locations are unknown.
aatattttgaaagagagatttattaagaaaantcattatttagactatgaatttgatgagggtagtgatattaagttaggtttcactactcgagaaaatgggttaagtccttatcctaatcatagttttaatatggcaagatatatcagtgacagtgcacatcatattacacatcatcaaaatatcttagcgaatcttattggttatacaagagatgaatgggtttttcctatacaaacacatgataatcgtatcgttgaagttacaagtgaacataaaggaacaaatattgatgaactaactgatgatttacatggcatagatggaatgtatacttttgattctcacattcttcttactatgtgttatgcggattgtgtacctgtatatttttatagtgaaccacatggctatataggattagcacatgcaggttggcgaggaacatatggtcaaatagtaaaagaaatgctaaaaaaagtggattttgattatgaagacttaaagattgtaattggtccagcaacttcaaattcttatgaaatcaatgatgatataaaaaataagtttgaggaattaaccattgattcaactttatatattgagaccagaggtaaaaatcaacatggtattgatttgaaaaaggctaacgcacttcttctagaagaagctggagttccatcaaaaaacatatacgttacggaatatgcaacttcagaaaacttagatttattcttttcatatcgtgttgaaaaagggcagacgggacgtatgttagcatttattggacggaagtaa

SEQ ID NO: 1965 - DNA, 963 bp, Staphylococcus epidermidis
atgaaactgaagtggaggcgtattttgacaatgagtaaaatcatttttatgggaacacctgatttttcaacgaaaattttagagatgttaattgctgagcatgaagttatcgctgtagtgacacaacctgatagaccagtgggacgtaagaaagtgatgacaccaccaccagtaaaaagagtagctacaaagcatcaaataccggtatatcaacctgaaaaacttaaagattctcaagaattagaatcgttactttctttagaatcagatttaatagtaacggctgcgttcggtcaactattaccagagtccttactcaatgcacctaaattaggagctattaatgtccatgcatcattgctacctaagtatagaggaggagcacctatacatcaggctataattgatggtgaagaagaaactggaatcacgattatgtatatggttaaaaaacttgatgcaggtaatatcatctcgcaacaatcaattcgtattgaagaagaagataatgttggcacaatgcatgataaattaagctttttaggtgccgaattattaaagaagacacttcctagtatcattgataataccaatgacagtatccctcaagatgatgcacttgcaacatttgcatctaatattcgtcgtgaagacgagagagttgattggaatatgagtgcacaagcaattcataaccatattagaggactgtctccatggccagttgcttatacaactatgaatgaaaagaatctcaaattatttagcgctttcattgtgaaagggaaaaaaggtaatccaggaacaattattgaaactactaagcatgaactcatcatagctaccggttctgatgatgccatcgcacttactgagattcaacctgcaggaaaaaaacgcatgaaagttactgattatttaagtggtgtacaagagtcgttagttgggaaagttctattatga

SEQ ID NO: 1966 - DNA, 1284 bp, Staphylococcus epidermidis
ttctacatgaaattaattaaaaacggaaaaatcttaaaaaacggtatcctaaaagacacagaaattttaatcgacggtaaacgtattaaacaaattagtagtaaaattaatgcttcatcttcaaatattgaagttattgatgcaaaaggaaatttaattgctcccggttttgtagatgttcatgtgcacctacgtgaaccaggtggtgaacataaagaaacaattgaaagtggtacaaaagccgctgcaagaggtggttttactacagtatgtcctatgcctaatacaagacctgtaccagatacagttgaacatgttagagaattaagacaacgaatttctgaaacagcacaagttagggtgttgccttatgctgctattactaagagacaagcaggtactgaacttgttgattttgaaaaattagcactagaaggtgtgtttgcatttactgacgatggtgtgggagttcaaacagcaagtatgatgtatgctgctatgaagcaagctgcaaaagttaaaaaaccgattgtcgcacactgtgaagataatagcttaatctatggtggtgcaatgcataaaggtaaacgtagtgaagaattaggcatacctggtattccaaatattgctgaatctgtacaaattgctagagatgtattattggctgaagcaactggttgtcactatcatgtgtgtcatgtttcaactaaggaaagtgttcgagtaatcagagacgctaaaaaagctggtatccatgtaacagcagaagttacaccacatcatttattattaactgaaaatgatgttcctggcgatgattcaaactacaaaatgaatccaccattaagaagtaatgaagatagagaagcacttttagaaggcttattagatggaacaattgattgtattgcaacggatcatgcacctcacgctaaagaagaaaaagcacaacctatgacaaaagcacctttcggcatcgtaggtagtgaaacagcattcccattactttatacacactttgtaagacgaggtaattggtcactgcaacaattagttgattatttcactattaaaccagctactattttcaacttaaattatggaaaattacacaaagatagttacgctgatttaacaataattgatcttaatactgaaaaagaaatcaaaagtgaagatttcttatctaaagctgataacactccatttattggtgaaaaagtttatggaaatccaacactaacaatgcttaaaggtgaagtagtattcgaggaggaaaagtag

SEQ ID NO: 1967 - DNA, 402 bp, Staphylococcus epidermidis
aacaaaatgaagatattcctgaagaaatctctagaaattcatccgttgaatctgaagaaggtaactaaaatgggacaaaatgatttagttaaaacattgcgtatgaattatctatttgatttttatcaaagtttgcttacaaataaacagaaaaattatctcgaattattttatttacaagattattctttaagtgaaattgctgatacatttgaagtgagtagacaagcagtttatgataatataagaagaactggcgatttagtagaagattatgaatcgaaattacgactataccaaagattcgagaaacgtcgtgaattatataacttaatgaaacaatcacttaatcaacctgagttgcttaaacaatatatcactcaattagaagaattagagtag

SEQ ID NO: 1968 - DNA, 486 bp, Staphylococcus epidermidis
aagaagtgtgatgatatgaaaaaagcaatcatagtcatgtttgttgttactgttatcttgacaatagcagcactcattgacgagtttatgattcaagatgcgaaacatggtcaaagtcgttttacgtcacatcatcctatgaaaatcaatacatataaaaaggggcagtgtacatattacgtctttgaacgtgttaaaaatgatggaaataagataaacaatacttggagcgacgccaagcattgggataaaaaagcaattgatgatggatacattgttgaccgtaaccctaaaaaaggatcaatattacaatcttctaaagggaaatacggtcatgttgcatatatagaaacaataaatgaagatggttctatgcaagtttcagaaatgaactatacacaaccttatgaaatcacaaaacgcacaattcatacctatgatattaaaaattattattatattcatccgcaaaagataaaaacataa

SEQ ID NO: 1969 - DNA, 777 bp, Staphylococcus epidermidis
ataaccatcgatatatatcagcattttagaaaggaagaacaagatgctctcgatcaattcatcgataaatgtaagcaggctgatgctaattatgctccagttctaacccatttcttggatccgagaggtcaatatatacttgaagtcattacgcgtagttatcaagatttacatgttacattttttggtggaccacatgcagaaagaaaacgtgcaatcatcgcaccattatattttaagccacagcctgaggactttgaattaactttatttgaacttcaatatcctaagaaatttgtaacaatacaacatcaacacgttcttggaacactcatgtcactgggaatacaaagagatcaactcggcgatattatagttggagaagatatacagtttgttttgacaaaacaattagaatcatatattatatctgaattaacgcgtattaagggagcctcagttaaacttaattctattcctactgaagatatgatacaatcagaagagaattggaaagttcatagtacaactgtgagcgctttgagattagatgtagttttaaaagagatgattcataagtctcgaaatattgcacaacaattaattataaaaaaaagagtcaaagttaaccatacagtaatagattctacagattttcaattagagcagaatgatttattgtcaatccaaggttatggtagagctcaaattgttgaaataggtggaaaaacaaaaaagaacaagttacacattcattatcaaacactatttaaatag

SEQ ID NO: 1970 - DNA, 336 bp, Staphylococcus epidermidis
tcacatcgagaatatggagcaacactacgaataaggagttcaactatggatattggtttgctaagtacaattttccgatttattatatttttagttcaaatatattattttggaatgattatatatttctttacttcttgggttccgagtataagagagtctaagtttggagaatttttaggaaagttatatgaacctttcttagaacctttccgtaaaattattcctcctattggctttatagacatttcttctatcgcggcaatcttcgttctagttttattccaaagtggtttagtaaaaatatttaatttaattcttgcatatttatcttaa

SEQ ID NO: 1971 - DNA, 1314 bp, Staphylococcus epidermidis
atcaacatggaaaatgagcaaatgtttgagcgtaccgttcagccagttcttgatgtaaaagataaaccaaaaccagcacaatgggcatttctgagtcttcaacatttatttgcaatgtttggatcaactgtacttgtaccatttttaacacatctgcctatatcagcagctttgttggcatcaggtattggtacacttttatacatattaatcacaaaagcgaaaattcctgcctacctaggatcgagttttgcctttattacacctatcattacagggttaagtacacatagtcttggagatatgctggttgcattatttatgagtggattaatgtacgtgattataggtattttcattaaattgagtggaacacattggttaatgcacttgttaccaccagtagttgtcggaccagtaataatggtcattgggttaagtttagctcctacagcagtaaacatggccatgttcgaaaattctgctgaaatgaaagggtataacttaagttacttaattgttgctttgattacattagcagtaaccatcatcgtccaaggattcttcaaaggatttttatcactaatacctgtacttataggtattatagtgggatatattgtatccattttcatgggcatagttaaatttgctccaatagcacaagcgaaatggatagattttcctcatatttatctaccatttaaagattacacaccatcttttcatttaggactcattctcgtgatgatacccgtggtgtttgtgacggtaagtgaacatattggtcatcaaatggtaattaataaaatagtaggacgcaatttctttgaaaatccaggtttagataaatcaatcattggtgatggtgtttcaactatgtttgcaagtatgataggaggtcctcctagtacaacttatggtgaaaatataggtgtactagcgatcaccaaaatatatagtatttacgttattggtggtgcggcagttatagctatcattcttgcatttattggtaagttcactgctttaatatcttcaatacctacgccagtgatgggtggtgtctcaattttattattcggtattatagcagctagtggtttaagaatgcttgttgaaagtcaagtagatttcgcaagcaatcgcaacttggttatagcatcagttgtgcttgttgtcgggattggtaatcttcttatcaatttaaaaggcataggtatcaatttacaaattgaaggaatggcattatcagcactttcaggaataatattaaatttaattttgccaaaagataaaaaccaaataaattaa

SEQ ID NO: 1972 - DNA, 240 bp, Staphylococcus epidermidis
agcgacgtggaaaacttcgataaagtaaaagacatcatcgttgatcgtttaggcgtagatgctgataaggtaacagaagacgcatcattcaaagatgatttaggcgctgactcacttgatatcgctgaattagtaatggaattagaagacgaatttggtactgaaattcctgatgaagaagcagaaaaaatcaacactgttggtgatgctgttaaatacatcaacagccttgaaaaataa

SEQ ID NO: 1973 - DNA, 207 bp, Staphylococcus epidermidis
aggcaactttggctaagcaaaagcatatccctcgtaaaaagagagcggaatagaattcataatgaattcattatcccaccatctcgcaatatgaccttaaatagagaatctaataaaattttcataacagaaactcagacccttaaacgttttattttaagtacatttcagggtagtcaatctactgcgaagagatttaatggctaa

SEQ ID NO: 1974 - DNA, 1353 bp, Staphylococcus epidermidis
ttatttaagtggtgtacaagagtcgttagttgggaaagttctattatgatgaaatcagtgcgaacatatgcattagaaacaatcaacgacgtcctaaataaaggtgcttatagtaatttgaaaattaatgaagttctatctacaaataacattaatacagtagataaaaatttgttcacagaattagtatatggaacaataaaaagaaaatacacgttagattatctactaaagccttttatcaaaactaaaatcaaatcatgggtgcgacaattactgtggatgagtttatatcaatatttatatttagataaaatacctaaccatgctattattcatgaagcggtagatatagcaaagaaacgtggtggctttcacacagggaatatagtcaatggtatattacgaacagtaatgcgcactgaattgccaagctttgaagatatagatgatactaaaaaaagaattgcaattcaatatagtcttcccaaatggattgttgatcattgggttacacattttggagtagaaaaaactgaaaacattgcacgatcttttttagagcctgtaaccacaaccgtgcgcgccaatatatctcgtgattctattgattcaattatctctaagttagaacaggaaggttaccacgttaaaaaagacgatatgttaccattttgtcttcatatatcaggtatgcctgtggttaattcaaacgcttttaaagaaggttatatctctattcaagataaaagttcaatgatggtagcttatgtaatgaacctagggcgagatgacaaagttttagatgcgtgcagcgcacctggtggtaaagcttgtcatatggcagaaattctttcaccagaaggtcacgtcgatgcaacagatattcatgaacataaaataaatcttataaagcaaaatattaaaaaattgaaattgaataatatcaaggcttttcaacatgatgctacagaagtatacgataaaatgtatgataagattcttgttgatgcaccatgtagtggattaggtgttcttagacacaaacctgaaattaaatatagtcaatcacaaaatagcattaagtctttagtagaattacaattacaaattttagaaaatgttaaagataatattaaacctggtggtacaatagtgtattcaacatgtacaatagaacaaatggaaaacgaaaatgtcatctatacttttttaaagagacataaagattttgagtttgaaccattccaaaatccagcgactggtgaacaggttaaaacgttacagatacttccacaagattttaattcggatggattctttattagcaagataaaaagaaaggaaagttag

SEQ ID NO: 1975 - DNA, 234 bp, Staphylococcus epidermidis
gttgataagcttggggctatattaacaattattaaaaattatcaatatagattaaagctttatatgataatcaatcatagattatcatatttttataattataatgattttttatttttcattagtttatacgcttgttctgctgccttttgttcggattctttctttgtctttcctttaccctctgcaactgctttattttctaaaatcacttccgatgtaaatagtctatga

SEQ ID NO: 1976 - DNA, 1722 bp, Staphylococcus epidermidis
aaaagtataaggtggcagataattatggcatatgatggcttatttactaaaaaaatgattgaatcattacaaggtttagtctcaggccgaattcataaaataaatcaaccagaaaatgacacaataattattgtaataagacaaaatcgtaaaaatcatcaactacttctatcgattcaccctagtttctctcgtttacaattaaccactaaaaaatacgacaatccatttaccccaccaatgtttgcaagagttttccgtaaacaccttgagggaggctttataaaagcaattcgacaggttggtaacgatagacgtatagagattgatatcgaaagtaaagatgaaattggtgatacaatatatagaactatcatattggaaataatgggtaaacatagtaaccttatccttgtcgatgatcaacgtaaaatcatcgaagggtttaaacatctaactcctaacacaaatcagtacagaaccgttatgcctggcttcaaatatgaagcaccaccaaatcaaaataaaatcaatccttatgaattaacaggacaagaggtattaaaatatatagactttaatgctggaaagattgccaaacaattacttaatatatgtgagggctttagtccgctaatcgctaatgaaattgtgaatcgtcgtcaatttatgactcaagaaacattacctgatgcttttgatgaagtcatggccgaaacaaaatcagcacctacccctgtctttcataaaaatcatgaaacaggtaaagaggacttctatttcatgaaacttaatcaattctatgatgatatagttgagtatcattcacttcatgaactattggatcgcttttatgatgcacgtggagagagagaaagagtcaaacaacgtgcaaatgatttagtcagatttgtacaacagcaactgcaaaaacaacaaaataaattgagtaaacttatcgatgagtatgaaagtgctaaaaacaaagaaactcagcaattatatggagagttgattacagctaatatatatcgtattcaacaaggtgacgattctgttatagcgttgaattactatactggtgaagaagtaaagattccacttaaccctacaaaatcgccatcaactaacgctcaatattattataaacaatataaccgtatgaaaacacgggagcacgaattgactcatcagattaaacttactaaagagaatattgattactttgataatattgaacaacagttaaagcacattaccgttgatgatatcgatgatattcgcgatgaacttgctgaacagggattcatgaagcaaagaaaacaaagtaaaaagaaaaaacagtctaaaattcaacttcaaacgtatcattctactgatggagatacgatattagtaggtaaaaataataaacaaaatgattatcttaccaataaaaaggcacgtaaaaatcatttatggtttcatacaaaggatattccaggatctcatgttgtcatactcaatgagagtccaagcgaaacaacgattaaagaagcggcaatgctagctgggtacttctctaaagctgggagttcagctcagattcctgtagattatacagaaattagacacgttcataaaccttctggagcaaaacctggattcgtgacatatgacaaccaaaagaccctatttgcaacacctgattatgatcatattcaacaaatgaaagaatcataa

SEQ ID NO: 1977 - DNA, 615 bp, Staphylococcus epidermidis
gagaataggagtgagccccccttggctttaaaggatttatttaataatttttttgtagttgaagaagaagaggaagttgaaggacctgaagaacgtgaatcttctagatcacgtgaacgtgttcaagaacgcgaagattacaatcgtaatgagaatcaagcgacaccacaaacttttaacaataagcaacaagcgattaagtctgtacctcaaaagaacactttgagatcgaatacaacttctgaagaaaggaattatcgtatgaataataattcaaaaaataattctagaaacgttgtaacaatgaaccaagcatcacaatcatatgctgctcaggaaagttcaaaaatgtgtctgtttgaaccacgtgtcttttcagatactcaagatattgccgacgaattaaaaaacagacgtgcaactttagtaaatttacaacgcattgatcaagtatcagcaaagcgtattattgattttttaagtggtacggtatacgcaattggtggagatattcaacgcgtgggtactgatattttcttatgcacacctgataatgttgaagtagccggcagtataactgatcacatcgagaatatggagcaacactacgaataa

SEQ ID NO: 1978 - DNA, 225 bp, Staphylococcus epidermidis
atggtgaggaggcgtctaatggaacaaaataatgataataatcatctttacactttaataaaacattgtaatgagtttctttatagacgagatgattatagaattccatctgattctcaatcagaccattctaataatgagaatattttaaaaacaatgaatgatgaagtatttaaacattcaattgaaatttttaaacgtgccaagaaaaatttaaatcattaa

SEQ ID NO: 1979 - DNA, 2007 bp, Staphylococcus epidermidis
agtatgataggtaaagtcataaatgaacgctatactattaccgataaactcggtggtggtgggatgagtattgtctacttagctgtagattcaatacttaacagaaaagttgctattaaagcgatttcgattcctccaagtgaaaaagaagagacatttaaacgttttgaaagagaagtacataattcttctcaactttctcatgagaatatagtcagtatgattgacgtagatgaggaagacgattgtttttatattgttatggaatacatagaaggtcctactttagcggaatatatacacagtcatggtccacttagtgtagaaactgctattcagtttacagaacaaattttgagtggaatcaaacatgcgcatgatatgagaattgttcatcgcgatattaaaccacagaatatattaattgataagaataaaaaattacaaatttttgattttggtattgctaaagcattgagtgaaacgtcgctgactcaaacaaatcatgttttaggaactgttcaatatttatcgcctgaacaggctaaaggcgaagctactgatgaaagtactgacatatattcaattggaattgtattatatgagatgttagttggagagccaccattcaatggagagactgcagtgagtattgctataaagcatattcaagatagtatcccaaatataacaacggataaaagagatgatgtacctcaatcattgagtaatgtcgttttacgtgctaccgagaaagataaatatcatcgctatcatactgttcaagaaatgtgtgacgatttaacaagtgctttacatgagaatcgtttgaatgaagaaaaatacgagctagataaaactaaaacggtaccactcactaaagatgatttgaatcataaaatctatgatgaacaaaatcaaaatgaccttaataaaaccatgcaaatacctattgttaacgattcaataaagcaacaagaatttcaatcgtctgaaccacgttattatcaaaaaagcgacaagaaacgttctaaaatgaaaattgcaattttatcaatcatttttgtaatattattaattggtttattttcttttgtagctatggctgtttttggaaataaatatgaagaaatgcctgaccttaaagggaaaactgaaaaacaagctgaaaaggtattagacagtcatcatctaaaagtaggtgacatatcaagaaattatagtgataaatatcctgaaaaccaaattattaaaacaaatccagatagtggagaacgcgtcgaacaagggaatagagttgatatcgttctatccaaaggaccagagaaggttaagatgccaaatgttttaggtatgtcgaaaaatgatgcgctaaaaaaattaaaggctatcggatttaaagatattcacgttgagcaagcttatagtcaaacatatgaaaaaggattaatttctgaacaaagcgttgtagctaatagtgaggttgccgttaataatcatcatattacaatttatgaatcattaggtgttcgacaagtatatgtcaataattatgaaaataagtcatatgagtcagcaaaaaaagaacttgaagataaaggatttaaagttcaagtgacaaaagaaaacaacgatgatgtcgaaaaaggtaatgtcatttctcaatctccaaaggataaaactgttgatgaaggttctactatactattagtggtttctaaaggagaaaagtctgaagaagatgatgatgaggaggacaaggatacaacgactaaaaatgagactgttaaagtaccgtataccggtaaaaaaagtaaaagtcaaaaagtagaagtatttattcgtgatattgaaaataaaggtgattcagcagttcaaacgtttaatattaaaagtgataaaacaattaatattcctttgaaaattaaaaaaggaagtgacgctgggtacaccataagagttgataataaaattgtagctgataaagatgtgagctatgatggctaa

SEQ ID NO: 1980 - DNA, 1248 bp, Staphylococcus epidermidis
ggttatgaaggaggaacaagcatgagtttttttaaacgtctgaaagataaattttctagtaaaagtgaagatgatattcaaaaagacctagatgaaactgtagattcaaatgctaatagtgactcagattcaatggacccgaatgattctgatgaacaagtcaaacccaaaaagaaacctaaaaaattaagtgaagctgattttgacgaagatggtttgatatcgattgaagattttgaagaaattgaagctcaaaaaattggagcaaaattcaaagccggtttggaaaaatcacgtcaaaacttccaagaacagttaaataatttaattgctcgatatagaaaagttgacgaagatttcttcgaagctctggaagaaatgcttattactgcggacgttggttttaataccgttatgaaattaactgatgagctacgtacagaagcacaaagacgtaatatacaagaaacagaagacttaagagaagttatagttgagaagattgtagaaatctatcatcaagaggacgattattctgaagcaatgaatattgaagatggacgtttaaatgtcatactgatggttggtgtgaatggtgtcggcaaaacaacaacaattggtaaattagcttatcgttatcaacaagaaggtaaaaaagtaatgttagccgctggtgataccttcagagctggagcaattcaacaattaaacgtctggggagaacgtgttggtgttgaagttgtgagtcaaaacgaaggttctgaccctgcagcagtagtatatgatgcgattaatgccgcaaaaaataaaggcgtagatattttaatttgtgatactgcaggacgcttgcaaaataaatctaatttaatgcaagagttagataaaatgaaacgtgtgattaatcgtgcaatacctgatgccccccatgaagctttattatgcttggatgcaacaactggtcaaaatgcactttcacaagcacgttcatttaaggaagttacaaatgtctcaggtatagttttaactaaattagacggtactgctaaagggggtattgtattagcaattcgaaatgagttacacattccagttaaatatgttggtttaggcgaaaaaatggatgacttacaaccgtttaatcctgaaagctatgtatatggattatttgctgatatgatagaacaaaatgaagatattcctgaagaaatctctagaaattcatccgttgaatctgaagaaggtaactaa

SEQ ID NO: 1981 - DNA, 222 bp, Staphylococcus epidermidis
tgtgtatttatatttattaaaggaggtactttcatgggtaaacaatgtttcgtaacaggtcgtaaagcttcgactggtaatcatcgttcacacgctttaaatgcgaataaacgcagatggaacgctaaccttcaaaaagttagaatccttgtagacggcaaaccaaagaaagtttgggtttctgcacgtgctttaaaatctggtaaagttactagagtttaa

SEQ ID NO: 1982 - DNA, 411 bp, Staphylococcus epidermidis
cacatggacataccaaaaattacgacgtttttaatgtttaatgatgaagctgaagaagcaattcaattatacacaagtttatttgaagatagtgaaattattacaatggtgaagtatggcgaagaaggaccgggcacacctggatcagtacaacactccatctttacgctaaatggccaagtatttatggcaatagatgcaaatagtggagaagagttgcctatgaatccagcaatgtcactatatgtcactgttaaggatactatggagatggaacgtttatttaatggtttgaaaaatgaaggcgccattttaatgcctaaaacagaaatgccaccatttagagagtttgcatgggttcaagataaatttggcgtgagttttcaacttgctttaccagaaaacaaatag

SEQ ID NO: 1983 - DNA, 3636 bp, Staphylococcus epidermidis
tttttaataattgttaatatagccccaagcttatcaactcaacacgactgtgataaggagaatacaatggtttatttaaaatcaattgatgccataggatttaaatcttttgccgaccataccaatgttcaatttgataaaggtgtgacagctattgttggtcctaatggaagtggtaaaagtaatattactgatgcaattaaatgggtactaggtgaacagtctgccaaatcactacgcggtgctaaaatggaagatatcattttttcaggtgctgaacatagaaaagctcaaaattttgctgaagtaaaacttaaattagataatcattcacaaaaactacaaattgattctgaggaattagttgtcacacgccgtctctatcgaagtggtgagagtgaatattatttaaataatgatcgtgcacggttaaaggatattatagatttatttctcgattcaggacttggaaaggaagcatttagtattatttctcaaggaagagtagatgaaatattgaatgcaaaaccaatcaatcgtcgacaaattattgaagaatctgccggagtacttaaatataaaaaacgtaaagctgaatcgattcaaaaacttgaccatactgaagataatcttaatcgagtcgaagatatcttatatgatttagagggacgagtggaaccgttaaaagaagaggcggccattgctaaagaatataagcaattatctaaagagatggagcaaagtgatgtcatcgttacagtatctgacattgatcattatactgaagataatcagcgattagatgagcgtttaaatcacctaaagagtcaacaggctgagaaagaaggtcaacaagctcaaatcaatcagttactacaaaaatataaaggtaaacgtcaacaaaacgattatgacattgaaaagttaaattatgaattagttaaagcaactgagaattatgagcaattatcaggtaagctaaatgtattagaagaacgaaagaaaaaccaatcagaaacaaatgcaagatatgaggaagaattagataatttagaatcacaaattgattctattaaaaatgaaaaagcccaaaatgaaaaattattagctgatttaaaaaataagcaaaagcaattaaacaaggaagttcaagaattagagtcacttctttatatatccgatgaacaacacgacgaaaaactagaagaaattaaaaatagttattatacattgatgtcagaacaatcagttgttaataatgatataagatttttagaacatacaatcaatgaaaatgaagcaaaaaaatcacgattagattcgcgtttagtagaggctttcaatcaacttaaagacattcaacaaaatattactcaaacacaaaaggaataccaaagttctaagaaatctatggaaaaagtagaacaaaatattcaacaattagaacaacagttgacagattctaaaagacttctatctgaatatgaaaataaactatatcaagcctatcgttataatgaaaagttaaaatcaagaattgatagtttagctactcaagaggaagattacacgtatttctttaatggtgtaaagcacattttgaaagcaaaagataaagaattaagaggaattcatggtgcggttgcagaagtgattaacgttccttcagaaatgacacaagcgattgaaaccgccttaggtgcatcgttacagcacgttattgttgataatgaaaaagacggtcgtcaagcaatccagtacttgaagcaaagaggtttaggtcgtgctacttttttaccattaaacgtgattcaaccaagacatgtagctgctgacattaaagatgtagctcgtggttcacaagggttcattaatattgcatctgatgccataaatgtatctgctaaatatcaaaacatcattgaaaatttattaggtaataccatcattgtagaaaatttaaaacatgcaaatgaacttgcacgtgccattcgatatcggacaagaatagtaactttagaaggtgatgttgtaaatcctggtggttccatgacaggaggaggagcacgtaaaacaaaaagtatattgtcacaaaaagatgaattatcaacaatgcgaaatcaacttgaagattatcaacgacaaacagcagaatttgaacgtcagtttaaagaacaaaaaacacaagctgaacaattaagtgaacaatattttagtgcaagtcagcagtacaacaatttaaaagaacaagtacatcatcacgaattagaactggatagactaaaaacacaagaagcacatcttaaaaatgaacatgaagagtttgaatttgaaaaaaatgatggatatcaaagtgataaaagtaaagaaacattaaaagaaaaacaaaatcatttaattgagatacaacaacaattgaagcaactagaaagtgatattgaaagatatacacaattatcaaaagaaggaaaagcttcgacacatcaaacacaacaacaactacatcaaaaacaatctgatttagctgttgttaaagagcgaattaaatcgcaaaagcaagtttatgaacgtttagataaacaacttagcgattcagaacgtcaaaaaattgaagtaaatgaaaaaattaaattgtttaattcagatgaaatgatgggtaaagatgcttttgaaaagttgaaagagcaaattcagcaacaagaaaatgtaagacaaaatttaaatcaacaacttagtgagattaaacaacaacgtaaagatcttaatgagaaaatcgaaataaatgaaagtcagcttcaaaaatgtcatcaagatatactttctatagaaaatcattatcaagatattaaagcaaaacaatcaaagctagatgtattaatcaaccatgcaatagatcatttaaatgacacgtatcaactcacagtagaacgtgcaagaatggaatatgattctgatgaaacaattgacaatttgcgtaaaaaagtaaaattaacgaagatgtcaatcgatgaattaggtcctgtaaatttaaatgcaatagaacaatttgaagagttgaatgaacgatacacatttttaaatgagcaacgaacagatttaagagaagcaaaagaaaccttagaacaaatcattcatgaaatggataaagaagttgaaggacgttttaagacaacatttcatgcggttcaagatcattttacgacagtgtttaagcaattatttggtggtggacaagcagaacttcgtttaactgaagatgactatttgtctgctggcgttgatatcatcgtacaaccgccaggaaagaaattacaacatctttcattattaagcggtggtgaacgtgctttaagtgctatagcattattgttcgccattctcaaagttcgttcagcaccttttgttatactagatgaagtagaagcggcattagatgaagcgaatgtgatacgatatgcccaatatttaaatgaattatctacagaaacacaattcattgtaattacacatcggaagggaacgatggagttttctgatcgtttatatggtgtaacaatgcaagagtctggtgtttctaagttagttagcgtcaacctaaatacaatagatgaggttatgaaggaggaacaagcatga

SEQ ID NO: 1984 - DNA, 2418 bp, Staphylococcus epidermidis
gtggcagtaatgattgcaaaagtaattgttgatattccgtcgaaaagtgtcgattttaaatttgattatatcgttcctaaaaatttagaacgtgtgattcaaattggcgttcgcgttgtggtaccttttggccctagaactatacaaggatacgttatgaatattcaacaagaaccagatggaaatatggatatatcgaaactaaaagaaataaaagaagtgcgtgatattaaacctgaattaacatccgaactgattcaattaagcgaatggatgagccattatcatgtgatgaaacgtatttctgttttagaagcgatgttgccaagtgccattaaagcaaagtataagaaagctttttcaattatcgatccaaaaaatttatcttcaaaaaccaaagcgctatttaacaatgacggttattacttatataaagaagctcagcaaaacaatgatttagaagaaatgttgactttgttaaatcaaggattgattgaagaggtcacgatactttctcaaaacacaaaaaagaaaactcaaaaagctgttggcgtagttaatacgttgaatggtgatgaagtacttgcaaaactcgagaaatatacaaaacaatatgatttgtatgcatttttattagaagagtctcatcgaacagtgtttttaaaagaaatcaatgatatgggcttctctcactcgagtttagattctttaatcaaaaaaggttatattgaaaaatataccgccgaggttttcagagatccttatgcaaatcgtatatttgaacaagaacaaaagaggatattaactaaagaacagcaagatgcatttgaagctattcaacattatattcatgatgaaaaagaaagaacatttttattacacggagtcacaggttcaggtaaaaccgaagtctatcttcaaacaatagaagaagttcttaataaaggtaaagaagccatgatgttagtgccggaaatcgccttaacacctcagatggtgctaagatttaaacgtcgatttggagatgatgtagcggtattacattccggactttcaaaaggtgaacgttatgatgagtggcaaaaaattagagacggtcgagctcgagtgagtgtaggtgctcgttcaagtattttcgcaccgtttaaaaatttaggcatcattataattgatgaagaacatgaatctacatataaacaagaagattatcccagatatcatgcacgtgatattgcacaatggagaagtcaatttcatcattgtcctgtagttttaggtagcgcaacaccgagtcttgagtcatatgctagagcagaaaaaaatgtttacgagttgttgtcattgccacatagagtcaatcaacaagcgttaccgcatattgatattatagatatgagagaagaattaagtgaaggtaatcgttccatgttttctatagcactaagacaagcgatacaagaacggttggataaaaaagaacaaatagtactattcttaaatagaaggggatatgcttcatttatgttatgtagagattgtggttacgttccccaatgtccccattgtgatatttcgttaacatatcataaaacaaccgatcaattaaaatgtcattactgtggttatcaagaaaatccaccatctcaatgtccaaattgtgaaggtgatcatatcagacaagtcggaactggaacgcaacgtgtagaagaattattacaacaagaattccctcatgctcgtattataaggatggatgttgatacaacttcaagaaaaggtgcacatgagaaattgttaaatgactttgaagcaggaaaaggagatatcttattaggtacgcaaatgattgctaaaggtttggattatcctaacattactctagttggtgtgctcaatgctgacactatgttaaacttacctgactttcgtgccagtgaacgaacataccaacttttaactcaggtatctggacgcgcaggtcgtcatgaaaaagaaggacaagttatcatacaaacgtacaatcctgatcattattcaataaaggatgtgaaattaaacgattatctttctttttatcaaaaagaaatgaattatcgaaaattaggaaaatatccaccttactattttttgattaactttaccatttcacatactgatataaaaaaggtcatgatggcttctaagcatatacatcaaattttagtacagcacttaagtgaaaaagcattcgtgttaggcccttcaccagcagcactagcaagaattaacaatgagtatcgttttcaaatactagtaaaatataagagtgagcctcaattacatccagcgttacaatatttagatgattattatcatgatcaatatgtaaaggataaactatcattaaaaattgatatcaatccacaaatgatgatgtga

SEQ ID NO: 1985 - DNA, 225 bp, Staphylococcus epidermidis
tcatttaaaattatttcaattataatcatcattgaaaagttacactacaaatttattattaatttatcattagttgttactcatttagccatcatagctcacatctttatcagctacaattttattatcaactcttatggtgtacccagcgtcacttccttttttaattttcaaaggaatattaattgttttatcacttttaatattaaacgtttgaactgctga

SEQ ID NO: 1986 - DNA, 645 bp, Staphylococcus epidermidis
atggttaaaattttaccatcacttttatctatagattttttaaatttaaaagaagagcttcaattgttagaaacagcaaaggtagacggattacactttgatgtaatggacggtaaatttgtccctaatatttcaatcggtattccgattttggatgctgttagacaacaatctcatttgccaatagatgttcatttaatgattgagcaacctgaaaattatattaatctttttgccgaacatggtgctgatatgatttctgttcatgttgagtcgacaacacatatacatagagcaattgaacaaattaaacaattagggaaaaaagcaggtgtcgtcatcaatcctggaacatctgtagaaacaattttacctatattgagtattgttgattatgttctagtaatgactgtaaatcctggttttggtggacaaacattcatagaacaatgcgtgactaagattgagcaattaaatcaacttaaacatgaaaatcatttaacttttgatattgaggtagatggaggcattaacgatcaaacgagtaaacgatgtgtagaacagggtgctacaatgttagtcactggttcatacttctttaaacaagaggattatgcaaaagtaacatctttattaaaggaatga

SEQ ID NO: 1987 - DNA, 936 bp, Staphylococcus epidermidis
gtgagtaaaatgggtaaaatagcagttgtcttccctggccaaggtgcacaaaaagtagggatggctagtgacttatataatgaagaggaacgctcgactcgagtattaaatttagctcaagagacagtagactttgatttgctagaaacgatgtttactgataatgatgggaaattaggagaaacagaaaatacacaacctgcactattaacacatagtgttgcgttactagaatcattaaatcatttaaaagtagattatactatgggacatagcttaggagaatattcaagcttagtttctagtgatgtattatcttttgaagatgcggttagaattgtgcgtaaacgtggccaacttatggctcaagcgtttcctaacggtgttggaggtatggcagcagtattaggtttggattatgatgatgttgataagatatgtcaaacgttatctacaaaagaacagttaattgaacctgctaatattaactcaccaggtcaaatcgtggtgtctggacataaatctttaattgatgaattagtagaaaagggcaaagaacttggtgctaaacgtgttcttccattagctgtttccggtccttttcattcttcaatgatgaaagttattgaagaggattttgctaatttcattaatcaatttgaatggcataatgctaattatccagttgttcagaatgttaatgcaaagggagaaaccgatgctgaagtaattaaacgcaatatggttaaacaattatattcacctgttcaatttattcaatcaacggagtggttgattaatcaaggtgtcgatcactttattgaaattggaccgggaaaagtattatctgggcttatcaaaaaaataaatcgagatgtaaaaatcacttcaattcaaacactcgaagatgtgaaaggatggaataatcatgaataa

SEQ ID NO: 1988 - DNA, 750 bp, Staphylococcus epidermidis
aaggatggaataatcatgaataaaagtgctttagttacaggtgcttctcgtggtattggtagaagcattgcattgcaattagcggaagaaggatataatgtagctgtcaattatgctggaagtaaagataaagcagaagcagttgttgaagaaattaaagctaaaggtgtagaaagctttgcaatacaagccaatgttgcaaaaggcgatgaagttaaagaaatgattaaagaagtggtaagtcagtttggttctgtagatgtattggttaacaatgcagggataactaaagacaacttacttatgcgtatgaaagaacaagaatgggatgacgtgattgatacgaacttaaaaggcgtgtttaactgtattcaaaaagtaacgccacaaatgttgcgtcaacgtagtggtgcaatcattaatttaactagtattgttggtgcaatgggtaatcctggacaagcaaactatgttgcaacaaaagcaggtgtcattggattaacaaaaactgcagcacgagaactagcatcacgaggtattacagtgaacgctgtagcacctggtttcatcgtttcagacatgacaaatgctttaagtgatgatttgaaggatcaaatgttagagcaaattcctttaaaacgttttggagaagatacagatatagctaatactgttgccttcctagcttctgataaagctaaatatattacaggccaaacaattcatgttaacggtggaatgtatatgtaa

SEQ ID NO: 1989 - DNA, 231 bp, Staphylococcus epidermidis
aatggtctgattgagaatcagatggaattctataatcatctcgtctataaagaaactcattacaatgttttattaaagtgtaaagatgattattatcattattttgttccattagacgcctcctcaccattcatatattacgataagttatctcgccaatcaactaatgtttggatatcatttaaagagattttaccttcatctttcgcaacttctataagctcattataa

SEQ ID NO: 1990 - DNA, 708 bp, Staphylococcus epidermidis
aaggagaagatgagtgtgagaaatctacccattatagcattagattttaaatcagcagacgaggttcatacatttttaaataaatttaatgaaccgttatgcgtcaaaattgggatggagttattttatcaaacagggccagctttaattaagtccattaaaaaaagaggtcatgatatctttttagatttaaaattacatgacatacctaatactgtgagtaaagcaatggaaggcttagcacgtttagatgtagatttagtcaatgttcatgctgccggtggtattaaaatgatggaagaagctaaaaaagggttaagaaaacataatgctgatattaaaatcattgcagttactcaattaacttcaactactgaaagacaattacatgaagaacaaaatattcaaacctcaatagaggaggcagttttaaattatgctcgtcttactaaaaaagctggtttagacggtgtcgtatgttctcctcttgaggctgagatgatttctaaagaactaggtactgactttttaaaagtgacaccaggtattcgcccgaaaggcgcagctcgtaatgatcaacaacgaattacaacaccagaggaagctaaaaccttggggtcaacacatatcgtagtaggtcgacctatcactcaaagtgagcatccaattgacagttatcataaaataaaagaaagttggttaagttaa

SEQ ID NO: 1991 - DNA, 492 bp, Staphylococcus epidermidis
gtgatgactgtaaagaaattagtaaaatcaacacatcctattttgaataaaacaattcaacctgtaagcacgtatgatcaaaaactaaaagtgttattggaagatttggaagatacattatatcatgaggaagctgctgcaattagtgcacctcaaattggagtagatcaaagtgttgcactcatcgatatggaacaagaagggttattacaacttattaatcctgtcgttaaaagtcaatctcaagagactgtttctgacttagaaggctcaatcagtttacctcatatatatggagaagttaaacgtagcaaaatgatcactgtacaaagctatgatatcaatggaaatgcagttgaattaactgcatatgacgatattgcacgcatgattttacatatgattgatcatcttaatggaattcaatttaccaaaagagcacatcatatattaaatgaaactgaagtggaggcgtattttgacaatgagtaa

SEQ ID NO: 1992 - DNA, 672 bp, Staphylococcus epidermidis
tttatggatgttaaagaaaatcttgctaagattgaaaaggaaattgatgcaagcattaaaaaaagtgcgcattcagcacaacctcacgtgattgcagtaacaaaatatgttacaatagagcgagctagagaagcgtataaagtaggaataagacatttcggtgaaaatcgattagatggattcaaagagaagaaagaatctctaccaagcgatgttaaattacatttcattggttctttacaatcaaggaaagtaaaagatattataaatgaagtcgattattttcatgctttagatcgtttaagtctagctaaggagattaataaaagagcaaatcatgttataaaatgtttcttacaagtaaatgtttctggagaagaatctaaacatggcatagctcttgaagaagtgaatcaatttataaatcaaattaaagaatatgaaaatatccaaattattggattaatgacgatggcaccattgactgatgatttatcgtacataagaaatttatttaaagaattaagacataaaagaaatgaaattcaacaattcaatttagcacatgcaccttgtacagaattatctatgggaatgagtaatgattatcaaatggcagttgaagaaggtgcaacctttgtcagaattgggactaaacttgtaggagaatag

SEQ ID NO: 1993 - DNA, 891 bp, Staphylococcus epidermidis
atgagaggtgtctttttgaagactggtcgaatcgttaaactaatcagtggtgtgtatcaagtagacgtagaaggtgagagatttgataccaaaccacgtggtttattcagaaaaaagaagttttcacctgtggtgggcgatatcgtagattttgaagttcaaaatacaaaagagggctatattcatcatgtacatgaccgaaataatgaactaaaacgaccacctgtaagtaatattgacgagttagttatagtaatgagtgcagtcgagcctgaaatttcaacacaattattagatcgctatttagtgattgctcattcttatcatctcaaacctagaattttaatcactaaacatgatttagcttccgaacaagaaattcttaaaatcaaagacacaataaaaatatatcaaaaaataggatatgctacgcagtttattggaaaagatagtaattatactgctactgttgatgaatggtctgacggtttaatagtattaagtggccaatctggagtgggtaaatctactttcttaaatagttatcagcctcagttgaagttagaaacaaatgatatttctaagtcattgaataggggtaaacatactacaagacatgtcgaattatacgatagaaaaggtggttacatcgctgatacaccggggtttagtgcgttagattttaatcatattgaaaaagaacaactaaaagatttttttattgatattcatgaagctggagagcaatgtaagtttcgtaattgtaatcatataaaagaaccacaatgtcatgtcaaagcactcgttgaaaaaggagaaattccacaattcaggtatgatcattatcagcaattatataatgaaatttccaatagaaaggttcgatactaa

SEQ ID NO: 1994 - DNA, 2784 bp, Staphylococcus epidermidis
agttcttttttatcattacaaggagtgaatttaatgaattacaaagataccctattaatgccgaaaactgattttcctatgagaggtggcttaccgaataaagaaccacaaattcaagaaatgtgggataatgatgagcaatatcgcaaagcgttagaaaaaaataaaaataatccatcattcattttgcatgacggaccaccatatgctaatggtaatttacatatgggacatgcattaaataaaatcataaaggattttattgttcgttataaaacaatgcaaggcttttatgcaccgtatgtgccaggttgggatactcatggtttaccaattgaacaggctttaactaaaaaaggcgttgatcgcaaaaaaatgtcagttgcagaatttagagagaaatgtaaagaatttgcattaaagcaaattgacattcaaaagaaagattttaagcgccttggtgtacgaggtgattttaataatccatacattacattaacacctgaatacgaagccgcacaaataagattatttggagaaatggcagacaaaggtttgatttataaagggaaaaaacctgtgtattggtcaccttcaagtgaatcatcacttgcagaagctgagatagaatatcatgacaaacgttctgcatcaatttacgttgcttttgacgtcaaagacagtaaaggtaaagttgattctgatgcccaatttattatttggacaactacaccatggacaattccatcaaatgtggcaattacagttcatccagagctaaaatatggtcagtataatgttgatggacataaatacatagttgcccaagcattatcagaagaagtcgcagaagcattaggttgggataaagattctatacaattagagaaagaattcacaggtaaagaattggaatttatagaggcacaacatccattcctagatcgtgtatcattagtaattaacggtgaacatgttacgacagacgctggtacgggatgtgtccatacagctcccggtcacggggaagatgactatattgtaggtcaaaaatatgatttaccagtaattagtcctttaaatgataaaggtgtattcactgaagaaggtggaccatttgaaggaatgttttacgacaaagcaaacaaagctgtgactgatcttttaaaagaaaaagacgcactacttaaacttgactttattacacatagttatcctcatgattggcgtacgaaaaaacctgttatctttagagctacaccacaatggtttgcatccattaataaagtaagacaggatattcttgatgcaattgaagacacgaactttaaagtagactggggtaaaacacgaatttacaatatgattcgcgatcgtggcgaatgggtaatttctcgtcaacgtgtatggggcgttcctttaccggtattttatgctgaaaatggcgacatcattatgactaaagagacagtaaatcatgttgcagatttatttgaaaaatacggttcaaatatttggtttgaaaaagaagctaaagaattacttcctgaaggatttagtcatcctggaagccctaacggtgaatttactaaagaaactgatattatggacgtttggtttgattctggttcatcacaccgtggtgtattagaaacgagacctgaactttcattcccagcagacctctattttgagggtagtgatcagtatcgcggttggttcaactcttcaattacaactgctgtagctactcgtggtcaagcgccgtataaattcttgttatcacatggctttttcatggacggtgaaggtaagaagatgagtaagtcattaggtaatgttatagttcctgatcaagttgttaaacaaaaaggcgcagatattgcacgtttatgggtaagtagtactgattacctttctgatgtgcgtatttccgatgaaattcttaaacaaacgtctgatgtatatcgaaaaattcgaaatactttaagatttatgttaggtaatattaacgatttcaaccctgaaacggatagtattgctgaaacaaatttacttgaagtagatcgctatttgttaaatcgtttacgtgaattcacagcgagtacgattaataactatgagaattttgattatttgaatatttatcaagaagttcaaaactttatcaatgttgaactaagtaacttctatttagattacggtaaagatatactttatattgagaaaaaagattctcataaacgtcgtagcatgcaaaccgttttatatcaaatacttattgacatgacaaaattactagcaccaattttagtgcatacagctgaagaagtttggtctcatacgcctcatgtaaaagaagaaagtgtacacctttcagatatgcctaaagttgttgatgtagatgaagaattgttagaaaaatggaatacatttatgaatttacgtgatgatgttaaccgtgcattagaacaagcacgtaatgaaaaagtaattggtaagtcattagaagctaaagtggttattggaaacaatgaaacatttaatacagcggaattcttacaacaatttaatgacttacaacaattattcatcgtttcacaagttgaagttaaagataaagtaaatgatggtgtatcctatcaatatggagatatccatattaaacatgctgaaggtgaaaaatgtgaaagatgttggaactatacagaagaattaggttcagtaggtgaacttgaacatttatgcccacgatgtcaagaagtagtaaaaactttagtataa

SEQ ID NO: 1995 - DNA, 1026 bp, Staphylococcus epidermidis
tttttaaaggtaaattcaaaatgtactatacaagtgaggatgaatgaaatggttaaaattgcagtagatatgatgggcggggatgatgcgcctggtattgtattagatgcagttaaaaaagctgtcgaggactttaaagatttggaaattattctttttggtgacgaatcacaatacaatttaagtcatgagcgaatagagtttagacattgtactgaaaagattgaaatggaagatgaaccagtacgtgcaattaaacgtaaaaaagatagctcgatggttaagatggctgaggcggtaaaatcaggagaagctgatggttgtgtatcagctggaaatacaggagctttaatgtcggctggattatttattgttggacgtattaaaggcgtagcgagacctgcattagttgtaacattgcccactactgatggcaagggatttgtgttcttagatgttggtgccaatgctgatgctaaagcagaacatttactacaatatgcgcaattaggaaatatttacgctcaaaaaattcgtggtattcaaaatccttcggtgtcacttcttaatattggcactgaagcagctaaaggaaattctttaactaaaaaagcatatgatttatttgagaaaaatcaatcatttaactttacaggtaatattgaagcaaaaacacttatggatggaaatgttgatgtcgtagtaacagatggttatacagggaacatggttcttaaaaatcttgaaggtactgcaaaatctataggtaaaatgttgaaagaaacaataatgagtagcttcaaaaataaattagctggtgcagtattgaaaaaagatttagaaacatttgctaagaaaatggactactctgaatacggtggatcagtattattaggtttagatggtacggttgtaaaagctcatggcagttcaaacgctaaagcattttattctgcaattagacaagcaaaaattgctggtgaagagaatatcgttcaaattatgaaagatacagtaggtgagtaa

SEQ ID NO: 1996 - DNA, 396 bp, Staphylococcus epidermidis
cgtaatacattatccgcttctttaaatgcttccatcattggcgtagatttgtcaacgatatctaataagcgatcatttggaataacaattaatgtatccactgctgctttcatagattctacgccagctgccgcttgtgtttggcgcttacgaccttcgaaaccgaatggacgcgtaacaacacctacagttaaagcacccatttcttttgctattttagcaacaaccggtgcagcacctgttccagtaccgccacccataccagcagttacgaataccatatcagcaccttggatagcgtcttcaatttgttctcttgattcttctgctgctttcttcccaatttcaggattagcaccagcacctaatccacgtgttaatttctcaccaatttga

SEQ ID NO: 1997 - DNA, 1185 bp, Staphylococcus epidermidis
atgttagaatttgaacaaggatttaatcatttagccacattgaaagttatcggtgtacgtggtggcggaaataacgccgttaaccgtatgattgaccatggtatgaataatgtagaatttattgccatcaacactgatggacaagctttaaacttatcaaaagctgaatcaaaaattcaaattggtgagaaattaacacgtggattaggtgctggtgctaatcctgaaattgggaagaaagcagcagaagaatcaagagaacaaattgaagacgctatccaaggtgctgatatggtattcgtaactgctggtatgggtggcggtactggaacaggtgctgcaccggttgttgctaaaatagcaaaagaaatgggtgctttaactgtaggtgttgttacgcgtccattcggtttcgaaggtcgtaagcgccaaacacaagcggcagctggcgtagaatctatgaaagcagcagtggatacattaattgttattccaaatgatcgcttattagatatcgttgacaaatctacgccaatgatggaagcatttaaagaagcggataatgtattacgtcaaggtgtacaaggtatttcagatttaattgcagtatcaggtgaagtgaacttagactttgcagacgttaaaacaattatgtctaatcaaggttctgcgttaatgggtatcggtgtgtcatctggtgaaaacagagcagtcgaagccgctaaaaaagcaatttcatctccattattagaaacatcaattgtaggtgctcaaggtgtacttatgaacattacaggtggagaatcactgtctttatttgaagctcaagaagcagctgatattgttcaagatgctgcagatgaagatgtgaatatgatttttggtacagttattaacccagagcttcaagatgaaattgtagttactgttatcgcaactggttttgaagataaaccttcttcacaaggtcgtaaagctacaagtactggttttggttcaagtgtaaatagtagttctaatcatcaatctggtgctagtgctaaagaagattcattctctgcacacacttctcattcacaatcaagtgaaagtgtaaatgaaagaagccacactactaaagatgatgatattcctagctttattagaaatagagaagaaagacgttctagaagaactagacgctaa

SEQ ID NO: 1998 - DNA, 228 bp, Staphylococcus epidermidis
tgtaataattcaatgaatgtgggtcaagcgcgagttgcacattacatccaccttcaatacctaaagcacgaattacttttaaagatacgtctcgtagcatttgatattctacatctgacagtgtttgactcggtgcaacaacgattgaatctccagtatgaatgcctacaggatctatgttctccatattacatactacgattgcgttatcatttttatcacgcataa

SEQ ID NO: 1999 - DNA, 684 bp, Staphylococcus epidermidis
atgtctcaatcatctaagcgaaaaaacgattctgtggtagaaacttttaaggacatcattcctttaacatttggagaagagattggtaatgcagcatcacatggtgctgctgcattacttacattatttattcttccatatgcagcagtgcatagttttaacaatggtggcacattagagtcaattagtgtgtcagtttatgtgattagtatttttatgatgttcatatcatcaaccatttatcattcaatgcaaaataatacgtctcataaatatatattaaggattattgaccatagtatgatttatgtggctatttcaggaacatacacacctgttttgttaagtgttgtcggcggttggttaggttggctcgtgacaatattattatggggaacgacattatgggggattttgtataaatcaatagcaactaaagtcaatcatagattaagtctcattgtttatttggtgatgggatgggtaggtatcatatttttacctattattattatgcgaacatcatggtggtttattttctttatatttcttggtgggttatcttatactatcggagcatggttttatgcccaaaaaaataaaccttattttcatatgatttggcatatatttattgttcttgcttctttcttacatatgataggcattttttattttatgtga

SEQ ID NO: 2000 - DNA, 981 bp, Staphylococcus epidermidis
aggggtgaatcgcatatgattaaacaaaacctgaagatgcgctataccattgtcttactgttattaatttttagtacaatctttagtctatgtataggatcagtaatgattaatcctattcatgcagttacaggcttctttttacacaatgactttattttaaatgaatatcgaattcctagaacacttttaggattacttataggcagtagtttagctatttctggctcggtgatacaaggggttataagaaatccacttgcttcacctgatgttattggaataacaaaaggggcaagtttagcagcagtaatgatcataatgatatttccatcagcacctctatttgttcttcctttaggttcatttatcggtgctttgacaataagtattattctttcagttcttatttcaaaatttgatgtaaagggatcaaaattagcattgataggtttagcgataggtgcaatttgtacggccattgtccaattcttgcttatacgtaatcctcttgatgcaaataatgcgttattatggttgactggtagtttatacggtcataatatagtcaatttttatagtttattaccatggtttattatcactgtacctatagtattgttattagggtatcaacttgatattttaaatttaggtgatcatgtagccattgcactaggagcacgtgtaaaaatcttaaaaatgattttacttgtattagcagtaatgttagcaggtgcttccattgcggtagtagggggtattagttttttaggtcttatagcacctcatattgcacgtcaacttgtcggccataaaaatatacatgttataatcatgtcaggtttggtaggagcaatattattaacttttggtgatggtttagcaagaggtatacaacctcctcttgatattcctgtaggtgttgtaatagcaattataggcgcaccttatttcttatttttattacgtaagatgtag

SEQ ID NO: 2001 - DNA, 414 bp, Staphylococcus epidermidis
gtaaagtttttagcttctcaattattcaaaagaggtttttttatcgattacttaggtgttgatattagtaaaagaagtagtgtagttgcacattataaaaatgaaaaattccaaaaagagtttttcatccaaaataataaaaatggttacaactatttactcaagtatttgaatgacttagaccacccacaactcatttttgaatctacaggtatctattcaagaagtatggaacgattttgttgtgtaaatcaaattaactatattcaaatgaatccgttagaagccaaatttaaaacgagcgctctaagatcatggaaaactgatcaggcagatgctcataagcttgcttgtttaggaccgacgcttaaacaaacagacaatttacctatatgtgccttaatgtccctgttt

SEQ ID NO: 2002 - DNA, 300 bp, Staphylococcus epidermidis; identical to SEQ ID NO: 233

SEQ ID NO: 2003 - DNA, 366 bp, Staphylococcus epidermidis
tatccttcaccatattgtctactagtaattaaaacaccaactgtaccatcacctataaatgaagctagattatcaactgtcgatctaccaggtaaagtaaacaaaggtcgcatgataggtctaaagatgggtccaagtaattctaatagaccatactccattaataaaggtaaaaagattgcagcaaataaaaatactgctacaagagtaggtaataaacttgaaaatactaatccacctgtatcttcagatttaatcatttcaggtccaatatttaaaaatgttaaccaagaaaagaagacagctaatactctcaaaacaagccatcctattttaacgttgaaagcactgctcattaaaccttga

SEQ ID NO: 2004 - DNA, 303 bp, Staphylococcus epidermidis
cgcttgccacctacgtattaccgcggctgctggcacgtagttagccgtggctttctgattaggtaccgtcaagacgtgcatagttacttacacatttgttcttccctaataacagagttttacgatccgaagaccttcatcactcacgcggcgttgctccgtcaggctttcgcccattgcggaagattccctactgctgcctcccgtaggagtctggaccgtgtctcagttccagtgtggccgatcaccctctcaggtcggctacgcatcgtcgccttggtaagccgttaccctaccaactag

SEQ ID NO: 2005 - DNA, 1080 bp, Staphylococcus epidermidis
gggggatttactttgttaacggtaaatcaagttaaagaaattgtaggggcattaaaggatccgattattgatgtgccattgagagaatctgaaggtattgttgatgtctctattaaggataatattaaccatgtgagtgttaaagtggcaatggcgcaattagggggacagccacaattagatcttcaaatggctatagtcaaagccttaaaagaaaatggtgcaaatactgtgggaattcgttttgaagaacttcctagcgaagtagtcgaaagatatataggaaaaggtagtgaaaagcccaaaaccattgaagaactattatcacaaaataatccagttgaattcatttctatagcttcaggtaaaggtggggttggtaaatcgacagttgctgtcaatctagccgtagcattagcaagagaaggtaagaaagtaggattagtagacgctgatatatacggttttagtgtgcctgatatgatgggaatagatgaaagaccaggtatagatggtaaggagattatacctgtagagagacatggagtaaaagttatttcaatggcattttttgttgaagaaaatgcaccggttatttggagaggtccaatgcttggtaagatgcttacgaatttctttacagaagtacagtggggagaacttgattacttacttcttgatttaccacctggcacaggagatgtagctttagatgtacattcaatgttaccatcaagtaaggaaattatagtaactacaccgcatccaaccgcggcgtttgtagcggcacgagcaggtgcaatggctaaacatacagaacatacaattcttggtgttatagaaaatatgagctattttgaaagtaaagaaacaggtaaaaaagagtatgttttcggaaaaggaggaggcaaaaagctttctgatgaacttgagacgcaattatttgctgaacttcctttagaacaacctacatggaatcccaatgacttttcgccttcgatatatcaatcggatgatcgtttaggagaattgtatactttaatcgcaagaaaagttatagtaagcacccaaaaacaataa

SEQ ID NO: 2006 - DNA, 603 bp, Staphylococcus epidermidis
tcaaatttcactagaagaaagaatgcaagagcgtggttggtaatgattaaaattggtgttttagccttacaaggtgctgtacgtgaacatatacgtcatattgaattaagtggttatgaaggcattgctataaaaagagtagagcaactagatgaaattgatggtctaatattacctggtggagagtttacaacattacgtcgtttaatggatttatatggatttaaagaaaagttacaacaattagatttgccaatgtttggaacatgtgctggattaattgttcttgcaaaaaatgttgaaaatgagtctggttatttaaataaattagatataactgttgagcgtaattcattcggtagacaagtcgatagctttgaatctgaacttgatattaaagggatagcaaatgatattgagggagtatttattagagcacctcatattgctaaagtggataacggagtggaaatacttagtaaagttggaggtaaaatagtagccgtcaaacaaggacaatacctcggtgtttctttccatccagaactaactgatgattatcgtatcactaagtattttattgaacacatgattaaacattaa

SEQ ID NO: 2007 - DNA, 294 bp, Staphylococcus epidermidis; identical to SEQ ID NO: 235

SEQ ID NO: 2008 - DNA, 351 bp, Staphylococcus epidermidis; identical to SEQ ID NO: 223

SEQ ID NO: 2009 - DNA, 195 bp, Staphylococcus epidermidis
tttaattatttaatagcaatgattgataatgctattaaaaattgcaattgtatcatgctttaccaagctgttcaaagtttaaataattacactataatggcatccaaaataataagaaatctctatattattctgagcattaagtttgtatcggtaattaaaatttggttgaatatggaattatcatttgaataa

SEQ ID NO: 2010 - DNA, 1479 bp, Staphylococcus epidermidis
atatggaattatcatttgaataaaaaggagtatatgtttatggccagttatgaattgtctaagactaagcgaaatttaattgtatctgtaatgttaattagcgctttcgtggccattttaaatcaaacattacttaatacagccttgccacacattatgcgtgagttaaatattaatgagaatacatcgcagtggctgattacaggtttcatgttagtgaatggtgtcatgattccactcaccgcttatttaatggataaagtaaaaacaagaccgctatatttaggtgcaatgggatcatttctgatagggtctatcgttgctgctattgcacctaattttggcgtgctcatgattgcacgggtaattcaagctgtcggtgcaggtatactcatgccattaatgcaatttacattgtttacattgttctccaaagaacaccgtggatttgcaatgggacttgcaggattagttatacaatttgcacctgcaattggacctacatttactggtttaatcattgacaatgcaagttggagagtgccatttattgttattgtcggtatagcattagttacatttatatttggttttgtatcgatttcaagttataacacgacgaaagaaacaaaactggataaaaaatccgttatatactctacattaggttttggcttaatgctttatgctttcagtagtgctggtaacctaggtttttctaacccaattgttctttgttcacttttaataagtttaatcatcattggcatttttgttaaacgacaaattacaatttctaatccattattaaatttgaaaatatttaataacaaaatattttgtttttctacaattacttctatgatcattatgttatctatggtaggacctgctttacttattccattgtatgttcaaaatgctttaggattatctgcgttgctatcaggattagtaattatgcctggcgcgattatcaatggtattatgtctgtgtttacaggaaagttttacgataaatatgggcctagaccgttaatatttactgggtttatcttattgatttcttgtacatttctattatgctttcttaaagtagatacatcctatacgtatttgatagtaatctatgcgattcgtatgtttgcagtgtctttactaatgatgcctatcaatacgaccgggataaatgcattgaaaactgaagacatttcccacggaacggcaattatgaactttggtcgtgttatggcgggatctctaggaactgctctaatggtcacttttatgagtataggtgctcaatgggttgtatcatcaagtgaacacgctagtaaagaaatgatccagcgacaaagtgttgctgtgggagttgatgtatcgttcgccttagtcactgtttttgtgattattgcttttgttctagcgttatttataaaggagcctaatcatttaactcacaatagtaggaaagtataa

SEQ ID NO: 2011 - DNA, 1215 bp, Staphylococcus epidermidis
aattacgtatacataaggagcgttatcatgttagacaaaaatcaattggaaaagtataaccaagagcatttgtatgaatatgaaaaattaatgagtagtaatgaaaagaatgctttagatgaaaaagtagatcagttaaatcttgcagaaattcaagatttatatcaagatttatatgttaatagaaaaactattgatgatgtatcttctgtatctgaagtcaaatatgaagtgaaatcgcgactcaatgaagaagaacgacatacatatgaacaaaaaggttatgaggcaatacgaaatggtgaatttgctgtattattgatggctggaggacaaggtacgcgtttaggatataaagggcctaaaggttcttttgaaatagagggtacgagtttatttgaacttcaggcgcgtcaactgattcgtttaaaagaagaaaccggccacacaattaattggtatattatgacaagtgacattaatcataaagatacaatagagtattttaaacaacataaatattttaactatgatgccaatcatattcatttctttaagcaagataacattgttgctttaagtgaagaaggaaagcttgttttaaatagagatggacatataatggaaacacctaatggtaatgggggtgtattcaagtctcttaagaaagcaggatatcttgataagatgcaacaagatcacgtcaaatatatcttcttaaataacattgataatgtcttagttaaagttttagacccgttatttgccggttttacagtgacacaaagtaaagacatcacatcaaaaacaattcaacctaaagatagtgaaagtgtaggtcggcttgtaaatgttgattgtaaagacactgtgttggagtattctgaattagatacagacatagcaaatcaatttaacaatgctaatataggtatccatgcttttaaactaggtttcattaccagtgctgttgatagagaattaccgtatcatttggcaatcaagcaattaaagcaattagatgaaaattttggtgtggttgaacgacctacattaaagtttgaattattttattttgatatatttaggtacggtacaagctttgtaacattacaagttccaagagaggaagaattttcacctttaaaaaataaagaaggtaaggatagtgtacatacagctacagaagatttaaaacgaatgggtttgatttaa

SEQ ID NO: 2012 - DNA, 429 bp, Staphylococcus epidermidis
ccaaaacttaaacctgcaaaaacaaccgcaaaagcaataagcaatgggagttttaagccaaacattatcatcagactactaactaataaaacaaaaaatgagcaaatatataatgtttttctagtaaaatgcgcttctattttacctaaattgaaattaagcgtaatccaagcaacagacaacgggaatattacaaatccactttgtaaaggtgataaactaagtttttcttgtaaatatactggtatatataaattatatcccatcagtgttatcgcaataagtaaatccgttataaaaactagaactattgatatgttaaattcttttgttggaagaaatggttgttcgatactattttctattttaaatagtagccataaaacagctaaagctaaaataattgagaatatgttaaaaataatatga

SEQ ID NO: 2013 - DNA, 228 bp, Staphylococcus epidermidis
catagtgataaatttaattctacctcttactatgtcaacttttttaaatccattcatatatattcaatccatttctatctttttatatccatatgtaatttaaagtatatcacattatatatatgcattattttgaataattacgtaaagaacactatacgctatttattaacttttagcaaatccattttaactctttttcatttaagcagttctattcgtatatga

SEQ ID NO: 2014 - DNA, 225 bp, Staphylococcus epidermidis; identical to SEQ ID NO: 237

SEQ ID NO: 2015 - DNA, 546 bp, Staphylococcus epidermidis
aatatgctaaaatatttttataaaggagaacaaaacatgacaggtaaaacacacgcatcatgtggctttttagtcggtgcaataaccacacaatattttcatacagatatatttacttctatatcagtgattgtactttcagtcatttcaagtatattgccagatatatgtcatacacaaagtaaaataggaagacgatttaggcttactagtttttttgtcagaattttatttggtcatagaacatttacgcattcacttttatttattataggaattagttttttactgtacttcatacaaactccgatgtattatatggttgcaattgttattggtatgttttcgcatgttatacttgatatattaacaccaagaggtgttaaactattatatcctttaccatttaatatcgtatcacccattcattttaaaactgggggactagtagatgtatctctagctactgcattaagtgttggtgcgatatatactttatttcaaccatatttaaatactatgatgcactattggttaatcaaataa

SEQ ID NO: 2016 - DNA, 1365 bp, Staphylococcus epidermidis
ttgaaagtaaatcaaccactttatttatcgttatatgaaaagttaaaaaatcaaattatcgaaggtcaatatcaatcaaatgatagatttccatctaaacgacagttaagtaactatttatctgttagccacactacaatagaacatgcatatcaattacttgtagatgagggtttcatttattcgaaacctagatctggctacttcgtttccgatatagaatcgttgccagtgatacatcgacaaacaaatcaattaaacactgataacttagaaaagaagcaacgacaatataaatatgcttttaatttagctgaaattgattctgaaagttttcctatgcacatttttagaaaatatgcgaaagacgtttttgaagaccatcagctatcactattacaacgaggcgagcgtcaaggggaatatattttaaggcaacaaatttcacattacttatttaatagtcgtggcgtcacttgtcacccaaatcaaattattgttggatcatcaacaagccagttactcgatatgataaccaatttactaaaaaaagaagaatttattattgaacagccaagttatccacctattaaacatacgcttgataaaaaaggtataagttatattcaagtcccagttgaacaaaatggaatacaaatcgaccctattttaaatacaaataacaatattttgtatataacaccatctcatcaatttccaactggttatgtcaccaatttaaaaaaaagaacacaattaatcaattggtcccatcaagctaagcaaagatatattatcgaagatgattatgattcagaatttagatattttggcaaacccatacctgcattacaaagtttagacacaaaaggaaaagtcatttatattagtactttctcaaaatctttatatccaagctgtaggattgcatatattgttttgccacaaaatttaatgcacaaatataataatcaaaaatataaagagggaaatacagtgcctgtgcatgttcaacacatggttgctcaattcatgataagtgggaaatttgaaagacatttgaataaaatgcgaaagatatatagagataaacttgattatattttaaaacgattaaagccctacaatactcaaataaagattgaaggcgcactaactggaatgcattttacaataactgttaataatggattgtcaatgaaacaatgtttaaaaaatgcgaaaaaaaataatttaaaattaaaaccttatcattacgaaaattattctaaagtttatccaaaatttattttaggatttggggggataaaaaaagaagaattagaagatcatgttaatgcattaattcattcactcgttatataa

SEQ ID NO: 2017 - DNA, 483 bp, Staphylococcus epidermidis
gggaggacaaaagtgatgaaatttttaaaaaataaatcatatcatttattagtaacacttattgttctcactatatttgttatttccggagcaatttttttaacatttttaggctttggtttgtacggtttgagtcgcatccttatttatttacacttaggcgattttagttacaataaaggcttttatgataatttaatatactacggtagttatatcgttttaggctattttactttattttcaattgagcatttaatggattattttaaaaagaatcttccaaaaaatccatactttcaaggtattaactttcatctcatctcctatattgttactacaattatgttttattttatagttcacatacactatgtacatgttaatatacatttttgggtaattatgattattataggatttttatttgtatgtaaagaagttttttatcctgaaagtaaaaatttgaataataaaaagtaa

SEQ ID NO: 2018 - DNA, 912 bp, Staphylococcus epidermidis
tcaataagaaaaggggtaagtagtatgtctaaaatagtaggatcagatcgagttaaaagaggaatggctgaaatgcaaaaaggcggtgtcattatggacgtcgttaatgcagaacaagctaaaattgctgaagaagccggagctgttgccgtaatggcattagagcgtgtaccatcagatattcgtgctgctggcggtgttgcacgtatggcgaatcctaaaatagttgaagaagttatgaatgccgtatcaattccggttatggctaaagccagaattggtcatattacagaagctagagttttagaatcgatgggtgttgactatatagatgagtctgaagtattaacgcctgcagacgaagaatatcatttaagaaaagatcaatttacagttccttttgtgtgtggctgtcgtaacttaggtgaagcagcacgacgcattggtgaaggtgcggcgatgttgcgtacgaaaggtgaacctggtactggtaatattgttgaagctgtccgtcatatgagacgtgttaattctgaagttagccgcttaacagttatgaatgatgatgaaattatgacatttgcaaaagatttgggtgcaccttatgaagtattaaaacaaattaaagataatggacgtcttcctgtagttaattttgcagctggtggtgttgctacgcctcaggatgcagcactaatgatggaattaggtgcagatggtgtatttgttggttcaggtatatttaaatctgaagatcctgaaaaatttgctaaagctatcgttcaagctacaacacattatcaagattatgagttaatcggaaaattggctagtgagctaggtacggctatgaaaggtctagatattaatcaaatttcactagaagaaagaatgcaagagcgtggttggtaa

SEQ ID NO: 2019 - DNA, 1380 bp, Staphylococcus epidermidis
atatatatgaatggatttaaaaaagttgacatagtaagaggtagaattaaatttatcactatgtcattgttagggattatattatttttagttcctataccagtcgttcaagatggaaagcagcaaacgacacttcctatagcttttttagctggtttattaaaagattggcttggtggtatcatgccaattttaattgtaaccatcataactgtatcaggtattttaacaatattatgctctacaatttataaaaataaattaaatcctcaaggtttaatgagcagtgctttcaacgttaaaataggatggcttgttttgagagtattagctgtcttcttttcttggttaacatttttaaatattggacctgaaatgattaaatctgaagatacaggtggattagtattttcaagtttattacctactcttgtagcagtatttttatttgctgcaatctttttacctttattaatggagtatggtctattagaattacttggacccatctttagacctatcatgcgacctttgtttactttacctggtagatcgacagttgataatctagcttcatttataggtgatggtacagttggtgttttaattactagtagacaatatggtgaaggatattactctagaagagaagcaacagtaatatccacaacctttagtgttgtatctattacgttcgctattgtcattgccgaaacaattagaatgcaagatcaatttttctatttttatttaacagttgtcatttcatgcttaattgcagcaatgattatgccaagaatttggccacttaaaaatattcctgacgaatatgctaaagaagtaagtgaagaggctcgtaatgaacagctaccagaaggcaaaacagcattaaaatatggttttgatttagcaactgaagttggaattaaatcgccagggtttaaagaatttttaatttcaggttttaaaacagttgtagatatgtggtttgtaattttaccagttgttatgagtataggaacaatagctaccattattgctaactacacgcctgtttttgaaattataggaaaaccatttgttccagtactagaattgttacaaattccagaagcacatgaagcatcacaaacaattttaattgggtttgccgatatgttcttaccttcaattcttattgaaggggttcaaaatgatgtaacacgttttgtaattggagcattgagtatctcacaacttgtgtatttatctgaagtaggcggcgtgattcttggttctaaaattccagttagtataagtaaattatttatgatttttttaattcgtactatcattacgcttccaataattgctttattagcgcatttatttatcggataa

SEQ ID NO: 2020 - DNA, 1047 bp, Staphylococcus epidermidis
gtaaggtggaaaacaatgactatggtgaataaagatagtcaatccgctattgaacaaaaaaagaaaaagcgcactacactcacttttattgtgggtgtgtgccttctttttatttcagtatatttgaatttagcgattggttcttcaaaaatacaatttaatgatattttaagttatgtaactggacacacgaatacaaaggcaactttcttaatacacaatgtacgtatgccaagaatgttagctggtttaattattggtggcgctttagcaattgcaggtttattgatgcaagcaattaccaaaaatcctttggcttcaccacagatttttggtgtgaatgcaggtgcttccttcgttattgtacttataactgtacttataccatcactaggctcttactctacaattttagcgataattggtgccttcttaggaggttttactgtttatacattgtctggctctactaagtcgattacaccgattaaattagcacttgcaggtatggctattcatctgttctttagtagtatgactcaaggtataattattttaaatgaagattctaatgatacagtgatgttctggttagttggttcattagccggtataaaatggcaacagattatattcatcttaccatttttactccttgctatttttgtgaccatatttatgggaagacaattaactatattagagttaggtgatgatattgccagaggattaggacaaagaacagaaatcgtcagaatgattgttggaatattggtcgttgttcttgctggtgtttctgtttctattgctgggcctataggatttgtaggtttgatagttccacacatagtgaaaagatatataaataaaaattatgtattgatgatacctttaacatttatattcggcgctactttattacttatttctgatgtattgtgtcgcttaattacttatccattcgaatcgccagtaggtattgttacatcatttgttggtgctttttacttcttattcataactgttagaggggtgaatcgcatatga

SEQ ID NO: 2021 - DNA, 1353 bp, Staphylococcus epidermidis
aaagggagtttttttatgaatcttaagtctatcattactgtaatggcactcatactaataatgtttatggcagctatagaaacatctattatttcattagcattaccaacaataaaaaatagtttgaatgccggtaatctagtttcattagtatttaccgtatattttattgctttagtcatagctaaccctatcgttggtgaacttatgtctagatttaaaattatttacattgctgttgtaggggtattattgtttgccttaggtagtttaatgtcgggattaagtcagacgtttacttttttaattatctctcgaacagtacaaggttttggagcaggagttatgatgtcactctcacaaatagttcctaagttggcttttgaaattcctttgagatataaaattatgggtatagttggaagtgtttggggaatttcgagtattattggcccattattaggtggtgcgattttagagtttgcttcatggcattggctattctatatcaatattcctattgctatagtggcaataatacttgtacttatgacttttcattttcctgatgagacacaagtacaacagagtcgttttgatataaaaggattgattatcttttatatctttatagctttattaatgtttggtttactcaaccaacatcatattatttttaacatattctcaattattttagctttagctgttttatggctactatttaaaatagaaaatagtatcgaacaaccatttcttccaacaaaagaatttaacatatcaatagttctagtttttataacggatttacttattgcgataacactgatgggatataatttatatataccagtatatttacaagaaaaacttagtttatcacctttacaaagtggatttgtaatattcccgttgtctgttgcttggattacgcttaatttcaatttaggtaaaatagaagcgcattttactagaaaaacattatatatttgctcattttttgttttattagttagtagtctgatgataatgtttggcttaaaactcccattgcttattgcttttgcggttgtttttgcaggtttaagttttggttatatttatacaaaagatagtgttattgtccaagaggaaacttctccaaaaaatatgaaaaagatgatgtcattttatgcattgacaaaaaatttaggttcgtcagtcggatctacgattatgggctatatgtatgcactaaatgttggtttatttggttctaatttacacaatgtattaggattagtcttaataattgcagtatgtttaattgtaatgtggatgacattatataaaagcaatactattcaatcttag

SEQ ID NO: 2022 - DNA, 225 bp, Staphylococcus epidermidis
gcacacggtttcaagttctctttcactccccttccggggtacttttcacctttccctcacggtactggttcactatcggtcactagagagtatttagccttaggagatggtcctcccagattccgacggaatttcacgtgctccgtcgtactcaggatccactcaagagagaatatgttttcgactacaggattattaccttctttgattcatctttccagatga

SEQ ID NO: 2023 - DNA, 183 bp, Staphylococcus epidermidis
cgagcttcttggcagattagaaaaagacctgtatggaagaaattaaacgctgtgaaaaatcaacgtgttgatattttagaccgtgacttatgggcaagatcacgtggtttaatttcttcagaagaaatggcaaaagaacttgttgaattatctaagaaagatagtaaaaaagataataagtaa

SEQ ID NO: 2024 - DNA, 207 bp, Staphylococcus epidermidis; identical to SEQ ID NO: 239

SEQ ID NO: 2025 - DNA, 231 bp, Staphylococcus epidermidis
acatacaatggaataagtaaagcaggtcctaccatagataacataatgatcatagaagtaattgtagaaaaacaaaatattttgttattaaatattttcaaatttaataatggattagaaattgtaatttgtcgtttaacaaaaatgccaatgatgattaaacttattaaaagtgaacaaagaacaattgggttagaaaaacctaggttaccagcactactgaaagcataa

SEQ ID NO: 2026 - DNA, 360 bp, Staphylococcus epidermidis
atgataaatattatattgaagaaaatagacttggaggtaattagaatgttcgttgttacaaatagaatcactgtaaaaaaaggatatgcaaaacaaatggcgcctaattttactaaaggaggacctattgaatctttaaagggctttgaaggtattgaagtttggcaaattgataaagatgattatagcgaagatatgtatgtaaatagttggtgggaaactgaagaagattttaaaaattgggtgaatagtgatgtatttaaacaagcacataaaaatactggaaaatccgaagattcaccagtcattaaaagcgaaattgttaaatcaaatgttttatcttctttgaacagaagataa

SEQ ID NO: 2027 - DNA, 279 bp, Staphylococcus epidermidis
ttaaaggaagtgttttcaatggcaatgacagttaagaaaaacgataatgaagttcgtattcaatggagagtagcagatatcaaaattccaaataatgaaattaaaaatgttactcaagatcaagatattcatgccgtaccagaagagaatggtaaagaaatctctcgtattggttctactttcggaaaaacaaatcgcgtattaattgataccgatcaacacttatatattatttacactcaaaatgatcaaaaagtatataatgagttaacaaaataa

SEQ ID NO: 2028 - DNA, 189 bp, Staphylococcus epidermidis
gcagttctattcgtatatgatttatatttttattttttaatgggccatcaaaatgatattgtgacatcaataagagcctgtacattaatttgtaatgtatcaggctctataactaaaaaatacgatattgaaactatcaaatttactacatcttacgtaataaaaataagaaataaggtgcgcctataa

SEQ ID NO: 2029 - DNA, 516 bp, Staphylococcus epidermidis
tctaatggctccaaatactctaaagaatcttcaaaatcatcgtttaaatcatctttcacaaaacgttttgttacttcgtgttgtggattctcaaatactttacttaccgctccctgttcgataactttaccgttttccattacagcaacttcatcacaaattcttcgtataacatgcatttcatgtgttataagtacaatagttaaattttgttgttcccttaccttcaataataaatctagaatttcatctgtagtttgtggatctaatgcacttgttgcctcatcgcataacaatacatctggatcattagctaatgctctcgcaatacccactctttgtttttgtccgcctgataattcagacggatacgcactttctcgaccttttaggccgacaagttcaatgagttccaatgctttttgtttagctagaccacttggaacgccagcaatttctaatggaaatgttacatttttcaatacatttcttgaccatagcaggttaaaatgttga

SEQ ID NO: 2030 - DNA, 249 bp, Staphylococcus epidermidis
cttatgtttccgttagtggagttctgtatttcaaatatggccaaaggtagtgatgttgtatttgaaaaattagaaaatgatcctaacatagatgtccttgaatacggttgtctacaaaattgtggtctatgcgcaagtagcttgtatgcccttgtagatggtgatattgttgaaggtaacacaccagacgatttattaaaaaacatatatcaacatatcgaagataatgatataacgaatttgttataa

SEQ ID NO: 2031 - DNA, 762 bp, Staphylococcus epidermidis
atgtcatcaacattagagattaaggacctacatgtgtctatcgaggataaagaaattttaaaaggtgttaacttaacaattaacactggtgaaatacacgcaattatgggacctaatggtactggtaaatcaacattatcgtcagcaattatgggacatccaagttatgaagttacacaaggtgaagtattattagatggcgttaatattttagagttagacgttgatgagagagctaaagcaggcttatttttagctatgcaatatccatcagaaattacaggggtaacaaacgcagattttatgcgctcagcaattaatgcgaaacgtgaagagggacaagaaattaatttaatgcagttcatcaagaaattggataaacaaatggactttttagatatcgataaagatatggctcaacgttatttaaatgaaggtttctctggtggagagaaaaaacgaaatgagattttacaattaatgatgttagaaccgaaattcgctattttagatgaaattgactctggtttggatattgatgctttgaaagtggtttctaaaggtattaatcaaatgcgtggtgaagagtttggagcattaatgattacgcactatcaacgacttttaaattatattacaccagataaagtacatgtgatgtacggtggtaaagttgtgaaatctggaggtccagaattggctaaacgccttgaagaagaaggctatgaatgggttaaagaagaatttggtgctgctgaatag

SEQ ID NO: 2032 - DNA, 294 bp, Staphylococcus epidermidis
cttaatgcgacttctgcgccatctactatattttttccaaaaacattaattactttttctaaattcatacctgatattaatccaccgacaagtgcactaataaataagctaatgaccacatttaatcgacataaacatagtatgatcattaatatgactgcgattacaacagcatttatcattctgcctcaccctttatcactctatcgaactaaagtatttataaaatatatactagcaagacatatatttaatgtcaatgttaaaaaagactcaacgattatatacatttag

SEQ ID NO: 2033 - DNA, 198 bp, Staphylococcus epidermidis
atggtgaatcaacacaagatttccaatatgttaaccgtggaaactgtatgttcattaggtgctaatgatggtgttggaattgtatatggtagagatatcgctggtaaaaaagcagcattcttgaagaaagttattgatactcgtgcgatttacaaacttggtggcataggattagcctttaaaaaaggaaaattttaa

SEQ ID NO: 2034 - DNA, 225 bp, Staphylococcus epidermidis
aatggattccactgtaaaagtgttgaagatattacagaaacacaagctattgcaaataatgaagttaaaggtaaagatttgattaagcatatcaaaattactttgggtgacttcaaagattttcaagttaaacatgattttgatgatgcgaacttattgaatatgattgcacctgtagctacaatggcttcaaaagtgaaagatatgccgagtgattgctactaa

SEQ ID NO: 2035 - DNA, 783 bp, Staphylococcus epidermidis
ctagtgaaacattatcaggcatacttaatcgatttagatgggacaatgtataaaggcacagatgaaattgacggtgccgcacaatttatagattatttaaataataatcatatcccgcatctatatgtaactaataattctacaaagacacctgttcaagttactgagaagttacgtgagatgcatattgatgctaaaccagatgaagttgtaacttcagcattggcaacagcggattatatctctgaacagcatccaaatgcaactgtatatatgattggtggtcatggactcataactgcactaactgatgcaggactttcaataaagaatgatgaacatgttgattatgtagttattggtttagatgaaaaggtaacatatgaaaaattatcaatcgcaacattagctgtacgtaatggagctaaatttatatctacaaatccagatgtatccatacctaaagagagaggttttttacctggtaatggtgctattacgagtgtggtcagtgtctctactggcattcagccagagtttattggtaaacctgaaccaattataatgtctaagtctttagatatacttggattagaaaaatcagaagttgcaatggttggtgatttatatgacacagacattatgtcaggtattaacgtgggtattgatacgatacatgttcaaactggtgtgagtacgtatgaagatattcaatctaaagaaataccgcctacgtattcatttaaagatttaaatgtagctattgcagaattagaaaaataa

SEQ ID NO: 2036 - DNA, 1362 bp, Staphylococcus epidermidis
agtacaattaagtatataaattttaaagagggggatcatgttatggaattaacaatatatcacacgaatgatattcatagtcatttaaatgaatatgctcgtattcaagcttatatggcaaaacatagaccgcaacttgaacatccctccctctatatagatataggtgaccatgttgatttatcagcacctgtgacagaagctacggtaggacataaaaatatagaacttttaaatgaagcacattgtgatattgcaaccattggaaataatgaaggaatgacaatttctcatgatgctttacaaaatctatataacgacgcggattttaaagtgatttgcacgaatgtcatagatgaagagggacatcttccacatcatattacctcttcgtatatcaaagaaataaaaggaacacgtattttatttgttgcagcaacggcaccgttcacacctttttatcgagcactggattggattgttactgacccattagcggcaatcaaagatgaaatcaatgcacatcaaggtgaatatgatcttttaatggttatgagccatgtcggtatcttttttgatgaaaagttatgccaagagattccggaaatagatgttatctttggtagtcatacgcatcatcattttgaacatggagaaataaacaatggtgttttgatggcagctgccggaaaatatggctattatttaggtgaagttaatattacgattgaaaatggaaaaatcgttgataaaatcgccaaaattcatcctattgaaacacttcccttagtcgagacacattttgaagaagaaggaagagcacttctaagtaaaccagtagttaatcatcatgtgaacttagtcaaaagaacagatgttgttacaagaacatcgtatttactggctgaaagtgtatatgagttttcaagggctgattgtgcaatcgtaaatgctggacttatagttaatggcattgaagctgataaagtgacggaatatgatatacatcgcatgttaccccatccaatcaatattgtaagagttcgattaaccggtaaacaattaaagcaagtgattcaaaaaagccaaaagcaagaatatatgcacgaacatgcacaaggtcttggttttagaggggatatatttggaggatatattttatataatctaggctttattgagtcagaagaccgttattttataggcgatgaagagattcaaaatgataaacaatatacgttaggtactgttgatatgtatacatttggaagatatttcccattgctaaaggggttatctacagattatattatgcctgaatttttacgtgatatttttaaagagaaattactaaaattataa

SEQ ID NO: 2037 - DNA, 699 bp, Staphylococcus epidermidis
aacatgggtaaatcttatggtgaaatatttcacgaaatggtgacaatgccaaatgttcagtggccagaggtttggcaggcaattttagaaactctatatatgactgttgtttcgacgctttttgcatttgtctttggacttatattaggggtattactctttttatctgcgaaaagtaactcattggctgctaagattttctacacgattgtgtcattcattgttaatttatttagagcaattccatttatcatattaattttactgttaattccatttacaagtatacttctcggaacaatcagtgggccaactggtgcattaccagcacttattattggtgcagcaccattctacgctagattggtcgagattgcttttaaagaaattgataaaggtgttatagaggctgcttggtcaatgggagcgaacacttcgatagttgtgagaaaagtgctacttcctgaagcaatgcctgctttaatttcaggtattaccgttactgcaattgctttggtaggttctacagctattgcaggtgttattggcgcaggcggtttaggtaatttagcatatttaacaggatttactcgaaatcaaaatgatgtcattttagtttcaacagtatttattttaattattgtatttataatccagttcctaggggattggcttacaaataaaatcgataaacgctaa

SEQ ID NO: 2038 - DNA, 450 bp, Staphylococcus epidermidis
agaggtgacaagcgaatgtattttgtagataaagataaactaactcagaaaatcacttacttacaaaagctcactgaagattacaatgataataaaaggaacctatatgcttttgaacgaattggtcaaatgttaattgaatcttctgtagatattggcaatatgattatagatgggtttattttaagagatcctggtaattataaagatgtaatagatattttagaattggaaaatgttatttcaaaagaaacacaatcacatatcaatcgaactattgatgttagaaaacagtttgcacatcactatatcgatttaaatatgaataaaattgagccgttatttgatgatgcactaccatactataagcaatttattcaagaagtaggacaatttttagaaaatgaaaatgtaccaattaccgcatttggaaaaggagcgaataactag

SEQ ID NO: 2039 - DNA, 1056 bp, Staphylococcus epidermidis
tacgaactaaatcttaaggagaaatgcatcatgattattgcaattatactattaatatttgtttcatttttcttttcaggtagtgagacagcattaacagccgcgaatcgcactaagtttcaaactgaagctaaaaagggtgatcgtaaggcgcaaggtttaacaaagttattagataaaccaagtgaatttatcactactatattaatcggtaacaatgtagcgaatattattttacctacactcgtgacaatcttagcgattgatattggagtgaatgtgggaatagcatcagcaattgtaacaattgtgattatacttatttctgaagtgattcctaaatcaattgctgcaacatttcctgataaaatttcaaaacttgtgtatcctatcattcatatatgtgttattgtactcaagcccattacaatcttattaaacaagatgacagatggtattaatcatttactatctcgaggccaacctgttgaaaaaagattttctaaagaagaaattcgtacattattaaatattgcgggtagagaaggtgcatttaatgagatagaaaatactcgacttcaaaacgttatggactttgaacaattgaaggttaaggatgttgataccacgcctcgtattaatgttgtagctttttcaaaggaagtaacatatgacgaagcttatgatacagtgatgaataacccatatacaagatatccagtatatgatgaaaatatagatgatatcatcggcgtattccactcaaaatatttattagcttggagtaaacataaagaggagtcaattactaattatgcatcaagccctttatttgtaaatgaacataatagggcagaatgggtattgcgtaaaatgaccgtttcacgaaaacatttagcgattgttttagatgaatttggaggtacggatgctatcgtatcgcacgaagatttaatagaagagctacttggtatggatattgaggatgaaatggatcgtgaagaagaaaataaattaaaacatcaaaaatttccgcaaagcatgatgcatcgttaa

SEQ ID NO: 2040 - DNA, 1068 bp, Staphylococcus epidermidis
tcaatgaaaaacttagtattactaggcgggggctatggtaatatgcgaattatgtcgcgcattttacctcattcaattcctgagggatatcacttaactttaatcgaccgcatgccattccacggtttaaaacctgaattttatgcacttgcagcaggaactaaatctgacaaagaggtgcgaatccaatttccagatagcagtcaaattaatacggtttatggggaaatcagtgatatagatttggacgaacaaatgataacagttggaaattcaaaaatagattatgacgaacttatcattggtctagggtgtgaggataaatatcataatgtccctggtgctgaagcatatacacatagcattcaaacattatctaaatcgcgtgaaacataccatagaattagcgagttacctaaaggggcacgtgtaggtatcgttggggcaggtttaagtggcattgaattagcgagcgagctacgtgaaagtcgatcagacttggaaattttgttatatgatagagggcctcgaattttaaggaattttccagagaaactgagtaaatacatatctaattggttttctaaacacaatgttactgtagtacctaattcagtcatcgacagagtagaacccggaaaaatttataataatggtaaaccagaaaatattgatttagtcgtttggacagcaggcatacaacctgttgaaattgtgcgtaatcttcctattgatatgagtaccactggacgcgtgattattaatcagtaccatcaagtcccaacctatagaaatgtttatgtcgtaggtgactgtgctaatttaccacatgcacccagtgctcaactagcagaactacaaggtgaacagattgctgaggtgttgaagaagcaatggaataacgaaccacttccagataaaatgcctgaaattaaagtacaaggctttttaggctctttaggtgacaaacaaggttttgcttatatcatggatcgaacagttaccggacgattagcctctattctaaaatcaggtgttctgtggcgctataaatatcataatggttaa

SEQ ID NO: 2041 - DNA, 840 bp, Staphylococcus epidermidis
acgctaaagaaaaggggattatattctatgaaaaaattattcggaattattttagtattggctttaacgattgccttagctgcatgtggtggaggtaaagataaggaaaaaactatcacagtaggtgcatctccagcaccacacgctgaaattttagaaaaagcaaaaccattattgaagaaaaaaggttatgatttaaaaatcaaaccaattaacgattacacaacgcctaataaattattagacaaaggtgaaatcgatgcgaacttcttccaacatacaccatacttaaatactgaaagtaaagaaaaagggtataaaattgaatcggctgggaatgttgaattagaacctatggctgtatactcaaaaaaatataaaagcttaaaagatcttcctaaaggtgcaacagtatatgtatcaaataacccagctgaacaaggacgattcttaaaattctttgtagatgaaggtcttattaaacttaaaaaaggcgttaaaattgaaaatgctaaatttgatgacataactgaaaacaaaaaagatattaaatttaacaacaaacaatcagcagaatatttaccaaaaatctatcaaaatcaagacgctgacgcagtaatcattaattctaactatgcgattgaccaaaaattaagtcctaaaaaagattcgattgctttagaatctcctaaagataacccatatgcaaatttaattgcagttaaaaaaggtcataaagatgataaaaatatcaaagtattaatggaagtgctacaatctaaagaaattcaagattatattaaagataagtatgatggagctgtcgtacctgctaagtaa

SEQ ID NO: 2042 - DNA, 1287 bp, Staphylococcus epidermidis
tacctcctagaggggaaactcatatatagaaaggtcgtgactataatggccgaacattcttttgatgtcaaggcagtcattaaagactttccaatacttgagcaaaaggtaaataataaacgtttagcataccttgattcaactgcgactagccaaacacctgtacaagttttaaatgtactagatgattactacaaacgctataattctaatgtccatcgtggtgtacacacattagggtctttagctacagatggctatgaaaatgcaagagaaacagtaagacgttttatcaatgcgaagtactttgaagaaattattttcactcgaggaacaactgcatcaataaatatagtagcacatagttatggtgacgctaatattagtgagggtgacgaaattgttgtaacagaaatggaacatcatgctaatattgttccatggcaacaattagctaaacgtaaaaatgcaacactaaaatttattccaatgacaaaagatggtgaattgcaattagatgatataaaagcaaccatcaatgataaaactaaaattgttgctatcgcacacgtttccaatgttttaggaacaattaatgatgttaaaactatcgctaaaattgcacatgaacatggtgcagttataagtgtggatggtgcgcaatcagctccacacatggctttagatatgcaagatatcgatgctgatttttatagttttagtggacataaaatgttaggtcctactggcattggagttttatatggaaaaagagaattattacaaaatatggaacccgttgaatttggtggagatatgatagacttcgtaagtaaatatgacgccacttgggctgacctaccaactaaatttgaggctggcacaccacttattgctcaagcaataggtttagcagaagctatacgttatattgaaaatttaggttttaatgcgattcatcagcatgaaaaagaattgacagaatatgcatatgaacaaatgttaactatagatggtcttgaaatttacggtccaccaaaagatagacgtgcaggggtcattacttttaatttagcagatatacatccacatgatgtagctacagctgttgatacagaaggtgttgcagttcgtgcaggccatcactgtgcgcaacctttgatgaaatggttaggtgtttcttcaacagcacgtgcaagtttttacgtttataatacgaaagaagatgtagatcaattagttcaagcattgaaacaaacgaaggagtttttctcttatgaattttaa

SEQ ID NO: 2043 - DNA, 1176 bp, Staphylococcus epidermidis
gactataaagaaagagacaatttggcttgtcatatgtttatagcctttatctacattgttggttggttaaaatattatgaaagcttaggtgaattagagatggctcaagatcgtaagaaagtgctcgtattaggtgcaggttatgctggtttacaaactgtaactaaattacaaaaagaactttctgctgatgcagcggaaattactttaattaataagaatgaatatcattatgaatcaacttggttgcatgaagcttctgccggtacgattaattatgaagatttattgtatcctgttgagaaaactgtcaacaaaaataaagtgaattttgttgttgctgaggtaacaaaaattgatcgtaatgctaaacgtgtagaaactgataagggtgtttatgactttgatatcttagttgttgcactaggttttgttagcgaaacatttggtattgatggtatgaaagaacatgctttccaaattgagaacgttttaacttctcgtaagttgtctcgtcacattgaagataagttcgcaaattatgctgcttctaaagaaaaagatgataaagatttatctattttagttgggggagctggatttacaggaattgaatttctaggtgaattaactgatagaattcctgaattatgcagtaaatatggtgttgatcaaagtaaagtgaagttaacatgtgttgaagcagcacctaaaatgttaccgatgttctcagacgacttagttagttatgcagtaaaatatttagaagaccgtggagtagaattcaaaattgcaacacctattgtcgcttgtaatgaaaaaggtttcgttgttgaagtcaatggagaaaaacaacaattagaagccggaacttctgtatggactgctggagtgcgtggaagtcatttaatggaagaatcatttgaaggtgttaaacgtggacgtattatcaataaacaagatttaacaattgaaggtcataatgacatctttgttataggagattgttcagcgtttattccagctggtgaagagcgtccattaccaacaacagctcaaattgctatgcaacaaggtgagcatactgctagcaacattaaacgtttattaaatggtgaatcaacacaagatttccaatatgttaaccgtggaaactgtatgttcattaggtgctaa

SEQ ID NO: 2044 - DNA, 192 bp, Staphylococcus epidermidis
atggctgaagataaatttgaacaagctaaaggtaatattaaagaaacagtaggtaatgctactgataataaagaattagaaaaagatggtaaaggtgacaaagcttctggtaaagcgaaagaagctgtagaaaacgttaaagaaaaagcaaatgacgttattgataaatttaaaggtaataaaggtgactaa

SEQ ID NO: 2045 - DNA, 243 bp, Staphylococcus epidermidis
ttaattatggaatttagagaacaagtattagatttattagcagaagtagctgaaaacaacattgtgaaggaaaacccagatgtagaaatctttgaagaaggtattattgattcatttcaaactgtaggtttacttttagaaattcaaaataaattggatattgaagtgtcaattatggactttgatagagatgagtgggcaactcctaataaaattgtagaagctttagaagagttacgatga

SEQ ID NO: 2046 - DNA, 258 bp, Staphylococcus epidermidis
aaggagacatgtcacatgcctactgagaatccaacaatgtttgatcaagtagcagaagttatagaacgtttgcgtccattcttattacgagatggtggcgattgtacgcttgtagatgttgaagatggtattgttaagctacaattacatggcgcttgcggaacatgtcctagttctacaattaccttaaaagctggcatcgagcgtgcacttcatgaagaagttccaggtgtaatagaagtagaacaagtattctaa

SEQ ID NO: 2047 - DNA, 1050 bp, Staphylococcus epidermidis
agatttaaatgtagctattgcagaattagaaaaataaaatatcatctatctgtttttgaaattaatagaggtgtgcatatgaataaaatactcgtaacacgtcaaattccacaacactacgtagagcaacttaaaaaaataggacaagttgtcatgtgggaacacgatttaacgcctatgtctagagaatcatttcttgctaacgttgaagatgcaacagcatgtgtgatcacattgagtgagcatattgatgaagaagtatttctcagggcacaacaacttaaagtgattgctaatatggcagtaggttttgacaatattgatatttcattagcaaagaaacatggtgtagttgttaccaatacacctcatgtactgacagagacaactgccgaactagggtttacattgatgcttactgtagctcgtagaatcattgaagcgacatcatatattcaaaagggtaagtggaaaagttggggcccctacttattatcaggaaaagatgtatacggtgcaactgttggtatttttggaatgggtgatataggaaaagcgtttgcacgtcgcttacaagggtttgatgcacggataatatatcacaatcgcaaacgtgacttaaatgctgaaagagatttaaatgctacatatgtaacgtttaaatctttacttgaacaaagtgattttattatttgcacagcacctttaactaaggaaactgagaatcaatttgatgctcgagcttttaataaaatgaaaaatgatgctgtcttcattaatattggaagaggtgcaattgtagatgaggaagcacttttagaagcgttaaaaaatcatgagatacaagcctgtggtttagatgttatgcgtcaagaacctattcaacctaatcatccaatactgaaattacctaacgctgtggtgttacctcacataggaagtgcatcccaagtcactagaaatcgaatggtacaactttgtatagataatattaaagcagtattaaataatgatgcaccaataacccttgtaacctctttacacttttaa

SEQ ID NO: 2048 - DNA, 1239 bp, Staphylococcus epidermidis
gaaaattgccgaggttgtaaacggatgataccttatggcacatttacatttttcttaattgcatttatcgttcttatacctgtgataatacttggattcttaggtaagcgaagttatatttacaatggtataagtacagcaatcatgattgtcattatattcgcatcagataaacataatctgttagggcaaaaatatctaagtgcacaacttttttgttttattatttatgtcatatggcaggttgccctcattatgtactactatcaatcacgacaaaagaagaatacttttacaaaatttgtaacaattatggtgttgtctattctccctctagcaattgttaaaatattacagagttcatggttaggtggacatcaaattcacttccatgaaagtaaattaattgaatttgtaggatttttaggtatctcatacgtcactttcaaaagtgttcaattaattatggaaattcgtgatggttctattaaagaaatcaaggtagggaaattgatacaattcatttcattcttcccaaccatttcatctggacctattgatagatataaacgttttgtgaaagatgataagaaagtacctagcggtgcagagtacagagaacttgttgtcaaagcaattcatatgattatgttagggttcttatataaatatattattgcgtatttgattcagacttacgctgttaatcctttacaacttaacctgcatggatttactcatatgtggctatatatgtacgcttatagcttatatttattctttgattttgctggatacagtttattcgcaattgcagtgagttatttatatggtattaagacaccgcctaactttaaacaaccgtttaaagccaaaaatattaaagatttctggaatagatggcatatgactttatctttctggtttagagattgtatctatatgagatctttattctacatgtcacgtaagaagttattaaaaagtcaatttgcaatgtcaaatgtagcgtactttttaaactttttcataatgggagtatggcatggtcttgaagtatattacattgtatatggattataccacgcagcgttattcataggttatggttattatgagcgttggcgtaaaaagcatccaccacgttggcaaaatggtttcactacagctataagtattatcattaccttccattttgtaactttcggattcttaattttctcaggcaaatttatttaa

SEQ ID NO: 2049 - DNA, 255 bp, Staphylococcus epidermidis
cgaatcatcagtaatatcgacacaaatatcataaacacgccaaagtataagttaaacgaatcaagtgtaaggtatctacttaaaaaagaaccaaccaaagatccaggtagtagtccaaatagaaatatcgaaccattttttatatctacttgtttggtttttaaatatcctaatgaggaagataatccagtaacaatcagaataactgaagaagtacctattgcaatttgcgtcgtaataccatgtagaagatga

SEQ ID NO: 2050 - DNA, 282 bp, Staphylococcus epidermidis
aggagcgtcagagttatgatagatatgtacttatatgatgatgaagaacaaagccaagtacagttcgtcggctttgttggtgagcatagtcgttacgacttaatgcttgtacaaacggatagacattatggtaaaactttagttttaaatatgcagacaaatcaatttggcattataggttcagatgatatagaagaagaaggttacatttctcatattttaggagtatcaaaggaagaagcggatgaaattattgaatatttaaatgaagttattcaatag

SEQ ID NO: 2051 - DNA, 213 bp, Staphylococcus epidermidis
tcaacatcaaggcaacaaataatattattaaccgaaataaaattaagtgagctaggtacagaattcgttatttcatcccgtgtaacgagatttataaaggaaatacctcgacgtaatgtatttttcgtttacttctttgatagccagtatataaaatgcttaggaacaatgttttgtatcctaagcattttattgttttatttagcatcatag

SEQ ID NO: 2052 - DNA, 489 bp, Staphylococcus epidermidis
aacaaacgaaggagtttttctcttatgaattttaataatttggatcaattatatagatctgtaattatggatcattacaaaaaccctagaaacaaaggtgtcttagacaatggctcaatgactgttgatatgaataaccctacatgtggtgatcgcatacgtttgacatttgatattgaagacggaatcattaatgatgctaagtttgaaggagaaggatgttcaatttcaatgtctagtgcatctatgatgactgaagcagttaaaggtcattcacttggtgaagcaatgcaaatgagccaagagtttactaaaatgatgctcggtgaagactacgagattacagaagaaatgggagatattgaggcgcttcaaggtgtctcacaattcccagctagaattaaatgtgcaacgcttgcatggaaagcattagaaaaagggacagtcgaaaaagaaggtaagtcagaaggtacaacggaagaagattaa

SEQ ID NO: 2053 - DNA, 1266 bp, Staphylococcus epidermidis
aattgtagaagctttagaagagttacgatgaaactgaaaccattcttacccattataatcagtggcgtcatatttattatatttttatttttaccagcaagttggtttactggtcttgtgacaaataagacgttagctgataatagaatttctttaactgatcaagttttaaaaggcacgctcattcaaaataaattattcgagtcaaataagtattacccgatttatggttcaagtgaactggaaaaggatgatccttttaatccaggtatagcgctaaataaacaaaatgctagtaaagaaacgttccttattggtgcgggaggttcgacagatttaattaatgcagttgaacttgcagcgcaatacgacaatttaaaaggaaagaaatttacatttattatttctccacagtggtttacgaatcatggattaacaaatcaaaactttgatgctcgtatgtcacaaagtcaaatcaatcagatgtttaatcaaaaagatatgccagctaatttgaagaaacggtatgcacaaagattgttacagtttccgcatgcacacaataagtcataccttagagaacaagcaaaacatcctaatgatgtctctggaaactacatttcttcatttaaagaaaatcaattaactaagattgaagctattaaatcattattctcattcactaagccacctctagcagaagtaaaacctgcaacaagagaagatgcttcatgggatgagatgaaacataaagctgccgatataggcaaagcaaatactcaatctaataaatatgatataagagatccatattggaaattgataaaacaaaacaagcgtaaaatcaaaagggattatgagttcaacattaactcacccgagttccaagatttaaaattattagtgcaaacgctacatgctgctggagctgatgtacaatatgttagtataccttcaaatggaagatggtatgatcatataggtatcaaaaaagatagacgtgaagctgtatataaaaagattcactcaactgtagttgataatggtgggaaaatttatgatttgacaaacaaggactatgaaaagtacgtaattagtgatgctgttcatattggatggaaaggttgggtttacgtcgaccagcaaattgcaagacatatggatggtcatgcgcctaaaaatcatgaagtcgattattctaaaaataaaccaccgcacaaacatcacaacgatcgtcaagatgatcaacatcaaggcaacaaataa

SEQ ID NO: 2054 - DNA, 1074 bp, Staphylococcus epidermidis
gaaagcatttttaatttgattactaagcaacataaggaggctattaacgtgattaagctaaaccaaattgttaaacgctatcataccaaggataaagatgttcttgctgttgatcacgttgatttaaacattgaatccggctctatttttggtgtgattggtttctcaggagctggcaaaagtacgcttataagaatgtttaacaacttagaatctccaacgtcaggtgaaatcattatagatggtgacaatataagtcaattatctaaatcacagttacgaaaaaaacgacaaaaagtgagtatgatttttcaacattttaacctgctatggtcaagaaatgtattgaaaaatgtaacatttccattagaaattgctggcgttccaagtggtctagctaaacaaaaagcattggaactcattgaacttgtcggcctaaaaggtcgagaaagtgcgtatccgtctgaattatcaggcggacaaaaacaaagagtgggtattgcgagagcattagctaatgatccagatgtattgttatgcgatgaggcaacaagtgcattagatccacaaactacagatgaaattctagatttattattgaaggtaagggaacaacaaaatttaactattgtacttataacacatgaaatgcatgttatacgaagaatttgtgatgaagttgctgtaatggaaaacggtaaagttatcgaacagggagcggtaagtaaagtatttgagaatccacaacacgaagtaacaaaacgttttgtgaaagatgatttaaacgatgattttgaagattctttagagtatttggagccattagatcatgatgcatatatcgtgaggttaaactttactggtgaaaatacgactgagcctatcatatcttatatgacgaagacgcataacatagatgtgaatattcttgaagcagatattaagaatactaaaaacggttcgcttggatttttagttattcacataccacatataagtgaagaacatttcaagcaatttaaacataatcttcacgaacaacacgttaatgtggaggtgctaaaacatgggtaa

SEQ ID NO: 2055 - DNA, 1524 bp, Staphylococcus epidermidis
cttataattattgttatacagaatgaggaacggaggatctatatgcaattttttattaatcaagatacgccaacatcaattgaaacgattgtggtgggtgtgccagatcacctcaaccaattaggtgagataaaatatcataagacgttaattaaagaacgattagaaacattaaaacaatatcatgtcatcaatagctcaatcggcaaaatatcatcaacgcttatctacattgatgaaaagcctaaaagattattaactgtaggactaggaaacttaaaaatcttatcatatcaacgtttattaaaagtttggggtcagttgtttcaatatttaaaagacgttcatgtcacggattgtgaattattgttagatactttcaaatctaaacatggtaacattgttgaaatttgtcaaactttaggtttacaaagtgcacaatctatctttgaatttgaccattataaatcggataaaaagcctccatatcaaggtagagtctatatacaaacgacagagcataatatagaaacgaagattaacgaaggccaacaattgggtgaatctataaattatgctcgtgaactaagtcaaatacctccgaatattttaacaccccaatattttgccgaagaaataaaaaaacatttcgaagggagttccgttagtgtagatatcaaagatcaccgacaaattatagatgaaggatttggattaatacatgcagtaggtaaaggttctaatcatggtccgagattaattacggtatcatactatggtgcagaagctgatgaaccacctatttcattagtgggtaagggtattacatatgattccggtggatatagtattaagtctaagataggtatgcaaactatgaaatatgatatgtgcggtgcggccaatgttattggtatgattgatgtgatctctaagcaaaacctacctgtaaatattgtaggaataatcgcttcagctgaaaatatgattggtgaatcttccatgaaaccagatgatgtatttactgcgcttaatggggaaacagtagaaatgttgaatagtgatgctgaaggtagaatggttttaggtgacgcagtattctatgcaacacaatttaaaccacaactaattcttgattttgctacattaacgggtgcagcgattgtagctttaggtgatgacaaggcggctgctttccaatctcatgctgaaaatgaacttaaaaacttattaacagttgcacgtcatgtagacgaaaaagtattcgaattacctattacagagactgaaagacatttaattaaacaatcagatgtagcagatttagtcaatcatacgaacggtcaaggaaaagcattgtttgcagcagcatttatttcgcattttagtggtgacatcccacacattcactttgatatcgcgggccctgcaacaactaaaagtgctacatataaagggccaaagggtccgacaggttacatgatacctacagttgtagagtggttacaacaaaaatataaataa

SEQ ID NO: 2056 - DNA, 873 bp, Staphylococcus epidermidis
aaggagattattatgaaaaaattcaaatggataaatatatttaaaggttttggtatgggtacaagtgatctcgtcccaggtgtaagtggagggactatcgctttattacttggaatttatgatgactttattagctcaattagtggtttgttttcaagacgattttggcctagcttaaaatttttactacctattttagtagggatgctaatagctataggactattaagtcaattatttaattatttgcttagtcaacatcatattcctactatgttattttttacaggtttgattctcggtatcatcccttatttattaaccatctcaaatttcaaaaaaaatttcagtataatacattattttattctattattaggtattgctattatagtcgttttcgcattgcttaatcatggagacaagcattcaggtgaaacacttactttatctttcagtcttatcattaaatattttatcgcaggtgttttcgcttcaagtgctatgttattaccaggcatttctggatcatttatgttacttgtcttcggagtatatgggacgctaatgtatgctatttctgaactacttcattttaatttaaatgcattacctatcatattaatagtaggtttcggtattgtaactggttttatgatttcaagtcgattaattcaatattgtctacatcaacaccctacaatgacatttgctttgataataggctttgtaatcggatcgttgtatgcagttttccctggattcccgaaagacttaatccaatggatcatatcatttttcctattgatcactggcttcttagtaagttatgttcttggtaaaattacagcaaaaaatgaagcatcattttga

SEQ ID NO: 2057 - DNA, 399 bp, Staphylococcus epidermidis
ggtgaaaatatgattaaagtcgaccaacaatattttgaattgatagaagaatatagagaatgttttgatgaggaaatattttcagctaggtattcggatatattagacaaatatgattatgtcgtaggtgactatggttacgatcaattacgcttaaaaggattttataaagatagtaataaaaaggcagaaataagtaaacgattttcaagtatacaagattatatactagaatattgtaattttggttgtccttattttgtagtcagacgattgtcaccaaatgaatttattgaagaaatagatgataaagaagatatcattgataaattacatgatgttaagattcaacctactattcaagacacagaaaaacatacccaagctatagatcaatag

SEQ ID NO: 2058 - DNA, 876 bp, Staphylococcus epidermidis
tgtggtatcatgttgttggtgataaatatgatagaaataggtcttactggctggggtgaccatgatacattatatgaggatttagagcgtaaaacagataagttaaaaacgtatgctagtcacttcccaatagtagagttggatgcttcgtattatgcgatacagccagagcgaaatataattaaatggataaatgaaacgccgaatagatttcaattcgttgttaaaattcatcaagcattaacattgcatgctgactatagagattatgcagagtcgagagatatattatttaaacagtttaaagaaatgatcaatccgttaaaagagcataataaattggcgatggtgctcgtacaatttccaccttggtttgattgtaacgtccaaaatataaattacatcttatatgtgagaaaacaattaactgatattccgatgagcattgaatttagacatcaatcatggtttgacaatcagtataaagaacaaactttatccttcttaacacaacatcaaatcattcatgcagtggtagatgaacctcaagttaaagaggggagcgttcctttagtaaataggattactagtgaaattgcttttgtacgttatcatggacgtaatcattatggttggactaaaaaagatatgactgatcaagaatggcgagatgtaagatatttatatgattatagcaatgatgagttagctgacttggctcgtaaagtcgaaatacttaatcaaaaggctaagaaagtatatgtaatttttaataataactctggcggtcatgcagctaataatgctaaaaagtatcaaaatattttagacattgattatgaaggtttagcaccgcaacaattaaaactattttaa

SEQ ID NO: 2059 - DNA, 330 bp, Staphylococcus epidermidis
gggattttaatgactaaaattagtgttgtcgtatatggagcagaagtcgtttgtgcgagttgtgtaaatgcacctacatctatagatacttatcaatggcttcaagcattacttttaagaaagtttcctcaacatcattttgaatttacatatattgacatacgaaatgatactgaaaatttaactgatcatgatatgcaatttatagaaagaattaatgaagatgaattgttttacccattagttacgatgaatgatgaatatgtagcagatggttacatacaatataaacaaataacccgttttattaaatcatattttactatgtaa

SEQ ID NO: 2060 - DNA, 354 bp, Staphylococcus epidermidis
ttgctactaatagcaagaaactttagttttattaagcagttatacactacttatttgaaaaataaccaattcgttcaattgaaaatggaattaaatggatatcgcgatgctttatacggtggtggtaaatctgctaaatccctgatgactaaaaaagatattaagatgagtaataaaattgccaatgcaatgaaaaggttagaaaaagttatagataactcacatgaaaaaattgacgccagagcaatacgagagtatgtcaataaatatccaattatcgagggtcaagttatacatatcaatagttgtcttgataatgatatttctggcacatatatttactacagtgcctga

SEQ ID NO: 2061 - DNA, 273 bp, Staphylococcus epidermidis
ggcagaatgataaatgctgttgtaatcgcagtcatattaatgatcatactatgtttatgtcgattaaatgtggtcattagcttatttattagtgcacttgtcggtggattaatatcaggtatgaatttagaaaaagtaattaatgtttttggaaaaaatatagtagatggcgcagaagtcgcattaagttatgcgttacttggtggttttgctgccttgatttcctatagtcgtataactgattatctaatagtgtcctacaccacggggaat

SEQ ID NO: 2062 - DNA, 969 bp, Staphylococcus epidermidis
tgccgatatgttataataaacgaagatatattaaacaggagggtatgcgttgttatggcgactagaaatgaagaaattttacgtaaaccggattggttaaagattaagcttaacacaaacgataattatactggtcttaagaaaatgatgcgtgagaagaatttacacacagtgtgtgaagaagctaaatgtccaaatattcacgaatgttggggtgcgcgtcgtacagctacatttatgattttaggggcagtatgtacaagagcatgtcgattttgcgcggtaaaaactggtttacctaatgaattagatttaaatgaaccagaacgagttgcagaatcagtagaattaatgaatttaaaacatgttgtaattactgctgttgcacgtgatgatttaagagatcaaggctcaaacgtgtatgcagaaacagtacgtaaagtaagagaaagaaatccatttacaacaatagaaattttaccatctgacatgggtggcgattatgaagcccttgaaacattaatggcttctagaccagacattcttaatcacaacattgaaacggttcgtcgcttaacaccaagagttcgagctcgagcaacttacgatagaactttacaatttttacgtcgttctaaagaattacaacctgatattccaacaaaatcaagtttgatggttgggttaggtgaaacgatggaagaaatttatgaaacgatggatgatttacgcgctaatgatgttgatatcttaactataggtcaatatttacaaccgtctcgaaaacatttgaaagttgagaaatattatacgccattagaatttggtaaaatgagaaagattgcaatggaaaaaggatttaaacattgtcaagcaggacctttagtaagaagctcatatcatgctgatgagcaagtgaatgaagcagctaaagagaaacaacgccaaggtgaagaacaactcaattaa

SEQ ID NO: 2063 - DNA, 840 bp, Staphylococcus epidermidis
gaggcgaatgtcatgttattaacaattattctattaatattaatagggggattatcagcgattttaggatctatcgttggtattggtggtggaatcatcatcgtccccacacttgtttatttaggcgttaaccatcatcttctacatggtattacgacgcaaattgcaataggtacttcttcagttattctgattgttactggattatcttcctcattaggatatttaaaaaccaaacaagtagatataaaaaatggttcgatatttctatttggactactacctggatctttggttggttcttttttaagtagataccttacacttgattcgtttaacttatactttggcgtgtttatgatatttgtgtcgatattactgatgattcgtcacaaaatcaaaccttttaaaatttttgacaaacctaaatatgcgcgtacatatgttgatgctgaagggaaaacataccgttatagtgtaccacccctgtttgcttttataacaacgttatttattgggctattaacaggactgtttggcataggtggaggtgcattgatgacccctcttatgctcatcgtctttagatttccaccacatgttgcagtaggcacaagtatgatgatgattttcttttcaagtgtgatgagttcaatagggcacatctttcaaggacatgtggcttggggctattctatcattctcattatttcaagtgttataggtgcacaaataggtgtgagggtcaatcgatctatgaaatccgacacagttgtaatgttattgagaacagtaatgcttatcatgggtgtatatttaatcattaaatcttttatttaa

SEQ ID NO: 2064 - DNA, 197 bp, Staphylococcus epidermidis
cttaatcacgttaatagcctccttatgttgcttagtaatcaaattaaaaatgctttctcaatttttagaaaatttgagaaagcatttgttgaaatgttctttctctcatcttctaaagttatactttatgtgaattggcaccatctctattttagacagtttgcaagggccttcacaaacgggattgcccgaaaggg

SEQ ID NO: 2065 - DNA, 1470 bp, Staphylococcus epidermidis
gggagagtagttatggcagacttaattaatattctaaaccacttcgttcaggaacaacctgaagcagttgcggttagacatacaaatgatgagctaacatataaacaacttgatgaagaatcaagtaagctagcacatctattacaagatagtaaaaagccaatgattttatatggtcacatgtcaccttacatgattgttggtatgattggagcgattaaatccggttgtggatatgttcctattgatacttctgttcccaaagaacgtgtgaatatgattattgataaagtacaaccggaaatcatttttaatacttcagatgagactttagaacagacaaatgcacaagtgcttaaggttagcgatattcaggattcacaatatccaattgtctttgatagtcaaatgaagcaaaacgatgtagtatatacaatttttacctcaggatctacaggagaacctaaaggtgtgcaaattgaatatgcaagtttaaatgaattcgcagaatggatggtatctttaaacaaaactggtactggtaaagaatggttaaatcaagcgccattttcttttgatttatcagtaatggcaatctatccttgtttaacatcaggtggtactttaaatcttgttgataaagatatgattaaaaaacctaaactattgaacgaaatgttagttcaaacaccaatgaatgtttgggtttctacaccttcttttatagaaatgtgtttattattacctaatttaaatgaacaacaatatagtagtttaaagcaattctttttctgtggggaaatcttaccacataaaacagctaaagccttagttgaaagatttccgaattcaatgatttataacacatatggaccgactgaagctactgttgcagtcacaagtatacaaatcacagaagaaattttaaatcaatataaccctttaccagttggtgtggctagacctggtacaaaattatttgctactgaagaaggagaacttgtcattgaggggcaaagcgtcagtttaggttatttaaagaatgaagaaaagacaactgcagtatttaattttgaagacggtgtcagaacatatcatactggggataaagctaaaattgaagatggattgtggtttattcaaggacgtattgattttcaaattaaattaaatggttatcgtatggaattagaggaaattgaaacacaattacgccagtcaaaacatgtaagagaggctgttgttgtgccggtttataaaaatggaaaggtcatacatttaataggagcagtagtacctactgaacctgtagaagataatttagcaatgacaactcatattaaacacgaacttaaatcacgcttaccagaatatatgattcctagaaagttcgaatggatggaacaactaccactcacatcaaatggtaaattagatcgtaagaaaattgccgaggttgtaaacggatga

SEQ ID NO: 2066 - DNA, 1320 bp, Staphylococcus epidermidis
gaggaaaaagtgatgacaactaaaactttgaacatttctgaagaacaacttgttgattattctaaagcgcacaatgaaccttcttggatgacagagttacgtaaaaaagcgttgaaattaacagaaactttagaaatgccaaaacctgataaaacgaaattaagaaaatgggattttgatacgtttaaacaacaccatacaacaggagatgcatacactcagttaactgatttaccaaaatctgttaaagaaatcattgatgttgaaaactcagaaaacttaatcattcaacataataatgaattggcatatacacaagtatcggatcaagctaaacatgatggtgtgattattgaaggtctatctgaagcactagtcaaccatagtgatttagttcaaaagtactttatgactaaagcagtagatgttgatgaacatcgtttaacagcattgcatactgcattagtaaacggtggtatttttgtttatgtacctaaaaatactgttgtagaacatcctatacagtacgttgttttacatgatgatgaacaagcgagcttttacaatcacgtcatcattgttacagaagaaagtgcagaagttacctatgtagagaactatctttctactactagtggtgaagataaccaacttaatattgtgtcagaggttatcgctggcgcaaactctaacgtcacatatggttcagttgattatttagataaaggatttacaggtcatataattcgtcgtggttctgcagatgcagatgcttctatcaattgggcactaggtttgatgaatgaaggtagccaaattatagataatactacaaatctaaacggtgatcgttcaacaagtgcattgaaatcagttgttgttggcacaggtgatcaaaaaataaatttaacttccaaaattgttcaatacggtaaagaaacagatgggtatatattgaaacatggtgttatgaaagaaaatgcatcttctgtatttaatggaattggctacattaaacatggtggtacgaaatctattgcgaaccaagagtcacgtgtattgatgttatctgaaaatgctcgtggtgatgctaaccctattcttttaatagacgaagatgatgttgaagcaggacatgcagcctcagttggtcgtgtcgatcctgagcaattatattatttaatgagccgtggtatttcaagagctgaagcagagcgtctagttatacatggtttcttagatccagtagtacgtgaattaccaattgacgatgtaaaacgtcaacttagagaagtaattgagcgtaaagtttcaaaataa

SEQ ID NO: 2067 - DNA, 1416 bp, Staphylococcus epidermidis
aatcaaggagtgattaaaatggcaaaacaagcacctgatgttggggattataaatacggattccatgacgaagatgtttccatttttagatcagagcgtggtttaacggaaaatatagtaacagaaatctctaaaatgaaagaagagccacaatggatgttagatttccgtttgaaagcattaaaactattctataaaatgccaatgccacaatggggtggagatttatctgaattagattttgatgatattacgtattatgttaaaccttctgaacatactgaacgttcatgggatgaagtgcctgaagaaatcaaacgtacttttgataaattaggtattccagaagctgagcagaaatacttagctggagtttctgcacaatatgaatcagaagttgtttatcataatatggagaaagaactggaagaaaagggtattattttcaaagatactgatagtgcattacgtgaaaatgaagagttatttagagaatattttgcgtcagtggtacctgctgcagataataaatttgctgcattaaattcagcagtatggtctggtggttcattcatttatgttcctaagaatgttaaattagatacaccactacaagcatatttccgtattaactctgagaatatgggacaattcgaacgtacattaataattgctgatgaaggtgcatcagtaaactatgtagaaggttgtactgcacctgtatactctacaagttcgctacactcggcagttgttgaaattatagtacacaaagatgcacatgtaagatatactactatccaaaactgggctaataacgtatataatttagtaactaaacgtacctttgtccatgagaatggtaatatggaatgggtagatggaaacttaggctctaagttaacgatgaaatatccaaactgtgtacttttaggtgaaggtgccaaaggtagcacattatccattgcatttgctggtaaaggtcaagttcaagatgctggtgctaaaatgattcataaagcacctaatacatcttcaactattgtttctaaatctatctccaaaaatggtggtaaagtcatttatcgtggtatcgttcattttggacgtaaagctaagggagcacgttcaaatatcgaatgtgatacattaattttagataatgaatcgacttcagatactatcccttataatgaagtgttcaatgacaatatttcattagaacatgaagctaaagtttctaaagtatcagaagagcaattattctatcttatgagtcgtggtatttctgaggaagaagcgacagaaatgattgttatgggattcattgagccgttcacaaaagaattaccaatggaatacgcagtagaaatgaaccgtttaattaagtttgaaatggaaggctcaattggttaa

SEQ ID NO: 2068 - DNA, 408 bp, Staphylococcus epidermidis
tataacgaatttgttataaaggttaaaaaattatgggaggttttttatatgccaacagtcattttaactgaagcggcagcatttgaagttagagacatgttaaaaaataacgacatgtctgatggttatttaaaaattaaagtaaatggtggaggatgcacaggattaacttatggtatgtcagccgaagcagaacctggtgaaaatgatgaaattctcgaatactatggtttgaaagttctagtagaccgaaatgatgctcctgtattaaatggaacaacaattgattttaaacagtcacttatgggtggaggatttcaaataaataatcctaatgctattgcctcatgtggttgtggaagttcatttaaaacagctaaagtcgctggaaatccagagcaatgttaa

SEQ ID NO: 2069 - DNA, 396 bp, Staphylococcus epidermidis
atcatgcgttctatcttattaccgtattcgatagattcatcatattcgaatgttaactcaggtataattcttaggcgcattcgagaaccaagttcagattttataaacccagttgctttatgcaaagctttaaacgtattatcaacttctttatcattccctaacactgttaaatatacctttgcttgtgaaaggtcattggttagttcaacatcagtaattgttaaaaaaccaactctagggtctttaactttattattaacaatgtccatgatttcctgtttcatttgttctcctacacgttctgctcttatattattcatcatctcacctctctttatttttactttactcacaaataaatgtgaaatatcagatttaatgattaactattga

SEQ ID NO: 2070 - DNA, 195 bp, Staphylococcus epidermidis
cgttcattatccaaaacgagacctcctactacagaaagttatctgtataatatcttatacttactatacaagcattttaagcaaaatacaagtcttttgcgaatatttgttcgcatttattgtgtgatagctgatacaaaaacgaacaaacgtacttatattttttgcaaaaatttaaaatatactatttattaa

SEQ ID NO: 2071 - DNA, 2121 bp, Staphylococcus epidermidis
gagaggagattcataatgtctcaagagaagaaagtttttaaaactgaatgggctgggcgttctttaactattgagacaggacaattagcaaagcaagctaatggtgctgttttagtgcgttatggagatacagttgtcctatcaactgcaactgcttctaaagaacctagagatggcgattttttcccattaactgtaaattacgaagaaaaaatgtatgctgctggtaaaataccaggaggattcaaaaaaagagaaggtcgccctggtgatgaagcaacgttaacagctcgtctcattgatagacctattcgtccactgtttccaaaaggatatagacatgacgtacaaatcatgaatattgtcttaagtgctgatccagattgctcaccagaaatggcagcaatgattggttcttcgatggcgttaagtgtttcagatattccattccaaggtcccatcgcaggtgtaaatgtaggttatatcgatggcaaatatgtcattaatccttccgtcgctgataaagaaatttctagattagatttagaagttgctggtcataaagatgcggtaaacatggttgaagcaggcgcaagtgaaattactgagagtgagatgcttgaggctattttcttcggacacgaggaaatcaaacgacttgttgcattccaacaagaaatcatcgatcacattcaaccgataaaacaagaatttgtaccggtggaaagagacgaagatttagttgaaaaagtaaaaagtttaactgaagataaaggacttaaggacacggttttaactttcgataagcaacaacgagatgaaaacttagatgctctgaaagaagaagttgttggtcattttctagatgaagaagatcctgaaaatgaaacgcttgttaaagaagtttatgcaattctaaatgacttaattaaagaagaagtaagacgtctaattgcagatgaaaaaatacgacctgatggacgtaaagtagatgaaataagacctcttgaatcagaagttggtttgttaccaagagctcatgggtcaggtttatttactcgtggtcagacacaagcactttcagttttaactttaggcgcacttggagattatcaattaattgatggtttaggacctgaggtagaaaaacgttttatgcatcattataactttcctaatttctctgtaggagaaactggccctgtacgtgcacctggtagacgtgagattgggcatggtgcgcttggtgaaagagcattacgttacattatacctgatactcaagatttcccttatacaattcgtattgtaagtgaagtattagagtctaacggttcatcatctcaagcatcgatttgtggttcaacattagcattaatggatgccggtgtaccaattaaagcgccagtcgcagggattgcaatgggactagtaacgcgtgacgatagctatacaattttaactgatattcaaggaatggaagatgcattaggtgatatggacttcaaagtagcaggtactaaagacggtattactgcgattcaaatggatattaaaattgatggtttaactcgagaagttattgaagaagcactagaacaagcgcgtcaaggacgattagctattatggatcatatgcttcacacgattgaacaaccacgcgaagaattaagtgcttacgcaccaaaagtggtaactatgagtattaatccagataaaattcgagacgtgattggaccaggtggtaagaaaatcaatgaaattatcgacgaaactggagttaaattagatattgaacaagatggtacaatctttataggtgctgtagatcaagcgatgattaaccgtgcaaaagaaattatcgaagatattacacgcgaagcggaagttggacaagtatatcatgctaaagtaaaacgtattgaaaagtatggtgctttcgttgaattgttccctggtaaagacgcgttattacacatttctcaaatttcacaagaaagaattaataaagtagaagatgttcttaaaattggagatacaattgaagtgaaaattactgaaatcgataaacaaggtcgcgttaatgcgtcacataaagtattagagcaatctaaaaattaa

SEQ ID NO: 2072 - DNA, 906 bp, Staphylococcus epidermidis
tggaggggattgattttggataaaatccaagaaacatttttatatatgttaaaggttgaaagaaacttttcagagtatacgttaaaatcttatcatgatgatttagttcaatttaacaactttttagaaagagaacatttacaacttgagacttttgaatataaagatgctagaaactatttggcttttttatattctaatcaattaaaaagaactacggtgtcaagaaagatatcaactttacgtaccttctatgaattttggatgactcaagataattcaattattaatccctttgttcaactagtgcatcctaaaaaagagaagtatttacctcaattcttttatgaagaagaaatggaagcactttttcaaactgtagagcatgataataaaaaaggcatacgagacaaagttattattgaattgttatatgcaacaggaatacgtgtgtctgaattaataaatattaaactaaaagatatagatatgaacttaccaggtgtaaaagttttaggtaaaggaaataaggaaaggtttatcccttttggagagttctgtagacagagtatagaaagatacttagaagaattccaacctaaacaattagccaatcatgattatttaattgtaaatatgaaaggtgatcctatcaccgaaagaggagtaagatatgtacttaatgatgtcgttaaaagaaccgctggcgtcaatgacatacatcctcataaattaagacatacttttgctacacatttattaaatcaaggtgctgatttaaggactgtacaatctttacttggtcacgtcaatttatcgactactggacgttatacacatgtttcgaatcaacaactgagaaaggtgtatttaaacgcacatcctcgagcaaaaaaaggagagtaa

SEQ ID NO: 2073 - DNA, 447 bp, Staphylococcus epidermidis
aagcggttgttgaagaacttggtggcgaaaaaatcgatatcgtccaatgggatgaagatcccgaaagtatttgttcgtaatgctttaagtccatcacaagttttagaagtaattgttgatgaagagaatcaatcaactgtagttgtagttcctgattaccaattatccttagctataggtaaaagagggcaaaacgcacgtttagctgctaaattaacaagttggaagatagatattaaatcagaatctgatgcccgagaagctggaatttatcctgttattgaatcagaagaagttgcagatgaaattgttaattccggtgacgaagatgttgagtttgataatgttaacttggaagagacaaacttaactagtacagaattagctgctgaaaatgatgaagataaaaaagataaaacagaagaagataatgacacagaatcatag

SEQ ID NO: 2074 - DNA, 336 bp, Staphylococcus epidermidis
agaagagatcccaaaataatgactaaaatgaaaatttttaatttgcttggtttagctatgagagctggtaaaatcaaaagtggcgaatcggtcatcttaaatgagcttaaaaagaatcaaataaaacttgtcatattagctagcgatgcatctagtaacactctaaaacaaatgaataataaatgtaatagttaccaagtgccattaaaagtgtttggtactagaaatgaattagggttagcaataggtaaaagcgatagagttaatattggtataacagataatggttttgcaaaaaaattgttatcaatgatagatgaatatggtaaggagtga

SEQ ID NO: 2075 - DNA, 1581 bp, Staphylococcus epidermidis
aataatgattatgggcatatagaaaggattttcaaagtgaatgaagagcaaagaaaggctggaacgataaatattctagcagaacgtgatcgtaaagctgagaaagattatagtaaatactttgaacaagtgtatcagccacctagcttaaaagaagctaaaaaaagaggaaaacaagaagttcaatataacagagattttcatatagatgaaaaatacaaaggtatgggtaaaggtcgcacttttttaattaaaacatatggatgtcaaatgaatgcacatgacactgaagttatggcaggaatattaaatgcattaggatatagtgctacttcggatattaatgaagcggatgtgattttaattaatacatgcgccattagagaaaatgctgaaaataaagtctttagtgaaataggaaatttaaaacatttaaaaaaagaacgcccagattgtttaattggggtgtgtggttgcatgtctcaagaagaatcagtcgtaaataaaatattaaaatcttatcaaaatgtagatatggtttttgggacacacaacattcatcatttacctgagattttagaagaggcatatttatctaaagcgatggtagttgaagtatggtctaaagagggagacatcatcgaaaatttacctaaagtgcgtgacggtcacattaaagcttgggttaatattatgtatggttgcgataagttttgtacttattgtattgttccatttactagaggaaaagaacgtagtcgtcgtccagaggacatcattgatgaggttagagaattagcaagagaaggttatcaagaaattaccttattaggtcaaaatgtaaattcatatggtaaagatatcgaaggtctggattatgaattaggtgacttattggaagatatttctaaaattgatatacctcgtgttcgttttacaacaagtcatccttgggactttacagatcgaatgattgaagttatagctaaaggtgggaacatagtaccgcatatccatttaccggtacaatcaggtaataaccaagtattaaagataatggggcgtaaatatacaagagagagttatcttgatttagtttcaagaataaaggaagctatccctaacgtagctctaactactgatatcatagtaggttatcctaatgaaactgaagaacaatttgaagaaacattatcattatatgatgacgttcaatttgagcatgcatacacatatttatattcacaaagagatggaacaccagcagctaaaatgaaggataacgtacctttagaagtgaaaaaagaacgtttgcaaaggcttaataagaaggttggaatatattctcaacaagcaatgagtcagtatgaaggtaagattgttacggtattatgtgaaggttctagtaaaaaagatgagaatgttctagcaggctatactgataaaaataaacttgtgaattttaaaggaccaagagagagcattggtaaactcgttgatgtcaaaattgacgaggcaaaacaatattctttaaatggaacatttatacaagaacatcaacgttcaatggtgacacaataa

SEQ ID NO: 2076 - DNA, 2676 bp, Staphylococcus epidermidis
atttatacatataatataaataaagatataagaataagggttgtgaaaatagaaatggctaacattacaccaatgatgcaacaatatttaaagataaaatctgaatatgatgattgtttgctattttttagactcggagatttctatgaaatgttctttgatgatgctaaagaagcatcaagagtacttgaaataacattgacgaaaagagatgctaaaaaagaaaatcctattccgatgtgtggcgtaccatatcattctgctgataattacattgaaacattgattaataatgggtataaggtcgctatatgtgaacaaatggaagatccaaagcaaacaaaaggaatggttagaagagaagttgtaagaatcatcacaccaggaactgttatggatcaaaatggtatggatgaaaagaaaaataattatattttaagttttatcgaaaatgaagaatttggattatgctattgtgatgtttctacaggcgaactcaaagtaactcatttcaaagatacagcaaccttgcttaatgagattacaacaattaatcccaatgaaatcgtcataaagcaagctctatctgaagaattaaaaagacaaatcaacatgataactgagacgattactgttcgcgaagatatatctgatgaagattatgatatgaatcagttgacacatcagttaatgcatgacacaactcaattattgttagattacattcatcacacacaaaagcgagatttatctcatattgaggaagtaattgaatatgctgcagttgattatatgaagatggattattatgcgaagcgaaatttagagctgacagagagcatacgattaaaatcaaaaaaagggactttgttatggttaatggatgagacaaaaacaccgatgggtgctagacgtttaaagcagtggattgatcgtccattaattaataaacaacaaatcaacgacagattaaatattgttgaagagtttatggaccgttttattgaaagagatacattacgtaatcatttaaatcaagtgtatgacatagaacgactagtaggaagagtgagttatggaaacgtaaatgcaagagatttaatacaacttaagcattctatatccgaaatacctcacattaaagcattactcaatgaattgggtgcacaaactaccacgcaatttaaagaattagaacctttagatgacttgttacaaattttagaagaaagtttagttgaagaaccacctatttccatcaaagatggaggattatttaaaaatggcttcaacgcgcaacttgatgaatatttagaagcttcaaaaaatggtaaaacttggcttgcagaattacaagctaaggaacgtgaacgtacaggtattaagtcattgaaaattagttttaataaagtgtttggttattttattgaaattacacgtgcaaacttaaataattttcaacctgaagcgtttggctataatcgaaaacaaacattatctaatgctgaacgatttattacggatgaattaaaagaaaaagaagatataatacttggtgctgaagataaagcagtagagttagaatatgaattatttgttaaattacgagaacacattaaaacgtacactgaacgtttacaaaagcaagcgaaaatcatttcagaacttgattgtttacaaagttttgctgaaattgctcaaaaatataattatgtcaaacctacatttagtgatgataaagttttacatttagaaaactcaagacatcctgttgttgagagagtgatggattataatgattatgtacctaatgattgccatcttgatgatgaaacgtttatttatctcattacgggacctaatatgtcaggtaagtcaacatatatgagacaagttgctataataagtatcatggctcaaatgggagcatatgtaccatgtgattcagcaacattacctatatttgatcaaatttttactaggattggtgcagcagatgaccttgtatcaggtaaaagtacatttatggtagaaatgttagaagctcaaaaagctttaacttatgctactgaaaatagtttaattatctttgacgaaataggaagaggtacatctacttatgatggtcttgcgttagcgcaagcgatgattgaatatgttgctcaaacttcccatgctaagacacttttctcaacacattatcatgaattgacatcacttgatcaaatgcttaagtgtttaaaaaatgtacatgttgctgcaaacgagtatcaaggtgaactgatatttttgcataaagtcaaagatggcgctgtggatgatagctatggtattcaagtggcaaaattagcggatttacctaatgaagtcattgatagagcgcaagttatattaaatgcatttgagcaaaaaccttcgtatcaactctctcatgagaatactgacgatcaacaaacggttccgtcgtataacgattttggtcgaacagaagaagagcaatcagttatagaaacacatacatcaaatcataattatgagcaagcgacctttgatttatttgatggttacaatcaacaaagtgaagttgaatgtcaaattcgagaattgaatctatccaatatgacaccattggaagccttaatcaagctgaatgaattacaaagtcaattaaagtag

SEQ ID NO: 2077 - DNA, 1758 bp, Staphylococcus epidermidis
aatcacaaatatcatggaaagtgggcggtcagcaagggcgaaggtattgaatctaccggtgaaatctttgctactgcgatgaatagaaaaggttattttttgtatggatatagacacttttctagtcgtataaaaggtggccatactaataataagataagagtttcaaaatcgcctgtgcatgcgattagtgatgatttggatatactcattgcttttgaccaggaaacgattgaattaaatcatcatgaaatgagagaagatagtattataattgcggatgctaaagcaaaaccccaaaagccagagaactgtgtggctcaattaattgagttaccattcactagcacggcaaaggaacttggaacagcattaatgaagaatatggtggcaattggtgcgacatctgcactgatggatttaaatacatcaacttttgaaactttaatcgataacatgttttcaaaaaaaggtaataaagtcgttgatatgaatatacaagcccttaatatgggttatgatttaatgaagcaacaagttaccaacgttaatggagactttacattagagaatggtagcggtcatcctcatttatatatgataggtaatgacgcaatcggattaggagcaatagcagctggatcaagatttatgtccgcttatccaattacgccagcttctgaaattatggaatacatgattgccaatctacctaaagttgatggtactgttgttcaaactgaagatgaaatagcagcagcaacgatggcgattggagctaactatgctggcgtacgaggctttacagcgagtgcgggtccaggtctttctttaatgatggaatctattggattgtctggtatgactgaaacgccattagtcattattaatactcaaagaggtggtccttctactggcttaccaacaaagcaagaacaatcagatttaatgcaaatgatttatggtacccatggtgatattccgaaaattgtcgttgctcctacagatgctgaagatgcgttttatcttactatggaagcatttaatttagctgaagaataccaatgtccagtcattctgttaagtgatttacaattatcattaggaaaacaaactgttaaaacactcgattataataaaatcgatattcgtcgtggagaaataatacagtcagatatcgagagagctgaagatgataaagcatactttaaaagatatgcattaacagctagtggcgtatcaccacgaccaataccaggtgttaaaggtggtatacatcatgtaacaggtgttgaacataatgaagaagggaagccaagtgaggcgcctatgaatcgtcagaatcagatggaaaaacgaatgcgcaaaactgaaagcttggttatcaataatcctgtgttactcaatgaacatgaagacgaagcagatatactgtatataggatttatatctactaaaggtgctattggagaaggtgcagaaagactagaacgacatggtgtaaaagtgaatacgatgcatattcgacaattacatcctttccctaaagatattgttcaacaagctattaataaagcttcgaaagtaatagttgcagaacataattatcaaggacaattatcaagtattttaaaaatgaacacacaagttaatgataaattagttaatcaaacaaaatacgatgggaaacctttcttaccttatgaaattgaagaaaaaggtttggaaattgctaaagagttaaaggagttggtgtaa

SEQ ID NO: 2078 - DNA, 1332 bp, Staphylococcus epidermidis
atgagtgattttaggaggggcaaaatgacgcaaaaagtaaacgttgtaggagctggtttagctggctctgaagctgcatatcaattagctcaacgtggaattaaagtgaatttaattgagatgcgtccagttaaacagacaccggcgcaccatacagataaatttgctgaattggtatgttcaaattcattgagaggtaatgcacttacaaatgctgttggtgttcttaaagaggaaatgagacatttagactcgttaattatcacatcagcagataaagcacgtgtgccagcgggtggtgctttagcagtggatagacatgattttgctggctatattacagataccttaagaaaccaccctaacatcactgtattaaatgaagaagttaatcatataccagaaggttatacgattattgcaactggccctctaactactgagcatttagctcaagaaattgttgatattactggtaaagatcaattgtatttttacgatgctgccgcaccaataatagaaaaagattcaattaatatggataaagtatatttgaaatcacgttatgataaaggtgaagcagcgtatcttaattgtcctatgactgaagaagagtttaaccggttttatgatgcagtattagaagctgaagttgcaccagtcaatgagtttgaaaaagaaaaatattttgaagggtgtatgccttttgaagtcatggctgaaagagggcgaaaaactttgttatttggtccgatgaaacctgttggacttgaagatcctaagactgggaaacgcccttatgcagttgttcaattaagacaagatgatgcagctggaacattatataatattgttggctttcaaacacatttaaaatggggtgcgcaaaaagaagtcattcgtttaattccaggattagaaaatgttgatattgtaagatatggtgtgatgcaccgaaatacctttattaattcacctgatgttttaaacgaaaaatatgaattaaaaggacatgataatttatattttgctggacaaatgactggcgttgaaggttatgttgaaagtgctgccagtggattagttgcaggtattaatcttgcgcataaaattttagacaaaggtgaagttattttccctagagagacaatgataggtagtatggcttactacatatcacatgccaaaaatgagaagaattttcaacctatgaatgccaattttggtcttttaccatctctcgaaaaacgtattaaagataaaaaagaaagatatgaaacacaagccaaaagagcgttagagtatttagataattacaaacaaacgctgtaa

SEQ ID NO: 2079 - DNA, 420 bp, Staphylococcus epidermidis
tacttaatccattattttgatttttatttaaatcaacctacctggttcctcaccaaattctctgcactaagattttccgttaccattctgttctcatatttatattttcaattgaaatatctatcaaaaattaaactattcttctatttaagtattcaacaaatgatgatacacctatatgggatggaatacttaccaacatatgtatatacctttgcttcaattattttacaattttccactcacatcattgacacaagggatttcctataccttatttcttttccatatatcactagcctgctatatctgggctcaaaaacaatgtgctacttacaatttcattatgtatgtgctaaactgtttgtgtcggatgacattaaaaagcatctcttcgtgttgaatattttggttggctga

SEQ ID NO: 2080 - DNA, 2397 bp, Staphylococcus epidermidis
gtattgccacaagcaaaaaaaagaacatcgacgaagagaaagggtaataaaaaaacgaataaaaaaaagcaaaatgaaacgcctttaagatatatattctcaataattgtagtaattcttattatactaggcgcttttcaattaggaatcattggtagaatgattgatagcttttttaattatctttttggtatgagtcgatatttaacttatattttagtacttattgcaacaatttttataacatactctaagcaaatacctagaactcgacgtagtatcggtgcaatagttttacaattagctttgttatttatagcgcaattgtattttcatttttcacataatatcacttctcaaagagagcctgtactgtcctttgtttataaagcttatgaacaaacacattttccaaattttgggggaggcttaataggtttttatttacttaaactatttatacctctcatatctattgtaggtgtaataataattactatcctattactagcttcgagtttcattttattacttaatttaagacatagagatgttacaaaaagtttattcgacaacctcaagtcatcaagtaatcatgcatctgagtcaataaaacaaaaaagagaacaaaataagattaaaaaagaagaaaaagcccaattaaaagaggcaaaaattgaacgaaaaaaacaaaaaaaatcacgtcagaataataatgtcattaaagatgttagtgattttccagagatttctcagtcagacgatattccaatatatggtcataatgagcaagaagataaaagaccaaatactgctaaccaacgtcaaaaacgtgttttggataatgaacaatttcaacaatcattaccaagtaccaaaaatcaatcaataaataataatcagccatctacaaccgctgaaaacaatcaacaacaaagtcaggctgaaggctcaatatctgaagctggtgaagaagccaatattgagtatacggtgccacctttatccttattaaaacagcctactaaacaaaaaactacttcaaaagctgaagtccaacgtaaaggtcaggttttagaatctacactaaaaaactttggagttaatgctaaagtaacacaaattaaaatcggtcctgcagttacgcaatatgaaattcaaccagcgcaaggtgttaaagtaagtaaaatagtcaatctccataatgacattgcattagctttggctgcgaaagatgtacgaatagaagcacctattccaggtcgctctgcggtaggaattgaggttcccaatgataaaatctcacttgtcactctaaaagaagttttagaagataagttcccatctaagtataaattagaagtcggcattggtagagatatttctggtgatccaatatcaattcaattaaatgaaatgcctcacttactcgttgctggttcaacaggaagcggtaaatcagtttgtattaatggtattataacgagtatattactcaacacaaaaccgcacgaagttaaacttatgttaatcgatcctaaaatggtagagttaaatgtttacaatggtattcctcatttacttataccggttgtaacaaacccacataaagcgtctcaagctttagaaaaaattgtttcagaaatggaacgtcgttatgatttgtttcaacattcatcgacacgaaatattgaaggatataaccaatatatacgcaaacagaatgaagaacttgatgaaaaacaacctgagttaccgtatatcgtcgtaatagtggatgaattggctgatttaatgatggttgcaggtaaagaagtagaaaatgctatccaacgtattactcaaatggctagagcagcgggtatacacttaattgtagctactcaaagaccttccgttgatgttattactggtattattaaaaataacattccatcaagaattgcgttcgctgtaagttctcaaactgactctagaacaataattggtgctggtggagctgaaaagctacttggtaaaggtgatatgctatatgttggtaacggagaatctactacaacccgaattcaaggtgcttttttaagtgatcaagaagtgcaagatgttgttaattatgttgtagagcaacagaaagcaaattatgttaaagaaatggaaccagatgcacctgtagataaatcagaaatgaagagtgaggatgctttatatgatgaagcttatttatttgtaatagaaaagcaaaaagctagtacttctttattacaacgacaatttagaatcggttataatcgagcttcaaggctcatggatgatttggaacgtaaccaagttattggtccacaaaaaggaagtaaacctagacaaatattagttgatttagaaaatgacgaggtgtaa

SEQ ID NO: 2081 - DNA, 873 bp, Staphylococcus epidermidis
ttgatacaacatacgatgttaaaactatattgggcaaatttcactacggcacaacttcatcatcttacaagtacatatcctgactttctatcagaaaacgtatttcatcaacatgacatgataaaaaggtggcttacagagcgtaattctgaaaggctatggaacaaatatgaacgtttcaaagaattaaagctgatggacattattaaagaaatgaaaaaagcaaatgttagttttacaacatactttgatgataactacccttctctttgcaaagaaatgtatgattatccttatgtgatattctacaaaggaaatccacagttctttaatcattctcactctttagctgtaattggctcacgtaatgccacacaatatacaagtcaatctttaaactatctttttccttcatttagacaattaaatatggcgattgtttctggattagcgcgcggtgcagatagtgtagcacatcaaaccgcacttaaatacctattaccaactattggcgtacttggatttggccattgttatcattatcctaaagcaaccttaaatttaagaactaaagttgaaaggaatggcttagtgataagtgaatatccaccattttctcctataagtaagcataaatttcctgaaagaaacaggcttataagtggtctgtccagaggggtacttataactgaggctgaagaaagaagtggtagtcaaatcactatcgattgtgctttagagcaaaatagaaatgtttatgttctacctggttcaatgttcaacaaaatgactaaaggtaatttaagaaggataaatgaaggtgctcaagttgttatagatgaaagtagtatattatatgattatctattttag

SEQ ID NO: 2082 - DNA, 810 bp, Staphylococcus epidermidis
gaggatgaacagagaatgagaatattgtttataggcgacatcgttggtaaagtgggcaggaaaatgattactacttatttacctaaaattaaacaaacttatcacccaacagtttctatagtaaacgctgaaaatgccgcacacggtaaaggattaacagaaaaaatttacaaacaacttttgagagaaggcgtggatttcatgactatgggtaatcatacatatggtcaaagagaaatttacgattttattgatgatgctcatcgaatggtgagacctgcaaattttcctgatgaagctccaggaacaggtatgagaataataaaaattaacgatattaaattggctattattaatttacaaggccgttcatttatgcaagacattgatgatccatttaaaaaggctgaccagctaatcgaagaagctcaaaaatctacaccatatatatttgtagattttcatgctgaaactacatctgaaaaaaatgctatgggttggtatttagatggtagagtgagcgctgttgttggtactcacacacatattcaaacttctgatgatcgtatattacctcatggcacaggatatatcacagatgtcgggatgacaggttattacgatggtattttaggtatcaatagagatgaagttattcaacgttttattactagtttgccacaaaggcatgttgttccagatgatgggcgaggcgtattatcaggagttatcatagatttagataaagaaggtaaaacgactcaaataaaaagactgttaataaatgaggaccatcctttccaaatttaa

SEQ ID NO: 2083 - DNA, 1596 bp, Staphylococcus epidermidis
tatacaaagcaaaccctagataaaggaggtgtttatgtgaatttattaagcctcctactcattttgctggggattattctaggcgttgttgtagggtatattgttgcccgaaatttattacaccaaaaacaagttcaagcaagacaaactgccgatgatattgttagctatgctaataaagaagcagacaatattaaaaaagaaaaattacttgaggcaaaagaagagaaccaaattttaaaagaacaagctgagaatgaactgcgtgaaagacgtggtgaacttcaaagacaagaaacccgacttcttcaaaaagaagaaaatttggatcggaaatctgatcttttagataaaaaagatgagattttggaacaaaaagaatcaaaacttgaagaaagacaacaacaagtagatgcaaaagagagtagtgttcaaacattaataatgaagcatgaactagaattagaacgcatctccggtctcactcaagaagaagctgtgaaagaacagcttcaaagagttgaagaagaactgtcacaagatattgcaatacttgttaaagaaaaagaaaaagaagcgaaagaaaaagttgataagacagctaaagaattacttgctacaactgtacaaagattagcagccgaacatacaactgaatcaactgtttcagtcgtaaatctgcctaacgatgaaatgaaaggtcgtatcataggtagagaaggtagaaatatacgcacattagaaacacttactggcatagatttaattattgatgacacaccagaagcagttattttatcaggttttgacccaattagacgtgaaattgctagaactgcactagttaatttggtttctgatggacgtattcatcctggacgtattgaagatatggtcgaaaaagctagaaaggaagtagacgatatcattagagatgctggagaacaagctacctttgaaataaatgtacacaatatgcatcctgatttagtgaaaattttgggtcgattaaattatcgaactagttatggtcagaatgtacttaaacattcaattgaagttgcccacctttcaggtatgcttgcagcagaattaggagaggatgttactttagctaaacgtgctggattattacatgatgttggtaaagccattgatcatgaagttgaaggtagtcacgtagaaataggtgttgaattagctaagaaatataatgaaaataacataattattaatgctattcactcacatcatggtgatgttgaaccaacctctatcatttctattttagttgcagcagctgatgcattatcagcagcgcgaccaggtgcacgtaaagagacacttgaaaattatattagaagacttgagagactcgaaacgttatctgaaagttatgatggggtagaaaaagcatttgctatacaagctggtagagagattcgtgtagtcgtctcacctgaagaaattgatgatttaaaatcatatagattggcaagagatattaagaaccaaattgaagaagagttacaatatcctggacatatcaaagtgacagttgttcgagagactagagcaatagaatatgctaaataa

SEQ ID NO: 2084 - DNA, 801 bp, Staphylococcus epidermidis
gaggaatttaaaatggcagtaatttctatgaaacaattacttgaagccggtgttcacttcggtcaccaaacacgccgttggaacccaaaaatgaaaaaatatatcttcactgaaagaaatggtatttatatcattgatttacaaaaaacagtgaaaaaagttgaagaagcatacaactttgtaaaacaaatctctgaagaaggcggaaaagtcttatttgtaggtacaaaaaaacaagcgcaagaatcagttaaagctgaggcagagcgtgctggtcaattctacgttaaccaaagatggttaggtgggattttaactaactacaaaacaatctcaaaacgaattaaacgtatttctgaaattgaaaaaatggaagaagacggattatttgaagtattacctaaaaaagaagttgttgaacttaaaaaagaatacgaccgtttaattaagttcttaggcggtattcgcgatatgaaatcaatgcctcaagcattattcgttgttgatcctcgtaaagagcgcaacgctattgctgaagctcgcaaactaaatattcctatcgtaggtattgttgacactaactgtgatcctgatgaaattgattacgttatcccagcaaacgatgatgctattcgtgccgttaaattattaactggtaaaatggcagacgctatcttagaaggtcaacaaggtgtatctaatgaagaagtagctgcagaacaaaacatcaatttagatgacaaagaagaatctgaacaagcagaaacaactgaagaaaacacttctgttgaatcaaactaa

SEQ ID NO: 2085 - DNA, 417 bp, Staphylococcus epidermidis
ttaatcattaaatctgatatttcacatttatttgtgagtaaagtaaaaataaagagaggtgagatgatgaataatataagagcagaacgtgtaggagaacaaatgaaacaggaaatcatggacattgttaataataaagttaaagaccctagagttggttttttaacaattactgatgttgaactaaccaatgacctttcacaagcaaaggtatatttaacagtgttagggaatgataaagaagttgataatacgtttaaagctttgcataaagcaactgggtttataaaatctgaacttggttctcgaatgcgcctaagaattatacctgagttaacattcgaatatgatgaatctatcgaatacggtaataagatagaacgcatgattcaagagttacacaaaaatgataaataa

SEQ ID NO: 2086 - DNA, 255 bp, Staphylococcus epidermidis
tatgaaactaataaaaatataggagttgtttattcattcatgtctattaatattgatcctgaaaaatttgctgaattagttgtaacttcaaatccagccaaatctgatgacgctgaagatatcgctaaagaaagtttaattttatacattaatgcttatcgtttagcagagaaatatgcaaatatcgctacaaattgctatgatacagctgaaattttaaaagaaataaatgaagttgatttacaattaaaataa

SEQ ID NO: 2087 - DNA, 258 bp, Staphylococcus epidermidis
gctaaaaataagacaacgagtaataccatcattgaggtacgtgttaacaacgatttatatttaataaatataaataacactatgattaaaatcaatgcaacaaacatccactttactgatctttccgacagtgcgataaatatgaaaccgtatatgaatactggtatagcaacaaaggtgtattctttaattgatatttcacttaaatgttgtatgaacaatgcaattaatacacttgttgataatgctaaaaagtaa

SEQ ID NO: 2088 - DNA, 987 bp, Staphylococcus epidermidis
aggagaaataatattatgaaagtgatagaagttacacatcccatacaaagtaatcaattcataactgaaaatgttgctatggcttttggtttcttcgatggtatgcatagaggtcacgacaaggtgtttcaagtgcttgatgaaaaagcaaaagagcatcaacttaaaaaggctgttatgacgtttgatccacacccctcagtcgtattaaaccctgagcgtaaacgtacaacctatcttacaccactttcagataagttagaaatgatagcagaacacggtatagactattgtatcgttatcaatttttcatcaagatttgctaatgtgacatctgacgatttcataaaaaattatattattaataatcatgttaaagaagtgattgcagggtttgatttcacctttggtaaatttggaaaaggaaatatgacggtacttcaggaatcaaaagcttttaatacgactattgtaggaaaacaagagatggattctgaaaaaatttctacaactgcaatacgccaagcgcttacagatggtcatttacagaaagcaaatgacgaattagggtatatatataggattaaaggaactgtagtacaaggtgaaaaacgtggaagaacaattggttttccaacagctaatgtgcaacccagtgatgattatgtactaccaaaaaaaggtgtttacgcagtgagtatggaaattggtccagagagtaaattacatcgtggtgtagctaacgttggagttaaaccaacattccacgatccaactagggctgagttagttattgaagtgaatatatttgattttaatgaaaatatttacggtgaacgtgtgactgtgtattggcatcactttttaagaccagaagttaaatttgatggtatcgatccattagttaaacaaatgaatgaagataaagcgcaggctaaacatttattatctattgatttcgatgatgatatatcatataatatataa

SEQ ID NO: 2089 - DNA, 546 bp, Staphylococcus epidermidis
tttatggataattctttacacgctacaacaatttatgctgtacgccataatggtgaagcagctatggctggtgatggtcaagtcacattaggtcaacaagttattatgaaacaaactgctagaaaagtaagacgtttatacgaaggaaaagtattggctggttttgcaggtagtgttgctgacgccttcacacttttcgaaaaatttgagacaaagcttcagcaatttagtggtaatttagagcgcgcagctgttgaactagcacaagaatggcgtggagataaacaattacgacaattagaggcgatgcttatcgtaatgaataaagatgccatacttattgttagtggtacaggtgaggttattgcacctgatgatgatttaattgccattgggtcaggtggtaactatgcacttagcgcaggtcgagcactaaaaagacatgcagcacaactttctgctagtgaaatggcatacgaaagtttaaaagttgcagctgatatttgtgtgtttacaaatgacaatataattgtagaaacgctataa

SEQ ID NO: 2090 - DNA, 930 bp, Staphylococcus epidermidis
aggtgtgacaacatgtataatggcatactaccggtatttaagaaacgaggtttaacaagtcacgacgtcgtttttaaattacgtaaaattttaaaaatgaaaaaaattggtcatacaggaacattagatcctgaagttaatggtgtgttaccaatttgtttaggcgatgcgacaaaagtcagtgattatatcatggaaatgggaaaaacttatcacgctatgataacgctaggaaagagtacgactactgaagaccaaactggagatattttagaaactagggctgttgataagaatgatattaatgaagatacgattgaccaagtgttgcagcaatttgaggggcatattcaacaaattccgcctatgtattcttctgttaaagtaaatggaagaaaattatatgaatatgcgagaaataatgaaactgtcgaacgccctaaacgacaagtttttattaaagatatacatagaatatctgaagttactttccaggagcagacatgtcattttgaagttgaagtaacatgtggtaaaggaacttatattagaactttagctacagatattggacttaaacttggttttccagctcatatgtcacgtctaactagaattgcttctggcggttttcaattagaaagtagtttaacgattgatcaaattaaagaattacatgagcatgattcattacataatgaattgtttcctatagaatatggcttaaaaggtctgaaatcattccaagtgaaagattcaaattttaaaaagaaaatctgtaacggtcaaaaatttcataaaaaagtgttaagtcaaaatgttaaagaaccttttatatttgtcgatagtagcactcaaaaagttttagcaatatatatagttcatccagataaaccttatgaaataaaacctaaaaaagtttttaattaa

SEQ ID NO: 2091 - DNA, 726 bp, Staphylococcus epidermidis
cgaggtgtaaaaatgtcggaaatgagtgcaatctatagagtaaaacaatacattttaaatttaatcaaagatggtgaactaaccaatggaagtaaattacctagtaatttgtcaattgcgagagcattaaatgttaaaacagatgatgtttatgatggtatagatgagttgattactgaacaagtagtaacggataattttgaagaggggactagcgtaaaagtaaagccccctttctattacccgttaaataaaattattagtatagggactatgattaaagaagcgggttatgaagcaggaacagaatatctgaatcttgacgagcaacctgcaactattttagatgctgaacatttaggtatagaaacaaaagaacctataacaattattgagagactaaggactgctaatcataagcctgtcgtatattgtttagacaaaatagcaaaaacttatctaacttgtacagattatcaacagagtagtggttcaatgttagaagctattaaagcatctacaaatcatcaaatcatgcatgcagaaatggatttagaagcaattagttacgaaccccatatctctgaagtgcttaatgcttcacctcacgaagggcttatgttacttaaagtagtacattatgacgaaaagcatcaaccaattttgtattctttaaattatattaagagtagtttagttaaattcactattactaaaagtgaataa

SEQ ID NO: 2092 - DNA, 870 bp, Staphylococcus epidermidis
ggaggaaaaaacgtgtcaagtaatgaattattattagctactgaatatttagaaaaggaaaagaaaattcctagagaagttttaattgatgcaattgaagcagctttaattactgcgtacaagaaaaactatgatagtgccagaaatgtaagagtagaattaaatatggacgaaggttcatttagagtgattgcacgtaaagaagtcgtagaagaagtgtttgatgacagagatgaagttgatttaagtactgctttagtcaaaaatcctgcctatgaagtaggagatatttatgaacaagatgtaacaccgaaagacttcggacgtgtaggagctcaagcagctaagcaagctgtgatgcaacgacttagagacgcagaaagagaaattttatatgatgaatttatcgataaagaagaagatattctaacaggtgtgattgaccgtgtagaccatcgctatgtatatgtgaatttaggaagaattgaagctgtgctgtcagaagctgaaagaagtcctaatgagaaatatattcctaatgaacgtatcaaggtgtacgtaaataaagttgaacagactacaaaaggtccacaaatttacgtatcaagaagtcatcctggattactaaaacgcttattcgaacaagaagttccagaaatttatgatggtactgttattgttaaatcagtagcgcgtgaagctggagatcgttctaaaattagcgtgtattctgataatcctgatatagatgctgttggcgcatgtgtaggttctaaaggagcacgagtagaagcggttgttgaagaacttggtggcgaaaaaatcgatatcgtccaatgggatgaagatcccgaaagtatttgttcgtaa

SEQ ID NO: 2093 - DNA, 2601 bp, Staphylococcus epidermidis
atgagaagaaaagcatgtttcattatattattaattacattatcattaattggtcatagttatattatttttcgcttccatcatgatggtgttctttcaactggcccaaatgatggtatggaacagatgattcctattcaaatgtatctttatcatcaatggactcaagggaacttattttattcaacacatttgggtcttggcggagattttttcactgacttaagttattatttttcaacaaatttaatatttattttaaatgtccctatcatcaaattatgtgaaatattcttttcattgaacacaaatcaaattcttctttggatgtacaacgcactaattgtttcaattattaaatcaactattgctctgttttgcacttatttatttagttattatatttctaaaaataaaataatcagtttattgatttcatttatctttgttatgtcacctttgtactttagatttacaatttactggccattctttagtgatactttcatttggttaccactcttattattagggattgaacgtttattaagggattttaaagcaggtttatttatactaactgtaagtctaattctaattaataacttttattttgcatattatttcctcattattggtataggttataccctgattagaattatttacagacatcctaaagatagtttaactcgttggcaagcttctcttacaattatatgtagtgctctgctcgctttaggaaatagtatgtttgtgttctttcatggtgttcaaagttttcttaataatcgtcgacaatcatttacaggacaagtgaattggattgaacatttaaataaagataccaatatatttttcgataattacttgattgttgtgatatttttatctattcaagctcttttgacaatcaaattatacaaacatttttattataaattatttgcattgttattattggcaacaattatttttgcatttctcccatttgttgaccaactatttaatgggttttcagcacctcaaaaacgatggcattttatcttagcttttaatagttcaattttaattgggttatttgtaaaatattttaaaacaattcgaccaaagacttatatttatactaatctgatagctcaaagtgtcatctacataagttcaattagctacaatacttttttaccttggctctctttagttccagtagtgtcagtgattggactattaattttattaataaaagagaaaaaagtacgttattatcttacttacctttatagtatttcaatcgctgctctcagtcttatgattactttcgtattcataaaaaatcaaattttctttcaagatcatatcaatcgtgcgaacaagcgatacattaattcaagtttctataactcggctatacaaagatcgttagtaaaagaaatgaaccaaactaagaatgacgatcaacgaataaattggcgtgtcgatgaacaagataatacccctatgtatcaaaattttaaaggacttagtatttactctagtatatttcatcacaacattctcgatttctattatgatgccttaaaaattaatttagctgaagaatctgtcagtcgataccagtctactaatgctcggcaaaatatcgagagtctgttttcagtaaaatatttaatgatgaaagattatcaaaattttattccatcttattttaagaaagttaagtcacgtggacaatatattatttataaaaatcaacttccactaccaagtgtaaaagtaacacaaaacatttataatcataaaagtttaaaaaaacctatagatagagagcatgcaatgattaatggtgctattgtgacatcaaaaggtacagcatatcactcaaaagttaaaaatttgttagaccaaacacgtgtatcaacacaaaatataacacgatattcaaacaatgaactaaccgttaataaagagagcggaataatcaaattacatttacctaagaatataagagacaaatacaaagatttttatctcactatgaatattaaacgaggcgatcctgacagtaattacactgtgagcatcaatcaatatcataatcatcgtctatacaatgattctatatatcgcacgggaataagcaaagtgctttatcgaagtttaccagacaaaaatggtgatattacgattcaactatcaccgaaaggtaagttcaatttggaactgttagaattaaacggtgaaaattatgatacgctaaaacaagcacaccatcatgctaactttaatatgcgttataaagatataaaaaacggggtaaaagttaacttagatcaccattctaaaggacttgcagtcattaatattccatatcgtaaaggtatgcgtgcatacgtggatgaccgacaaagcaatatcaaaaaggtgaattatatgatgacaggtgtcccagttaataaaaatgataaaacaattacgattcaatatcgaccaccttttctaaaaacgatgttttctatctcaatatttagtatagtggtgagtattgtattcattagattaaagaatataaggaaaagaaagatgaggattcgccatgattaa

SEQ ID NO: 2094 - DNA, 528 bp, Staphylococcus epidermidis
ctcaggcagaagagtgggcataaacccgctcttttctatttgccaaaaaaggaggcctgtatgagtaaaattactgagcaagttgaagcattgattcaaccagttttaaatgatttgaactttgaattagtagacattgagtatgttaaagaaggtaaagaccattttttaaggatttccattgataaagaaggtggcgtagatcttaatgattgtactatagcttcagaaaaaattagtgaagttatggatgaaaatgatccaatacctgaaatgtattatcttgatgttgcatcgccaggggcagaaagaccaataaaaaaagaaacagatttttataatgctatcaatcaacccatttttgtatctctttatgcaccaattgaaggagataaagaatggttaggtgttttaaaatctgtaaatgatgaatcaattaatatggaagttaaagaaaaggcaaaaacaaaagaaattgaaattccaagaaataaaatagcaaaagcacgtcacgctgtaatgatttaa

SEQ ID NO: 2095 - DNA, 288 bp, Staphylococcus epidermidis
ttaaggaggaaattgataatggcaatttcacaacaacgtaaagatgaattaattaaagaatatcgtgtgcacgaaactgatactggttcaccagaagtccaaatcgctgtattaactgcagaaattactgcattaaatgagcatttacgtgaacacaagaaagaccaccattcacgtcgtggtttattgaaaatggtaggtcgtcgtcgtcacttattaaactacttacgtagtaaagatattcaacgttaccgtgaattaattaaatcattaggtattcgtcgttaa

SEQ ID NO: 2096 - DNA, 1722 bp, Staphylococcus epidermidis
atagggaggaaaaagagaatgaaacaatctaaagtatttataccaacgatgagagaagtccctgcagaggcggaagcattaagccatcgtttattattaaaagcagggttaattaaacagagtacaagtggtatatatagttacttaccacttgctacacgtgtactaaataatatatctaaaatcatacgtgaagaaatggaaagtatagatgctgtagaaattcttatgccagctttacaacaagcagaattatgggaagagtcaggacgttggagtgcatatggtccagaactaatgcgtttaaaagacagaaacggacgtgaatttgcattaggacctactcatgaggaagtagtcacttctttagtaagagatgaattaaaatcatataaacagttaccccttactttatttcaaattcaatccaaatatagagatgagaaaagaccacgctttggattattaagaggacgcgaatttcttatgaaagatgcatattccttccattcagatgaagcttcattagatgcaacttatcaagatatgtatcaagcatatagtcgcatattcaaacgtgtaggcatcaatgcaagaccggttgtggcagattcaggtgcaatagggggaagtcatacacacgagtttatggcattgagtgaaattggggaagatacaatagtttatagtaatgagagtgactatgcagcgaatattgaaaaggctgaagttgtttatcatccttctcataagcattctgcacttgcggaattgactaaagttgagacgcccaatgttaaaacagctcaagaagttgcagaatatttaaagagaccattagatgaaattgtaaaaactatgatctttaaaatagatggcgaatttattatgtttctagttcgtggacatcatgaattaaatgaagtgaaattaaaatcatatttcggcacggaacatgttgaaatggctactccagatgaaattgttaatcttgtagatgccaatccggggtctcttggtcctatttttgataaagatattaaaatttatgccgataattacttacaagatttaaataactttgttgtaggagctaatgaagatcattatcactatataaatgtcaatattggtagagactttgatgtaacagaatacggtgactttagattcattacacaaggtgagatgttaagtgatggctcgggagtagcacaatttgctgaaggcattgaagtaggacaagttttcaaattagggacaaaatattctgaatcaatgaatgcaacttttctagataatcagggaaaagctcaaccactcattatgggctgttatggtattggagtatcaagaacattaagtgcaattgttgaacaaaacaatgacgagaatggaattatttggccaaaatcagtaacgcctttcgatatccatctaattactatcaatcctaaaaaggatgatcaacgtactttaggtgatcaactttatcaaaaattaatggattcatacgatgttttatatgatgaccgaaaagaacgtgctggtgttaaatttaatgattcagacctaattgggttaccggtacgagttgttgttggtaaaagagctgaagaaggtattgttgaggtaaaacaacgcattaacggtttaagtgaagaagtgcaaattgatgaattagagtattacttacaagaattatttaagaatattaagtaa

SEQ ID NO: 2097 - DNA, 981 bp, Staphylococcus epidermidis
acgatggggaaaataaaagaacttgagacgtctctagctaataaaatagctgcgggtgaagtggttgaaagaccaagttccgtagttaaagagctcttagaaaatgcaattgatgcacaagcgacagaaattaatattgaagttgaacagtctggagtttcatcaataagggttgtagataatggcactggtattgctcaggaagatttagggttagtatttcatagacacgcaacgagtaaaatagtcgcagatgatgatttgttccatattcgtactttaggttttaggggagaagctttagctagtatttcatcagtagcaaaggtgacattaaagacctgtactgataatgaaaatggacatgaaatatatgctgaagatggtaaaattattcatcaaaaacctgcaaaagctaaaaagggtacagatatacaagtggattcattattctacaatacacctgctcgattaaaatatataaaaagtttgtataccgaactgggtaaaattacggacattgtaaatagaatggcgatgagtcatcccgaaattagaatttctttagtttcagatggtaaaaaacttttaagtacgaatggctcaggaagaacaaatgaagtaatggctgaaatttatggaatgaaagtagcaaaggatttagtgcatatttcgggtgatactagtgattatcatcttgaagggtttgtagctaaacctgagcattctagaagtaataaacattacatttctattttcatcaatggtagatacatcaaaaactttgtactcaataaagcaattttagagggatatcacacattgcttacaataggaagatttcctatatgttacattaatatccaaatggatcctattttggttgatgtaaatgttcatccaacaaaattagaggtgagactttctaaagaagatcaactttatgatcttatcgtaaccaaaatcagagagggcttttaa

SEQ ID NO: 2098 - DNA, 786 bp, Staphylococcus epidermidis
agagtgaatgatagtatgtctctaacaattaaagaaatcaaagaaaaactatctcgaattgaaacgttggaagagttacataaacatgaagcaaataatgattcacgtaaaggtgttataaatgcgattaagtctagggaaaaaaatattcttaagcaacaagcattagaagagcactatttatccatgaatcaatacgaaaacaacattatgtcctctaacagggatgcattaatttgtggaattgatgaggtagggcgtgggcccttggctggaccagttgtggcttgtgcagttattttagagaagaatcatcattatattggtttagatgactctaaaaaagtgtctcccaaaaatagagcacgacttaatcaaaatttaaaagaaaatgtctatcaatatgcatatggcatagcgtcctcagttgaaatagatgaattgaacatttatcgggcaactcaattagctatgctacgtgctataaatcaattagatgttacaccgacgcatttattaatagacgcaatgacactagatattgatattccacaaacctcaattattaaaggtgatgctaaaagtgtgtctatcgcagcagcaagtatcatggctaaagaataccgtgatcaatatatgagacaactatctaaacagtttccagaatatggttttgataaaaatgcaggttatggaactaagcaacatttaaaggctattgatcaagtgggcataatcaatgaacatcgtcaatcatttgaaccaattaaatcaatgatgaaataa

SEQ ID NO: 2099 - DNA, 558 bp, Staphylococcus epidermidis
aaaatgagtgacataatcaaagatacaaagtctagaatgcaaaaatcaattgataacttatctcgtgaacttgctaacattagtgctggtagagcaaactctaatttacttaatggtgttacagttgactactatggtgcacctacaccagtgcaacaattagcaagtatcaatgtgcctgaagcacgtctattagttatttcaccatatgataagtcatcagttgctgatattgaaaaagcaattatcgcggctaatcttggggttaatccaacgagtgatggtgaggttattcgtatctctgtaccagctttaactgaagaaagacgtaaagaattagttaaagaagttaaaaaaattggtgaagatgctaaagtctcaattagaaatattcgtcgtgatattaacgatcagcttaaaaaagacgaaaaaaatggtgacattactgaagacgacttaagaagtcaaactgatgatgtacaaaaagctacagataattcgattaaagaaatagatcaattggttgccgacaaagaaaaagatattatgtcagtatag

SEQ ID NO: 2100 - DNA, 984 bp, Staphylococcus epidermidis
ccaaaatcagagagggcttttaaagacaaaatcctcatcccacaaaacgatttaaatcacgcgcccaaaaagaataaggttttagatacatttgaacaacaaaaaattaatttcgtgaagcaacaatcacaaattggagaaacatctgcaccatatgtacatgatcacaaagataagaatcatgacgtagagtcgcataagaataatttagattcaacttcatcgacaaataatgaaagtacggaagtttctaatgaattacacaattacattgatgatagttacttacaaagtcaaaaagaagtattttttgatatggaacaaaacacatctaacgaatatgagatatcaaatcagcaatcaaacgatattaaaggaacagtgagtcagacacctcatcgtagggtgccttatatggaaattgtaggtcaagtacacggtacgtatatcattgcacaaaatgaaaatggaatgtttatgattgaccaacatgctgctcaggaaagaattaaatatgaatattttagagaaaaaattggcgaagtgaccaatgaagtgcaaaacttattaataccacttactttccatttctctaaagatgaacaaatgattattgatcagtacaaagatgaattagataaagtaggagtacatcttgaacattttggtgggcatgattatattgtaaatagctatccagtatggtttccgaaagaagaagcggaagaaattattaaagatatgattgaacttgtcttaaaacacaaaagtgttgatgtgaagaaaataagagaagatgcagcaatcatgatgtcttgtaagaaatcaattaaggctaatcactatttaaaaaataatgaaatggcagatttaattgatcaactaagagaagcagaagatccttttacttgtcctcatggtagaccgattattatcaatttttcaaattatgaattagaaaagttatttaaaagagtaatgtag

SEQ ID NO: 2101 - DNA, 2073 bp, Staphylococcus epidermidis
actttggcagataatttagtcattgttgaatcgcctgcaaaagctaaaaccattgaaaaatatttaggcaaaagatataaagttattgcttcaatgggacatgttcgtgacttaccaagaagtcaaatgggtgtcgacactgaagataactatgaaccaaaatatattacaattcgtggcaaaggtcctgtagttaaagatttaaaaaaacatgcgaaaaaagcaaaaaaaatatttttagctagtgaccctgaccgtgaaggtgaagcgattgcttggcatttatcaaaaattttagaattagaagatagcaaagaaaatagagtagtatttaatgaaattacaaaagatgctgttaaagatagttttaagcatcctcgtggtattgaaatggatttagttgacgcgcaacaagcacgtcgtattttagatagactcgttggttataatatttctccagtattatggaagaaagttaaaaaagggctgtctgctgggagagttcagtcagttgctttacgtttagtcattgatcgtgaaaatgaaattcgtaattttaaacctgaagagtattggtccattgaaggtgaatttagatacaagaaatctaaatttacagctaaatttctacactataaaaataaaccttataagctaaacaacaaagacgatgttcaaaggattactgaagcattaaatggtgatcaatttgaaatcacaaatgtgaatcgtaaagaaaaaacacgttatcctgctcatccatttactacatcaaccttacaacaagaagctgcacgtaaactaaattttaaagcacgcaagacaatgatgttagcacaacaattatacgaaggtattgacttaaagcgtcaaggtacagtaggtttaattacgtatatgcgtaccgattctactcgtatctcaacttctgcaaaatcagaagcgcagcaatatataaatgataaatatggtgaacagtacgtgtctcagcgtaaatcatcgggtaaacagggcgatcaagatgctcacgaagctattagacctactagtacaatgcgaactcctgatgacatgaaagcttttcttactagagatcaacaccgtctatacaaattaatttgggaaagatttgtagcaagtcagatggctccagctattttggatacagtagctttagatgtaactcaaaacgacattaaatttagagctaatggtcaaactattaaatttaaaggttttatgacactatatgtagaagcaaaagatgataaagagaatgataaagaaaataagcttcctcaactagataaaggagataaggtaactgcgacaaagattgaaccggcacaacactttacacaacctcctcctcgttatactgaggcgcgtttagttaaaacgcttgaggaacttaaaattggaagaccttcaacatatgctccaaccattgatacgattcaaaagcggaactacgtcaagttagaaagtaaacgcttcatcccaactgaattaggagaaattgtttatgagcaagttaaagaatacttcccagaaattattgatgtagaattcactgtaaacatggaaacattacttgataaaattgccgaaggtgacatgaattggcgtaaagtaataggagacttctacaacagttttaaacaagatgttgaacgcgcagaatctgaaatggaaaagattgagattaaagacgagccagctggtgaagattgtgaagtctgtggttctccaatggttattaaaatgggaagatatggtaagtttatggcatgttcgaactttccagactgtcgtaacaccaaagcaattgtcaaaacgattggtgtcacatgtccgaagtgtaatgaaggagatgtcgtagaacgtaaatcaaagaaaaatagaattttctatggttgttctagatatccagaatgtgattttatttcttgggataaacctgttggaagagattgtcctaagtgtcatcattaccttgtgaacaagaaaaaaggtaaaagtagtcaagttgtgtgctccaactgtgattatgaagaagaagttcaaaaatag

SEQ ID NO: 2102 - DNA, 294 bp, Staphylococcus epidermidis
agcatgcaagatacattaatgagtattcaaattattccaaaaacaccgaacaacaacgatgttattccatatgttgatgaggcaattaaaattattgatgattcaggtttgcattttagagtgggaccgttagaaacaacagttcaaggtgaaatgagtgaatgtcttattttaattcaaaaattaaatgatagaatggttgaattagaatgtccaagtattattagtcaagttaagttttatcacgtacctgaaggaatagaaattgagacgcttacaggaaaatacgactaa

SEQ ID NO: 2103 - DNA, 285 bp, Staphylococcus epidermidis
gtgtggaaagaactttcccattacacacgcctaaaatcgaaaaaattgaagttaaacgtcgtggtaaagtacgtcgtgctaaattatattacttacgtagtttacgtggtaaagctgctagaattcaagaaattcgctaatcagtatattcgacaatttataaaaggccagtctataagcactatagttgccaatttcaacttattgcttaagatttgccataatgaaaaaagctttcaaacttctgttttaccagagtttgaaagcttttttattttatcttaa

SEQ ID NO: 2104 - DNA, 792 bp, Staphylococcus epidermidis
ctgaaaggagacaatcgtgtcttctttacttatatatttacatatttttacgatagagaggataagaaaatggcacaaacttctaaatataaacgtgtagtattaaaattgagtggcgaagctttagcaggtgataaaggattcggcataaatcctatcattatcaaaagcgttgcacagcaagttgctgaagttgccaaaatggattgtgaaattgctgtcattgtcggcggtggaaatatttggagaggcaaaactggtagcgacctaggtatggatcgtggtacggccgattacatggggatgcttgctactgttatgaatgctttggcattacaagacagtttagaacaattagattgtgatacacgtgttttaacttctattgaaatgaaacaagttgctgaaccatatattcgtcgacgtgcaattagacatttggagaaaaaacgtgttgttatatttgccgctggaattggtaatccttacttctcaactgacacaactgctgctttacgtgcggctgaagtagaagcagatgtaattttaatgggtaaaaataatgtagatggtgtttattcagctgatccaaaagttgatgcaaatgcaattaaatatgaacatttgacacatattcaaatgcttcaagaaggtttacaagtgatggattcaacagcttcatcgttctgcatggataataatattccgttaaatgttttctctattatggaagaaggtaatattaagcgtgctgtaatgggtgaaaaaatcggaacattaattacaaaataa

SEQ ID NO: 2105 - DNA, 1722 bp, Staphylococcus epidermidis
atagtgagtttatatatggacgggtcactatttataggaggtaacattttgagtttaataaagaaaaaaaataaagatattcgtattattccactcggtggagtaggcgaaatcgctaaaaatatgtacatcgttgaagtagacgatgaaatgtttatgttggatgcaggattaatgttcccagaagatgaaatgcttggggtagatatcgttattcctgacattcaatatgtcattgaaaacaaagaaagattaaaaggaatatttcttacacacggtcatgaacatgctataggcgcagtaagttatgtgttagaacaaatcgatgcaccagtttatggttctaaattgacaatcgcacttgttaaagaagcaatgaaggcccgaaatattaaaaagaaagtacgttactatactgtaaaccatgattcaattatgagatttaaaaatgttaacgtgagtttctttaatacgacacatagcattcctgatagcttaggcgtatgtattcatacttcgtatggttctatagtttatactggagagtttaagtttgatcaaagtttgcatggacattatgctccagacttgaaacgaatggcagaaattggtgatgagggtgtgttcgcattaatcagtgattcaacagaagctgaaaagcctggatataacacgcctgaaaatattattgaacatcacatgtatgatgcttttgccaaggttaaaggtagacttattgtatcatgctatgcttcaaacttcgttcgtattcaacaagtgcttaacattgcaagtcaacttaatcgtaaagtgtcatttttaggtcgttcacttgaaagttcgtttaacatagcacgtaaaatgggatactttgatataccaaaagatttattaatacctattaacgaagtggaaaattatcctaaaaatgaagtgattattattgctacaggtatgcaaggtgaaccagtagaagcattaagtcaaatggctcgcaaaaagcataaaattatgaacatagaagaaggagattcaatattcctagcaattactgcttcagctaatatggaggttattattgcagatacattaaatgagttagtgcgtgctggagcacatataattccaaacaacaagaaaattcatgcgtcaagtcatggttgtatggaagaattgaaaatgatgttaaatattatgaaacctgaatattttgtacctgttcaaggtgaatttaaaatgcagattgcacatgccaaattagcagcagaaaccggtgtagcacctgagaaaattttcttagttgaaaaaggcgacgtgattagttataacggtaaagatatgattttaaatgaaaaagttcaatcaggtaatatacttattgatgggattggcgttggtgacgtaggtaatatcgtattaagagacagacatctattagccgaagacggtatttttattgcggttgtgacattagatcctaaaaatcgacgtattgctgcaggacctgaaattcaatcaagaggcttcgtctatgttagagaaagtgaagaacttttgaaagaggctgaagaaaaagtacgtaaaattgtagaggaaggtcttcaagaaaaacgaatagaatggtcagaaatcaagcaaaatatgagagatcaaatcagtaagttactatttgagagtacaaaacgccgtccaatgattattccagtcatatcggagatctaa

SEQ ID NO: 2106 - DNA, 822 bp, Staphylococcus epidermidis
agatttaagtgcatttattttataaatatatatagaaggagaaaaattatgagcttattatctaaaacaagagaattaaacactttattacaaaaacataaaggtattgcagtagattttaaagatgttgctcaaacaattagtaatgttacagttactaatgtatttattgtgtcgagaagaggtaaaatcttagggtcttgtttgaatgaattattaaaaagtgaacgcattaaagatatgttagaagatcgacatataccgcgtgaatatactgaagagttgatgaatgttaaacaaacagaatcgaatatcgatattgataatgaattaactgtatttccgccagagaatagagaggtatttttaaatagtagaacaactattttcccaattttaggtggtggcgaaagacttggtacgctagtcttaggtcgagttcaagacgacttcaatgaaaatgacttagtattaggagaatatgcagccactgtaattggaatggaaattttacgagaaaaacataatgaagtcgaaaaagaagctagagataaagctgctataacaatggcaatcaactcactttcatattcagaaaaagaagcaattgaacatatatttgaagaacttggtggtacagaaggtttacttatagcttcaaaagtagctgacagagtgggcattacacgatcagtcattgtgaatgctttacgtaaacttgaaagtgctggtgtcatagaatcacgttctcttggaatgaaagggacatttattaaagtaaaaaaagataaattccttgatgaacttgaaaaaaataagtaa

SEQ ID NO: 2107 - DNA, 522 bp, Staphylococcus epidermidis
ataattattttagaggagttaagtacaatgaatattagaaagttgaccatcacagcattcttaatagctattaatgtcgtgttaagtagtttaattgtcattcctttaggtccaattaaagccgcacccgttcaacattttgtaaatgtattatgtgctgtatttgttggaccatggtatggtttagcgcaagcttttatttcttctgtactacgaatttcatttggaactggaagcgcatttgcttttccaggaagtatgataggtgtcttactttccagtctgttttatatgtataggaagcatatttttatggcttcagttggtgaagtattagggactggtgttattggtagtttaatgtgtatacctttagcatggtttttaggacttcaagatttctttattaaaccattaatgcttatgttcatagtatcaagttttattggggctttaattagttatatattgcttattattttgaaaagaagaggtttactagatagatttaacaaaaattaa

SEQ ID NO: 2108 - DNA, 315 bp, Staphylococcus epidermidis
ctcatggtccgtactgatttaactagtttccgttcaggagacactttacgtgtacacgtaagaatcgttgaaggttctcgcgaacgtatccaagttttcgaaggtgttgtaattaaacgccgtggtggaggaatttcagaaactttcacagttcgtaaaatttcttctggtgtaggtgtggaaagaactttcccattacacacgcctaaaatcgaaaaaattgaagttaaacgtcgtggtaaagtacgtcgtgctaaattatattacttacgtagtttacgtggtaaagctgctagaattcaagaaattcgctaa

SEQ ID NO: 2109 - DNA, 705 bp, Staphylococcus epidermidis
atgaaagcgctagtcataggtggttctggaacaataggtcgtgccattgtaaaacgactgctatttgaaggttatgaagttttcttacattatcattcagctcaatattctgatttaagtaatcaatttaaaaatagcaaagttacatttattcaatgtgatttaaccaaagatatagagctcgaagattactttggacacattgacgagctagattgtctaatttataccagtgggacagcattatatggcatgttacaagatatgagtgattgtgacatcgataatagttatgcattaaatgtaagacaatttatacgtttgactcgctactttattgatattttaaggcagagtaacaatggacgtatcattgttatttcatcaatttggggagaaactggagctagtttagagacaatctattcagcgatgaaaagtgctcaaattggttttgttaaagcattaagtcaagaattagctttaacttcagtaactgtaaatgctattacaccaggtatggtaaaagggaaaatgagcgatgtatggtcgaaagatgagttatcgaatatagtatcagagttacctcagcaaagaatgattgatccttctgaagtggcacatgcttgtgcatacttgtgtagtactatgtcaaaaagtattacgggtacagtacataaagtgaatggcggatggtatatttaa

SEQ ID NO: 2110 - DNA, 294 bp, Staphylococcus epidermidis
acaagtaagcgaagaagaatcaatcatgaaagagaagtattaaaacaacaagcattaaacgaaggtaaaccagagaaaatcgttgaaaaaatggttgaaggtcgtttacgtaaatatttacaagaaatttgtgctgtagatcaaaacttcgttaaaaatccagacgaaactgttgaagctttcttaaaagctaaaggtggtaaacttactgatttcgttcgttatgaagttggagaaggtatggaaaaacgtgaagaaaactttgctgaagaagttaaaggacaaatgaaataa

SEQ ID NO: 2111 - DNA, 1338 bp, Staphylococcus epidermidis
agctgttctagatacaatttatgtactaacgaaaggagaccaacactgatgaaaacacatcaatatgaacttatagatgagaaagttttcgaacatgagtttgataatggattgaaattatttatcattcctaagcctggttttcaaaaaacgtatgtgacctacacaacacagtttggttcattggacaatcattttaagcccataggtagtcagcaatttgtaaaagttcctgacggtgtggcacattttttagaacataaattgtttgaaaaagaagatgaagatttatttactgcatttgccgaagagaatgcgcaagctaatgcttttacaagctttgatcgtacgagttatttatttagcgcaacaagtaatattgaaagtaacattaaacgtctcctcaatatggtagaaacaccttattttactgaagaaacagttaataaagaaaaagggattatagctgaggaaattaaaatgtaccaggaacaaccaggatataaattaatgtttaatactttaagggctatgtattccaagcacccgatacgggtggatatcgctggtagtgttgaaagcatttatgaaataacaaaagatgatttatatctatgctatgagacattttatcatccctctaatatggtgttgtttgtggtaggcgatgttagtcctcaatcgataattaaacttgtagaaaagcatgaaaatcaaagaaataaaacttatcaaccacgtattgaacgtgcgcaaattgatgagcctagagagataaatcaacggtttgtttctgagaaaatgaagttacagtcaccacgattgatgctaggttttaaaaatgaaccattagatgaaagtgcaactaaatttgttcaaagagatttggaaatgacatttttctacgaattggtttttggagaggaaacggagttttatcaacaacttttaaataaagatttaatagatgaaacattcggttatcaatttgtattggaaccgagctacagtttttcaattattactagtgcaacacaacagcctgatctatttaaacaattaataatggatgaattaagaaaatataaaggaaaccttaaagatcaagaagcatttgatttgttgaaaaagcaatttattggagaattcatatcaagtttaaattctccagaatatattgctaatcaatatgcaaaactctatttcgagggagtgagtgtatttgatatgcttgatatcgtagaaaatattacgttagagagtgtaaatgaaacttccgaattattcttgaactttgaccaacttgttgatagtcgtttggagatggaaaatagatga

SEQ ID NO: 2112 - DNA, 318 bp, Staphylococcus epidermidis
ctcaccgacagttatgccttcttgataagtgattttagagggcatttcttttgtttctgctacctcattttgaggtttattatttttattattctttttatttttattgtttttttgattcttattagttttattgtttttattttgctgttttcctttgttgttttgttcttttttcttcgttggtttactattattcttactttgttgtttttctttatcgttagaattttgtttattattagatttttggtgattattttgagtattttgtttattagtgtctttcgcttgagaggctttaaattttttatctaa

SEQ ID NO: 2113 - DNA, 1275 bp, Staphylococcus epidermidis
attttgaagagattcaatcaagataacacaaaagttcgagtcaatgttttgcctaccgataaatttaaaacaacgacaattacatttaaatttatggcaccattaaactataaaacaattacttcacgttcaattttaagtaaagtattagttcgtgcaacacaacaatggcccaccgataaaactttaaataaacagttatcagaattgtatggcgcctatgttaatagttttgtttctaagtttaaagataagcatgttattacaatctcattagaagtagttaatgaaaaattcttaaaagataaaacccctttatttgaaaagggattagatacgttaaaagaaataatttggaatccattaatcaaagatagatgctttgatcatacatatgtagctcaagaaaagtctttacttagcaaaaaacttgaagcaatggaagataataaagcacagtattcatttcttcagttaatgaattatatgtttaaacaagaaccctatcgatatatagcgacaggtcaattagaacaaattccacaagtgacttctgaaagtctatacgatacatatctatccatggtacaaaatgatgattgtgccatatatgttgtaggaaatattaacaaagaggaagtaacgcaactaattctagataagtttgcaattaagcctttctatttagaaaataaagaaagtactgaaatcacaccttcttttgatcaaccgcaatatataattgaaaaagacgatgttgaccaagctaaattgaatttgggatatcgctttccatcttattatgggaaaagtaattactatgcatttatagtattaaatatgatgtttggaggagatccttcctcagtactatttaatgaagtcagagaaaagcaaagtttggcatactctatacattcacaaattgatggtaaaaacggatttttatttgttttaagtggtgtttctgctgagaaatatgagcaagcaaaagatactgtcatcaaagagtttgataagataaaaaatggagattttgattctaataaaattgaattagctaaaaaaatcattatttcccatagacacgaagcatcagatagacctaaaagtataattgaaatactacataatcaattattattaaaccgacagcaaactgatcaagattttataaatgcagttaatcaagtgacgaaaaaagatgttattaaattggcaaatgaagctgttctagatacaatttatgtactaacgaaaggagaccaacactga

SEQ ID NO: 2114 - DNA, 1167 bp, Staphylococcus epidermidis
atatcagggagtatatcattgatgaatatttcaattgtagctgttggctctgaattattactaggtcaaatagctaatacaaatgggcaatatctttcaaaactttttaatagtattggtaaaagtgtagtagaacacacagttattggtgataaccctcaaaggttagaatatgtaataaagcaatgtctatctagatttgataccattgttttaacaggtggcttaggaccaacaaaagatgatttaactaaacatactgtagctaaagtattaggaaaaaatctagtgacggatgaagcatcgttaaactttatcaaaaactattttaaagaacaaggtcaagatatgacctctaataataagcaacaagcattagtaattgaagatgccatagttttaccaaataaaaatggtatggctcctggtatgcttgtagaattaggtaaacaaaaaataattctactaccaggtccaccgaaagagatgcaacctatggcgaagaatgaattattaccttatcttatggataaagatgaagttattttttctgaattacttagatttgctggtataggagagtcgaaattagaaacactattaattgatctaatagatgatcaaactaatccgacaatcgcacctcttgcaggtacgcatgaagtatattttagattaacagccaatgctgaaagtaaggaacgatgtcaactgcttattaagcctattcgagatgaaattttaaatagggttggtacttattattttggctcagacgaagttaatattgaagaatcggttataaatagtgcaaaacagaattttgctatttatgacggtgtaactaatggagctttgtttactcgattaaaaaatgctgacagtaaaaatctagttaaaggtatgctaccacattctaatcaatttattgatgtgacttctgagtttaatgccgtgttattcaatgcagcacaatatgtcagggatttgtaccaaacagatttgggtattgtacttttaaataaagataacattgtatatttaggaatttatgatggaaataatttcgatatcgaaacatttaagatgtctcaaagtcgtaatttattgagaagcagaagtcaaaattatgcaatgattagattattaaattggtttaataaatag

SEQ ID NO: 2115 - DNA, 930 bp, Staphylococcus epidermidis
ggaaaggatgggagcactaagatgagtgtatttattgataaaaatacgaaagtaatggtacaaggtatcacagggtctactgcccttttccatacaaaacaaatgcttgattatgggacacaaattgttgcaggggtaacacctggtaaaggtggacaagttgtagaaggtgttccagtatataacactgttgaagaagctaaaaatgaaacaggagctaatgtatctgttgtatacgtaccagcaccattcgctgctgattcaattattgaagcagctgatgccgatttagacatggttatttgtattactgaacatatacctgttgttgatatggttaaagtaaaaagatatttacaaggtcgtaaaacacgtttagtaggaccaaactgtcctggtgtgataactgccgacgagtgtaaaatcggtattatgccgggatatatccataaaaaaggccatgtcggtgtcgtgtctcgttctggtacattaacgtatgaggcagtgcatcaattaactgaagaaggtatcggtcaaacaactgctgtaggtatcggcggtgatccagtaaatgggactaactttattgatgttttaaaggcgttcaatgaagattctgaaactaaagccgttgtaatgattggagaaattggtggtaccgcagaagaagaagcggcacaatggattaaagaaaatatgaacaaacctgtagtaggttttatcggcggtcagacagcacctccaggtaaacgtatgggtcatgctggagctattatttcaggaggtaagggtacagcatctgaaaagattaaaacattaaacgattgtggtgttgaaactgcagatacaccttctgaaataggaacaacccttattgatgcagctaaaaaagcaggcatttatgaagagttattaactattaaaaaataa

SEQ ID NO: 2116 - DNA, 1425 bp, Staphylococcus epidermidis
caatatggaggaatgttaaatatggatacaaatggaattaaattaaccccaaaagacatcgtatctaaattgaatgagtatattgtaggacaaaatgacgcaaaacgtaaggtggctattgcactaagaaatcgttatcgtagaagtcttttaaaagaagaagagaaacaagagattgcgcctaaaaatattttaatgataggtccaacgggagttggtaaaactgaaatagctcgacgcatggcaaaaattgttggagcaccatttattaaagttgaggcaactaaatttacagaagtcggttacgtcggaagagacgttgaaagcatggttagagatttagttgatgttgctgtacgtttagtaaaagacgggaaaaagtcattagttaaagatgaggcaactaagaaagcaaacgacaaattagttaaattacttgttccgagtttaaaaaagaaggcagcacaaggtaacaaccctttggaaaatttattcggtggagcaattccaaacttcggtcaaaatcaagatgaagaggaagaaccgccaactgaagaaattaaaaccaaacgttctgaaataaaaaaacaacttgaacagggcaaacttgaaaatgaaaaagtaagaattaaagtagaacaagatcctgcatcaatgggtatgttagggactaatcaaaatcaacaaattcaagatatgatgaatcaattgatgcccaagaaaaaagtcgaaagagaagtttcggttgaaacagctagaaaaatcttagctgatgattttgcagatgaattaattgaccaagaaactgcgaatcaacaagccttagagcttgcagaacaaatgggtatcatatttattgatgaaatagacaaggttgctactaacaatcaaaatagcggtcaagatgtgtcaagacaaggcgtacaacgagatattcttcctatacttgaaggtagcatgattcagacaaaatatggtactgtaaatactgaacatatgctatttataggtgctggtgcattccacgtatcaaaaccaagtgatttaattcctgaattacaaggtcgatttccaattagagttgaattagaaagtctttcagtagaagatttcgtgagaattctgacagaaccaaaattatcgcttgtcaaacaatatgaagcattgcttcaaactgaagaagttacagtaaatttctcagaagatgccattcaacgattagctgaaattgcatatcaagttaatcaagatactgataatattggtgctcgtagattacacactattctagaaaaaatgcttgaagatttatcatttgaagcaccaagcatgccgaatgctgttgtggatattactccacaatatgtagatgacaaattaaaatcaatctcaacaaataaagatttaagtgcatttattttataa

SEQ ID NO: 2117 - DNA, 1185 bp, Staphylococcus epidermidis
gaaacaggaggatggaagatgaatatccacgagtatcaagggaaagaaatatttcgttcaatgggcgttgcagttccagagggacgagtagcatttactgctgaagaagcagtggaaaaagcgaaagaattaaattcagacgtatatgtggttaaagcgcaaattcacgctgggggtagaggtaaagcaggcggcgtgaaaattgctaaatcattatctgaagtcgaaacgtacgcaaatgaactgctaggtaaacaattggtcacacatcaaactgggccagagggcaaagaggtcaaacgtttatatatcgaagaaggatgcgatatccaaaaagaatattatgttggttttgttattgatcgtgctactgataaagtgactttgatggcatcagaagaaggtggaactgaaattgaagaggttgcagctcaaacacctgaaaagattttcaaagaaacaattgatccagtagtaggattatcaccttaccaagcgcgacgtatcgcttttaatattaacattccaaaagaatcagttggaaaagcaactaaatttttattagcactatataatgtctttatcgaaaaagattgttctattgttgaaattaacccacttgttacaactggagacggtcaggtattggctttagatgctaaattaaactttgatgataatgcattatttaaacataaagatattttagaattacgagatttagaagaagaagatcctaaggaaatagaagcttctaaatatgatttatcatacatcgctttagatggagatattggttgtatggttaatggcgcaggtttagccatggcaacaatggatacaattaatcattttggtggaaatccagccaacttcttagatgtaggtggcggtgctacaaaagaaaaggtaactgaagcatttaaaattattttaggtgatgacaatgttaaaggtatctttgtaaatatttttggtggaattatgaaatgtgatgttattgccgaaggtattgtagcagcggttaaagaagttgaactaacattaccattagttgttcgtttagaaggaactaatgtcgaacgtggtaaagcaatattaaacgaatcaggtttagctattgagccagcagcaactatggctgaaggtgctcaaaaaattgtgaaacttgttaaagaagcataa

SEQ ID NO: 2118 - DNA, 4089 bp, Staphylococcus epidermidis
caattgatttttcaattaaagataccaacaatcaagatgagtttcgctttaaaatatttcggacattgtattgatcaaacacgattgtcgccaaaagtgaaaggtcaattgaaacaaaaaaaactcattatgagtggaaatgtgttaaaagtcttagtttcaaatgacattgagagaaatcattttgatagggcatgtaatggtagcttggttaaagcatttagacagtgtggctttgaaattgataaagtcgtttttgaaacagattcaacaaatcacgatgatgaccttggctcgttagaagcacatattccacaagaagatgaacaaagtgcaagagaagcaactgaaaaattagaaaaaatgaaagcagaaaaagcgaaacaacaagataataatgaaagtacagtggaaaaatgtcagattggaaaaccaattcagattgaaaatataaaaccaattgaatcaattattgaagaagaattcaaagtagctattgaaggtgttatatttgatattaacctaaaagaacttaaaagtggacgtcatatagttgagcttaaagttactgattacacagattcacttgtattaaaaatgtttacaagaaaaaataaagatgacttggaccactttaaggcacttagtgttggtaaatgggttagagctcaaggtcgtattgaagaagatacttttgttagggatcttgtcatgatgatgtcagatattgaagaaattaaaaagacacctaaacaagataaagcagaagataagcgtgtagagtttcatttacatacgtctatgagtcaaatggatggtattcctaatattagtgcatatgttgaacaagctgctaaatgggggcaccaagctttagcagtaacagatcacaacgtagtacaagcttttcctgatgcacataatgctgccgaaaaacatggtattaagatgatttatggtatggaaggtatgctagtagacgatggtgttcctatagcttataaaccaacagaccgtaatttaaaagatgcaacatatgtggtgtttgacgtagagacaacaggtctttctaatcaatatgataaaattattgaattagctgcagtaaaagtgcataacggtgaaattatagataagtttgaacgttttagtaatccacacgaaagattatctgaaaccattatcaatcttacacatatcactgatgatatgttaactgatgctcccgaaattgaagaagtgttaactgaatttaaagagtgggttggagatgctatatttgtagctcataatgcttcatttgatatgggatttattgacacaggatatgaaaggttaggctttggaccttctacaaacggtgtaattgatacacttgagctttcacgtacaattaataccgaatatgggaaacatggtttgaatttccttgccaaaaaatatggtgtcgaattaacgcaacatcatagagcgatttatgatacagaagcaacagcttatatttttataaaaatggttcaacaaatgaaagaactaggtgtgaacaaccatctagaaattaataaaaaattaactaatgaagatgcatataaaagagctcgtccatctcacgttacactcattgttcaaaatcaagaaggtcttaaaaatttatttaaaatagttagtgcttcattagttaagtattattaccgtacgccaagaattccacgttctcttttaaatgaatatcgagaagggatcttgattggtacagcttgtgatgagggtgaattattcacagcagtaatgcagaaggatcagtcggaagtagaaaaaatagcaaagttctatgattttatagaagttcaaccgcctgcgctttatcaagatttaatggatagagaattaatacgagataatgaaacgttaacacaaatttacaagcgattaatagatgctggtaaaagcgctaatatcccagtgattgctactggtaacgcgcattatctatatgaacatgatgctatagccagaaaaattttaattgcatcccaaccagggaatccattaaatcgttcaacattaccagaagctcactttagaaccactgatgaaatgttagatgattttcacttcttaggtgaagaaaaagcatatgaaatcgttgtaacaaatacaaatgagctcgctaataaaattgaaaaagtggttcctataaaagataaactatttacgccaagaatggatggggctaatgaagaaattcgtgagttgagttattctaatgcgaaaaaactatatggtgaagatttaccacaaattgttatagatcgccttgaaaaggaattagatagtattattggtaatggcttttctgttatttacctcatatctcaacgtttggtgaagaaatcgctagatgatggttatttagttggatcgcgtggttcagttggttctagtttcgtagcaacaatgactgaaattacagaagttaatccgcttccaccacactacatttgttcacattgtaagacaagtgagttctttgatgatggttcggttggatctggattcgatttaccagataaaaaatgtcctacttgtggtaatgaattaattaaagaaggacaagatatcccttttgagacattccttggatttaaaggagataaagttccagatattgatttgaactttagtggtgaatatcaacctaacgctcataattacacaaaagtattgtttggtgaagataaagtatttcgtgctggaacaataggtactgttgctgaaaaaacagcttttggtttcgtaaaaggttacttaaatgatcaaggtattcacaaacgtggtgctgaaattgatcggttggttaaaggttgtacaggggtcaaacgtacaactggtcaacatcctggaggaatcattgttgtaccggattacatggatatttatgattttacaccgattcaattcccagcagacgaccaaagtgcagcgtggatgacaacccatttcgacttccattcaatacacgataatgtcttaaaattagatatattaggacatgatgacccaacgatgattcgtatgttacaagacttatcaggaattgaccccaaaactataccagtagatgataaagaaacaatgcaaatatttagtggtcctgagagtttaggtgttacagaagacgaaatattatgtaagacaggtacatttggtgtaccagaatttggtactggatttgtacgtcaaatgcttgaagatactaagccaacgacattctcagaattagttcaaatttcaggtttatctcatggtacggacgtttggttaggtaatgcacaagagttaattcgtcaagggatatgtgacttatctagtgtgataggctgtcgtgatgatatcatggtatatctgatgtatgctggacttgaaccgtcaatggcttttaaaacgatggaatttgtacgtaaaggtcgtggcttaacagatgaaatggttgaagcgatgaaggaaaataacgtgccagattggtatttagattcttgtcgtaaaattaaatatatgttccctaaagctcatgccgctgcttatgtactgatggctgtaagaattgcatactttaaagtacatcatccactatattattatgcagcatactttaccataagagcttccgattttgaccttataacaatgattaaagataaaacgagtattcgtaatacagttaaagatatgtattcacgatatatggatttagggaaaaaagagaaagatgtattaactgtattagaaataatgaatgaaatggcgcatcgaggttttcgattgcaaccgattagtttagaaaaaagccaagcttttgacttcatcattgaaggggatacattgattcctccattcatttcagtgccaggacttggagaaaacgttgcacaaagaattgttgaagcgagagaagagggaccatttttatccaaagaagatttaaataaaaaagccggcttatctcaaaaggttattgactatttagatgaattaggctcattgccagatttacctgacaaggcacaattgtcgatatttgatatgtaa

SEQ ID NO: 2119 - DNA, 591 bp, Staphylococcus epidermidis
ggatttaatatgaatataccgaatcaaataacggtatttagagttattttaataccattttttattttatttgctttagttgattttggttttggacaaatttcaattttaggtggaaatcatattagaattgaaatattaattagtgctatcatatttgtggttgcatcattaagtgattttgctgatggttatcttgcccgtaaatggcaattagttactaatatggggaaattcttagatccacttgcagacaaattattggtcgcgagtgcattaattgttatggtacaacttggttttactaattctgtcgttgctatcataattattgctcgagaatttgccgtcacaggattacgattactacaaattgaacaggggtttgtaagtgctgcaggacaactagggaaaataaaaacagcagtgacaatggttgcaattatatggattttattgggcgatcctttcttacactatctacatttcccaattggagtgtggttattatacattggagtattctttactattctttcaggtattgaatatttttataaaggaagagatgtatttaaacattctaaataa

SEQ ID NO: 2120 - DNA, 375 bp, Staphylococcus epidermidis
cacaataatatgtatagtgaaaaagaaatcatacgaaaagtcgaaagtttagcagagaaaattggaaaactagaagttgttcaagattatcataatgtagaaaaacaaattcataataatcaagcaataaaacaaaagatgaatcgtttgaaagcgcaacaaaaacaatcggttaattttcaaaattatggaaaacaaaatgcactcgagcaatctgaagttaaaattcagaatctaaaagatgaaattaatgaattacctattgttgaagaatttcgttcagcacaatatgaagcgaatgatttactacaaatgatggtcaaaacaatggaagatagactcaatgaatataataaaaaagaacacaatgaataa

SEQ ID NO: 2121 - DNA, 315 bp, Staphylococcus epidermidis
cacagaatcataggttggagtgataaattaatgagaaagaaaaaaattccaatgagaaaatgtattatatctaatgaaatgcgtccaaaaaaagatatgattcgagtggttattaacaaagaaggcgaaatctttgcagatgcgacaggaaaaaaacaagggcgcggtgcatatgtgtctaaagatgtagctttagttgaaaaggctcaacaaagagaagttttagaaaaatattttaacgctactaaagatacacttgatcctgtttataaagaaataataagactgatttatagagaagagatcccaaaataa

SEQ ID NO: 2122 - DNA, 2613 bp, Staphylococcus epidermidis
ggattcgccatgattaaaaatatatggaataaacctattaaacgttttacactaatcgttttagttagttgtatattgtcatttattctatatggcccttttctctatcaatttataactaaaggtatagtatttagtggtagtggagatggcttcagacaaatgatgccttttcaaatgtacctttatgaacacttcacatcattaaaaggattttatgatgcttcatttggattgggaggcgactatgttaaatcactggcatattattattcactatctccattgatgtggatcaacttctccatgatatggatattagaacaaactatcaatgtgaatcctcatgacatcagcttttggccaataaaccaattaatcatggcatatgtgcgcactgtaatcacatttattttttcattttatttatttagttatttgcgacttaaacccgcaccaatgtttatcgcaactattttatatggtatgtctactgttgttacatattataattttacttggtctttttacggtaatcttttaattatgttacctatgtcactttgggctatagaaagattctttaaagaacgtaaaataggttggtttattttcgcgattgcttatacattattctcaaacttttattttagttactatgaagcaattgtcataggtttctattttatttatcgattcgctattcctcatgagaaagatattgtgaatcgttggcagaaattatacatactcgtatgtgccactttgttaagtgtattagtaagtatttatggactatatactggtatatcttcctttttagataatgaccgagcgcaaaatcctaatttcaaaattacttttttcacaaatttatttgaaaccaattataatatttttgctgatggtttttacattacaatttcttttattgctatcattgcattattttgttttaaattatatcaacactattattataaattgttcgcaattgcaacttggattttacttatcggttccttttctcaatggtttgacagtgcatttaatggtttttcattaccccaaagacgttgggtttactttttagcattatcaacaagtgtattaattgcattgttcatacaacatttaagtgaaatatcaattaaagaatacacctttgttgctataccagtattcatatacggtttcatatttatcgcactgtcggaaagatcagtaaagtggatgtttgttgcattgattttaatcatagtgttatttatatttattaaatataaatcgttgttaacacgtacctcaatgatggtattactcgttgtcttatttttagctcaacaagtcttaatgactaatgattccagaaaaattactatcgaaccttatcaaacgactatcaaaacaattaatgattcgagctatagaagccctgtcctaaataaaaaaattaagtatatgcatcaaagctctacagatccattgaaaagattagattatttttcatactatgcattaaactcacctttgatatatcactacaacggcacatcattgtattccagtattttcgatggagatatattgaaatactatgaccagacgttacaaattaatatgcctgtagataaaaatagtacttatcgatatttaaataatcgtgcaaacttaatgtctctttgggatgttcaagatcgattacgacatcctgatgatttaaatatgccttatggttttaaaaagaaagaacttataactgataaaaaagatcaatggattcactctgttaatacaataaattatcctagtgcacacattactaataaaatttatgatgcaagaaaactaaaatctccccttgatagagagcaagctatgcttaaaggtgtcgtattgaatcataaatcccaagccaatactgattttaaacctaatcctaatttactttctaatgcaaaacaaaacttaaatcatgcgaattggattgatagtaaacatttaaaagttaaacagcacaatggtggcgtcaccctcaatttacttcgcaatatagttaaaaattataaagatatgtatattgaaatggatgttgaattactgtctcttgacaaagagcataaagtaggggttaatgaatattcgcaagaaagaaaccgtttgtcatacaaataccgtcgttttgtttcgccagtgacgatgcgtgctaaagcttcaaatcaacttaacattaagatgtcaaaaggagtttatcgttttaaagtaaaaggaatttatggtgaaaactatcaaacattaaaaaaagcttctcaacagctccaaccagttaaagtaaaaaaagaaagaaatggtttcacaattattaaaaagaaaaaagaacatggttatcttgtcttgccaatggtatatgctaaaggaatgcatgcaatggcaaatggaaagcctctaaaggttcaacaaggaaacggtattatgactactattcctgtaaaagagggacaaacaaagataaaattaagttatacccctccttatttttatttattaatcactgtcagttgcattgggatcattttaagcattcttttcactcattacgtaaaaagaaaataa

SEQ ID NO: 2123 - DNA, 1290 bp, Staphylococcus epidermidis
aacatgagcattttaattacgattatttcatttatcatcgtatttggtgtactcgtaactgttcacgaatatggacacatgttttttgctaagcgagcaggaattatgtgtcctgaatttgcgattggtatgggtcctaaaatttttagttttcgtaaagatgaaacattatatacaattcgtctattaccggtgggtggttatgtcaggatggctggtgatggtcttgaagaaccaccagttcaaccaggtatgaacgtaaaaataaagttaaataaccaagacgaaatcacacatataattctagatgaccaacataaattccaacaaattgaagccatagaagttaagaaatgtgattttaaagatgacctatatattgaaggtatcacttcttatgatgatgaaaggcatcacttcactatagcgaaaaaggcattttttgtcgaaaatggaagccttgttcaaattgctccaagagatagacagtttacacataagaaaccattgccaaagtttttaacattatttgcaggtccgttatttaattttattttagctttagttctatttattggattagcatactaccaaggtacgccaaccaatgtcataggagaagttgtgaagaaatctccagctgatgaagctggattgcacaaaggtgataaaatagttcaggtaggtaatcataaaattaaaaattttgatgatatcaaacatgttcttgaccaaaataaaacggcgaaaacaactgtaaaaattaaaagggatggccaaaacaagtctgtagatctccaacctaaaaaagtagagagaaagataactaaaactaaaactcaaacaacttatcaaattggttttgcccctactacagaacacagcgtttttaaaccaataagctacggtatttataactttttcgataaaggtaagcttatttttacagctgttgttggtatgttagctagtatatttacaggagaattttcatttgatatgttaaatggccctgttggtatttatcacagtgttgattctgttgttaaatctggaattattaatttagtaggatacaccgctttattaagtgttaacttaggaataatgaatttgctacctattccagcgcttgatggtggtcgcatattatttgtactatatgaggctatttttagaaaaccagtgaataaaaaagcggaaacaggaattattgctgtaggcgcactttttgtggttattattatgattttagtcacttggaatgatatacaacggtatttcttataa

SEQ ID NO: 2124 - DNA, 393 bp, Staphylococcus epidermidis
gtgaaaacgattggtgaagtgttgaaaagtagacgtgaaagattgggtatgacactaagtgaattagaacaaagaactcagttaaagcgtcaaacgttaatacatatagaaaataatgattttaatgaactagccaagagtgattatactgaaggttttattagaaaatacgctaaagttgtaaatatcgaaccaaatcaacttattgaagcacatcaagatgagattcctgaaacacaatatcaaattgatgatgtgatacaaacattttctaatgggtatgaacccccttaccgacgtcaatctaaggaagcgtttcaattgttgatgtggatgggtttcattattttaatatctttaatcgtttggatactcgcagtattaattatataa

SEQ ID NO: 2125 - DNA, 801 bp, Staphylococcus epidermidis
acagagacgatcaggctcggaggaaagaccatgtttaaaaagctgaaaaataaaaataaaactgagacaaaccataataatgacttagacatacataatatacctgaacatgtggctattatcatggatggaaatgggcgttgggcaaaaaaacgtaaaatgcctagaattaaaggccattatgaaggtatgcaaacaatcaaaaaaattactcgcgaagcgagtgatataggtattaagtatttaacattatacgcattttcaacagagaattggtctagacctgaaagtgaagttaattacattatgaatcttccagtgaatttccttaaaacatttctaccagaattaattgaaaagaatgttaaaattgaaacaatagggttttatgaaggtttaccacaatctacaattgatgctattgattttgctaaagctaagactcagcacaatactgggttaactcttgtgtttgctataaattatggtggacgagctgagattattcagagtatgaaagcaatatataacgaattacaattaaacggacaaggatctgaagtgattgatgaggcgttaataaagcgtcatttaatgactcatagttatccagatccagacttattaatacgcacttcaggagaacaaagaataagcaatttcttaatatggcaagcttcatatagtgaatttatttttaatgaaaagctatggccagattttgatgaaaaagagttaagagagtgtttgaaaatatatcaatcacgccaaagacgttttggaggattaagtgaggagtaa

SEQ ID NO: 2126 - DNA, 867 bp, Staphylococcus epidermidis
ctcatggcgatacaatggtatccaggtcatatggctaaagccaaaagacaagttagtgaacaactgaaaaaggtagatgtagtttttgaactcgtcgatgcacgtattccatacagttcgagaaaccctatgattgatgatgtcattaaacaaaaacctcgagtagtaattttaaataaaaaagatatgacgaatttaaaagaattagaaaaatgggaaatttattttaaaaatgaaggtttctatccggtagctgtagatgcaaaacatggcaagaatcttaaaaatgttgaagttgaagctataaaagcaactcaagaaaaatttgatcgtgaaaaagccaaaggtttaaaacctagagcgataagagctatgattgtaggcattcctaatgtaggaaaatcaacacttatcaataagttagcaaaacgtagtatcgccgaaactggaaataaaccaggagtaacaaaacagcaacaatggattaaagttggaaagtctcttcaattactagatacaccaggtattttatggcctaaattcgaagatgaagaggtcggtaaaaaattaagtttaactggtgcaattaaggatagtatcgttcatttagatgaggtagctatttatggtttgaattttatgattaaacatgatgtttcagctttaaagagacattataatattgatacacatgaagacgctgagatactcgattggtttgatgcaattggaagaagaaagggattgttacaaaaaggaaatgaagtagattatgaatctgtcattgagttgatcatcaatgatatgagaaatgcaaaaattggaacttattgttttgatattttaaaagaaatgaagagtgaatga

SEQ ID NO: 2127 - DNA, 348 bp, Staphylococcus epidermidis
tgtttaatagttttaaatttagtattaattaaggtggttattattttggcaatgacaaatcgagaaaagtttaaagtgcttgccgatcaaataaaaatatcaaatcaactagaacaagatattcttgaacaaggtgaactcactcgtatagatgtttcaaataaaaacagaacatggactttccaaatatcactcccacattttttatctcatgaagattatcttctttttacacatgcaattgaagaagaatttaaagaaatagctacagtagcaattgatttttcaattaaagataccaacaatcaagatgagtttcgctttaaaatatttcggacattgtattga

SEQ ID NO: 2128 - DNA, 1074 bp, Staphylococcus epidermidis
ctttctgtagtaggaggtctcgttttggataatgaacgtcaaaaagctttagatacagtaattaaaaacatggaaaaatcttttggtaaaggtgccgttatgaagttaggcgataataaaggtcgcagagtatcaagcacttcaagtggttctgtcacagttgataatgcattaggggttggaggttatcctaaaggaagaattatcgaaatatatggacctgaaagttcaggtaagacgacagtagctttacatgctatcgctgaagtacaaaaaaacggtggtgtagcagcatttatcgatgccgaacatgctctcgatccagtatatgcacaagcattaggtgtagatattgataatttatatttatctcaacctgatcatggtgaacaaggtcttgaaatcgccgaagcttttgttcgtagtggtgctgtggacattgttgttgtcgattcagtagcagcattaacacctaaagctgaaattgaaggtgaaatgggagatactcatgttggtttacaagcaagattaatgtctcaagcattaagaaagttatcaggggctatttctaaatctaatactacagctatatttattaaccaaattcgtgaaaaggtcggtgtgatgttcgggaatcctgaaacaacgcccggtggtagagccctaaaattctatagttctgtacgtttagaggtaagaagagcagagcagttaaaacaaggtcaagatattgtaggtaacagaaccaaaataaaagttgtaaaaaataaagttgcacctccatttagagttgcagaagtagatattatgtatggtcaaggtatctctaaggaaggagagctcattgatttaggtgtagagaatgatatcgttgataaatcaggtgcttggtattcttataatggagatagaatgggccaaggtaaagaaaacgtcaaaaattatcttaaggaaaatccacaaatcaaagaagaaattgaccgtaagttacgtgaaaagttaggtattttcgatggtgatgtggatgaaaatgagaatgaagacgattcaccaaaaactttatttgatgaatag

SEQ ID NO: 2129 - DNA, 786 bp, Staphylococcus epidermidis
aaaatgaaagtaagaacattaaccgcgattatagccttattaatattcttgcccatcttgctcaaaggtggcttaatattaatgcttttcgcattcttattagctttgatagccttaaaagaactacttaatatgaatatgatcaaatttttatctatacctggtctgattagtgctttagccctaattattatcatgttacctcaagatgcaggtgaatgggttcaagttatccaacttaaaggtttaattgctatgagtttcatagttttaagttatacagtgctatctaaaaacagatttagttttatggatgctgcattttgtttgatgtctgtagcatacgtaggaattggcttcatgtatttttatgagacacgttctgagggcttgagatatattttatttgcatttttaatagtttggctaacagatacgggtgcttatatttttggtcgccttatgggtaaacataagttatggccagtcattagccctaataaaacaattgaaggtttctttggtggtattttatgtagcattttagtaccattagtgatgcaaatgtttgtagatttacatatgaatatttggcttttactattagtcacaattgttttaagtatgtttggtcaattaggtgatttagtagaatctgggtttaaacgtcattttggtgttaaagattcaggacgtatactaccaggacatggtggtatattagatagatttgatagcttcatgtttgtattaccgctattaaatattttactgatacaaacttaa

SEQ ID NO: 2130 - DNA, 552 bp, Staphylococcus epidermidis
tgtaggggagttttaattatgaaagagaatattttgccagctattagaaatatgagagatttagaaaagttaattaaaacagactacaaagcatgtgttgtgttagatatgcatataggtcatttgaaaagcattatggagttacttaaaagtcattcgattgaatgttatgtacatatcgatttaatcaaaggactcagtcatgatgaatttgcttgtgagtacattattcaacaatataaacctaaaggtattgtttctacaaaagctaaggtcatcaaaaaagctaaaatgttaaatactttgacgatatttagagtgtttatcatagatagtcaagcattaacaagaagtattgaactcattaaaaaagtagagcctgactatgttgaagttttacctggtgttgcaagtaaagcagtgagtaaaattcaacaagaaacatcagcgtcagtaatagctggtggtcttatcgatgaacaatcggaaattagagaagcaatttccaatggcgctaagtacgtcactacaagttacgagaaactttggtaa

SEQ ID NO: 2131 - DNA, 2187 bp, Staphylococcus epidermidis
atgaatatggtaaggagtgattatatgagtaaaaaaagaatttacgaatatgcgaaagaattaaatctaaagagtaaagagattatagatgagttaaaaagtatgaatgttgaagtgtcaaatcatatgcaagctttagaagaagaacaaatcaaagcattagataaaaaatttaaagcctctcaagcgaaagacactaataaacaaaatactcaaaataatcaccaaaaatctaataataaacaaaattctaacgataaagaaaaacaacaaagtaagaataatagtaaaccaacgaagaaaaaagaacaaaacaacaaaggaaaacagcaaaataaaaacaataaaactaataagaatcaaaaaaacaataaaaataaaaagaataataaaaataataaacctcaaaatgaggtagcagaaacaaaagaaatgccctctaaaatcacttatcaagaaggcataactgtcggtgagttagctgaaaagctaaatgtagaatcagctggtattattaaaaaattgttcttactaggtattatggctaatatcaatcaatcattggatgaagaaacattagaattaattgcagatgactatggcgttgaaatagagaaagaagtagtcgttgatgaagaagatttatcaatttattttgatgatgagactgatgattctgatgcaattgaacgtccagcagttgttacaatcatgggccacgtagaccatggtaaaacgactttattagattctattcgtaacactaaagttacagaaggagaagctggcggaatcactcaacatattggtgcttatcaaattgaaaattcaggtaaaaaaattacgttcttagatactcctggacatgctgcatttacgactatgcgtgcacgtggtgctcaagttactgatattacaattttagtcgtggccgctgatgatggtgtgatgcctcaaacaattgaagctataaatcacgctaaagaagcagaagtacctacgattgttgcagtaaacaaaattgataaaccaactgctaaccctgatcgtgttatgcaagaactcactgagtatggattaattccagaagactggggcggtgacacaatctttgtaccactatctgcattgagtggagacggtattgatgatttattagaaatgatcggtttagtagcggaggtacaagaacttaaagctaatcctaataaacaagctgtaggtactgtgattgaggctgaattagataaatcacgaggtccagctgcatctttacttgttcaaaatggtactttaaacgttggagatgcaattgttgtaggtaatacttatggacgtatacgtgcaatggttaatgatttaggaaaaagaattaaatctgccggtccttcaacacctgtagaaattactggtattaacgatgttccacttgcaggtgatcgttttgttgtatttggtgatgaaaaacaagcacgtcgaattggtgaagcacgtcatgaggcaagtgtcatacagcaacgtcaagaaagtaaaaatgtttcattagacaatttatttgagcaaatgaaacaaggtgaaatgaaagatttaaatgtcatcattaaaggtgatgtacaaggttcagttgaagcattggccgcatctctaatgaaaatagatgttgaaggtgtgaatgtacgaattattcatacagctgttggtgctatcaatgaatcagatgttacattagcaaatgcatcaaatggtattattattggttttaatgtacgcccagatgcaggtgcgaaacgtgcggctgaagctgaaaatgtagatatgcgattacacagagttatctataatgttattgaagagatagaatcagctatgaaaggtttacttgacccagaatttgaagagcaagtcattggacaagctgaagtgcgtcaaacatttaaagtttctaaagttggtacaattgctggtagttatgtgactgaaggtaaaatcactcgtaacgctggtgtacgcgtaattagagatggtatcgtgttatttgaaggtgaacttgacacattaaaacgtttcaaagatgatgctaaagaagtagctcaaggctatgaatgtggtattacaattgaaaaatataatgatctcaaagaaggagacattattgaagcgtttgaaatggtagaaattcaaagataa

SEQ ID NO: 2132 - DNA, 867 bp, Staphylococcus epidermidis
ttggctacatttaaagattttagaaataatgtgaagccaaactggtgccctggttgcggtgacttttcagttcaagctgctatacaaaaagcgacagcgaatattggtttagaaccagaagatgtagcaatcattacagggattggttgttctggtagactatcaggttatattaattcttatggcgtacactctattcatggacgtgcattgcctctagcacaaggcgttaaaatggcaaacaaagatttaacagttatcgcttctggtggtgatggagacggctatgcaataggaatgggacatactattcatgctcttagacgtaatatgaatatgacgtatattgtcatggacaatcaaatatatggattaactaaaggacaaacatcaccttcctcagctaaaggatttgtaactaaatcaacacctaaaggaaatatagaaaagaatgtagctccattggaattggcactgtcctctggtgcaacttttgtagcacaaggattctcaagtgatataaaggcattaactaaaatgattgaagatgcgattcatcatgatggtttttcttttgttaatgttttctcaccttgtgttacttacaataaagtgaatacttatgactggtttaaagaacatttaacaagtatcgatgatattgagggctatgacatcacagataaacaacttgctatgaaaactgtgctggatcatgagtcactggttaaaggtatcgtttatcaagatacaacaacaccttcttatgaatcgcaaatttcagaactagaacatgaggcgttagctaaaagagatattcatattacagaagaaactttcaacgatttaactgcacaatttttataa

SEQ ID NO: 2133 - DNA, 639 bp, Staphylococcus epidermidis
gatgatttttcggaggttaatatggacaaatttaaatctatgacagaattaaaagaattgactaaagaaggaaaagattgggaaatagagtgtgaaaatcgttctagcatagtcactatattagcattacatggcggtggaattgaacctgccacaactgaattagcctatacaattgcacattgtggcgactataactatttttcctttaaaggtatgagaagtaaggggaataatgagttacatgtgacttccacacattatgatgaccaaattgcattagatttagtgagaggtagccaaagaactgtagccatccatggttgtgaaggtaatgaaagtgtggcttatataggaggtagtgatgacagactaattgagttaatcaccgaatctcttgaagatataggaattagcgtgcgagaagcaccacatcatatttctggaactcaagaaaataatattgttaatatgactcaaacccaaggaggagtgcaattagaactgacagctcagttaagaaaggagctatttaaaaatagaaaaagttcacgcaaaaaccgtgaaaataaagataattgggatgatttaatgtacgactttgctgatgcaatgaaaaaagctatagaacgtgcataa

SEQ ID NO: 2134 - DNA, 627 bp, Staphylococcus epidermidis
  unsure (502): Identity of nucleotide at the above locations are unknown.
atggcaatttcagcaaaacttgttaaagaattacgtgaaaaaactggcgcaggaatgatggattgtaaaaaagcgctaactgaaactgatggtgacatcgataaagcgattgactacttacgtgaaaaaggtattgcaaaagcagctaaaaaagctgaccgtatcgcagcagaaggacttgtacacgttgaagtaaaagataatgaagctgcaatcgttgagattaattcagaaacagacttcgtagcacgtaacgaaggtttccaagaattagttaaagaaattgctaaccatattttacatagcaaggtagaaacagtagacgctttgatggaatctaaattatctagcggtaaaactgttgatgaaagaatgaaagaagctatctcaacaattggtgaaaaattaagtatccgtcgtttctctatcagaacaaaaactgataatgatgcatttggtgcatatttacacatgggtggacgtattggtgtgttaactgtantggaaggtactactgatgaagaagctgctaaagacgtagcaatgcacattgcggcaatcaaccctaaatatgtttcttctgaacaagtaagcgaagaagaatcaatcatgaaagagaagtattaa

SEQ ID NO: 2135 - DNA, 873 bp, Staphylococcus epidermidis
acaaagatttcatgtgcttcgttgttaacaaggggtgatcaagaaatgacttttgcaaaaaggaaagagtggtacttagaatatgagataactgtaaatcgtgctggcttactcggtgatatttcaagtttgcttggaatgctcggcattagtattgttacaattaatggtgttgatcagggaaaaaggggattgttaattaaaacagatcaactagaaaaggtcgaaaggttcgaacaaattgtaaaagaaattaatgaaatagaaattacaaagttaagagttcctgaattacgagatagactcgctgtacgacacggtagatatattgaacaagatgctgatgataaaaagacttttaaatttgaacgagaagatttaggattacttgttgattttttagctgagttatttaaagaagaaggacataaattaatcggaatacgtggaatgcctagagttggtaaaactgaatctattgtagctggaagtgtttgtgcacataaaagatggttattcataagctcaactttaattaaacaaacagtaaggcgttcactatttaaaggtgaatatgattctaatcacgtatatatcattgatggtgcggtaacagcacgtgaattgaaccctgagcaccaagaattggtgagagaggttatgacgttaccctcaataaaagtagttgaacatccagatttatttgtagagtcgtgcaattataatatggaagattttgactatattattgaattgagagaaaatgaagatcaagagattcgatatgaagaaatgaagaaacatacggttcaaagcaagaataatttagattttggagatccatttggtggagggtttggtttctttgaataa

SEQ ID NO: 2136 - DNA, 342 bp, Staphylococcus epidermidis
agtgttcgctcatgtgaaattaattcaatctgtaggtcatcactcgaacatcctacaaagcgtgtgcttgctccctgttgtggtaaatgtagagccttttattttcaaaatgatgtagttattgccaaaacatcaatgacaactattcaacttcaacccaaacaagttattaatatgatgacgcaattacaggatgcaagtattattttcaaacaaacggattgtctccataatgctgctatcagtgatgtaaaagattttttgaacatcaccacgatatcgtacgtcataacactcttgataaattatacggttattatattcaacgacatataccggtga

SEQ ID NO: 2137 - DNA, 213 bp, Staphylococcus epidermidis
tgtaaaagattttttgaacatcaccacgatatcgtacgtcataacactcttgataaattatacggttattatattcaacgacatataccggtgagagataagattttgatttttagcggtcgtatttcattagaaattttaatcaaagcagctaaaattgatgtaggaattatattctctaaatcttccctacttcacttcaatacaacttga

SEQ ID NO: 2138 - DNA, 1242 bp, Staphylococcus epidermidis
gtaaagtttttagcttctcaattattcaaaggaggtttttttatcgattacttaggtgttgatattagtaaaagaagtagtgtagttgcacattataaaaatggaaaattccaaaaagagtttttcatccaaaataataaaaatggttacaattatttactcaagtatttgaatgacttagaccacccacaactcatttttgaatctacaggtatctattcaagaggtatggaacgattttgttgtgtaaatcaaattaactatattcaaatgaatccgttagaagccaaatttaaaacgagcactctaagatcatggaaaactgatcaggcagatgctcataagcttgcttgtttaggaccgacgcttaaacaaacagacaacttacctatacatgagttaatattctttgaattaagagaacgcgtccgttttcatctagaaatcgagaatgaacaaaatcgacttaaatttcagatccttgaattattccatcaaacattccctggtttagaaagattattcagtagtcgatattcaatcattgcactcaacatcgcagaaatctttactcatccagacatggttcttgatatcgacaaggaggtactgattacacatatattcaattctacagataaaggaatgtcaatggataaagctacaaaatatgcacttcaattaagagtgattgctcaagaaagctatcctaatgtcgatagacattcctttctagtcgaaaaattacgcttacttattcaacaattaaaacaatctattcatcatctcaaacaattagatgatgccatgattcaattagcacaacaactcgattattttgaaaatattcattcgatacctggtattggtaagctaagcacagctatgattattggggagattggtgatattaagcgatttaaatcaaataaacaactcaatgcttttgttggcattgatatcaaacgatatcaatcaggtcatacacactgtagagataccatcaacaagcgtggtaataaaaaagcgagaaaacttttattttgggtgattatgaatataataagagggcagcatcattatgacaatcatgtcgtcgattattactacaaactaagaaagcagcctaatgagaaacctcataagactgccatcattgcttgtataaatcgattattaaaaacaattcattatcttgtaatgaatcataaattgtacgattatcaaatgtcaccacattag

SEQ ID NO: 2139 - DNA, 282 bp, Staphylococcus epidermidis
ttagtaatgttattaaatatcatagaaggagtgacgcatatcaatcctaaagtattaaaagctctagcaatcacatctaatgtactattagttattggaatcatctgtttaattatgctaaagctcatgttagctattgcattttttgttgtatcattaacaattagtctcgtcatttttaatgttatgttcagacaccgtacaggtatgaaaattgcaattaatgtctcgttctttatagtgatgattgctatcgtaatagcctattttgtattatcttaa

SEQ ID NO: 2140 - DNA, 198 bp, Staphylococcus epidermidis
tttccgtcaccattagctgaattggttaataaatatagttattcattaatacctaataaactttcatccaccgcccttttccaacttcggaaatacaaaaacaaccctctaaccattgctgttaaagggttgttgcattattatattatattctattcccactcaattgtacttggtggcttagaggtaatgtcatag

SEQ ID NO: 2141 - DNA, 498 bp, Staphylococcus epidermidis
ttacatccacctgaattaatcagtattcaaattattaaaattgctccaatctattcttgtgtaagaatagattggattttttatttaatagtaatgtttgtgagaggccattgcctcgaagttacgaatttgagaaaatggttctattactttaataggaggaataaaagaatgcaatggcttaaagttatattagccggttttattgaaatcatctgggtcactggacttgatcaagcgcactcattgtttacatggatattcaccctcttttttattgctttaagcttttttctagtcattgatgcttcgaagcacttaccagttggtacggtatatgcattttttgtcggaataggtgctgttggtacagtgttagttgatatgattttcttcaaccaaccatttactttcactaaaatatttttaataatgacccttattttaggaataataggattaaaactgacaactgatgcaacgaaagaagggagataa

SEQ ID NO: 2142 - DNA, 579 bp, Staphylococcus epidermidis
gtggagtcgttaggacgaaaagtcaaagaagatggcgttgtcatcgatgagaaaattttgaaggtagatggatttttaaatcatcaaattgatgcaaagttgatgaatgatgtaggtaaaacattttatgagtctttcaaagacgctggtattactaaaattttaactattgaagcttctggtattgcgcctgctattatggcttcttttcattttgatgttccttgtctatttgctaaaaaagctaaacctagtactttgaaagatggcttttatagcacggatattcattcatttacaaaaaataaaacgagtacagtcattgtatctgaagaatttttaggtgcagacgataaagtacttatcattgatgactttttagctaatggtgatgcttcgctaggtcttaatgacattgtaaaacaagcaaatgcgacgacagttggcgtgggtattgtggttgaaaaaagtttccaaaatggtcgccaacgtttagaagatgcaggcttatatgtatcttcactttgtaaggtagcttcattaaaaggcaataaggtaactcttttaggtgaagcgtaa

SEQ ID NO: 2143 - DNA, 411 bp, Staphylococcus epidermidis
gcaattgagttttatcacacaaacacaacatccaagaatcaacttaggaggcatattattatgagtaacaaagtacaacgttttattgaatcagagagagaattaagtcaattaaagcattggcttaaaacgacatatcgtatttctattgaagaatttgtagttctttacaaggtctatgcagacactaaaattagtggtaaagagttacgagacacattacatttcgagatgttatgggatacaagtaaaattgatgtgattattcgtaaaatctataagaaagaactcatttctaaattacgctcagaaaccgatgaaagacaagtttactatttcttcgatgcaaagcaaaagaaattattggacaaaatgactggagaaattgaaacaattagtattgcaaattaa

SEQ ID NO: 2144 - DNA, 279 bp, Staphylococcus epidermidis
ccaagccatactttttatctcccttctttcgttgcatcagttgtcagttttaatcctattattcctaaaataagggtcattattaaaaatattttagtgaaagtaaatggttggttgaagaaaatcatatcaactaacactgtaccaacagcacctattccgacaaaaaatgcatataccgtaccaactggtaagtgcttcgaagcatcaatgactagaaaaaagcttaaagcaataaaaaagagggtgaatatccatgtaaacaatgagtgcgcttga

SEQ ID NO: 2145 - DNA, 438 bp, Staphylococcus epidermidis
cagtccatcacccaatcgtttaaggaggctatatcaatgattcctggtgaaattattgttaaaaatactgaaatagaagtcaataaacatcatcccgaaacggtgattgaagtgaaaaatacgggcgatagacctatacaagtaggttcacatttccactttttcgaagcaaataaggcattagaatttgatcgtgagaaagcatatggtaaacatttggatattcctgcaggagctgcagtgagatttgaacctggagatgaaaaaaaagtacaacttgtcgaatattctggacgacgtaaaatttatggattccgtggtttagtcgatggcgatattgacgaagaacgcgtattccgtccaaatgattcaaatcaaaacgccgccgttaaaaacgatgcaggcgaagacaatgcgaataaaaaaggtggtaaataa

SEQ ID NO: 2146 - DNA, 189 bp, Staphylococcus epidermidis
actaaattaacaaggtgccttatgtatagagattataacaagactcaacttactctaccaatggaaacttcagtacttatccccacaaatgatattacacgatatgtacataatattgtagaaacaattctagagactgaattcagacatcatcgtgattcaacatcataccatccaaaaatgatgtaa

SEQ ID NO: 2147 - DNA, 666 bp, Staphylococcus epidermidis
tatagtccaaccaggagatacaattgcgctcattccaccggtcagtgggggttgatcaagatgaaagcaattattttagcaggtggagaatctagccgatttggtaaagctaaagcttttgctaaaattgataatcaatatttttatcaaaaaattatagaaacgttaaaatctacaaatatgtttaatcgcattatcattagcactaattcccaattagcttctcagtttgaatatgaatatgtgattattgatgacgaacatcatcaaaataaagggccgctaacaggaatttactcagtgatgaagcaatacatggatgaagaattgtttttcattgtatctgttgatacaccaatgattacaagtaaagcagtgaatgggttatatcatttcatggtatcaaacttaattgaatcacgtttagatattgtcgcgtttaaagaaggagaaatatgtataccgacgattggtttttatactctatcgacgtttccttttattgaaaaagctttaaattcaaatcatttaagtctaaagcatgtcattaaacaattatcgacagattggttagatgttactgaaattgactcgcctcattattggtataagaatattaattttcagcatgatctggactctttaaaaaagcagataaatgaataa

SEQ ID NO: 2148 - DNA, 444 bp, Staphylococcus epidermidis
ccatgtaagacaacatttttaaaaggggcgataatcatggcaaaaattactgtagtgaataaccaagatgaattatataaagtcatcaatcaaataaaatctgaaggttatttagagacagaattagctgttatcagtaaaagtaagttgcacttagatgatttacacaactctcaaatctcgttaatggctacaagtggctcatttagtgaccgtatgtctcgtttacttacaggtgaagatggagaagaaacagtattatctcgttatgatttaactgacaatgaactagaaggatataaacaagatattttaaacgataaaatgctcgttgttgctaacagtgaccgttcttctcatgatgaagttgaagataataatgctgcatataaagaagtggatattactcattatgccgcagagtctgaagggcctaaagcataa

SEQ ID NO: 2149 - DNA, 264 bp, Staphylococcus epidermidis
agaggtttttatatgagaaagtttattttattgttatttattatcctaaatctcgtggcaatcattattacaatcaatcacccactaacaatttcatattttagtcttcgtgtcatcttcgtagcatttatatttattatatccattttttttatttttttacgtaccacaaactatgaattgattctaagtattttatctaccgttttcgctttcatacacatcggtttaattattcacagtgcctatctatatttatactag

SEQ ID NO: 2150 - DNA, 369 bp, Staphylococcus epidermidis
aggagtgctcatatgaataaagcgcttgttatacgtgcaatcaaattttctttaatatttatgactgcatttttaattcttaatttattgactatgaaagaggcttcaatatcgtctattattgtacgaactgtcattgcagctattgttttctttgtcatttatatcattgtatttacaattttaagttcgtcagaacgtaaaattatttatggtacaactttacctattgcgctttttatatgccttatattcggagcaattttcttcactccgcgtataggtatcattgccggactaattataggtgtgtttgctggtgtcatatgggagttcttaaatagaaaaaatggaggtcgctcatcttga

SEQ ID NO: 2151 - DNA, 210 bp, Staphylococcus epidermidis
tgtggctatcataaaatcaaaagcctacttataaaacgattaatcgattcaaaaccaaataaaaaaataatgaggaattatagttgggaatatttcaatgcccaaattaaaaaaagctttcagaaccaaaacaaaaccatctacagtcaaagtaaaattgatgtggagcctgattttggattttcactcgtatgtccgttcgagggatga

SEQ ID NO: 2152 - DNA, 360 bp, Staphylococcus epidermidis
ttattcaatcatatgggaggctttatgaattatttagaaatttcactacatattgaacaacaacttgttaaattactctctctgagtgaaaatgcgaaatactatgcactcatacatcataacaaatttgaatcttttatagatgatttcaaccttactgtaaatcaagagatgaaatgggcaatgtctcatcaattgttgttgaattctaatgatacgcttttatcgtactgccaattgattcgaaggttaaacgattctccacttttaactttaaaccaaggacatataatttattacattaatacacaacaaacactcattcaccgacagttactcaaacataaacaagctctttag

SEQ ID NO: 2153 - DNA, 891 bp, Staphylococcus epidermidis
caaatgaatcatttaactactgaaacgagaaatatacaaacgatgcatctggatgaaatgaatctaagtgatgcattaaaaactatgaatcaagaagatcaattagtacctaaagcgatagaacctgttattcctaatttaacaaaagtgatagagagtgcaattcaacgctttaataatggaggacgaattatttatattggtgcaggtacaagtggaagacttggcgtactagatgcagcagaatgtgttccaacttttaacgtttcaccaaatgatattattggaatcatcgctggtggacaaaaagctatgacggtagctattgaaggtgcagaagatgatgctgaacaaggtgcacaggatttaaagaacatccatcttcaatccaaagatattgttgtgggtatttctgctagtggacgtacaccatatgtaaaaggtgcactagtttatgcaaataaaatgaatgcagaaacagtcgcactctcttgtaacgttcacagtgatataagtaaaaattcaaatcacgtattagaaatcaatgtgggacctgaagtattaacaggctctacgagattaaaatcaggtactgctcaaaaattagttttaaatatgatttctacaatgacaatgattggcgtgggtaaagtttatgataatttaatggttgatttacgacctacaaatcaaaagttaatccatcgttctattcgcataattcaagatgtgtgtgatttaaatcatcaagaggctatagaattatatgaaaaatcagaccacaatatcaaaatagctatcgtaatgcacttatgttccacaactcaacaagatgcaagacttcgtttaaaacaaaataatggagtgattaagcaagctatcaacacttaa

SEQ ID NO: 2154 - DNA, 642 bp, Staphylococcus epidermidis
agatggggtcaagttatggaaaataatgagttgcaaaggggattgaatgcacgtcagatgcagatgattgctcttggtggaacaattggtgttggtctttttatgggagcaacaagtacaattaaatggacaggtccatcagttattcttgcatatttaattgctggtatttttttatttttaatcatgagagccatgggtgaaatgatatatattaatccaaccactggttcttttgcgacgtttgctagtgactatattcatccagcagctggctacatgactgcttggagcaatgtatttcaatgggttgtcgtcggcatgagtgaagtgattgcagtaggagaatatatgaactactggttcccaagccttcctaattggataccaggagtgatagcagttctctttttgatggctgctaacctagtttcagtaaaagcgtttggagagtttgaattttggtttgccttaattaaagttgtaactattgtattaatgattattgcaggattacgattaattttatttggtataggcaatggagggaatccaatagggatttctaacttatggtcacatggtggatttatgccaaatggattcattggatttttctttgctttatctattgtgatttga

SEQ ID NO: 2155 - DNA, 867 bp, Staphylococcus epidermidis
gcacgacgtcttactgaaagggttaacttaatggctgagcaacgttggaccggtcaactagatttaacagttttcaataatggtcaaagctcaaaagcacgaaatatattttttgaaaaggcgctcaaagtactacgacctatatatttagaacaatctcctgtaccaacattctatattgtcaatgttggtggaggttatctagatggagatagataccgtgtcaacgtcaacttagaagataacgcacaagtgacgcttacttctcaaggtgcaactaaaatatataaaacgcctaatgaccatgtagaacagtatcaaacgtttaatttatcaaatcaatcgtatatggaatttgtagcagatcctattattgcctatgaaaacgctaaatttttccaacataatacgtttaatcttaaagaagatagtgctatgttttacactgatatattgactccaggctattcatctaatggccaagatttcacgtataattatatgcatcttattaatgaaatttacattgacaatcaattagttgttttcgataacatgatgttaagtcctgataaaagcagacttgacggcattgggtatatggaaaattatacacacttaggatcagcttattttattcatccagatgtaaaccaaagtttcatagaagatatttacacggcggttgctgattttcaaaaacaatacgactgtagaataggtatcacacaattacctactcatggattggccgttcgtattttgactaaaagaactcaaataatagaagaaattttgactcgtgttcaatcatatatcaatcaaacgatttatcatcgacaaattaacttcttaagaaaatattaa

SEQ ID NO: 2156 - DNA, 387 bp, Staphylococcus epidermidis
accttgctacaacaagatgtgcatcagaggagtggttttataatgggaaaaattaaagacatcaatgatttggttaatgcgacatttcaagtaaaaaaattttttagagatactaaaaagcaatataatttaaattatgaagaaatttatattcttaatcacattttgaaaagtgaatctaacgaaatatcttcaaaagaaattgctacatgttcagagtttaaaccgtattatttaactaaagcattacaaaaattaaaagatttaaatttactatctaaaaagagaagcgtgcatgatgaaagaacagtaattgtatttgtatcagatgaacaacgagaaaaaataaaaaaattgattttagaattagaaaactatatcaaataa

SEQ ID NO: 2157 - DNA, 537 bp, Staphylococcus epidermidis
ataaacatgcacaaacatcaacatcagaatattcatttaaacagaccgattcatgtagcaattttgactgtatcggatacgagagattatgattctgataaaggtggtcaactgattcaatctttgataaatcaacatgagaatcatgttgatattaaccactatcgaattgttaaagatgatatagaagctattacacaccaacttaagctttggttaacttcgtcaaatcaactagatgtcattattacaacgggaggaacaggtatctcacaaagagatgtgacaatagaagctgttcgcccattgttaactaaagaattagaaggttttggtgaattatttagatacttaagttataccgaagatgttggtacaagagcattattaactcgagctattgcaggtacctgtgatagcaccttaatttttgcacttcctggctcaactggtgcaattaaacttgcaatagaaaaattaattaaacctgaattgagtcacttagtgtttgaattaaataaagacattaggtattaa

SEQ ID NO: 2158 - DNA, 309 bp, Staphylococcus epidermidis
ataacacctaaaccgccttgtcgagccatagcaattgccatttttgattcagttactgtatccatacctgctgagataacaggaatgtttaacttgatcttatctgataatttgacacttaagtcaacatcgcttggtaaaacatctgatgcagctggaatgagtaacacgtcgtcgaatgttaaagattctttagcaaatttattttcccacattaaaaacagcctccaattttatttatacttagttacattatttcacattttcttcagtttgtttatactttataccattaaaaaagaaatttaa

SEQ ID NO: 2159 - DNA, 975 bp, Staphylococcus epidermidis
gttattcataaaaaaacgttaggagtatcaactatgaccaaagtatattttaatcatgatggtggcgttgatgatctagtgtcactatttttattattacaaatggaaaatatagaacttgttggtgtaagtacgattggtgcagactgctatttagagccgtcattaagtgcttcattaaagattataaatcgtttttcagacgttgaaattaatgtagcaccatcatatgaaagagggaaaaatccttttccaaaagaatggagaatgcatgctttctttatggatgccttaccagtgctaaatgagtcttgtatacccaaaagatgtaaggctagtgaggacgaggcgtatatagatattattcgtaaggtgaagagttgtgatgagaaagttacattgttatttactggaccgcttacagatttagctaaagctataaaatatgacaactcaattttaaaaaatatagagaaattagtttggatgggtggaacgtttttagacaaaggaaatgttgaagaaccagaacatgatggtacagctgaatggaatgcattttgggatccagaggctgtaaaagttgtattagatagtgatatgattgtcgatattgttgctttagaaagtacaaatcaagtccctctaacaatggaagttcgtcaaatgtgggcagataaaagacaatatttaggcgttgattttctgggcacaagttacgcagcagtaccaccactcacacattttgtgaccaattcaacatactttttatgggatgtattaactactgcttatgtgggttctccaaatttagttgaatcaacgaaattgaaaattgatgtagtcagtcaaggacctagtcaaggaagaacattccaatctgaaaatggacgtgaagttcaagtcattacggatgtaaataaacaagcattttttaaatacataacggatttagcaaagaaaatcgagacctaa

SEQ ID NO: 2160 - DNA, 1107 bp, Staphylococcus epidermidis
tataagcataaaaatttagtgaaaagaggtaaaaaaatgaaaatagctattgtaggttcaggtaatggtgcagtaactgctgcagtggatatggtagataaaggtcatgatgtacgattatattgtcgtaacgaatctattagtaaatttgatgtagccctagaaaaaggtggctttgatttttataatgagggagaagagaagtttatagagtttactgatattagtgatgatatggagtatgttttagatggtgcagacattgtccaggtaatcattccttcatcattcattgaatattatgctaaagtgatgtcaaaatttgtgacgaacgaccatctcattttctttaacattgctgcttcaatgggttcaatacgatttatgaatgtattagaagatcgccatattgatgtccatccacactttgcagaagcaaatacattaacatatggtacacgtgttgactttaacaatgctaaagtagatttatctttaaatgttcgtcgtgtgttcttttcaacatttgatcgtagtgagttaaatgaaagttatgaaaaggtatctaaaatttacgattatcttgtaaaagaagaaagtttacttaaaactaaccttgaaaatggtaacccagaagtacatcctggaccaacattattgaacgttggacgtattgattattcagaagagttttctttatataaagaaggcataacaaaacatactgtgagattattacatgctattgagatagaacgtttaaatttagggagaaaattaggttttgaattatcgactgccaaagaatcacgtattcaaagaggttatttagaacggaaagacgaggatgaaccgttaaatcgtctttttaatactagtcctgtgttttctcaaattccaggaccgaatcacgttgaaaatcgttatttaactgaagatatcgcatatggattagtattatggtctagtttaggacgtgtcattgatgtcccgacacctaatatcgatgctgttattatgatagcttcaactattcttgaacgcgatttctttgaagagggcctcactatcgaggaattaggcttagataaattaggattagagtaa

SEQ ID NO: 2161 - DNA, 792 bp, Staphylococcus epidermidis
ctaataaataataatgaagttgatgaggcgatgtttatgtcgaaaataacttttaaagatatttatattgatggaaataaaataactgaagatactagaaaggtgatttatctcttaccttctcaacctttaaaatatgctagtaacacgtggatttataaaacgatgccaacaatgaaccagtggcttaaagacattgaagttcaaaagaaaatgcatctaaatcaatcatcctatcatctttcattttcatttccagctaatgaaaagatagatgaagtattgttggaaaaaatacgtgaactaggttttcagataggagtacttgagctctatgtcattgaagctaaagcgttaaaggagctctcccgcaaaagagacgtagatattcaacttgtatcaagcaataatatcaatgattaccttcatgtttatgatgtgtttgcacggccttttggtgatagctatgccaacatggttaaacaacatatttatagctcatataacttggacgatattgaacgtttagttgcatatgttaaccagcaaccagttggaatagtcgatactataatgacggataaaacaatagaaatagatggttttggggttttagaagaattccaacatcaaggtatcggttctgaaatacaagcttacgttggacatatggctaatgagcgacctgttattcttgttgcagatggagaagatactgctaaagatatgtatctaagacaaggatatgtatatcaaggttttaagtatcatattttaaaagaaaatatttaa

SEQ ID NO: 2162 - DNA, 1218 bp, Staphylococcus epidermidis
agcaatgataaaggaggagcagtaatgaatcagtctacaataattaaagaccccatctttacgaagagttttaatattaactttgctattaacttttttgtttatctatgtatgtatttattaattgtcgttatcgcgagctatagtaaatcagaataccatgcttctgattctgttgctggactcgtagtcggactttttatagtaggatcattaataggtcgatttgtaacaggtaaatacgtaaatcgatttggtccaaaaaaaattctcatttttggtttaatatgtttagtagtaacacagctactttattttatacctggttctgtttggttcttaatgatggtgcgtttactgaacggcttagcaacagcggttgctacaactgctacaggaacaatagcagcatatattacaccacctacacgcaaaagtgaaggtatcagtttattctcattaagtttggtgttgggaaccgctattggcccattttttggtatgttattgatgaattccttttctatcaatattttatttactatttgtgtaattttaggtgtcataagtggtctattatcactgttaattaaaattaatttcacaacagttaaagaaaacacaattacacataaacgattcaatttggctcattttgtagccaaagaagccattccggtagcattcgtcatgctattaatcggtgttacttacgctgctattttaacttatttacaggcttttgctgttgaaagagatctagttacatcagcaagttactttttcattttttatgctattgcgtccctcataacaagacctattgctggaagattgatggatgataaaaacgaaaatgtagttgtttatccagcatttatctttttagtattatcttttgttctactgatgcttagttttaacggttgggtattacttattgcaggtatcgcattaggaattggttatggtaacttgtcatcttgtatgcaagctatcgcaataaaagtatctccatcaaataaatatggcttagctacatcaacttactttattggtttagatatagggattggatttggaccatccttactaggtcttttcacacatatgatttcttatagtcaattatatggaatcatgggtattttaggatttgcaactttagtcatctatatttttgtgcacggacgtaaggtttacagcacttcatattaa

SEQ ID NO: 2163 - DNA, 573 bp, Staphylococcus epidermidis
aatctatgtaaggaggatgaacaagtgactacaaaacatttagtatatacagctttaatgactgctatcatttgtattttaggtttagtaccaagtgtacctctgccatttatgccagtccctattgtattacagaatataggaatctttttggcaggaattattttagggcgaaagcttggtactacaagtgttattgtctttttattattagtagctacaggtttgccagtgctttctggaggccgtgggggaattggcgtatttgcaggaccttcggcaggattcttattcttatatcctgttgtagcttactttataggtattattcgtgatgcatatttgcataaaattaatttcttagtgatttttatagctacactagttatcggtgtattaggattagatatattaggtacactcattatgggcttcattatacatatacctatctctaaggcatttatattatcatttacatttatgccaggtgatattattaaggctattattgcaagtttaataggtgcagcaattttaaatcattcacgtttcaagactcttattcaataa

SEQ ID NO: 2164 - DNA, 1656 bp, Staphylococcus epidermidis
ataaagagcaataaagataaacatatattagttatcataattaagggaagtgggaggtattcaaaaatgaatgcaattaaacgatttggtagtgcaatgatagtacctgttttaatgtttgcttttttcggtattgttttgggattcgctacattatttaaaaatccaaccattatgggaggattagctgatcagcaaacattttggtttaaattttggtctgttattgaatcaggtggttgggtaatatttacacatatggaaattgtctttgtagttggcttaccattatctcttgctaaaaaagcaccaggacatgcagctttagcagctctaatgggatatttaatgtttaatacttttatcaatgcaattttaactcaatggccacatacttttggcgctaatttaaaaaaaggtgtagaaaacacaacaggattaaaatcgattgcaggtattgaaacgttagataccaatattttaggtgcaatcattatctcaggaataataacgtggatacataatagatattacagtaagcgtttacctgaaatgttaggtgtatttcaaggattaacattcgttgtaacaatctctttctttgtcatgctaccagtggcagcaatcacttgtgttgtttggccaacgattcaacacggtattgcttcaattcaatattttattgttgcatcaggttatataggtgtttggttatatcatttcttagagcgtgtactaatacctacaggattgcatcattttatctatgcaccaatcgaagtaggtccagtagttgttaatcatggtttgaaagcagaatggcttcaacacttaaaccagtttgccgaaagtaataaaccacttaaagaacaattcccatatggatttatgttgcaaggaaatggaaaggtttttggttgtctaggtatagcattggcaatgtatgcaactacaccaaaagaaaatcgtaaaaaagttgctgcattattaataccagcaacacttacggcagtagtagctggtattacagaaccacttgaatttacattcttatttattgcgccatttttattcgtattacatgcactactagcagcaactatggatacactgatgtatggatttggtgttgtaggtaatatgggtggcggtgtactagattttattgcaactaactggataccattaggaaaagcacattggatgacatatgtctttcaagtagtaattggtttaatctttgttgcaatttactacttcttatttaaatatttaattttaaaatttgatattccattaccaggacgtaagaaaggtgaagaagaagttaaattattttccaaacaagattataaagataaaaaaggagattcaactcgcaatcattcacctaatagtgaatatgaagaaaaggcgatgtactacctagaaggtcttggaggaaaagaaaatattaaagacgttacaaattgtacgacacgtctacgtttaactgttaaagacgaaagtaaagttcaagaaagtgcctattttacacataatcaaatgtctcatggtttagtaaaaagtggcaaaagtgttcaagtcgtcgttggaatgtctgtacctcaggtaagagaagcatttgaaaatattgtaaatgatgatctatcttag

SEQ ID NO: 2165 - DNA, 222 bp, Staphylococcus epidermidis
aaacttctaaagccatattctctagattatatgagtcatataaattattttatgataatagcaaatttttgttgtattttcaatataattaaagagatgttcacgattcaaaaagcatcaaaattcagtgtaagcgttatattaaaggatgaattatcattgaaatgttttaatacaaaattatataattatctgtgtaatagttttattaaattagactag

SEQ ID NO: 2166 - DNA, 735 bp, Staphylococcus epidermidis
aatccaataaagctaaacaaattcttaaagaatatcaattttctgtataaggagttcagagctatgcctgatttaacgtccttttggatttcttttcgtgttgctttaatcagtacaatgatagttactatttttggcattttgatttctaaatggctatacaataaaaatagatattgggtaaatctattagaaagttttatcattttaccaattgtgttaccacctactgtccttggttttatactattaattatattttcaacaagaagtcctgtaggagaattctttactaatatcttacacttaccagttgtatttactttgacaggtgcagtgattgcatctgtcattgttagttttcctcttatgtatcaacatacagtgaatggttttcgaagtatagattcaaagatgttaaatactgcaaggacgatgggagcaagtgaaacaaaaatattttttaaattggtgttaccattatctaaacgttctattcttgcaggtattatgatgagctttgcaagagcaataggtgaatttggtgctactttgatggttgctggctatatcccagacaaaacaaatacattgcctttagaaatttattttttagtggagcaagggaaagaaaatgaagcatggttatgggtgcttgtattagttgcgtttgcggtaactgtcatagcgaccataaatctggttaatcgtgatacgtttagggaggttgattaa

SEQ ID NO: 2167 - DNA, 1035 bp, Staphylococcus epidermidis
ggaggtccaaaaatgaaagcgctaatacaagataaattaggccgtccaatacgggatttaagaatatcggtcactgatcgatgtaatttcagatgtgattattgtatgccaaaggaaatctttggagatgattacactttcttacctaagaatgaattgcttacttttgaagaattgacacgaatttcaaaaatttatgctcaattgggagttaagaagataagaattactggaggagagcctctcttacgacgcaatctttataaacttgtagagcaattaaatctcatagatggtatagaggatattggattgactactaatggcttattattaaaaaaacatgggaaaaatttatatcaagctggtttacgacgtattaatgtaagtttagatgcgattgaggataacgtttttcaagaaattaacaatagaaatattaaagcgtctacaattttagaacaaattgattatgcaatatcaataggttttgaagttaaagtaaacgtggttattcaaaaaggggttaatgataatcaaattattccgatgattgattattttaaaaataaaaatattgaagtacgttttattgaatttatggatgtaggtaatgataatggatggaatttcaataaagttgtaactaaagaagaaatgcttaatatgatagaacaacattttgagataagtcctgtaacacctaaatattatggggaagttgctaaatattttcgacataaagataatgatgcacaatttggtctaattacgagtgtatctgaatcattttgctccacatgtacgcgtgctcgattatcttcagatggtaaattttatggttgtttatttgcctcctcagagggatttgacgtaaaagccttaatacgcagtggagctacagatgatgatttaaaagcacaatttaaacgattgtggagtattagaaacgatcagtactctgataatcgtacgatgcaaactattgagaataatagaaagaaaaaaattaatatgaattatataggtggataa

SEQ ID NO: 2168 - DNA, 3156 bp, Staphylococcus epidermidis
atgattaaaaaattattacaattttcgttaggtaataaattcgctatttttttgatggtagttttaattatattaggtggcgtttattcaagcgccaaattaaaacttgaattattaccagatgttgaaaatccagttatttcagttcaaactacaatgtctggagcaacaccccagtcaacacaagatgaaataagtagcaagattgataatcaagtacgctcgttggcctacgtaaatagtgtacagactgaatctatacctaatgcttctatagtaactgtagaatacgataatggtacagatatggataaagctgaagaacaattaaaaaaagaaatcgacaaaattaagtttaaagatggcgttggtgaacccgaattaacaaggaactctatggatgcttttccaattgtggcatattcttttacgagtaataatcaaaagttaaaagacgttactaaaaagttaaatcaacagctcgtaccaaaattacaaaccattgatggtgtacaaaatgcacaattaaacggtcaaactaatcgtgaagtatcgttaaagtttaaacaaaaaaatttagatgaaaaaggtttaactgcaaatgatgttgagaactatataaaaacggctacacgtgaaacgccattaggacttttccaatttaataagagtaataaatctattgttgttgatggtcaatttaaatctgtagacgcttttaaaaatcttaaaatccctttatctatttctggacaagctgcacaaaatgatagcgattccgacagtgatagtctaatgccaagtgataatactcgctcgactaatagttcaactcatatggcacagaaaggccaaatgccatctgtaccacttaaagatttagcagatattagtgtcggtgatgaacgtacttctatatccaagacaaatggaaaagatgctgttaacttacaaattatgaaatcacaagatgctaatactgtgcaagttgcgagagaagttcagaaaaaagtagatgaatttgtacgtaatgagagtggaatgaaatctattaaaacaatggatactgctaaacctattgaagactctctttatactatggttgaaaaggccgctctcggtacgattgttgctattatcgttattcttctgtttttaagaaatataagaactacagctatttcaattgtatctataccaatgtcaatattaattgcgctcatagcattaaaattaagcaacgtatcattaaatattcttactttaggtgcattaacggttgcaatcgggcgagttatagatgattctatagttgtcgttgagaatatatttagaagattatctgatccgaatgagaagctcaaaggtgaaaatttaattataagcgctactagagaagtatttaaacctattatgtcatcgacccttgttactatagtagtgtttttaccactagtgtttgtgtcaggttcagtaggtgaaatgtttagaccatttgcgctagccattacttttagtttattagcttcactacttgtttcgattaccctagtgccttctttaggtgcaacattttttaaaaatggcgttaaaaatagggaacaaaaagaaggtctaggaacagttgggagagcctatagaagcgctttgaattggtcacttaatcataaatggattgtgcttatagttagtatttttattttagttggaagtgtggtcataggcgcaagaaatctaggaacgagttatatttcaactggagataataaatttttagctctaacatatactccaaaacctggagaaacacagaaatctgtgacacaacatgctgaaaaagtacaaaattatttagataaaaaagataaagtagaaactgttcaatattctataggtggtcctacaccacaagatcctaccggtagtaccaacagcatggcaattatgattaaatatcaatctgacacgcctaattttgatgaagagcctgataaagtacttaaacatatcgagacatttaaacaacctggagaatggaaaaatcaagatttaggaacaggagcaggtaataattctgttgaagtaactgtcaaaggacctaatacaagtgcaatgaaagatacagtcaaccgtgtagagaaaatgatgactgatattaaaggcataacgaatgttaaatctgatttatcacagacgtatgaccaatatgaaataaaagttgaccaaaataaagctgcagataatggtatttctgctgcacaacttgcgatgaatcttaatgaaaacttacctgagaaaacaatttctacagttaatgaaaagggtaaatctatagatgtaaaggtcaaacaaaataagcaaacagattggtcttctcaaaaaattaaaaacattaaactaaataagcctacgggcggtacgattaaacttagtgaaatagcatctcttaaaaaatcatatacaccaagtaaactgactcaagaagatggcgattatgctacgactgttacaggtaaagtgactgataaagatgtgggtggtaaatctcaacaagttatggctaaagtgaaagaccttgagaaacctagtcatattaaaattaatgtcggcggtgcaactgatgacattgataaggctatttctcagcttgctatggcgatgatagcagcaattatcattgtttatttaattttagttattacatttagaggtggtctggcaccatttacaatcttgttctcattaccatttacggttatcggtgtagtacttgcactcatcattaccggagaaactatttcagttccaagtttaataggtatgcttatgttaattggtatcgttgttacgaatgctatagtattaatcgatcgtgttattaacaatgaaaaacaaggtatgccgatgaaacaggcattgatagaagcgggtggtacacggataagacctatattaatgacagcaattgcaacaataggtgcactagtgccgttgttatttggtcatgacagttcaatattaatttcaaaaggtatggctgcaacagtaataggtggattaatttcttcaacgctactcacactctttgtagtaccggttatatacgaaattttattcactttaaaaaataaaattactaaaaagtttaatatgtaa

SEQ ID NO: 2169 - DNA, 1254 bp, Staphylococcus epidermidis
accatggaaaagatgaacatcactaatcaacaacatgacgcatttgtgaaatctcatcccaatggtgatttattacaattatctaagtgggcagatacgaaaaaattaacaggatggtattcaagaagaattgctgtcggtgaaaatggtcaaattaaaggtgttggccagctactattcaaaaaaatacctaaacttccatacactttatgctatgtatctaggggatttgtagctgattataataataaagaagtgttagaagctctacttagctatgctaaagaagtagcaaaagatgaaaagtcgtatgctatcaaaatagatcccgatgtcgaagtagataaaggtgcagaagcacttaaaaatctacgtgagcttgggtttaaacataaaggttttaaagaaggactgtctaaagactatattcaaccaagaatgactatgattacgcctattgacaaaacagatgatgaattagttcaaagtttcgaacgtcgaaatcgttcaaaagtaagacttgcactgaagcgtggaactaaagtagaacgatcaaatcgcgaggggcttaaaatctttgctaatttaatgaagataactggggagagagatggttttttaactcgagatattagttattttgaaaatatatatgatgcacttcatgaagacggtgatgcagaactcttccttgttaaattagagcctaagccagtattagatacggttaatcaagatcttgaagcacaattagctgagaaagagaaattacaatcaaaaaagcaagataaaaagacacttaataaacttaatgatattgataataaaattaagaaaacaaatgaattaaaatcggatttaacagaacttgaaaaaagcgagccagaaggtatttacttgtcaggagcgctcttaatgtttgcaggaaacaaatcttactatctctatggcgcttcctcgaatgactatcgtgatttcttaccaaaccatcacatgcaatttgaaatgatgaaatatgcacgtgagcatggtgcaacaacctatgactttggtggtacagataatgatcctgataaagattcagaacattatgggttgtgggcttttaaacgagtttggggtacatatttaagtgaaaaaattggagaatttgattatgtattaaatcaaccgctatatcatttagttgagaaagtgaaacctcgtttaacgaaagctaaaattaaaatatcacgtaaacttaaaggtaaataa

SEQ ID NO: 2170 - DNA, 696 bp, Staphylococcus epidermidis
ctttcattgaataaattagaacgtcaaaatcgaattattcaaactattcaaagttctgacaaaattactgcatcccagcttgcaaaacaatttaacgtatctaagagaactattttacgtgatattgatgaattagaagatcaaggggtaaaagtatatgctcgtcatggcaaattaggcggttatcaaatcaaagatgcacatgctaaaatcaccttatcgttaactgaacagcaactttcggcattatttttaacactaaatgaaagtcagtccaattccactttaccttatcaaaatgaaattcgagcaataatcaagcaatgtttaaatttacctcaaacacgattacgtaaaatgctaaaaaaaatggattattatattaaatttgaagattctaatcatgtcacactacctcaattattttctgatattttaatttattgcacggagcgtaatgtgatgttagtagatttaaatgaaaataatcaaattcaagctgaaaatgtgatttttataggcttaatatgcaaaaatgctgtttggcatgctgttgtatttgaaatcggtagaggttacactcgtgaattatctatcctggatattcaagatatctcatattcttttgaaaaaacgatacaaacccaagatatctcaattgaaaattatcgacagtttttagcgccttctgaatga

SEQ ID NO: 2171 - DNA, 792 bp, Staphylococcus epidermidis
gctatcatgaaaattaaacatatttttattattattttaacattgtgtgtagtattagcaggttgtaccaacgagaaaggtcagaataaagaacagaatgaaaaacaatcgacaaaaggtgataaacaagaacttcaagtttctgctgcagcaagtttgactgaagtcagtaaagcattaggaaatgaatttaaaaaggaccatccaaatgtagaaattaaatttaactatggcggatcaggtgcgttaagacaacaaatagaagcgggtgctccgtcagatgtcatgatgtcagctaacactaaagatatagacctgttgaagaaaaaaaacaaagcacatgacacttataattatgcaaagaatcaacttgtattaattggtgataaaaataaaagttatacctctgtaaaagatttaaatcaaaacgacaaactcgcactaggacaaataaaaacagtgcctgctggtaaatatgcaaaacaatatttagatgatcaacatttatatggtgatgttaaagataaaattatttttgctaaagacgtaaaacaagtattaaattatgtggaaaaaggaaacgcacaggaaggattcgtttacaaaacagacttatatcaacaaaagaaaaaagcaaataaagttaaagtcatcgaagaaattaaattaagcaaaccaattacttataaagcaggtgcaacttcagataaaaaattagctaaagaatggattaacttcttaaaatccaataaagctaaacaaattcttaaagaatatcaattttctgtataa

SEQ ID NO: 2172 - DNA, 1275 bp, Staphylococcus epidermidis
agcgtaatgaaaaatttcatattaagtgtgcaacatttgttagcgatgtatgcaggggctattcttgttcctattattgtggggacaagcttaaaattttcagctgaagaaattgcttatctagttactgttgatatatttatgtgcggggtagcgacatttcttcaagcaaataaagtcacagggactggattaccgattgtactaggatgtacgtttactgccgttgcacctatgatactcatcggtcaaacgaaaggacttgatgttttatatggttcgcttttaatatccggtatcttagttgttttaattgcaccttttttctcttatttagttaaattctttccacctgttgtaacaggaagtgttgtgacaattattggaatcaatttaatgccagttgcaatgaattacttggcaggtggtgaaggagcgaaaaactatggcgatactaagaatttaatattaggtggtgttacactactcattattcttattttgcaaagatttacaaagggcttcttgaaatcaattgcgatacttataggattagcaataggtactgctttagctggtatatttggaatggttgatatcaaacaagtgggtgatgcacattggtttggtttccctgtgccattcagattttctggcttcggatttgatgtcagctcaatacttgtatttttcattgttgcagttgtaagtttaattgaatctactggtgtctatcatgcactgagtgaaattactggtagaaaactagaaagaaaagattttcgaaaagggtacactgcggaaggtctagcaatcattttaggttcaatatttaatgcgttcccttacactgcatattcccaaaatgtaggtcttgtttctttatcaggagctaaaaagaacaatgtgatatatggaatggttattcttttactaatttgcggttgtatacctaaattaggtgctttagctaatattattccattgccggttttaggtggggcaatgatagcaatgtttggaatggttatggcatacggcgttagtattttgggtaacattaatttccaaaatcaaaataatttattaattattgcaatttcagtagggttaggtgctggtattagtgcagtacctcaagcatttaaaggattaggagaacaatttgcttggttaactcaaaatggtatagtgcttggcgcaatttctgcaatcatcttaaatttcttttttaatggtataaagtataaacaaactgaagaaaatgtgaaataa

SEQ ID NO: 2173 - DNA, 492 bp, Staphylococcus epidermidis
agaagaattgatactatgattttacaaattgtaggtatgaaaaattcagggaaaactacattgatgaaccatgcgatatcatttttaaaagaacgaggctattcagtagcaacaattaaacatcacgggcatattggtgaagaaattgaattacagtcatctgatgttgaccacatgaaacatttcgctgcgggtgcagaccaaagtattgttcaggggcatcatttacagcaaacagtgacacgtaaaaagaaacaatcgcttagagaaataatagaaaattctgttacaattgattatagtatcattttagttgaaggctttaaagaagcaaattatgataaaattatcgtttataaaaataatgatgaattaagaagtctacaaggactttctcacgtcatagggaaaatagaaaccaatcatccacgtgcaaataatcaacttgagcacttactcaacaaattaattaaggataagggaatgaattaa

SEQ ID NO: 2174 - DNA, 789 bp, Staphylococcus epidermidis
gagttagttgaaatgttaaagaatactcggcttcgaatgacgacattgttcataattagcatactcgtcattttagcaatactttttcttatatttgatacaaacctttttaaaaatgatgttaaacatacatttaaagaagcggtgtctcttcaaacaagtgagggaaatatccatactaaagaagttaatggtaagtttatatatgcttccaaacaagatatagagaaagctatgcaaataaaacatagtgataatgatttgaagtacatggatatatcagaaaaagtacctatgtcagagaaggaagttaaccatatcttaaaaggaaaaggtattttagaaaataagggatcaacgtttattaaagcccaagataaatatgaagtgaatatcctatatctcatcagtcatgcactagttgagacaggaaatggtcaatcagatttatcaaaaggaattaaagaaggtaactatcactattataacttttttggtattggtgcttttgatgaagatgctgtaaagactggtaagagttttgctaaacagaagaagtggaccactcctgaaaaagcgataatgggtggcgcgtggtttgtgagataccattactttaaaaataatcaattgagcttatatcaaatgcggtggaacccacaaaatccaggccaacatcaatatgctagtgatattcagtgggccaataatatagctgatttaatggagaaatactatgataaatatggaataaaaaaagatcatataagaaaaaaatattacaaataa

SEQ ID NO: 2175 - DNA, 627 bp, Staphylococcus epidermidis
gaggcatatgagatgtcaaacccaattaaaattggtatcgggggtcctgttggtgcaggtaaaacccaattgatagaaaaagtggttaaacgccttgcgaaagaaatgagtattggcgttattactaatgatatctatactaaagaagatgaaaaaatactagttaatactggtgttttaccagaagatagaattatcggtgtggaaactggaggttgtcctcatacagctattcgtgaagacgcttcaatgaacttcgcagctatagatgaattattagaacgtaatgatgatattgaacttatttttattgaatcaggtggcgataacttagcagctacttttagtccagaactcgtcgacttttcaatttatatcattgatgttgcacaaggcgaaaagattccacgtaaaggtggacaaggtatgattaaatctgatttcttcattattaataaaactgaccttgcaccatatgtaggtgcttcattagatcaaatggctaaagacactgaagtatttcgtggaaatcgcccattcgcttttacaaatttaaaaactgatgaaggtttagaaaaagttattgagtggattgagcacgacgtcttactgaaagggttaacttaa

SEQ ID NO: 2176 - DNA, 237 bp, Staphylococcus epidermidis
ttaaaatatgaagggactttttcaatgttaactaaagaatttgctcaacgtgtagaactaactgaaaagcatgtccgaaaaattgtacaacatttagaggaacgaggctatcaccttagtaaaacagaatatcgtggtcgtgaagccacagactttaaagaagatgacatcgaattatttacagatatcgctaacaaagttaaacaaacaaatagttatgatttatcatttgaatag

SEQ ID NO: 2177 - DNA, 453 bp, Staphylococcus epidermidis
tatgacaatgaggtgttaaatattttaaccaatgaatttttcaatagttttataggtatatatagaccctatattaaacttacacaacctatattagatcagcatcagattcataccggccaatggcttgtgctaagagatattgccaattatcaacctactacacttgtaaaaatttctcatcgtcgttcaatagaaaagcctacaacacgaaaattgattaaagtattgttagacaatggttgggttatgacaaaaacaggagttgataagagagagaaattattaagtttaactgacaaaggccaaatcctctttgaaactattaataaaaaggtcactgtcattcaacaagatattataaaaaaaactggattaactgatgagcaagtatttgatattacaaatgcgatgtctcaaattcatgaagcaatgataaaggaggagcagtaa

SEQ ID NO: 2178 - DNA, 831 bp, Staphylococcus epidermidis
aatgaaggtgaaattatgacagaactttatttaaaaaaattagatgaatacatatgtcaatggatacgtggtttagacgatatcattccacgtttggttgagaaaatggaaacatcaacaaaaaaagataggtttgatttagttactaatgttgataaacaaattcagaatcattttcaaaactttcttcaggaacattatcctacacatcaattactagctgaagagaaagataactcagatataacaccttacgagggtcacctctggattatggatcctatagatggaacaagtaatttagtgaaacaacaagaagattactgtatcataataggatattttattgatggggaacctaaactttcatatatttatgattatccacatcaaagattatatagagcaattgctggtataggagcctacgaaaacaatcaattaatgacaatgccaaaaagaattggtttaagagaggcaattatttcatttaaaccacaagtgttaaaagaagagacggttcaatctttatttcaatcagcctttgattttagaagtattgggtcttgtggtcttgattctattcgagtgataaaaggtcagtttggggcacacattaatacgaatcctaagccatgggatatttcagcacaatttctttttgcaagagaactaggtttgattatgacacaaataaatggtgaacctcttgattttagtaaggcgggcccatttattattagtaatcctggttgttacgatgatatgatacgtatcttaaatgaaggcggaggttattcaaagagtagtcatcatatcgagcgtggttaa

SEQ ID NO: 2179 - DNA, 813 bp, Staphylococcus epidermidis
ttaaagttagattttgttaaaatgagcaataacatgtggagggggataaagttgaacttaaaattagaccatatcattcactatatacatcaattagagtcatttaagtttcctggagaaatattagaattgcaaaatggtggaagacatcatcatttgggcacctttaatcaaatagcaccgattaaaaatagttatatcgaattgctagatgttgaaaatgagtcaaaacttaacaatgtagctaaaactgaagaaggtcgtgtatcatttgctacaaaaatagtgcaggatcattttaaacaaggctttaaaggtatttgctttagaacaaaggatatagatcaggttaaaagttccttagaaaatagaggcgttgatgtgataggtcctattgatatggaaagagaaaataaaaaaggtcatcaattaagttggagattgctatatattgctaaccctgactatagagtcaaaccacctttctttatagaatgggataacagcaaaaagcaaaacctatcacaaatacataatttcaacttgtcatcgtttaaaattaaagaggtgattattactagcactcaacgtgaaacaacagtaagtctttggaaagaatggtataacctgaaaatagtaaatgaaacggctacatctactgatctcaaattagaaactgatgaagttatctataaaatagaagacggcaaagattcaggttttcatacattaataatgaccgatatcaatgccacagcaccatattcaatatttatacgtggtgctaaatatcgttttgagccacccaactag

SEQ ID NO: 2180 - DNA, 195 bp, Staphylococcus epidermidis
ccctttgaagaggagaatgatacgatggacttgaattcaaagttatcagaacttaaatatgattatacacgattacaaaacgatttagaaaaacgtgagtcgcttcatcaagatattgaccctctacttaaacaacttgaaaatattgaacaagaaatctcctatatacgttcaaaattaaatcaacaatcttaa

SEQ ID NO: 2181 - DNA, 750 bp, Staphylococcus epidermidis
ctaagaaaggattatcatcaaatgcaacaacagaagattaaacgattcttagcccattttgtattagatcacgtcacaatagaatatttgaaatatggccaccagttgacaattgaacagcttaaattattaatatttatattacatttcactgaaaatcataaagaagatttaagtttaaatatgatcatcttttacaaaaattatcaaaaaaaccaattgttaaaaagtattacacatctatatgaatttaattggatttcaaaaaaacgacatccatacgaccaacgtagactagttattacattaactcaaaatcaatgtagtaaaataactcaattaattgatgaattagaacacttcttagaggtgaaatctacattaataaacgaaattaatcattcaactttattatcgtattatttaaagtgccatagtcaatttagggtaattgaacaatcttgcacatctcaacatttaacattagaagaattataccttcttgggttacttatcgttagtgataacaagactacatttaaaagcataaaagtacatgctttgaagggaatcattgcaatgggacctattattaagaccttacagtcaaaaggttatctcattaaaagtcggagtagagatgatgaacgctatattgtattaacacttagaaaagaaaaaattaatgtgattcagtcagaaatcgaggaatgttacaataaattagaacagggaatacagcatgtgtaa

SEQ ID NO: 2182 - DNA, 213 bp, Staphylococcus epidermidis
agaatgaattggaggtattcaaaaatgggctatattatcctatttttcatagcaggtccagtaattataggagtgggtaatcttatattgggaccgatatttaataaacgtacacctttacatgttcaatttcgatcgtttattattggctctcttgtgtaccttattctcgccacgatctgctattttttgtttcttcaaggcaaattataa

SEQ ID NO: 2183 - DNA, 786 bp, Staphylococcus epidermidis
attacgttctgcaaaagtaaatttaaaaatggtgatccatttactattgcactttttggcgtagattctgatgaaaagcgaaagcaacaaggcggtggggaacgaagtgatacaatcatggtactttccattaatccgaaagaaaagaaaactgagctagtaagtattccacgtgataccaaagcagaaatagcaggtcgaggtactgaagaaaagattaaccatgcatacgcttatggcggtcctaacatggctgttaaaacaattgaaaaattaatgaatgttccaattgaccattacgctacgattgacatggatggactacatgacatgattgatacattaggtggcgttgatgtcgtaagtaatagtacatttacaatgggggctaatcactttgttaaaggtgaaaaaacacacgtagatggtgatgctgccatggactttattagaagtcgtaaagaagatggggcaggaggcgattttggtagacaagagcgtcagcaacttatcttagaagcgatggcagataagttgacaagcgcttcttcaatcactcattttaatacattaatgaatcaaattcagaaaaatgttaaaacagatttaaaattaggtgatcttaatacaattagaactaagtataaagatgctaatgaccaagttaatcgacatcagttagagggtgaaggtggtatacaaaatgacggtttgtactatttcataccaagtgatgcatctaaaaatgaaaatacacaattactaagagataatttaaatttataa

SEQ ID NO: 2184 - DNA, 1008 bp, Staphylococcus epidermidis
ttgtttgcgctttcttattttactatactattcataaaagaaggagtgatggttatgacaaaagtttatattgcaggcgcaatacctgaagtgggacttaacttattgaaagaacattttgaggtagacatgtatgatggcgaggggcttatcgataaagaaaccttaaaaaaaggggtagaacatgcagatgcattagttagtttactatcaacttctgttgataaagatattattgatagtgctaataaccttaaaattatagcgaattatggtgcaggttttaataatattgatgtcgaatatgcaagacaacaaaatatagatgttacgaatacaccacacgcttcgacaaatgcaactgctgatttaacaatcggtttaattttatcagtagcgcgtagaattgtagaaggagatcatttatccagaacaacaggttttgatggttgggcacccttattcttccgaggcagagaggtatcaggaaaaactattggtattataggtttaggtgaaattggaggtgcagtggctaaacgcgcacgcgcatttgatatggatgtactgtacactggtcctcatcgtaaagaagaaaaagaacgagatatcggtgcgaaatatgtagatttagatactttacttaaaaatgcagattttattacaatcaatgcggcatataatccatcactacatcatatgattgatactgaacaatttaataaaatgaaatctactgcctatctaattaatgcaggacgtggtccaatagtaaatgaacaatctttagttgaagcacttgataataaagttattgaaggtgctgcattggatgtatatgaatttgagccagaaatcactgatgcattaaaatcatttaaaaacgttgtgcttacacctcacattggtaatgcaacatttgaagctagagatatgatggctaaaattgttgcgaatgatacaataaaaaaattaaatggtgatgaacctcagtttattgtcaattaa

SEQ ID NO: 2185 - DNA, 549 bp, Staphylococcus epidermidis
tacaattatagttgcattaagtcattttttttacaaatggaggtaaaacctattatggacaaacacacgaattacaatgaattagaatctaagaatgtgtctgatcaaacttcatcagacaatttatcgaatgacaatatagtacaccagcaatcaactattcaaaatgaggaaagtcaagataatcgtttaatggcaatgttaatttatttattaagtttatttactggtatcattggtcctttgattatttggttaatcaaacgtaaagagtcccgacttgttgatgtatctggaaaaacgtatctaaactattttatttcttatactatctattcaacagtaggcgtgatatgtatgtttatgattgttcctttaatgaatataagtgaaagtttagccatcttttcattgattttgttgctggtggtagtttttatcttattagcattgttaataatgtcatttgtgtgtacaattattgcttgtgtaaaatatatgtcaggcaaaacttacactatcccactcacgataccgtttataaaataa

SEQ ID NO: 2186 - DNA, 333 bp, Staphylococcus epidermidis
aaagggtggctctttatgaaactttatcttattttattgcctgttttatacttaattgtttcgtacattagtatttttaaaatgcattctgtcataactcgaatcttgagaattgttatgggcatattgttactatttgtagttgctttgacaacgttacaattccctaaagaaaattggtgggtatttgtcgttttattgcttttagttggtaatgttgaagtgactggttttaaagaattaaaagatgataaaaaaggtgttagtatcttgaatatcttatcacttttattatttgttatatttattattttaatttttatactatattaa

SEQ ID NO: 2187 - DNA, 1485 bp, Staphylococcus epidermidis
aattggaggctgtttttaatgtgggaaaataaatttgctaaagaatctttaacattcgacgacgtgttactcattccagctgcatcagatgttttaccaagcgatgttgacttaagtgtcaaattatcagataagatcaagttaaacattcctgttatctcagcaggtatggatacagtaactgaatcaaaaatggcaattgctatggctcgacaaggcggtttaggtgttattcataagaatatgggcgtcgaagagcaagctgatgaggtacaaaaggttaaacgttcagaaaatggtgttatttctaacccgttcttcttaacaccggaagaaagtgtgtatgaggctgaagcattaatgggtaaataccgtatctctggtgtacccattgtcgataatcaagaggatcgcaagttgattgggattttaacaaatcgtgatttacgttttattgaagatttttcaattaaaatatcagatgtaatgacgaaagataatttaataacagctccagttggtacgactttagatgaagccgaggctattcttcaaaaacataagattgagaaacttccattagtagaaaatggtcgtttagaaggattaatcactattaaagatattgaaaaagtacttgaattcccatatgcagctaaagatgaacatggcagattgttagctgcggcagcaatcggtacgtctaaagatactgaaattcgtgcacaaaaactagttgaagctggcgtagatgcattaattattgatacagctcatggtcattctaaaggcgttattaatcaagttaaacacatcaaggaaacatatcctgaaattactgttgtcgctggtaacgtagcgactgcagaggcaacacgtgctttatttgaagcgggtgccgatgttgttaaagtaggtattggtccaggctcaatttgcacaacacgtgttgttgcaggtgtaggtgtgcctcaaattacagcagtttatgattgtgctacagaagcccgtaagcatggtaaggctattattgctgatggtggtattaagttctcaggtgatattatcaaagcattagctgctggtggtcatgcggttatgttaggtagtttgttagctggtacagaagaaagtcctggtgcaactgaagtattccaaggtagacaatataaagtttatcgcggcatgggatctttaggtgctatggaaaaaggttcaaatgatcgttacttccaagaagataaaacaccaagaaaatttgttcctgaaggtattgaaggtcgtacagcttataaaggaccattacaagatacaatttatcaacttatgggtggcgttagagctggcatgggttatactggttcagaaaacctaaaaaaattacgtgaagaagcacaatttacacgtatgggaccagctggcttagctgaaagtcatcctcataatgttcaaattacgaaagaatcaccaaactattctttctag

SEQ ID NO: 2188 - DNA, 345 bp, Staphylococcus epidermidis
tgcaacgaaagaagggagataaaaagtatggcttggttatttctaatgatagccggaagttttgaaattttgggtgttgttctgttaaatgaactgtcacgtacaaagaataaaatttatgtcatttttttaggattagcatttatattaagctttagtactttaaaatttgcaatggtatctattcctatggggactgcatacgctatatggacaggaattggtacagctggtggtacattaattggaatgattttttatggagaatctacacgtttaagtagaattttatgtattttattaatcatcatttcagttgttggattacgtttaataagttattaa

SEQ ID NO: 2189 - DNA, 1722 bp, Staphylococcus epidermidis
ataagcatgagttttaaaatgacacaatctcaatacacaagtctttatggaccaactgtaggagactctgtgagattaggagatacgaacttgtttgcacaagttgagaaagactatgcaaattatggagatgaagctactttcggtggcggaaaatcaattcgtgatggtatggctcaaaatcctaatgtgacaagagatgataaaaatgtagccgatttagttttaactaacgcattaattattgattatgacaagattgttaaagcagacatcggaattaaaaatggttatatttttaagatcggtaaagctggaaacccagatataatggataacgttgacatcatcattggtgcaacaactgatattattgctgctgaaggtaaaattgttactgccggcggtatcgatacacacgtgcactttatcaatcctgaacaagctgaagttgcacttgagagtggtattacaacgcatatcggtggaggaactggtgcttctgaaggtgctaaagcgactactgtaacaccaggaccttggcatattcatcgcatgttagaagcagcagaagagatgcctattaatgtaggatttactggtaaagggcaagctgtcaatcatactgcacttattgaacaaattcatgcaggcgctataggtcttaaagtacatgaagattggggagctacaccttcagcattaagtcatgcattagacgttgcagatgagtttgatattcaagtcgctttacatgcagacacattaaatgaagctggatttatggaagatacaatggctgctgttaaagatcgtgtattgcatatgtatcatactgaaggagctggtggtggtcatgcacctgacttaatcaaatcagctgcatattcaaacatcttaccttcttctacaaacccaacattaccttacacgcacaacactgtagatgaacatttagacatggttatgatcactcaccatcttaatgcttcaataccagaagacattgcatttgcagattctcgtatacgtaaggaaactatagcagcagaagatgtattacaagatatgggcgtatttagtatggtaagttcagattcacaagcaatgggacgtgtcggtgaagttgtaacacgtacttggcaagttgcacaccgtatgaaagaacaacgcggaccactagatggtgactttgaatatcacgataataatcgtattaaacgttacattgcaaaatatacaatcaatcctgccattacacatggtatttctgactatgttggatctgtggaagcgggtaaacttgccgatttagtaatgtgggaaccagaattcttcggtgccaaacccgatcttgttgttaaaggtggcatgattaactctgcagtaaatggtgatgctaatggctccataccaacatcagagcctttgaaatatcgcaaaatgtatggtcaatttggtggtaacattacacatactgctatgacttttgtttctaacactgcatatgaaaacggtatttatcgtcaactcaatctaaaacgaatggttcgaccagttagaaatattagaaatttaactaaggcagatatgaaaaataataatgctacacctaaaatagatgtagatccacaaacatatgaggtattcgttgatggtaataaaatcacaagtgaagcagcaacagaattacctttaacacaaagatacttcttattctag

SEQ ID NO: 2190 - DNA, 774 bp, Staphylococcus epidermidis
ttattggtgagtggaaaggatacaatgatgaaaaaagataaaaaaaggcaaagttataggtttaaagatatagtatggcgtgatttcagtttaattgcgataggctttctatgtatatttatatttagctttataggtttaacaattgctgctatagcttttcaaagtattaatgaattacaacttactatgattggaactctaggacaatttatgtcatatattttagtgatattagctttttattttttacatatcaattcatttgtagatagagttaagagtggttttgattatttgaaaaagcattggttgtttataattatcgtcatgtgtgcatcttttattatttctaatgtttatgacaaattaattgaactattacctaaatatttgcaatatagtgaaacgcaaaatgaacttgaactcaatgaattatttaaaagtggtatatttattccttttgcatttgtacttattgtaattgtaggacctattgttgaagaattggtatttagacatttgttaataggtgaactaggtaaaaagtttaactttattgtgatgggggttatatcagcattgtcttttacatatatacatgtgagtgatgctaagtccccatttgaatttggagcatatttaatactggcaatagcattagtatatgtttacttaaaatcgaatagaaacttagcttcatcaattagcttacatatgttaaataatttcatatcattcatttggacaattatagttgtattcagtaaatga

SEQ ID NO: 2191 - DNA, 207 bp, Staphylococcus epidermidis
aaaaaatggaggtcgctcatcttgactattattatcggactcattgtaattattttgttaatcattagtttacttccaaattataaagcaatggtattagctaagcagcaaggccaaaaacctacacgatatactattatggtaggcattgatttattattaattatacttattatagtaacattagtattaaaattgattatgtag

SEQ ID NO: 2192 - DNA, 690 bp, Staphylococcus epidermidis
ataatattagggagaggatataacatggaatttaaagtgatagaatcagctaaagatccattatttaacgaggcactcaaattatatgatgataaattggatattggtttagatgaagatagtaaaatttttaaacgctcacttgaaaataataaaacagaaaatgattacgcctttatcgttggaattgaaaaccagactgtagttagcttagcaactgcacattacgaagcaacaaccaattctgcatttttaatttacttaatcgcaaaagaaagccccaatcatgatgaaagaatgtccttaactttagaggcaatagaaaaacaattaaaccttttatcacaagaagttcataatagagatattaatttcatcatgttagaagttccaaaagaaccctcgactgctaacatcgatgacaagctcagaaatgcactagaacatcgtcgtcaattcctctttgaaaatcaatttgaaaagcaggacgacattgactatattcatccaaaccaaaatcaaaaggaaacgccacaaaaagtagatttatttattaaagctaacattgaattaacaaaggacatttatggtacaagtgtcaaatctaattatattcttaaatatgtttttgcaaatggcatttcaagagaaattatttaccctctcctaaaagaaatgaatttaagatag

SEQ ID NO: 2193 - DNA, 750 bp, Staphylococcus epidermidis
tcataccaaggtgttgaattgattggcatctcagcaggtgaaaccaaaaatcctcaaacaaatattgtaaaggcagtcaacggagtgatatggagaattttaattttctatattggtgcaatttttgtcattgtatcagtatatccttggaaccaattaggtagtattggtagtccttttgttgcaacgtttgctaaagtgggcattacgtttgctgctggtttaataaactttgtagtcttaacagcagcattgtctggttgtaattcaggtatttttagtgcaagtcgaatgatttatactttggcaaaaaaaggacaaatgcctaaagtatttactaaagtaatgaaaaatggcgtacctttctacactgtatttgcagtatctatgggaatattaattggtgctttattaaatgttatacttccattaattattgatggagctgatagtatctttgtatatgtatatagtgcctctattttaccgggaatgataccttggtttatgattttatttagtcatctaagatttagaaggttacatcctgaaaaggttcacaatcatccttttaaaatgccgggaggggcaattgccaattatttaactatcatgtttttactcctagtattagtcggtatgttacttaacaaagaaactgtagtatcggttgttattggtatcgtgtttttaacagctgtgacactttattatcttattagatatcacaaaaaggaacgacaaatataa

SEQ ID NO: 2194 - DNA, 255 bp, Staphylococcus epidermidis
agcaaaaaaggggaaagcaagatgaaaattttatattttgcagagttaaaagagttgctcaatcaatctactgaaacgatacatttagatacgacattaactgttcaggaattcgagtcatatttattaaaacaccatagtgaacttaaatctaaaaaatttcaaattgctgttaatgaagaattcgtcagacaggatgatatagtccaaccaggagatacaattgcgctcattccaccggtcagtgggggttga

SEQ ID NO: 2195 - DNA, 657 bp, Staphylococcus epidermidis
atattgaaaggagatgacaatatgtataaagctgtagtgtttgattttgatggtactgtcattgataccgaaaagcatttgttcgatttaataaatacacatttaaaaatccatcaagtagcgccgatttctttagaattctataaacaatttattggcggtgaagctactgaattacatacatatttagaagatgctattggtttcaaaaataaagaaaaaatttatgatcaatattatcaaacaagtgttgaattgccggtaaatcctacaatcattcaattgatgcaatatttaaaaaaacgtcatatcccaatggcgattactacaagtagttataaaaagaatatatatcctatatttaaacaattaggactagatacatatattgatgttgttgttggtcgtgaaaatgtcgatagtgttcaacctaatccggaaatttttttaaaagccgtacaagagcttaattataatcctacaaattgcttagcaattgaagattctgtcaatggtgctactgcagcgatgctagcaggattagatgttgtcgttaatacgaatataataacgaagaatcaagatttttcgacagttcaatgtgttggacaagatatggaatttgaagatataaagaattttttatttaaagaatga

SEQ ID NO: 2196 - DNA, 237 bp, Staphylococcus epidermidis
ctagtagaaggccatactaagccaagtgattgtttgaaagttcgtgatgatatgcttgggaaatgccataaactatttactgagagaaaagagtttacaggtgatacgccagtaattgttaatattggcgaatgggatgagggcgatgaagaagataaacagagagctctagataaaataaaagaaaactatcctaatagaactatgattgtggatgatataccgttagaggattaa

SEQ ID NO: 2197 - DNA, 378 bp, Staphylococcus epidermidis
tacataagaggaaaactaacaatgacagatgcaatcactgcacctgtcaaagtaaatacaactggtaagtgtaagatattagtaaagaattctcctacaggacttcttgttgaaaatataattaatagtataaaaccaaggacagtaggtggtaacacaattggtaaaatgataaaactttctaatagatttacccaatatctatttttattgtatagccatttagaaatcaaaatgccaaaaatagtaactatcattgtactgattaaagcaacacgaaaagaaatccaaaaggacgttaaatcaggcatagctctgaactccttatacagaaaattgatattctttaagaatttgtttagctttattggattttaa

SEQ ID NO: 2198 - DNA, 795 bp, Staphylococcus epidermidis
ttttcaggaggatatttaacaatgaaaaaaatcgctacagctacaattgcaactgcaggaatcgctactttcgcttttgcacaccatgatgcacaagcagcagaacaaaacaatgatgggtacaatccaaacgacccttattcatatagctacacttacacaatcgatgctgaaggtaactaccactacacttggaaaggtaactggagtccagatcgtgtaaatacttcatataactataataattataataactacaactactatggttacaataactatagcaactacaataactataataactacagtaattacaacaactatcaatcaaacaacacacaatcacaaagaacaactcaaccaactggtggtttaggcgcaagctattcaacatcaagtagtaatgttcacgttacaacaacttctgcaccatcatcaaacggtgtatctttatcaaacgctcgctcagcatctggtaacttatacacttcaggtcaatgtacatattatgtatttgacagagtaggtggcaaaatcggttcaacatggggtaacgcaaacaactgggcaaacgctgcagcacgttctggttacacagtaaacaattcaccagctaaaggtgcaatcttacaaacgtcacaaggtgcatacggacacgtagcatacgttgaaggtgtaaacagcaatggttcaatcagagtttcagaaatgaactacggtcacggtgcaggtgttgtcacttcacgtacaatctctgcgagccaagctgcttcatataactatattcactaa

SEQ ID NO: 2199 - DNA, 1164 bp, Staphylococcus epidermidis
gtcatagggggcgtaaatgtgatggagtcttttttaattcacactgacattcaaaagaagtggattcgtaaatttaaaaagattgaaagtgaattcaaagcacgtgcagctgaaaatgatattcaatctagatttccatatgaaaatattgagtggctgataaaggaaggatatactaaactaactttgcctgtagagtatgggggtgaaggtgctactattgaagatatggtaattttacaaagttatttgggtactattgatggagcaactgctttatctatagggtggcatttgagtgtaattggtcaattgtacgagcaacatatgtggacaccatcaatgttagattcctttgctaaagaagttgttcacggtgcactgatcaatagagcagtcagtgaagcggaaactggtagtcctactagaggtggtcgcccatctacacatgctgttaaagctgaaaatggttatgttataaacggtgttaaaacctttacatctatgagtaaggcgttgacacattatattgttggcgcgtatgttgaagaaactaaatcgatgggattctttttaattcctcagtcaactaaaggtgtaagtattgctgacaactgggatatggttggtatgagagcgactgagagccatgatttaattcttgatgatgtttatgttcctaatgaaaattttgtagaatcaaaacgtgaatcaagacctaatggttggcttcttcatataccgagctgttatctaggtattgcacaagcagctcgtgactatgcagtagattttgcaaaaaattatcgtcctaacagtattacaggtacgattgatagtttacctacagtgcaacaaaatttagggaaaatggaaagtttattactttctgcaagacattttctatggagtacagctagagggtatcaatcatatacagaggatgcacaaatatggaatgaaacctcagcaagtaaagtggtggtaatgaaccaaagtatagaaatcgttgatttagctatgagaatagttggagctaagagtctagaaatgagcagacctcttcaacggtactatagagatatacgtgctggattacataatccaccaatggaagatatggcttacactaatattgctaaaagtattacaaacaaactttaa

SEQ ID NO: 2200 - DNA, 456 bp, Staphylococcus epidermidis
gtcatgattatagaagaaattcaaggaaatattgctaatttatctcaagatgaaaagcaaaaacatgtcgaaaaagtttatcttgaaaactcagatttggttaaacgtatacaacgtgttaaaacagatcacggtaatgaaatagggatacgtcttaaacaacctattgacctacaatatggtgatattttatatcaagacgatacaaacatgattattgtcgatgttaatagcgaagacttattagttattaaacctagaaatttaaaggaaatgggagacattgctcatcaactaggtaatcgccatctacctgcacaatttacagaaactgaaatgcttattcaatatgactatcttgttgaagatttattaaaagagttgggtatcccctactcacatgaagacagaaaggtcaatcaagcatttcgacatataggacattcgcatgattga

SEQ ID NO: 2201 - DNA, 918 bp, Staphylococcus epidermidis
atggaggctataaaattgaaattgataaaagtaattttaagtagtatctctcaagtggttttaattaataatccatatactgggttattcattttaattggactgtttgcagtgaattggaaagtaggaatcagtgccatgattgcaagtgtaatgacttggatattggcaccatatatgaattacacaaaagaagaaatcgaaagtggattagccgggtttaaccctgtattaaccgcaattgcacttactttatttttggatagcaattggagcggtatattaatcacattcgtagccactattttaacgctaccgattggagcagcgattagagaagtattgaaaccacataaaatagcatttctaactagtccgtatgttattatgacgtggattacattattaatacctaatcaacttaaaacgttacatactcagattgatattattccggagcatatagaaaaggtatctttaaataatgaccacaccagtgttcatttttttcaatcagttttagatggatttggacaaatatttttaatgcccagcataataggtggtttgttaattctaatagggatttttataggttctaaaaaagctggaattgtttctataattgcaaacattattgggttcctaataattatattactgggtggagactatagtagtataaatgaaggcatatttggctataatgtagttttatctgcgattgcgctaggtgtcacttttgagacagcaattcatagttatctcgcaatgattttaggaatagtactcactgcattcatacatttaggtttgagcacattgctcgcaccactaggtttaccaactttaacatggccatttatttttgctacatggattatgttgtttgcaggaattaaaaatcaaactgtataa

SEQ ID NO: 2202 - DNA, 1983 bp, Staphylococcus epidermidis
ggaagacatatgagagaaaattattcgatacgtgtttttaataatttagccattaatacagaaaatgcactgagtgtaaaggtattttattgtttgaaagggaaatgtgaagtcactatcaatgttcagaaacatatattagaaaaagatgatatagcatttgttgtaatgaatgatacgtattcactgttaagtaatacagagaccatgtgttgtattatcgatatacctatacatcgatatcttagtcagaaggatactcaatttttaataagtggtacaaagattgatgaaagtagtagagatagaataaaatattggatattaaaaatattagagctccattgtttatcttataatgatgtgtccgagatacaaaggttgatacaatttttacttattgaattgagttatctaaagaaaccaaaacttgatgtaaataaagatttttatttatctgaagatatacatcaatatttagtggatcatcatgacagtaaaatcaacaaacatgaactagctgaagctgttaacctatcaaatcaagcacttacatctatgtttaaacaaacgccatttcaaacatttaatcaatatttaaatcaacttagattaaaattttgtcttatagatattttgacaacccataaacctatcgaagaaatagctatagatcatggttttcatcattattctcgatttatacaattattcaaaaatacatatggttacacacctaaattgattagaagagattatatagcgacgtctatcttcaaaaatactgctgaagaaattgatttagatagacattttcttatgaacattcacgaattacaagatttagattcaaaaataataagtaaaaaatatattaagatgtcagataaaggaaaaaaatatcgatcttatgatatttatattgaagataaccgaagtactattcttgatcaggagcagatagttcatataaagcgtaatttaagtttaagtcaaaaatcaatgcgttatgtaatagaacttaactacacttctatgattgaaaacaaagagttatgtcgttatgagatgttgaaaattttacgtttttgttccggtttgaatttaattccaacatttaaaatcattaccgatcgacatgatacttttacatcaaaggaaaaaatggctctgaagttaacatttcaaatgttattcatcatgcttagggaatttaatcaacttgagattgaatttatagtagaggacatgatgttaaaacaagtggtgcagttaaaaaagatgattagctcttattttgaatattataaattaaattatcgtattaaaaatgagaaaattggaaatgttaattatcaaaatttagaaaaacaagtgactcaaattttcattcctattgatcaattacatttatatattaaagagatatcatttgaaaaagtcattttggaaaccagctatttgaccgatttaaaaagtgagattgtagaatattcatggattcaacatattcatacattaattaaaatgagtggagaagtgaggggagttttaatacaaccgtcctatgattacgctgccacatacacatatcattcaaatttaaaaccgtatcatatcttgtcttatgtaataagaatgtttaaccaattaaggggtacaatcgtctataaagatgatgcaatcattatgactaaatataagtatgaatatcaggccattgctatctttttaaaaaataggattaaggaaaatgtaaaccatcaacaattaattttttcagatattcaatcactcaaccatgcagaatatgaatatatagaaatgatgccacttttaatgaatgagaataatgagctagatagtcatataccatacccacatcaatattggttagcaaagttgaagagtaaagaaagccaacaagcaatagttgatcttcctaaaatgagtattgctcatttaacatttctttgttcgtag

SEQ ID NO: 2203 - DNA, 1557 bp, Staphylococcus epidermidis
aggagattcatgactatggaaatggcgaaagagcaagagctgattcttgttttagactttggtagccaatataaccagttaattacgcgtcgtatccgtgagatgggcgtttatagtgaattacatgatcacgaaatttctattgaagaaattaaacgaatgaatcctaaaggtatcattctttcaggtggtccaaattcagtgtatgaagaggggtcatttaccatcgaccctgaaatttacaatttaggtattccagttttaggtatatgttatggtatgcaattaacgactaagcttttaggtggtaaagttgagcgtgccaatgagcgtgaatatggcaaagctacaattaacgctaaatcagatgaacttttctttggcttaccttctgaacaaacagtatggatgagtcattctgataaagtaattgaaattcctgaaggatttgaagtgattgcagatagtccaagtactaattatgcagctattgaagataaaaaacgtcgcatttacggtgtacaattccatccagaagtacgtcacactgaatatgggaacgacttactaagaaacttcgtccgccgtgtttgtaattgtacaggtgaatggacgatggagaatttcattgaaattgaaattgagaaaatccgtcaacaagtaggtaatcgtaaagtattatgtgcaatgagtggtggagtagattcatccgtagttgctgtacttttacataaggcaatcggcgaccaattaacatgtatttttgtggaccatggtctattacgtaaaggtgaaggtgacatggtcatggagcaattcggtgaaggttttgatatgaatattattcgtgttaatgctcaagaacgcttcatgagtaagctaaaaggtgtgtctgatccagaacgtaaacgtaaaatcattggtaatgagtttgtatatgtctttgatgacgaagctgcgaaattaacagatgtagatttcttagctcaaggtacgttatatacggatgtgattgaatcaggtactaagacagctcaaacaattaaatctcaccataatgtaggtggattacctgaagacatggaatttgaacttattgaaccaatcaatacattattcaaagatgaagtgcgcgcattaggaatagaattaggtatacctgaacacttagtttggagacagccgttcccaggacctggattaggtatccgtgtacttggagaaattactgaagataagcttgaaattgttcgtgaatcagatgcgattttacgtgaagtgattcgtgaggaaggtcttgaaagagatatctggcaatactttacagtacttccaggtattcaatcggtcggtgtcatgggagactaccgtacgtatgatcatactgtaggtattcgtgcggtaacatccatcgatggcatgactagtgactttgctagaattgattgggaagtcttacaaaaaatttcaagtcgaattgtcaatgaggtggaccacgttaatcgcgttgtctatgacattacctctaagccaccaagtacaattgagtgggaatag

SEQ ID NO: 2204 - DNA, 207 bp, Staphylococcus epidermidis
tctttatacataaggcacctcgttaaattagtttattggtatttattaaattatacgaaagggccatattttttaaagtattttaatataaaattacatataagcacaaagtattttggcgagactcttgagggaacaggacaagctgaagactacaggctgaagctgtccgataagaaagcgagccaacaatacgaagtattgtaa

SEQ ID NO: 2205 - DNA, 804 bp, Staphylococcus epidermidis
ggaggtaacatagtgtttgaagaattagaaaataaagtggttcttattaccggagctgccactggaattggtaaatctattgcggaaaactttggtaaagctaaggccaaggttgttataaattaccgttctgatcgacatcatagtgaaattgaggaaattaaacaaactgttgctaaatttggtggtcaaacattggcagttcaaggtgatgtttcaattgaagaagatattaaacgaatgatcgaaacaacaattaatcactttggaactttagacattataattaataatgctggattcgaaaattcaatcccaactcatgaaatgtcgattgacgactggcaaaaagttattgacataaacttaactggcgcctttgtgggttcaagagaaaccatcaatcaatttttaaaggaaaacaaaaaaggtactattattaacatttcgagtgttcatgacactattccatggcctaattatgtacactatgccgcaagtaaaggtggcttaaaattaatgatggaaacaatgtcaatggaatatgcccaatacggtattcgtattaataatatatctcctggggcaattgttactgaacacactaaagaaaaattttctgacccaacgacacgtgaagaaacaataaaaatgatacccgcacgtgaaattggaaatgctcaagatgtagctaatgcagtactattcctatcttcagatcttgcaagttatatacacggtacaacattgtacgttgatggtggcatgatgaactatccagcatttatgggtggtaaaggttaa

SEQ ID NO: 2206 - DNA, 873 bp, Staphylococcus epidermidis
ttgccaaacattttgtataagattgacaaccagtatccctatttcactaaaaacgagaaaaaaattgcgcaatttattctcaactatcctcataaagttgttaatatgacttctcaagaaattgcaaatcaattagaaactagttctacttctatcatacgtctaagtaaaaaggtaacacccggtggctttaatgaacttaaaacacgtttgtctaaatttttacctaaagaagtcacacaatataatgttgagttagttgataacgaaagtacaatttcacttaaaaacaaattgcattctcgctctaaggcagcgttaagtaatgctaatgaaaccattaacgctgctatcatcgatgaaatttgtgatctaattaaaaattctgaaaccatatttatttacggctatggtgcctcatttgttgtagcaacagatttatatcaaaaattatctcgcatcggtctaaatattcaactagtgcatgaaactcatattttcaccactatgttagcaacacgtaactctaatgattgtgttatatttatatctaacaatggtactcaaagtgaaatgcaatctattgctaaagtcattgcagactatcacattcccattgcgactatttcaagcacttctgataatccagttgcaaagcaatctaatattgttttaacctatggacaaaccgatgaaaatgagatgcgtatgggagccacaacttcgttatttgcacaaatgtttactattgatatattgtactatcgatatattgcgctaaattatcaatcatctttagattttattactcaatcaaaaattgcattagataattaccgtaaacatctctcgaatatagattttaaacattaa

SEQ ID NO: 2207 - DNA, 699 bp, Staphylococcus epidermidis
gacattcgcatgattgatcaccaacatttaagactttttcagttctgtgattctcagtttcctacaggtgcatttagtcattcttttggacttgaaacatatattcaacgagaaactgtacatgatactgagacatttattaaatggttacatttgtttataaacgaacaattaacttattcagatgggttagctatgagaattgtctaccacgcattaattaacaatgacaaagataaaattttagatattaaccaaaaactcttcgtacaaaacctacctaaagaaacgcgtattggcgctaagcaaatgggtacacgcatggtaaaattagctttagatctttatgatagtgaatggattcaatggtattataatcaaatgaaaaaccataaaattaagcttcatcctgctgtgtgctttactatgctaggacattttttaggtgtagatgtggaatccatcattgattattatttatatcaaaatatctctagccttacccaaaatgcagtaagagcgattcctttaggacaaacagctggacagcaagtcgtaactgaaatgatagcccatattgagaagacacgaaatcacatactagaattggacgaaatcgattttggtatgactgctcccggcttggaacttaatcaaatggaacatgaaaatgttcatgttcgaatctttatttcatag

SEQ ID NO: 2208 - DNA, 588 bp, Staphylococcus epidermidis
aatataagcattcatatcattttcatacatatattgttaacgattggaggtccccatatgttgattgataaatttgaaacctacatcattaatgttgcaggtttgaaatctcgctcaacgcgaaaaaaattaatacatttatgtaaagaaattactttttgtgaatcttttcagtattctatcattaagcaaaacaatgtgttcgcattggaagttagcctccccaagctacaactaccttatctgataagtttcttaagtttccacaattatgctatttatcaaatacttttacccaaccgtgtaaatgaacttcttgattcagaacaactttaccaatctattaaacgctttgatttagcgatcgatggtttacaagatgccttcattaaagataaagtcatcgatattatgaatatgtttgcgaatcatcataatgtgaattatacattaaataataattgcgcgagcgtcacatgtcctcctgagattttcacaaagctgcttcaaactattgcaacgcgtaatattgatatcctatcagcaagttatagagcaaaaatgctacataaagcacgcatttcatga

SEQ ID NO: 2209 - DNA, 186 bp, Staphylococcus epidermidis
gtaagtataatcatcttacctaagtcgtttttttacatattaaactttttagtaattttattttttaaagtgaataaaatttcgtatataaccggtactacaaagagtgtgagtagcgttgaagaaattaatccacctattactgttgcagccataccttttgaaattaatattgaactgtcatga

SEQ ID NO: 2210 - DNA, 621 bp, Staphylococcus epidermidis
atgctcacaattaaagtgaatggtgttctttatcagacgaaaattaatataaatatagaggatcaacaccctaagatatatgcgatacagggaccatctggaattggaaagacaacaattttaaatataattgccggtttgaaatctataaattattcatatataaaggttggtaaacgtgtattaacagattcacaacaccatttgaatgttaaggttcaacaacgtcgtataggatatttatttcaagattatcaacttttccccaatatgaatgtttataacaacataacgtttatgactaaaccttctgaacatatcaatgaacttattcatactctaaaaatagagcatttacttgaaaagtatcctgtgaccttatcaggaggtgaagctcagcgcgtcgctttagcaagggcgctaagtacgaaacccgatttgattttgcttgatgagcctttttcaagtttagatgataagacaaaaaaagaaggtatcaaattaattttaaaaatattcgaagcatggcaaattcctattatatttgtaacgcattcaaattatgaagcgcaacaaatggcgcatgagattataacaattgaagattgtatacaaatatag

SEQ ID NO: 2211 - DNA, 690 bp, Staphylococcus epidermidis
  unsure (498),(499),(500),(501),(502),(503),(504),(505),(506),(507),(508),(509),(510),(511),(512),(513),(514),(515),(516),(517),(518),(519): Identity of nucleotide at the above locations are unknown.
gtcgcaacaatatcttcagcaagaatatgtcctaaactttcatctaaattaacattgatattcttcacttcaacctgttgtttcataatacgtttaattgcttctttaactgatattggcgttcttttctctatagacatacactcatctccaaaaaatattaattttcatgatatacttactcctaacaggagggaaaaaatgactcatttcacacatattaataaacaaggtaatgctaaaatggttgatgtttctaataaggaaattacaaaacgtgtagcagaagcacactcaagtataattgttaatgaaaaaatttatagacaaattactcaaaatactaatagtaaaggaaatgtacttaatactgcgcaaattgctggtattatggcagctaaaaacacttctacaatcattcctatgtgtcatccattaccacttacaggcatagatatatccttcaaatgggattcaaataatgatgattcatatcgnnnnnnnnnnnnnnnnnnnnnntctacaacaggtaaaactggtgttgaaatggaagcattgactgctgcttcagttacagcacttacaatctatgatatgacaaaagctatagacaaaggcatgataattggagaaacgtacttagaatctaaatctggtggtaaatctggcgacttccacagaaaaaattga

SEQ ID NO: 2212 - DNA, 399 bp, Staphylococcus epidermidis
ttagataaaattatcaaagtattatacttgtatacttcattaaatagttttaatataaaattcgcaagacaaattaatatgaaagaagggatagttttgcactttacacaacgtgaacaagacaaattgatgatagttgtagctgctgaggttgcacgtcgtagaaaagcaagaggacttaaacttaatcatcctgaagcacttgctttaatcagtgatgaattattagaaggcgcgcgtgatggtaaaacggtagctgaacttatgagctatggaaaaacaattttaaacgaggaagatgtcatggatggcgtagctaacatgattacagaacttgaaattgaagcaacttttccagatggtactaagttaataacagtccatcacccaatcgtttaa

SEQ ID NO: 2213 - DNA, 1128 bp, Staphylococcus epidermidis
aacatgaaaatagcaatagtaggcgcaggtataggtggtttaactgctgctgcgttattagaagaacaaggtcatcaagttaaagtgtttgaaaaaaatacttctataaacgaattaagcgctggtattgggataggagataatgttttaaaaaaattagggcatcatgaccttgctaaaggcattaaaaatgctggtcaaaatcttaccgcaatgaatatttatgatgagcaaggcaccccattaatgagcgctaaattgaagtctcattccctaaatgtcgcattatctagacaaactttaattgagatcatacagtcatatgtcgaagaatcatctattcacacaggatttaaagttactaaaattgaacaaacgagttgtaaggttaccctacattttaccaaacaggaaagtgaatcgtttgatttgtgtattggtgctgatgggttacattctgtagtaagagagtctgtaggtgcacgaactaaaattcgttacaatggttacacatgttttagaggcatggttgaagatgtacaatttaatgaccaacatgttgcgaatgaatattggggtgttaaaggacgagtaggtatagtcccattaattaatcaacgtgcttattggtttattactgttcatgctaaagaaggagatccaaaatatcaatcttttggaaaaccccatcttcaagcatattttaatcactttccaaatgaagtgagaaatgtgttagaaagacaaagtgaaacaggtatattacttcatgacatatatgatttaaaaccactgaagacattcgtttatggacgtactattttaatgggcgatgctgcgcatgccactacgcctaatatgggacaaggtgctagtcaagctatggaagatgcaattgtattagtgaattgtttagaaaaatatgattttaataaagcgattgagcgttatgataaacttagagttaaacataccacaaaagtgattaggcgttcgaaaaagataggtaaaatggctcaaaagcatcataaattaactgttaaacttagaaataccgcgatgaaattaataccaaatgctttggcatcagctcaaacaaaatttttatacaaatctaaagaaaagtaa

SEQ ID NO: 2214 - DNA, 924 bp, Staphylococcus epidermidis
aaagaaggaatcaatgtgactgaacaatttgtcataattatattattaatagcacttggttattttcttaaacgtatgaattacttgaaagcaactgatagtcaagtactttcaactttagtgttaaatgttacattaccttcactcgttatagttaacttaaatagtgcaaaattagatgtatctttttcaatattacctataatgatgattatttacggtatagtagctaaaattattgtaatttggttctttagaaaatatgataaccatatgcgtggttctgttggtatgatgactggatctatgaatattggtttgtttgcttatccgttggttgaagcgatatggccatctaaaggtatgatatatttcggaatggttgatattggtggggccattatcatgtttggtattacttattttgtaggaagttattttagcgaaggtagtgaccaatttaacttcaaatttttaggaaaaaaattagttcaatcagtcccattagtaacctatatgattatgtttggattgaacatgtctcatattcatatatggcaaccagctattgatttctttagtgtattatcaaaggcgaatatgcctttatccatgatattattaggtgtaatgcttaattttagtattgagagagaatacctccctgtaacaattaaatatctttgtttacattacgggttaggtatgttagctggaacactagttcactttttattacctgtatctgatgatatgattaaaacaaccttgcttataacgtggttattaccagtaggagtagcaatcataccatattcgattcaattcaaatataagacattaccatttgttggaatggtaactaatttaaccattattattagcattatcattttgtatatttatcaagctgtatttgtataa

SEQ ID NO: 2215 - DNA, 849 bp, Staphylococcus epidermidis
ccattgttgatagagattacattgaatttagcaatttacaacgacaaacgctcttttatagagcgtgatgcagaagatgtactaccaaaagtaatcgctgcacagaaagttttaaaagagatacgtaaagatgtagagatagatgcttatattgagcatgttaattacaatttcttagagcaacatggcatgcatgtcgatatcatattagatgcaactgataattttgatacacgtcagttaattaatgactttgcttataaacatcagattccttggatttatggtggtgttgtacaaagtacatatgttcaggcaacgtttattcctggtgaaacaccgtgttttaattgcttaatgcctcaattaccatctattaatttaacatgtgatacggttggagttattcaaccagctgtaacaatgacaaccagtttacaactcgttgatgcattgaagttgctgactggtaataaggttaataaacacttcacttacggggatatttggacaggagatcattatacatttggttttagtcgtatgcaaaatgaagattgtaaaacttgtggtaatgctccaacatatccacaccttaatcaacatcaacaagattatgcgaccttatgtggaagagacactgttcaatataaaaatgctgatatttctcaggaaatattactatcatttctcgagcgaaatcatattcaatatcgcacgaatttatatatgacaatgtttaggtttagagaacatcgaattgttgcattttctggaggtagatttttgatacatggaacgacggaacctaaaaaagcaattcaattaatgcatcaactatttggttaa

SEQ ID NO: 2216 - DNA, 1089 bp, Staphylococcus epidermidis
ttagccatgattaggtatcaagaaggagtgtttaaaatgcttggtttctcagtctatctaggacagaatttagatcgagattatattttaaatatggctgacttaggctatgatgtagtttttacttcactacagatacctgaggaagacaagaaaaatcaaatggcttatttgggagacttatgccaactattatcagcctatcaaatcacttatattatcgatgtaaccccttcattacttaatcaaactatttacagttatttgaaccaattacctcatggggatttttatattcgtatagataatcaattaaatattgaccttatcaaagacattatcagtcacggcttcaaatgctgtcttaatgctagtacattaactgatagcatgttagcgcacatatattgtactgattttaataatcaacttttatactgtcataattattatcctagacctgatactggtttatctatctcatttattgaagaaaaaaatcaactcataagaaaatacgatgcgcatgcaaaaatttgtgcttttatacctggcacgcagaagagaggccccttattcaaaggtcttcctacagttgaaaaacatcgttttgaacaccctcttattgctgcacaagaccttcaattaacgggtatatctgacattataattagtgatacgctattatcacacatttatgcggaacaattatctaatatgtggctatatcgacactttattttacacttagatcaactagactcctcatttacatcacaagttttaaagatacacacatcaagattagattcacctgaacatgtaattcgatctcaatattctcgtacagataatcaacagactgtcccaatgataggatcggcacatagagatcaaggagatatcacaattgataatcacttgaatggtcgttatgaaggagaaattcaagttataaaagctcctatgccaggtcattcccacatcaattgtattggtcatgtttgtgataaagatgttccattgttatcactgattcaacctggagatacttttaaatttgtatatacgaaggagaataacaaatga

SEQ ID NO: 2217 - DNA, 771 bp, Staphylococcus epidermidis
ggtgttaagatgattttagatgaacgtgtaaactctaatttcgatcaattaaatgataatgatatacaaattgcacattatgttaatacacatatagatgtttgcaaaaatatgaaaatacaagatttagcctcacagacacatgcttcaaatgctacgattcatcgcttcactcgtaaactaggttttgatggttatagtgactttaaatcctttttaaaatttgaagatagtaagaatcatcaacttccttctgattctatggagcaatttaaacaagaaattgaaaatacattcaactatttagaacgtattgattatcgtttattaactcacaaaatgcatcatgctacaacaatatacttatatggtactggacgtgcacagatgaatgtcgctgaagaagcacaacgtatactgttgactatgcataaaaatattatattgttacatgatgttcatgaactaaagatggtgttaaacaagacaattccagaagatttgtttttcatcatttcactttctggcgaaacacatcaacttaaagaagtcacacaattgcttcaactgagacaaaaatattttatttccgtaacaacaatgaaagacaatacattggcacaacaagctgattacaatgtctatgtttcaagcaataccttctatttaaacgatggtactgattattccagttttattagctatcacattttctttgaaacactactaagaaaatataacgaatataaagagaatcatgaattaacatag

SEQ ID NO: 2218 - DNA, 864 bp, Staphylococcus epidermidis
gtgcaaattgtagattttttgatagcacttttaccagccctgttttggggtagtgtagtcattataaatgtttttgtaggtggtggaccatataatcagattcgaggtacaactttaggtacactttttatcggattttctctacttgctactggacacgcagcgtttgataacctaacagtaattattgtcggtttagtatcaggagctctatgggcttttggtcaaggtaatcaattaaaatcagtgcatttaataggtgtatctaaaacgatgcctatttcaacgggtatgcaacttgtcggtaccactctatttagcgctattttcttaggtgaatggagcacgattgttcaagtagtgatgggacttatagcaatgatcttattggttgtaggtatttctttaacatcacttaaagccaaaagcgaaggcaaatccgataacccagaatttaaaaaagcaatgggaatattacttctatcaacaatcggttacgtaggttatgtcgttcttggagatatttttggagtaagtggtacagatgctctcttcttccaatcaattggtatggcaattggaggattaatcctttcaatgaaccataatacttcaattaaatctactgctctaaatcttataccaggtgttatctggggtatcggtaacttatttatgttctattcacaacctaaagttggtgtagcaactagtttctcattatcacaactccttgttattgtttcaactttagggggtatctttattctaggggagaaaaaagatcgtcgccaaatgattggtatttggtcaggtattatcgttatagttatagcttcaatcattttaggcaacttaaaatag

SEQ ID NO: 2219 - DNA, 342 bp, Staphylococcus epidermidis
ctaaaaggagttgaaagaatgattttagacaatgtgaatcctgatgatttatttcctaccgagaaaaaagggccctctgtattaggtatgattgagtataacgtgcagggtcagactaaatttgaaggtgccttcatagctacaaatgaacggttaattatgaatgtagatatgaatggacaattttattatcgaaatatacgttatgatgaaattaatcaaattcattttgatggttcagatattatatttgagttcaatattggaacagttccaatgcgtgaaattaagacagaagatgtacaagcttttgttgattatataaaacaacaaattcaataa

SEQ ID NO: 2220 - DNA, 339 bp, Staphylococcus epidermidis
ggatttttggtttcacctgctgagatgccaatcaattcaacaccttggtatgatcaaatcacaatagataaagcaaagaaaaatccaatgaatccatttggcataaatccaccatgtgaccataagttagaaatccctattggattccctccattgcctataccaaataaaattaatcgtaatcctgcaataatcattaatacaatagttacaactttaattaaggcaaaccaaaattcaaactctccaaacgcttttactgaaactaggttagcagccatcaaaaagagaactgctatcactcctggtatccaattaggaaggcttgggaaccagtag

SEQ ID NO: 2221 - DNA, 243 bp, Staphylococcus epidermidis
ataggagtggtagggatgcaaagatcagataaaagaaaaatgagcctgccgatgaaaatactactatgggtagtgggaattttatttctattagcaatcattgcagttatttatgttagtgcaaaaatatttattacaggagacaaaatacataatccgttaaatagaaatcattctgaattacgttctgcaaaagtaaatttaaaaatggtgatccatttactattgcactttttggcgtag

SEQ ID NO: 2222 - DNA, 1287 bp, Staphylococcus epidermidis
aaattaatattttttggagatgagtgtatgtctatagagaaaagaacgccaatatcagttaaagaagcaattaaacgtattatgaaacaacaggttgaagtgaagaatatcaatgttaatttagatgaaagtttaggacatattcttgctgaagatattgttgcgacctatgatataccaagatttaataaatcaccctacgatgggtttgcaattagaagtgaagattcacaaggtgcaagtggcgaaaaccgtattgaatttgaagtaatagatcatatcggtgcaggttcagtttcagaaaaaacaattgataaaaaccaagcaattcgaataatgactggtgctcaaattccttctggagctgatgccgtagtaatgtttgaacaaactattgaatctgaaacaacttttacaattagaaaatcctttaaacatttagaaaatatttcgctacaaggtgaagaaataaaagctggtgatattgtactgcataaaggtatgcgtattaactctggtgtgatagcagtcttagctacatacggttatactaaagtgcgagtggctcgaaaaccaactgttgcagtaattgctacaggtagtgaattgcttgaagtagaagatgagcttgaaccaggaaagatacgaaattcaaacggaccgatgattaaagcattagctaaacaatttggaatacaagttggaatgtataaagttcagcatgataatctcgaaaagagtatggaggttgtaaaaaaagctttatcagagcatgatttagtaattactactggaggtgtgtcggtaggagattttgattacttaccagaaatatacaagtctatccaagcgcagatactatttaacaaagtggctcaaagaccaggtagtgttactacggttgcatttgcagatggtaaatatttatttggcttatctggaaacccttcagcctgctatacaggatttgaattatatgtcaaacccgctgtaaataagctcatgggaactaaagcttgttatccgcaaataatcaaagctacacttatggaagactttaataaagctaacccatttacacgattgattcgtgctaaggcaacattaacaaaagctggaatgacagtaataccatctggatttaataaatcaggtgcagttgtagccattgcgcacgctaatgctatgattatgcttcctggtggcacacgtggatttaaagcgggcaacattgttgatgtgattttgaccgaatctaatagttttgaagaagaattgatactatga

SEQ ID NO: 2223 - DNA, 2172 bp, Staphylococcus epidermidis
catgatgtattttataaatgtgaaaggaaaattaaaatgaaatctttaatcttagctgaaaaaccatctgtcggaagagatatcgctaatgctttgaatcttcaacaaaaaagtaatggttatatagaagggaaacagtatatagtaacttgggcattggggcatcttgtgacaaatgcaacgcctgaacaatataacccttcatataaagaatggaatttagaagacttacctatcattcctaagaaaatgaaaacagtagtgattagtaaaacaaatagacaatttaaaattgtaaaatctttaattttagataaaaatgttaaagaaattattatagcaacagatgctggacgagaaggtgaacttgtagctcgtcttattttagatagagtaggtaataaaaaaccaatcaagcgtttgtggattagttcggttacaaaaaaagccatacaagaaggatttaaacggttaaaaaatggaaacgcgtatcaaaatttatatgaagcagcacttgcacgaagtgaagcagattggatagtagggattaatgcaacacgtgcactaacgacaaaatatgatgcacaattatcattaggtcgtgtacaaactccaacaatacagttagttaaatcaagacaagatgagattaactattttaaaccagaaaaatattacacgttatccattaatgttgatggttacgatttaaaacttaaccaacaaaagcgatataaagataaaaaagaattagaattgattgaacatgaaattaaacaccaagaaggaaaaatattagaagttaaaggaaaaaataagaaatcttacgcgcaacctttatttaatttaacagatttacaacaagaggcatataaacgttacaagatggggccaaaggagacactaaatacattacaacatttatatgagagacataagttagtaacctatccccgtacagattctaattatttaacagatgatatggtcgatacaattcaagaacggttaagagcaattttagctacagattataaatctcatgttcgagatttaatttctaagtctttttcttctaaaatgcatatttttaataatcaaaaagtttcagatcatcatgcgattattcccacagaagttagaccatctattgaacaattgagtcaacgagagtttaaaatttatatgctaatagcagaaagatttttagaaaatttaatgaatccttatttatatgaagttttaacaatccatgcacaactgaaagattaccattttgttttaaaagagaaaatacctaaacaattaggatataaagctttaaaagatcaactctcttcgcatactttaacgcattcttttaaagaaggtcagttatttaaagtacatcgtattgagattcatgaacatgaaacaaaggcaccggaatattttaacgaaggttcattacttaaagccatggagaatccacaaaatcatattgatttgaatgataaaaagtatgcaaaaacactcaaacatacgggggggattggaactgtagcaactagggctgatattatagaaaagttatttaacatgaatgctttagagtcgcgagatggcaaaattaaagttacatcaaaaggaaaacaaattttagaattgtctccaagtgaattaacctcacctatactaacagcccaatgggaagaaaaattaatgcttatcgaaaaggggaaatataattctcagaaattcatacaggaaatgaaaaactttacatttaaagtggtaaataaaattaaaagcagtgagcaaaaatataaacatgataatttaacaacaactgagtgtccaacatgtggtaagtttatgataaaagtcaaaactaaaaatggacagatgcttgtatgtcaagatcccaaatgtaaaactaagaaaaatattcaacgcaagactaatgcacgttgccctaattgtaagaaaaaaatgaccttattcggtaaagggaaagaagctgtttatagatgtgtatgtggccacacagaaactcaatcacaaatggacaaaagaatgagagataaaacgaatggtaaagtttcacgtaaagaaatgaaaaaatatataaataaaaaagaagaaatcgacaataatccatttaaagatgctctgaaaaatctcaaattgtag

SEQ ID NO: 2224 - DNA, 417 bp, Staphylococcus epidermidis
atattacaatttttggaggcgttaaatattatgaaaaaaatcaaaacaatctcgacattggtagctggacttggtatagcatttctaggtcacacaacacatgcagatgcggctgaaaataacaatcaacaacaaagtacatataactatagtacaactgaagtatcattttctaattcaggaaatttatatacttctggccaatgtacttggtatgtttatgataaaactggtgggaaaatcggatcaacatgggggaatgcaaatagctgggcaactgcagctcaagcagcaggattcactgtaaataatacacctgaagaaggtgcaattatgcaatcatctgaagtgctttcggacatgttgctttcgttgaaagtgttaataatgatggttctattactgtatcagaaatga

SEQ ID NO: 2225 - DNA, 453 bp, Staphylococcus epidermidis
atgaagcaatttgaaatcgtgactcaacctattgaaacagaacaatatagggattttacgattaacgaacgtcaaggtgccgtagtcgtatttactggtcacgtaagagagtggactaaaggtattcgtacacaacacttagagtatgaggcttatataccaatggctgaaaaaaaattagctcaaattggtaaagaaattgaagaaaagtggcctggaacaataacaacaattgtacatcgaattggtccgttacaaatatcagatattgcagttttaattgcagtatcttcaccgcatagaaaagcagcatatgcagcgaatgaatacgccatcgagcgcataaaggaaattgttccaatttggaaaaaggaaatttgggatgatggatctgaatggcaaggccatcaaaagggaacatataatgaagcaaaaaaggggaaagcaagatga

SEQ ID NO: 2226 - DNA, 1455 bp, Staphylococcus epidermidis
caattaaaatttaagaaaagaggttttgtttcaaatcatactgaagggagcaaaagtatgactcaaaagtatagatatcctacttttttagaatctatttctactattttagttatggttgtcgttgtagtaattggttttgttttctttaatatcccgatacaaatattattattaatttcttcagcttatgcagcatttattgcacatagagtgggattaaaatggaaggatttagaagaggggattactcatcgattgagcacggcgatgccagctatctttattattttagctgttggaatcattgtaggaagttggatgtattctggaacagttccagcgttaatttactatggacttaaatttttaaacccaagttatttattagtatctgcatttataatcagtgcaatgacttcaatcgctacaggaactgcttggggatcggcatctacagcaggcattgcactcatatcaattgctaatcaattaggtgtgccagcaggtatggctgctggtgccattattgcaggggcggtttttggtgataaaatgtctccattatctgatactacaaatttggcagctctcgtaactaaagttaatatttttgctcacattaaatcgatgatgtggacaacaatccctgcttctataataggattggctatatggtttattgttggattacaatttaagggagacgcaaatacacaacaaattcaaaatctattaaaagaattaacaacaatttataacttgaatttttgggtatggattccacttattatcataattttatgtttaatatttagaatctctacagtaccgtcaatgcttatctctagtatcagtgctttagttattggaacattcgatcatcaatttaatatgaaagatggttttaaagcttcttttgatggatttaatcatacgatgctacaccagtctcatatttcagataatgctaagacgttgattgagcagggtggtatgatgagtatgactcaaatcattgtaactatattttgtggttatgcttttgctggtattgttgaaaaggcaggttgtttagacgtaattttagagacaatagctaaaggcgtaaagtcagttggaacactaatattaataactgtagtttgtagtattatgctagtatttgcagcaggcgttgcttcaatagttattattatggtaggtgtacttatgaaagatatgttcgaaaagatgaatgtctcaaagtcagtgttatcgcgtacacttgaagattcaagtacaatggtattgccactcattccatggggcacatctggtatatattatgcacaccaacttaatgtttcagttgatcagttctttatatgggcaatcccatgttacttatgtgcattcattgcaataatttatggctttacaggtataggaattaaaaaaataagtagaaaataa

SEQ ID NO: 2227 - DNA, 261 bp, Staphylococcus epidermidis
tttgtatattcaaaatataaagagaggtttagagatctaatgcaagaaagatactcgagacaagtgttgtttaaggaaattggtttaaaaggtcaaagtctacttgagaaaaaacatgtgcttatagtaagtatgggtgcgttaggaacacacttagctgagggattagtgagagcgggaataaataagttaaccattgttgatagagattacattgaatttagcaatttacaacgacaaacgctcttttatagagcgtga

SEQ ID NO: 2228 - DNA, 1437 bp, Staphylococcus epidermidis
ggaggagattccatgagtaaagaagaacgtcttgccaaagacattacccacgcattaggcggttctcaaaacataagcaatatcatccattgtatgactcgagttcgtattaaagtacacaatgatgcaaaagttaattatgatgaattaaaatcaatcaatggcgtattaggcgttgttgaagatgaaagaattcaagttgttgttggaccggggattgttaataaagttgctaaacttatggctgaccagtcaggagcaactctagctgaagagacgactgaaaatcaaagttataaatcacaggcagaaaaacgtgcgtatgaacataaaaaacaattccaaagtcaacgaaaacaaagtaaatggaataaagtgttaaaatctattgctaatatctttatacctttaataccagcatttataggtgcaggattaatcggtgggattgcagcaatacttagtaacttgcttacagcaggttccatttcaggtcaatggattcaacaaattgttactgtcttaaatgttattaaagatggtatgttattttacttagctattttcactggtattaactcagcgaaagtattcggtgctacaccaggtttaggtggagtaatcggtggtactacattactaaccggtatcacggatgaaaatccaattaaaaatattttcactggagaacatctagctgctggacaaggtggtattattggtgttatcttcgcagtttggttattaagcatggttgagaaacgactacataaaataatacctaactctattgatatcatcgtaacgcccacaataaccttactacttattggtttgttaactatatttataatcatgccactagctggctttgtctccgatggtcttgtttatgtaattaactggattattggagtaggaggcattttcagtggattcattataggagcattctttttacctttagtcatgctaggattacatcatatcttcaccccaatccatatcgaattaatcaatcaaactggctccacttacttgttacctattgccgctatggctggtgctggacaagtcggtgcggcgattgcattgtgggtgagatgcggtaaaaataaagaattacgtaatacgctcaaaggtgcccttcctgtagggttcttaggtataggtgaacctttaatttatggtgtaacacttccattaggtcgccctttcttcactgcgtgtataggtggcggtgttggtggtgctgtcattggtggtatcggtcatattggggcgacagctgtaggaccaagtggtatttcattattaccattgattgctaataatatgtatctcggttacatcgtaggtttactagctgcttatacgggtggctttatctttacttatttcttcggcacaactaaagaaatgagaaatcctgaataa

SEQ ID NO: 2229 - DNA, 504 bp, Staphylococcus epidermidis
gaggcgtttttaatggattggattttaccaattgcaggaatcattgctgcgatagcgtttttaattttatgtatcggtatcgtcgtggtacttatttctgttaaaaagaatttagactatgtggctaaaacactagatggtgttgaaggtcaagttcaaggtattactcgtgaaacgactgatttacttcataaagtgaatcgcttaactgaagatattcaaggtaaagttgatcgtttaaattctgtagttgatgctgttaagggcattggagactcagtacaaaacttaaatggatctgtagatagagttacaaactcaattacgcacaatatttctcaaaatgaagataaaatttctcaagttgtacaatggtcaaatgttgcaatggaaattgctgacaaatggcaaaacagatacaatcgtagaggaagtgcaaactacaaaacaaacactgtagcagatgatgcaaatcatagctacaattcacgtgttaataaataa

SEQ ID NO: 2230 - DNA, 1101 bp, Staphylococcus epidermidis
ggagtgagattttatatgactattgataactcaaaaacattggaacgaattaaaatattaacagagcttcatggagcacctggttttgaagatgaagtgagaagttatatgaaaagtgaaatggaaccatacgtggataagtttattcaaaataagatgggtggtttctatggtataaaaaaatcaaataaagaaaacgcacctcgagttatgatagcagcacatatggatgaaataggttttatgattactcatattaatgataatggaatgattcaatttacgaatttaggtggcgtggctaatgatatttggcaaggacaaagattaaaaataaaaaatagatacggtaaagaaatcataggtgtagttgctaatattcctaaacattttagaacaggaaatgaaagcatacctcaaatcaaagatttaatgctagatattggtgcttcttcatcagaagaagtgcgcaatcggggtgtagaggtgggcgatacaatagttcctcacacaataatgactcagttgtcaaaaaacagatacagcgcgaaagcctgggacaatcgatatggttgtgtcttagctattgagatattagaattattaaaagacgttcaactagatgttgacttatatgttggtgccaatgtacaagaagaagttggacttagaggagctaaagctgccgcaaagcaaattgatcctgatattgcattcgttgtcgattgctcccctgcaaatgatatcaaaggtaaacaacaactttctggtgtgttaggggaggggactttaattcgtatcaaagatggtactatgatacttaaaccattatttagagattatctccttaagctagcagaagaaaatcagattgcatatcaatattatatatcaccaggtggtacagatggtggggagattcataaagaaaatgaaggtataccaacagctgttattggagtatgtgcgcgttatattcatagcactgatgcggtctttgatattagagattatttttctgcacgtcacttgctaaaagaaagtattattcatttaacaagtggacaaattcaacaattacaatatggaaaggaattttga

SEQ ID NO: 2231 - DNA, 627 bp, Staphylococcus epidermidis
aagtcaactttcaagatatggtatactatatctaactttaggaggtatctaatgcatttcaacaagtatcaaatactaactacagataaatatactaaatttgaacatttatataagaaggtcaaacatatatgtgtcgtaatttttttggtggtttttttgattggttttattatactgttgtcattagtattatacttccaacaactaactaaagatgcttcgtcaataagtgatcgagagttgaaagcaaaaatccttcatatacctggcgatgagctaataaatcataataatcaaattttagaagaatatgatcattcacaaaatacactcatagttggaccgaaccatgtaaattcaaatattatacatgcacttacagcctctgaagatacattattttataaacataacggtattatgcctaaagcacttttaagggcgatgcttcaagatatcacaaattcaaaccaatcttctggtggtagtactatcacgcaacaattagtaaaaaatcaagtgctctcaaataaaaaacttatagtcgtaaagcaaatgaaattatcttggctacacgggtcgaaaatttattatcaaaagatgaaatcatatatacgtatttaa

SEQ ID NO: 2232 - DNA, 639 bp, Staphylococcus epidermidis
atgtctatgtttacaggtatcattgaagaaataggtactgtacaacaagttcgctctgagcaatcagtaagaacgcttgaaattaaagcacaaaacattttagttgatatgcatattggtgattcaataagtgttaacggtgcatgtttaactgtgatagatttcactgactcaagtttttcagttcaagtcatcaaagggactgaaaacaaaacatatcttggaagtgttcaacgtaatacagaagttaatctcgaaagagccatgagtggaagtgggagatttggtggacatttcgtgttaggtcatgttgatgagcttggaacaatttctaaaatcaatgaaactgctaactcaaaaattatttctattaaaacaactaaaaacattttgaatcaaatggtaaagcaaggttctataactgtagacggagttagtcttactgtatttgatttacatgattatacttttgatatacatcttataccagaaacacgtcgatctactattctttcatctaaaaaagtgggcgacaaagtgcacttggagtctgacgtactattcaaatatgttgaaaacatcatgaatcaaaatcaatcgcagttaacagaagaaaagcttagagcatttggtttttag

SEQ ID NO: 2233 - DNA, 741 bp, Staphylococcus epidermidis
cctttcacgttcaggaggagaaatgacatgacaaaattaaatgttaaagtgtttgcggatggtgcagatattgaagaaatgaaatcagcatataagaatcaactcgttgatggttttacaacgaacccaagcttgatggctaaagcgggtgtaactgattataaagcttttgcagaggaagtggttagtgaaatacccgacgcttcaatttcttttgaggtgtttgctgacgatttacctactatggaaaaagaagctgagattttaaaacaatatggtgataatgtatttgtaaaaattcctattgttacaacaactggtgagtctacactaccattaattaaacgtttatcatcgaaacaggtaaggttgaatgtcacggctgtctatactatagagcaagtaaaagcaattactgacgctgtaactgaaggtgtgccaacatatgtgtcagtatttgcaggacgcattgcagatactggggttgatccacttcctttgatgaaagaatcagttaaggtaactcatagtaaagaaggcgttcaattattatgggcaagttgtcgtgaagtatataatgtaatccaagctgatgaaattggagctgatattattacttgcccagctgatgttgtaaaaaaggttaataacaatttaggccgggatataggagaactttcagtagatacagtcaaaggttttgccaaagacattcaaagttccggtttgtcaattttataa

SEQ ID NO: 2234 - DNA, 1524 bp, Staphylococcus epidermidis
aacgtaactactaataataaatacataaggatgatttacatgcgtgtagcaataataggtatgggaacagctggtgtaagtgtgttacgccaactcgttaaacatgaaaacttttctcaattaaaagtagatgtatatgacgatgatagaaatatgggccaaggtgttccatttcaaaatgatagtagcgaactacttattaacatgccatcaaaatccatgagcttaaatcttgatgatgatcaagagttttggaagtggtatcaaaatcagacggaatttaattttagtaatcctcaatatttgcctagatttgtatttggtcattatatgaagtcttatttatcttattataatgaccaatttgataatttaactattatcaatgataaagtacaagaaatttttacacaatccgatgttgatgacacagatttaaaatatcatgtatgtacatgtgatgatgaaaaagaatggcgtgaatacgattatttatttttaacttttggaacttttagttaccatgacccttatgatttgaagggaactaaaggctatatacaaacgccgtatcctacatatcatacacttgataatgttaaagattcagatcgaatcgtgattattggaacagggttggctagtttagatgctgtgagatatgtagctgcacatcatccatctttacccattactatgacaagtcgttctgcagcattgccaagtgttagagggaaaatgactaaaattcagtttacgcatttaactaaatcacgatttaatggaattatgaaaaatcactttggtaatgtaccattagaaaaagtagtttcattatttttaaaagaatgtgaagattatggaatagattttaaaaaacttatttatcgtagaaccggaaaccatgtcaaagacttggagtatgatttaaatcatgaagaagaaatggggatattccaaagtatcattgaacatttaaaagaaaatttaaactggatttggaatagtttgagcgttaaagatcaagaaacttttaatcgtaaatacactaaaattattcagttaaattctaatccaatgcctcctagaacagctcgtttacttatcaagttaatacagaataatgaacttgtcattaagaaagggctagaagacatagtccataaaaataatcaatttatgttgaagtataacgacactacgcaaaattatgagttgtttgacatcgttattaatgcaacgggctctaaaacacatctttctcaattagatgaggatgatcaattaattttaaacttagaaaatagacaaattgttcaacgtcatcctatgggtggcattcaaattatcccagaaacaaatcaagtcataagccctagatatggaaccttaaaaaatgtgattgcaattggacaaatgaccaacggtgtcaataaacttagaaatggcgtaaagatgattgttaatcaagttgttgatacagtatctcaattatatataacacaggaaaatagaaataagtaa

SEQ ID NO: 2235 - DNA, 186 bp, Staphylococcus epidermidis
aaaagacatacgaaagcaagtgttcaaaaattaaataattgcttttcacaagcttttaaagatgcgttaaatgaggaaataattgaacgtgatcaaacttggaacgaccctatctatgaaaggaaacctacaaaaaaagaagaagataaattcatgtctttaactgaatacaggaaattaaaataa

SEQ ID NO: 2236 - DNA, 663 bp, Staphylococcus epidermidis
gcatgtaacactcttttttgttttttcataacaacaaaaaagaaaaaggaggagtctcacatggctcgattcagaggttcaaactggaaaaaatctcgtcgtttaggtatctcattaagcggtactggtaaagaattagaaaaacgaccatatgcaccaggacaacacggtcctaaccaacgtaaaaaattatcagaatatggtttacaattacgtgaaaaacaaaaattacgttacttatatggaatgactgaaagacaattccgtaacacatttgatattgctggtaagcaatatggtgtacacggtgaaaacttcatgattttacttgctagtcgtttagatgcagttgtttattcattaggtttagctcgtacacgtcgtcaagcacgtcaattagtaaaccacggtcacattgaagtggatggtggacgcgtagacatcccatcttactcattaaaacctggtcaagtgattacagttcgtgaaaaatcacaaaacttagatattattaaagaatctgttgaaattaacaatttcgtaccagaatatttagacttcgatgctgacaacttaaaaggtactttcgttcgattccctgaacgtagcgagttaccagctgaaatcaatgaacaattaatcgttgagtactactcaagataa

SEQ ID NO: 2237 - DNA, 231 bp, Staphylococcus epidermidis
aaaggaggaacttttatggattatgcacatttaaatctcgagcacttttttgcaagaaatgatgatttggatattattagagatcgatctgattttgtgatgattaataatttcaccaatgagatgaaataccgtgaaggtgaaattgaaggaactatagatttgaatcaatactattataaaaatagatcacaagctgtaagtttcataatgatgaattataagaactaa

SEQ ID NO: 2238 - DNA, 1098 bp, Staphylococcus epidermidis
gtagaaatgactaataaattagaacagtatagagaagaaattgtttccttaaatgatcaagtattagaattactatcgaagcgaggagaattagcacagaaaattggtgaagaaaaaattaagcaaggtacacgagtatatgatcctcagcgtgaaaaggaaatgattaatcagctattagataaaaataaaggtccatttaacgacaatgtgattaagcaattatttaaagaaatttttaaagcctctacagatttacaaaaatcagaaaatgaaaaacatctttatgtatcacgtaaattgaaacctgaagatacgatcgttaaatttgataatggtggaatcattggtgatggtaataaatcatttgtatttggtccttgttctgtagaatcacaagaacaagttgatgctgtagcacaagatttgcaggctaaaggcgagaaatttattcgtggcggagcgtttaagccgagaacttctccttatgatttccaaggtcttggagtagaaggtctcaaaattttgaaaaatgttaaagataaatataacttaaatgtagtaagtgaaatagttaacccaaatgatttcgaaatcgcttcagattatttggatgttttccaaattggtgctagaaatatgcaaaattttgagttactcaaagaagctggtcgtacagataaacctattttattgaaacgtggtttatcagcaacgatagaagaatttatctatgcagcagaatatattgcttcacaaggtaaccgaaatattattttatgtgagagaggtattcgtacatacgaaaaagcaactagaaatacattagatatctctgctgtacctattttaaagcaaggaacacatctacctgttatggttgatgtaacgcatagtacaggtagaaaagatattatgttaccgacagcgaaagcggctttagccgttggtgctgatggagttatggctgaagttcatccagatccttctgttgcgttaagtgatgccggtcaacaaatggatcttaatgaattcaatcaattttatcacgaattaaaaccacttgctgatatgtacaattcgaagaaactgaaatag

SEQ ID NO: 2239 - DNA, 228 bp, Staphylococcus epidermidis
acagccgtgacattcaaccttacctgtttcgatgataaacgtttaattaatggtagtgtagactcaccagttgttgtaacaataggaatttttacaaatacattatcaccatattgttttaaaatctcagcttctttttccatagtaggtaaatcgtcagcaaacacctcaaaagaaattgaagcgtcgggtatttcactaaccacttcctctgcaaaagctttataa

SEQ ID NO: 2240 - DNA, 1248 bp, Staphylococcus epidermidis
ctctcatatttaaagagaattttcgtaatttatttaaaggagaaaatgatgacatacaataaacgattatttacctcagaatcagttactgaaggccatcctgataaaattgctgaccaagtttcagatgccattcttgatgaaatattaaaggatgatcccaatgctcgtgtagcatgtgaaacaacagtaacaacaggaatggcacttatttctggagaaatctcaacaactacttatgtagatattcctaaagtggtgagagaaacgattaaagatattggttatactagagcaaaatatggttatgattcacaaacaatggcagtgttaactgcgattgatgaacagtctcctgatattgcacagggtgtagacaaagctcttgagtatcgaaatgatatttctgaagaagaaattgaagcaacaggtgcaggtgaccaaggattaatgtttggatatgcaactgatgaaactgatacgtatatgcctctacctatattcctgtcgcatcaacttgctaaacgattggctgatgtacgaaaagatgaaattttagattatcttcgtccagatggaaaagtacaggtgactgttgaatatggtgaagatgacaaacctagacgtattgataccattgtagtttctacacaacatgctgaagatgtagagttagcacaaattgaaaaagacattaaaacgcatgttatttacccaactgtagataaagctttattagatgatgaaactaaattttacattaacccgactggacgtttcgttattggaggacctcaaggagatgctggtttaactggacgtaaaattatagttgatacgtatggtggttatgcccgtcatggtggaggttgttttagtggtaaagatcctactaaagtagatcgttcagcagcttatgcagcaagatatgtagctaaaaatattgttgcagctggtttagctaaacaatgtgaagtacaacttgcatatgcaattggtgtagcagaacccgtttccatttcaattaatacgtttgatactggaaaggtttcagaagcacgtttagttgaagctgtaagaaagcattttgatttaagaccagcaggtatcattaaaatgttagacttaaaacaaccgatatatagacaaacagcagcgtatggtcattttggacgtacagacgtattgttaccatgggaaaaattagataaagtcaatgttttaaaagatgctgttgaaattcaatga

SEQ ID NO: 2241 - DNA, 588 bp, Staphylococcus epidermidis
aatgaacaagcagagtatacaatcatgaaactagaacgtattttacccttctctaaatcgttaattgattctcatattaatcataatagtattgtaattgatgcaacatgtggtaatgggaatgatactgcttattttgctcaacatgttccaaatggatttgtctatggattcgatatacaagaacaagcaattttgaatacgcacaaaaaaacaaaagattattcgaatgtaaaattaatccaatctggtcatgaaaatgctaaattgcacattcccgcccaacatcacggttgcatagatgctgctatttttaatttaggttatttaccgaaaggtaacaaagaaattgtcactaaacctgaaacaacaattatggctattaatgaaatctttgatatcttaagtattgaaggaattattatattagttatatatcacggtcatgaagaaggtaaagtagaaaaagaagcactacttgaatttttacaaaactttgatcaaaataaagctcatatattacaatatcaattcataaatcaaaagaataacgctccttttatctgtgctattgacaaacgtaattaa

SEQ ID NO: 2242 - DNA, 1128 bp, Staphylococcus epidermidis
ggcatgaaggctatattatttgatgtagatggcgtatttttaagtgaagaacgatgttttgatgtttcagcaattactgtagctgaacttttatcgagtccagattttttaaattgtgacatagatattcattttgatggtaatttaactgaaaatgatataaacaaaatacgtagaaacgtatttaataatgaccgaatattaaatcaactaaagtcacttggtttaaattcaaattgggatatgctatttattgtatttagtattcatttaattgataaagctaaacaattaaaaccatcattacgagatcaattacttgatgaattattgtttaccaaagagactttaaaggaaatagcaaaggatttaactgataaaacgataaattatagcttaccttacgatgtgatagcttcgtttagaaatggtaaagatgctatttacgaagatttggaagtttacgctaaaaatcaattagaacttaacaacactagtttatttaaattgaaaagtgctttatggacattagcaaaagatatatatcaagaatggtatttaggaaaagctttatttaatcaagttgaatataaaaaagatattcaagattttaagaaaggtttcatttatgatgaggtcattcttaaacctatagaagaaattcaattattacttcaaaatctaatagaagcgggatatcaaattgcgatagcaactggtagacctcgaactgaaacaattattccatttcaatcattgggattaaaatcttattttaaagatgaacatatcgtaacggcaagtgaggtgttgctagcagagaaacaatttcctcaatatcaacctttaggaaaacctaacccgtttagttacatcgctacgttaaatggaaattataatgaccaatatgaacgatatgcgacaaagcaagaagatatcgtaaataaagatgaggtttacatagtaggcgactctttagctgatttattaagtgcgaagaagataggggctacgttcattggtactttaactggtttaaaaggtaaagctgctcactctgaattagttgcaaatggagcagatcatgtagtagaggatataactaagattcgaaaaattctattatag

SEQ ID NO: 2243 - DNA, 11091 bp, Staphylococcus epidermidis
gaggccaatttaatgaatctatttagaaaacagaaatttagtattagaaaatttaatataggtattttttcagcattaatagctacagtcgcatttttagctcatccggggcaagcaacagcatcagaactggaaccttctcaaaataatgacactacagctcaatctgatggagggttagaaaacacatctcagtctaatcctataagtgaggaaaccacaaatacattatctgggcaaacagtaccttcatctactgaaaataagcaaacacaaaatgttcctaatcataacgctcaaccaattgcaataaatactgaagaagctgaatctgctcaaacagcatcttataccaatatcaatgaaaataatgatacgagtgacgatgggttacatgttaatcagccggctaaacatcatattgaagcccaatctgaagatgtaacaaatcacacgaactcaaatcattcaaattcatcgattccagaaaataaagctacaacagaatcatcaagtaaacctaaaaaaagagggaaaagatcattagatacaaatagcggaaatgacacgacaagtacaactcaaaatacggatccaaatttaagtaatacaggtccaaatggcattaacactgtaattacatttgatgatttaggaattaagacaagtactaatcgctctcgacctgaggtaaaggtagttgatagtctaaatggctttacaatggttaatggtggtaaggtcggtttattaaatagtgtgttagaacgtacaagcgtgtttgatagtgccgatccgaaaaattatcaagcaatagataatgtcgtagccttaggacgtattaaaggaaatgatccgaatgatcatgatggtttcaacggtatagaaaaagaattttcagtgaaccctaattctgagataatattttcatttaatacaatgactgctaaaaacagaaaaggtggaactcaattagttttaagaaatgcagaaaataatcaagaaattgcttcaactgatattcaaggaggcggcgtatatcgtttattcaagttacctgataacgtacataggttaaaagttcaatttctacctatgaacgaaatacactcagattttaaaagaattcaacagctacatgatgggtatagatactattcttttatagatacaattggtgttaattctggttcacatctatatgtgaaatcaagacaagttaacaaaaatgtaaagaatggtaaagaatttgaagttaatactcgtatagagaataatggtaacttcgctgctgctataggtcaaaatgaacttacttataaagtaacactaccagaaaatttcgaatacgttgataattcaactgaagtttcatttgttaacgggaatgtgcctaattctacggtaaatccgttttcagttaatttcgatagacaaaatcatactttaacgtttagtagtaatggtttaaatttaggaagaagtgctcaggatgttgctagattcttgcccaataaaatactaaatattagatacaagcttagacctgtcaacatctcaacgccacgtgaagtgactttcaatgaagcaattaaatataagacattttctgaatattacattaacactaatgacaatactgttactggtcaacaaacacctttcagtattaatgtcatcatgaataaagacgatttatcagaacaggtcaataaggatatcatcccatcgaactatacacttgcttcttataataaatataataagttgaaagaacgtgctcagactgttctggatgaagaaacaaacaatacaccttttaaccaaagatactctcaaactcaaattgatgatttgttacacgaattacaaacaacactaataaatcgtgtgagtgcttcgagagaaattaatgataaagctcaagaaatgactgatgctgtatatgatagtacagaattaactactgaagaaaaagatacattagttgatcaaattgaaaatcataaaaatgaaatttctaataacattgatgatgaacttacagatgatggtgttgaaagagtcaaagaggctggattacatactctagaaagtgatactccacatccagtaacaaaaccaaatgcacgacaagttgtgaataacagagcagatcaacaaaagacgcttatacgtaacaatcatgaggcaactaccgaagaacaaaatgaagcgattagacaagttgaggcacattcatctgatgctatcgccaaaataggtgaggcagaaacagataccactgtaaatgaagctagagacaatggtacgaaattaatagctacagatgttccaaatccaactaaaaaagcagaagctagagcggcagttaccaacagtgcaaattcaaaaattaaggatatcaacaataatacacaagcaacattagacgagagaaatgatgctatcgcacttgttaatagatcaaaagatgaagcaattcaaaatattaacactgcacaaggtaatgatgatgtcactgaagcacaaaataatggaacgaatacgatacaacaagtaccattaactccagtgaaaagacaaaatgcaatagcaactatcaatgctaaagcggatgaacaaaaacgtttaattcaagcaaacaataatgcaacgactgaagaaaaagctgatgcagagcgtaaagttaatgaagcagtcataactgcaaatcaaaatattaccaatgcaactactaatagagatgttgatcaagcacaaacaactggaagtggtatcatatctgctattagtcctgcaacgaagattaaagaggatgcacgtgcagcagtagaagctaaagctattgcacaaaatcaacaaattaattcaaataatatggcaacaactgaagaaaaggaggatgcattaaatcaagtagaagcacataagcaggccgcaatagcaactatcaatcaagcgcagtcaactcagcaagtttctgaagctaagaataatggcataaatactattaatcaagatcaacctaacgcagttaagaaaaataatacaaaaacaatattagaacaaaaaggaaacgagaaaaagtcagcaatagctcaaacacctgatgctaccactgaagagaaacaagaagctgtcagtgctgtttcgcaagctgttaccaatggcattacccatatcaaccaagcaaattctaatgatgatgttgatcaagaacttagtaatgcagaacaaattattactcatactaatgtcaatgttcaaaaaaaacctcaagccagacaagcattgattgctaaaacaaatgaaaagcagagtgcgattaattctgataatgaaggcactatagaagaaaaacaaaaagcaattcaaagtttgaatgatgctaaaaatttagctgatgaacaaattacacaggctgcttctaatcaaaatgtcgacaacgccttaaatataggtataagtaatatcagtaaaatacagactaatttcactaaaaagcaacaagctagagaccaagtaaatcaaaagttccaagaaaaagaagctgagttaaattcaacacctcatgcaactcaagatgaaaaacaagatgcgttaactagattaacacaagcaaaggaaactgcactcaacgacataaatcaagcacaaacaaatcaaaatgtggatacagcacttactagtggaattcaaaatattcaaaatacacaagttaatgttaggaaaaagcaagaagccaaaactacgattaatgatattgttcaacaacataaacaaagtatacaaaataatgatgatgctacaactgaagagaaggaagtcgcaaataatttagttaatgcatcacagcaaaatgtaattagtaagattgataatgctacaacgaataatcaaattgatggtattgtgagtgatggtagacaaagcataaatgcaattacacctgatacatcaattaaaagaaatgctaaaaatgatattgatattaaagcagctgataagaaaataaaaattcaaagaataaatgatgctacagatgaagaaattcaagaagcgaatcgtaaaattgaagaagctaagattgaagcaaaagataatattcaacgcaatagtactagagatcaagtaaatgaagcgaaaactaatggaataaataaaatagaaaatataacaccagcaactactgtgaaatctgaagctagacaagcagtacagaataaagcaaatgaacagattaatcatattcaaaacacgcctgatgcaactaatgaagaaaaacaagaggcaataaatagagtaagtgctgaattagcaagagttcaagcacaaataaatgcagaacatacaacccaaggtgtcaaaactatcaaagacgacgcgataacttctttatctcgaattaatgcacaagttgttgagaaagagtctgcaagaaatgcaatcgaacaaaaggcaacacaacaaacgcaatttattaataataatgataatgctacagatgaagaaaaagaggtcgccaacaatttagttatcgctacaaaacaaaaatcattagataatattaactccttatcttcaaataatgatgttgaaaatgctaaagtagcaggaataaatgaaatagctaacgttttaccagcaaccgctgttaagtcaaaagcaaaaaaagatattgatcaaaaactcgcgcaacagattaatcaaattcaaacgcatcaaactgctacaactgaggaaaaagaagcggctattcaattggcaaatcaaaaatcaaatgaagcaagaacagcaattcaaaatgaacatagtaacaatggtgtcgcacaagctaaatctaacggcattcatgaaattgaattagttatgccagatgcgcacaaaaaatctgatgctaaacaaagtatcgataataaatataatgagcaaagtaatactatcaacactacaccagatgcaacagatgaagaaaagcaaaaagcattagataaattaaaaatagctaaagatgcaggatacaacaaagttgatcaagcgcaaacaaaccaacaagtatctgatgcaaaaactgaggctatagatacgataactaatattcaagcaaatgttgcaaaaaaaccatccgctcgagtggaattagattcaaagtttgaggatttaaagcgtcaaatcaatgcaacgcccaatgctacagaagaagaaaaacaagatgcaattcaaagattgaatggtaaaagagatgaagttaagaatctaataaatcaagatagacgtgacaatgaagttgaacagcacaaaaatattggacttcaagaattagaaacgattcatgctaatccaactagaaaatctgatgcgctccaagagttacaaactaaatttatttcacaaacagagttaattaataataacaaagatgcaactaatgaagaaaaagatgaagccaaacgacttcttgagattagtaaaaataaaactataacaaatatcaatcaagcgcaaactaataatcaagttgataatgctaaagataacggcatgaatgagattgctaccataataccagcaacaacaattaaaacagatgcaaaaacggctattgataaaaaagctgagcaacaagttacaatcatcaatggtaacaacgatgcaacagatgaagaaaaagcagaggctagaaagctggttgaaaaagcgaaaattgaagccaaatctaatattacaaatagtgatactgaaagggaagtcaatggtgctaaaaccaatgggttagaaaaaataaacaatattcaaccatcaactcaaactaaaacaaatgctaagcaagaaataaatgacaaagctcaagaacaattaatccaaattaataacacgcctgatgcaaccgaagaagaaaagcaagaggcaacaaatagagtcaatgctggattagcacaagcaatacaaaatattaataatgcacatagtactcaagaagtaaatgaatctaaaacaaatagtattgctacaatcaagagtgtacaacccaatgtgatcaaaaaaccgactgctataaatagtttgactcaagaagctaataatcaaaagacgttaataggtaatgatggtaatgctactgatgatgaaaaagaggctgcaaagcaattagtgacccaaaaattaaatgaacaaattcaaaaaattcatgaaagtacacaagataatcaagttgataacgtaaaagcacaagctatcactgcaattaaattgattaatgcaaatgcacataaaagacaagatgccattaatattttgactaatctagctgaaagtaaaaaatcagatataagagccaatcaagatgcaactactgaagagaaaaatacggcaatacaatctatagatgatacgttagcacaagcacgtaacaatattaatggtgcaaatacaaatgcgttagtggatgagaatttagaagatggtaagcaaaagttacaacgtattgtgttgtcaactcaaactaaaacacaagctaaagcagacattgctcaagcaataggtcaacaaaggtcgacaatagaccagaatcaaaatgctacaacagaagaaaaacaagaagcccttgagagacttaatcaagaaacaaatggagtcaatgatagaatacaagcagctttagcaaatcaaaatgttacagacgaaaaaaataatatattagaaacaataagaaatgttgaacctattgtaattgtaaaaccaaaggctaatgaaataattagaaaaaaagctgcggaacaaacgactttaataaatcaaaatcaagatgcgacactagaagaaaaacaaatagcacttggcaaattagaagaagtaaagaatgaagcgttaaatcaagtatcacaggcacactcaaataatgatgtgaaaattgcggaaaataatggaattgctaaaatttctgaggtccatcctgagactataattaaacgtaatgctaaacaagaaattgaacaagatgcgcaaagtcaaattgatactatcaatgcaaataataaatcaactaatgaagaaaaatcagccgctatagatagagttaatgtagctaaaattgatgctattaacaatattactaatgctacaactacacaattagttaatgatgctaaaaatagtggtaacacgagtattagccaaatattaccaagtacagcagtcaaaactaatgcattagcagctctagctagcgaagctaaaaataaaaacgctataatagatcaaacaccaaatgcgacagcagaagaaaaagaagaagcaaataataaagttgatcgtcttcaagaagaagcagatgctaatatcctaaaagcgcacactactgatgaagttaataatattaaaaatcaagctgttcaaaatattaacgctgttcaagttgaagttatcaagaaacaaaacgttaaaaaccaattaaatcaattcattgataatcaaaagaaaattattgaaaatacgcctgatgcaacactagaagaaaaagctgaagctaatagattgcttcaaaatgtactaacttccacatcagatgaaattgctaatgtagatcataacaacgaggttgatcaagctttagataaagctagaccaaaaatcgaggaaattgtaccacaagttagtaagaaacgagatgttttaaatgcaatccaagaagcatttaattcacaaactcaagaaatacaagagaaccaagaagctacgaatgaagaaaaaactgaagcattaaataaaataaaccaattacttaatcaggctaaagtaaatattgatcaagcacagtcaaataaagatgtagatagtgcgaaaacacgtagtattcaagatatagagcaaattcaaccacatccacaaacaaaagcaaccgggcgtcacagattaaatgaaaaagctaaccaacaacaaagtactattgcaactcatcctaattcaacaattgaagaaagacaggaagcaagtgcaaaactacaagaagttcttaaaaaagccatagctaaaatagataaaggtcaaaccaatgatgatgtagaaaagactgtagtaaacggaatagctgaaattgaaaatatattacctgctactacagttaaagataaagctaaagctgatgtaaatgctgaaaaagagcagaaaaacctacaaattaatagtaatgatgaagcaacgactgaagaaaaattagttgctagtgacaatttaaatcacgttgtcgagacaacaaatcaagctattgaggatgcaccagataccaaccaagtgaatgtagaaaagaacaaaggtataggtacaattagagatattcaaccacttgtagttaaaaaacctactgccaaatctaaaattgaaagcgcagtagaaaaaaagaaaactgaaattaatcaaacacaaaatgcaactcatgatgaagtaagagagggtttaaatcagttaaatcaaattcatgaaaaagccaaaaatgatgtaaatcaatctcaaactaatcagcaagttgaaaatgctgagcaaaatagtttagatcaaatcaataacttcagaccagattttagtaaaaaacgtaatgcagtagctgaaattgttaaagcgcaacaaaacaaaattgatgaaatagagcaagaatttagtgctacacaagaggaaaaagacaatgctttacaacatttagatgaacaggttaaagaaatcattaattctataaatcaagctaatacagataatgaagtagataatgctaaaacttctgggttgaataacataactgaatacagaccagaatataataaaaagaaaaatgctatattaaaattatatgatgtttcagatactcaagaagctataattaatggttatcctgatgcaactgaagatgaacttcaagaagctaatagtaagttaaataaaatacttttagatgcaaaaaaacaaattggtcttgcgcacacaaataatgaagttgatgatatttataatgaagtttcccaaaaaatgaaaactattttaccacgtgtagatacaaaagcggtagcacgttctgtacttaatgcacttgctaaacaattgattaaaacttttgaaaatactgcagatgttactcacgaggaacgtaatgatgcgattaatcatgtaaaagaacaattatctttagtattcaatgccattgaaaaagaccgaaaagatatacaagttgcgcaagatgaattatttggattaaatgaattaaatagtatatttatcaacataactcaaaagccaactgccagaaaagcaattagtggtatggcgagtcaattaaacaactctatcaataatacgccatatgctacagaagaagaacgacaaattgcactgaataaagttaaggcgattgttgatgatgcaaatgaaaaaatacgagaagctaacactgatagcgaagtacttggaacaaaaacaaacgcaataacattgttacaagcaatcagtgcggatgtacaagttaaaccacaagcatttgaagaaatcaatgcacaagctgaaattcaaagagaacgaattaatggaaatagtgatgcgacaagagaagaaaaagaagaagctttaaaacaagttgatacattagtaaatcattcatttattacaattaataatgttaataaaaatcaagaagtttatgatactaaagacaaaacgattgaagctattcataaaatcaaaccaatatcaactatcaaaccacaagcattaaatgaaatcactattcaactagacactcaacgtgatttaataaagaataataaagagtctacagttgaagaaaaagcctcggctatcgataaattaattaaaactgcagcaagaatagccgaagcaatagataaagctcaaacaaatgaagaagttaaaaatattaaaaaacaaagtattgatgaaatttctaaaatactacctgttattgaaattaaatcagctgcaagaaatgaaattcatcaaaaagcagaagttattcgcggattaattaatgataatgaagaagcgactaaagaagaaaaagatatcgcattaaatcaattagacacaactctaacacaagcaaatgtttcaattgaccaagcattaacaaatgaagctgttaatagagctaaagaaatagcaaattctgaaattaataaaatttctgtcattgccattaaaaagcctgaagctatagcagaaattcaagaactagcagataaaaaattaaataaatttaaacaaagtcaagaagctactattgaagaaaagcaatcagctatcaatgaattagaacaagctttaaaatcagctattaatcatattcatcaatctcaaaataatgaatcagtgagcgctgcattaaaagaaagtatatctttaatagactcgattgaaattcaagcacataaaaaattagaagctaaagcatacattgatggatatagtgacgataaaattaatgacatatcttctagagcgactaacgaagaaaaacaaatatttgtaagtaaacttaaagcattaatcaatcgtacacataaacagattgacgaagctgaaacatttgtttcagttgaaacaattgtccgaaactttaaagttgaagcggataaattaaactcaattgtacgtaaaaaagctaaagcatcgaaggaaattgaattagaagcagaccatgtaaagcaaatgataaatgcaaatttaagtgctagtactagagtgaaacaaaatgctcgtacattgataaatgaaattgttagtaacgctttaagtcaacttaataaagtaaccacaaataaagaagttgatgaaatagttaacgaaacgattgaaaaacttaagtcaatacaaataagagaagataaaatattgagtagtcaacgttcatcaacatctatgacggaaaaatctaatcaatgttatagttccgagaataatacaattaaatctctaccagaggcaggaaatgctgataaatcactaccattagcaggagttactttaatatctggtttagcaatcatgtcctcacgtaaaaagaaaaaagataaaaaagtaaatgactaa

SEQ ID NO: 2244 - DNA, 201 bp, Staphylococcus epidermidis
cttatcatttatatcaaatcaacttttatgtttaaaattatcatgaaagttgtttttttacaaaaagccccaaatgattttaaatataaattcatttggggcgaagttattgtgataggtttttattattattatataatatcaattttacctcagagttcaattatatcaatgatttgtcctgacacagcatctgcataa

SEQ ID NO: 2245 - DNA, 357 bp, Staphylococcus epidermidis
ttcagcacttactctatttattgcctcttgtttttcttcattagttgcatcaggcgtgttttgaatatgattaatctgttcatttgctttattctgtactgcttgtctagcttcagatttcacagtagttgctggtgttatattttctattttatttattccattagttttcgcttcatttacttgatctctagtactattgcgttgaatattatcttttgcttcaatcttagcttcttcaattttacgattcgcttcttgaatttcttcatctgtagcatcatttattctttgaatttttattttcttatcagctgctttaatatcaatatcatttttagcatttcttttaattga

SEQ ID NO: 2246 - DNA, 849 bp, Staphylococcus epidermidis
aggagagattatatggagacggttcaattttataacggaagaacaatgccgaaaatagggctcggcacttatagagtaaaagatggcgatgaatgtagagaatctgtaaaatatgctatcgaacggggttatagaagtatagatacggcaatgatttatggtaacgaagaaacggtaggtcaaggtattaaagaaggattagaatcgactggtttaagtcgtgaagatttatttataacttctaaattatggctaactgattttggacgtcaaaatgtggaagatgcctatcgacaatctgttgcaaaattaggactggattatttagatttatatctgatgcattggccaggtacaaatgaagcggtaatgattgatacttggagaggtatggaagacttgtataaacaaaatcaggtgaaaaatattggtgtgagcaattttactccagaacattttgaagcattgcttgcccaagtttctattaaaccggtcattaaccaagtagaatttcatccttatttaacacaaaataaattacgaaagtatttagaagctcaaaatattatcatggaatcatggtctccattaatgaattcacaaattctccatgatgaagtcataaatgaagtagctaatgaagtaggaaaaactccagcccaagttgtaataagatggaatattcagcacgatgttgttgttatacctaaatccgtaacaccacatcgcatagaagaaaatttagacgtatggaattttgaattaagcgacaaccaaatggaaagaatcgatcaattaaatcaagataaaagaattggacctaaccctcttgaatttgacggtaagtaa

SEQ ID NO: 2247 - DNA, 219 bp, Staphylococcus epidermidis
ttgtcaattcttacaatacgtaacgtttcttcttctctatcaaacttgaattctacgtctaaatgttttaaacgcgctttcaatttatctctcatttggaagacattcattattaacactccctattttcgcacctttttacagtttacaataaataatgttgagttaacagaaaaaactcagataatcacattaatttgttattataaattaatgtag

SEQ ID NO: 2248 - DNA, 747 bp, Staphylococcus epidermidis
ggaggaattctaatgagaaaattatttctatcaattttatctattataataatttcaagtttttgtgttgcaacagggtttcaaaacgttaatgctgcaaataatgaggtgagcaaacctcaaagtaatgtggatagtaaaactaaacaaaatattattaaaaaaataaaaaaatctaatgcttataaaaagcacgctaattcaacttctattgactcaataaaagatgacgatattattgttcatttggataaaggtaaaaacaccaatgtatattctattaactatgtatttggtaaaaaattagctaaaatgaatgataaccttgcaatgattgaattaaaatataacgaagcaaacaatgaagttttctacaatcatatgatgtattcaaaatttgttaaatataataataaagaatatattaatatgaaaggcattttaaatggcaaaccttattatgaatttaatatagatcagaaaggtcattactacgataaaaactttaaacatacctctaaagatgaaatcgaaaaagattctgctaaaaacttaccacctaaagagcgtggttggtgtgaatgggcagtaggagctttatgtggtaccggtggagctgcaggttgttgggcaactgctacagctttaggtattactactggttggggaggcttttcattaactacaatttgtggtctgataagctctctaggctgtactggtgcaaccaactatatttgtaaataa

SEQ ID NO: 2249 - DNA, 306 bp, Staphylococcus epidermidis
aaagtagcgtataagacaatgcaacttaaatacaatgaaataaataagaaccaactcatttcgtctgaaacaccgtttctagaaaactttcaagattgtataaaaattaataaaaagaacaaaatatcacaatcaactttaaactgttattataatgcattaaatatctttgatgaaaagtttggcaatacagctattaaaaatttttcacaacttaaatatagcgaaatgttaaaagagtatgcagaaggtcacattattggtggacataaaaaagacatacgaaagcaagtgttcaaaaattaa

SEQ ID NO: 2250 - DNA, 366 bp, Staphylococcus epidermidis
atgcaatatctatatatttttgtaggtggtgctttaggtgcattgataagattctgtttatcaatgcttaatgaaggttcaaccattccgttggggacatttgttgcaaatttattaggtgcttttttaatgggtagtatcggcgcattaagcctttcactttttaaaactcatcctaacataaaaaaagggcttactactggtttacttggtgcgttaactaccttttcaacatttcaatttgaacttgtaacactatttaatcagcatcattttatactatttactatatatggtgtgacgagttatattctaggaatactaagctgttacctcggtgtcaaaataggaggtagattttcttga

SEQ ID NO: 2251 - DNA, 210 bp, Staphylococcus epidermidis
ttttatcatctatattattctaaatctagtagtataaaaatttatcttaatatatttttaaatgatatcagaatttgttttttgagatccacattgaattatttaatgatttttatatcaaaaaaagtacgactaagatttcaaataaaaatcttaatcgtactcagtgaccacatttgtgatttacagtgtaattccagaatttactag

SEQ ID NO: 2252 - DNA, 1725 bp, Staphylococcus epidermidis
tatctaattcaaagtatgttgtcaattttatacattgtcactatttctattttaaagtggataaattcaatcggtatgttatactatctaaatgtaagggcttacataaattatcgtatggagggattgggtatgtctatagatacatacacagaaacacttaagataaatcagctaatagaaaaagctacatcacattttcaactatcatcaacacaattatacaaaaaaattttaaaaaatcatgagggtgagttaactgaactgggggcaataaatgttaaaacaggtaagtacactggtcgttcacctaaagataaatttatagtcactgaaccatcgtataaggataatataaattggggagatatcaatcagcccatggatgaagaaacatttctaaaactttacaataaagtactcgattatttaaatcagaaagaggaactttacatatttagtggatatgcagggagcgataaagagtcacgtcttaaacttaaggtgataaatgaattagcttggcataatttatttgctcgtaacatgtttattcgtccagaatctatagatgaagctcaaaatataaaacccaacttcacaattgtttcagcacctcactttaaagctaatcccaaattagatgggacacatagtgaaacatttgtcattatatcttttaaacataaagtgattttaattggtggcacagaatatgctggtgaaatgaaaaaaggtattttctctgtaatgaactatttgcttccaatgcaggatatcatgagtatgcattgttcagctaatgttggagaaaaaggagatgtagcactattctttggattatcaggaactggtaagacgacgctttctgccgatccaaaacgtaagttaattggtgacgatgaacatggttggaataaaaatggcgtttttaatattgagggtggatgttatgcaaaagcaattcatttatctaaacagaaagagcctcaaatttataatgctattaaatacggaacaatattagaaaacacagttacaaatgatgacggtacggtagattttgatgataacacctatactgaaaacactcgcgccgcctaccctattgactatatagagaatattgttacaccttcaaaggcagcacatccgaatacgattattttcttaaccgctgatgcatttggagttatccctcctatttctaagctaactaaagatcaagcaatgtatcatttcttaagtggattcacgtctaaactagctggaacagaacgtggtgttactgaacctcaaccttcgttttcaacttgctttggtgcaccattcttacctttaagtccaacaaagtacgctgatttacttggaaatttaatcgatattcatgatgtagatgtatatctagtaaatactggatggacaggtggtaaatatggtatagggcgaagaattagtctacactatactcgtgaaatggtagatcaagctatatcaggtaaattaaaaaatactaaatatattaaagatgatacatttggcttaaatattccagttcagattgacagtatacctacaactattctgaatcctatcaatgcttggaacaataaagataactacaaagcacaagcttacgatttgattcaacgctttaataataactttaaaaaattcggcaaggaagttgaacatattgccaacaaaggtgcatttaatcaataa

SEQ ID NO: 2253 - DNA, 252 bp, Staphylococcus epidermidis
ccgcttgaccaaggagccatggctccacaggtaggattcgaacctacgaccgatcggttaacagccgatagctctaccactgagctactgtggataaataaaatggagcgggtgatgggaatcgaacccacaacatcagcttggaaggctgaggttttgccattaaactacacccgcttaatgaaatacgattatggggcggttgaagggaatcgaaccctcgagtgtcggaaccacaatccgatgcgttaa

SEQ ID NO: 2254 - DNA, 525 bp, Staphylococcus epidermidis
acacctgcacaaaaagaagatgaaaagtttatgagcatagaaaattttgtaaatttaaagaagtatgtatctgatccccctattcaatcatatgtatttgtttatattttaatcgtcactggaggtcgctttggagaagttcaaaaactaagtagaagtgatttagattataaaaataatacaatacacttaccaggaacgaaaacagaaacttcagatagaactgtagatatacctgctgcagatatgaatatgttaagaaaaacattatctaaaatgccagtgagtttatcaaatcaattattcagtacaggtgtaggattgattacacacaatgctgtatctaaagtgttacaaaaattttgtttagaaaataaaataggtaaatatactttgcatagtataagacacacgcattgttcttatttactactcaatgacgtatctatctattacacttcaaagagattaggttacaaaaatattaaaactactatggatgcatatttcgcatctattagatga

SEQ ID NO: 2255 - DNA, 201 bp, Staphylococcus epidermidis
agaataaaacagccacaagtattgcaacaattaagccaattactgtcggtgaagaaaaatccattaaaacaacgctcctttatcagtttcaataactctaattataatagaaaaaaggcttattttcgacatatattttataattatttattttctattttacaagtcattgaatttcaacagcatcttttaaaacattga

SEQ ID NO: 2256 - DNA, 1194 bp, Staphylococcus epidermidis
gaggaatataacatgcaattcgatacaattgagttggctatagaggctttaagaaatggagagagcattattgtagttgacgatgaagatagagaaaatgaaggagatcttgtagctgttacggaatggatggatgataataccattaattttatggctagagagggtcgtggtctgatttgtgcaccaattgataaatctatagctgaaagattaaaactacaatctatggagcaaaataacactgatatttatggcacacattttactgtaagcattgatcattataaaactactacaggaatcagtgcacatgaacgtacacaaacggctagagcactcatagatgaaaatactaatcctgaagattttcatcgtccggggcacttatttccacttatagcaaaagagaatggtgtgttaacacgtaatggtcatactgaagctgccgtagatttggcacggttaacaggagcacaaccagctggagtaatctgcgaaattatgaatgatgatgggacaatggctaagggtgaagatctccagtcatttaaagaacgccaccatttaaaaatgattactataaaaagtttggttgcttttcgtaaggctgttgaacttaatgttaatcttaaggcaaaggtcaagatgccaacagattttggtcattttgatatgtatggatttacaacggattatagcgatgaagaaatcgttgctattgttaaaggagatttaaaaagcaatcctaatgtacgtatgcattctgcttgtctgactggggatatttttcatagtcaaagatgtgattgcggggcacaacttgaagcgtcaatgaaatatattgacgaacatggtggaatgattatttatttacctcaagaaggtagaggaatagggttaattaataagttgcgcgcatatgagttgatagaaaaaggttatgatacagttactgcaaatcttgctcttggttttgatgaggatttgagagattatcatgttgcagctgaaatattaaagtattttgatataagtgaaattaacttgctcagcaataatcctaaaaaatttgaaggtttagaagattacggcattgagatcgtagatagaattgaacttatcgttccagaaacacaatataaccatagttatatggaaactaaaaaaaataaaatgggacatttaatatag

SEQ ID NO: 2257 - DNA, 198 bp, Staphylococcus epidermidis
gttcgaatcctacctgtggagccatggctccttggtcaagcggttaagacaccgccctttcacggcggtaacacgggttcgagtcccgtaggagtcatacaaacagaagtgaaatatcgcttctgtttttttattattatattctatcatggagagttgtccgagttggccgaaggagcacgcctggaaagtgtgtag

SEQ ID NO: 2258 - DNA, 1011 bp, Staphylococcus epidermidis
aacgtttacaaggaggaaattatgacagttacaatttatgatgtagcccgagaggctagggtatcaatggcaactgtttcacgtgtagtaaatggaaaccaaaatgttaaaccagaaacacgtaataaagtaaatgaagtcattaaaaggttaaactatcgacctaacgcagttgcaagaggtcttgcaagtaaacgtacaacgacagttggagttataattcccgatatttcaaatgtttattattctcaacttgcaagaggtttagaagatattgcaacaatgtacaaatatcactcaattatctcaaactcagataatgatccagaaaaagaaaaagaaatttttaataatttattaagtaaacaagtcgatggtattattttcttaggtggaactatttctgaagaaattaaaagtcttattaatcaatcatctgtaccagtcgtagtttctggaacggatggtaaggatgatcatattgcatctgtaaatattgattttaaacaagcagccgaagaagcaacacaatatcttatagagaagggtgctaaaacattttctttaataggtggagaatactctataaaggcacaagatgatgttttagagggccttaaaaatgttttaagtcagcatcaactaaaattagacgatacattacatttaactggcaatgaaagttacaaatcaggtataaaaacatttgaacaattgcaatcgaatttaccagatgctgttctttgtattagtgatgagcaagcaataggtatattgcatagtgcacaagatgctggagtgaaagtacctgaagacttacagattattagttttaacaatacacgtttagtagaaatggtgagaccacagttatctagtgttattcaaccattgtatgatattggtgctgttggaatgagattactgactaaatacatgaacgatgaagaaattgaaaatcctaatgtcatattgcctcatagaatagaataccgtgggacaactcagtaa

SEQ ID NO: 2259 - DNA, 882 bp, Staphylococcus epidermidis
tttaacaacaatgacctaagaggtgtgaatatgactaagcacaagaaaggctcaatattagctatcataggtttgctaattgtatttgttgttacaggttttatcttcttttcaatgatttcagatcaaatatttttcaaacatgtcaaaccagttgaaaaggttgaaaaattagataaaactttagataaagcatctaaaaagcaaatacacaattatacgagccaacaagtatctaacaaagcaaatacagcttggcgtgatgcgtctggtacagaaattaaagaagctatggatagtagtaaattcatagatgatgataaacaaaaatatcaatttttagatttgtctaagtatcaaggcattgataaaaacagaattaaacgcatgttgtttgatagaccagtactactaaaacatacagatgattttattaatgctgcaaagtctaaacatgtcaatgaagtatatcttatttctcatgctctattagaaacaggcgcagctaaaagtgaactggctaatggtgtagaaatagatggtaaaaaatattacaatttctatggtgttggtgcattagatagtgaccctattaaaacaggtgccgaatatgctaaaaaacatggatgggacacaccacaaaaagctatttatggtggcgctgattttattcataagcatttcttatctcatgacgatcaaaatacactttatagtatgagatggaaccctaaaaacccgggtgaacaccaatatgctactgatataaaatgggctgaaagtaacgcgaatatcattgcagatttctacaagaacatgaaaacagaaggtaaatacttcaaattatatgtttataaagatgacgataaacaccaaaaataa

SEQ ID NO: 2260 - DNA, 783 bp, Staphylococcus epidermidis
ggcaaattaaataagtttaaaagaaaggtgactttgatgaaatttcgacgtccaaatcaacatttccaaatcgtagcgcatagaggattacctgaagattatcctgaaaatactattatcgcttatcgacatgcgctcatgttacatatagatatgttggaaattgatgtacattacacaaaagataaagaacttgtcgttatacatgatgatactatcgatcgtacgtcaaatggtaaaggtaaggtttctgattttactttaaaagaattaaaagcgttagattttggtttctataaaggagagaaatttaaaggggagagtataccgacttttgatgaagtgttagatttagcagataacttttcacaaaaattattaatagaaataaaaaagcctagtcagtatccaaatattgaaaatatgattgttgataaattgaaggaaagacaaatatctaaatctaaagtgattttacaatcattcgattttgattgtgtaaaaaaattgtcagcaatgaatttagattatgaattaggtttattaattagtaagaaaaaatattggcacaagttaccaaatttcaaaaaaattgccaaagttgctgattatgctaatcctaattatcaaattgtttcgaagaaatttatgcaacttgctcatgaggaagagttaaaagtattaccttatactgtaaataaattaaaagaatcacaaaaattaatagatattggtgttgacggtattatttccgatgtacctgaagatttatttgagctataa

SEQ ID NO: 2261 - DNA, 552 bp, Staphylococcus epidermidis
ttattttcaaacaataagttaacttctatttatccggaaatcattttatgtgcacaaataggagttaattacatgtcatttgaggaagcatataaaaaatacaacaatatcatacattatttgttaaaaagttatcaaatcacttataattatgatgaattttatcaacaaatgctcattaaaatgtggcaacttacactcgattttgatgaacaacaatcttcttcttttaaatcttatctatttatacgcctaaaattctatcttatagatttatttagacaaaaagacaatacgcttaatatatgtagcattgacgccctttcagaactttctccgtcattttcaatcaacgaaatcgatttacttattaaagatatttcacaacagttacttccacgcgaacgagattggttaaccttatatttacaaggatacaaacaatatgaaatttcccaaattttagatttttcacttacaacgattaaaaaaataaaatctaacgcaatacgaaaactacgtcgttatttaaattcatctacaaaggattga

SEQ ID NO: 2262 - DNA, 453 bp, Staphylococcus epidermidis
gaactaacaaaggagagatgtaaaatgggaaaaagtactaatttatttaaaattgcattaggcattggtggtgcaattactgttgtagcattatcacgtaaagaaagtcgagataaacttaaacaagaatataataaatataaagaaaatcctgaatcatataaatctagcgctaaagatttagcaactcaaataggtaataaagctaatgaaacaattcaagaagttaagaagaaccctaaagactatgttgaacgtatcaaaagtaatcctaaagaatttttagaagaagaaaagtctaaaattattggcaaaaatgatcagacacaagatgatattgaagaaggaaaatttgatgctgaaggcggcgcaactgtcaataacaatttaagagttgttactgaagatgacttaaaaaataataaaaatgcattacaagataaaaaagaataa

SEQ ID NO: 2263 - DNA, 852 bp, Staphylococcus epidermidis
tttatgacaaaagtttttataaatggtgaatttgttaatgaagaggatgctaaggtttcatatgaagatcgaggctacgtgtttggggacggaatctatgaatatatacgggcatatgatgggaaattgtttaccgttaaagagcattttgaaagatttttaagaagtgctgaagaaataggactagatttaaattatactattgaggaattaattgaattagtacgccgattattaaaagaaaataatgtggtgaatggcggtatttatatacaagctactcgtggtgctgctcctcgaaatcattcatttcctacaccacctgtaaaacctgttattatggcgtttacaaaaagttatgatagaccttatgaagaattagaacaaggagtttatgccattacaactgaagacattagatggttacgttgtgatattaaaagtttaaatttattaggaaatgtattagctaaagaatatgctgttaaatataatgctgcagaggctatacaacaccgaggtgatattgtcactgagggtgcatctagtaatgtttacgcaattaaagatggagtgatatacacgcatccagttaataattttatattgaacggaattactcgccgtgtcataaaatggatagcagaggatgaacaaataccattcaaagaagaaacatttacagtagaatttcttaaaagtgctgatgaagttatcatttctagtacttctgcagaagttatgccaattacaaaaattgatggtgaaaatgttcaagacggacaagttggtactataacacgacaattacaacaaggatttgaaaagtatattcaatcgcatagtatttaa

SEQ ID NO: 2264 - DNA, 1248 bp, Staphylococcus epidermidis
attgagaaaaatataaagagagggactcatgatatgaatatacctaaatcagtatggtggctagttataggtatggcacttaatataaccggcgccagttttttgtggcctttaaatacaattttcatgaaggaagaacttcataagagtttaacaattgcaggtatcgttttgatgattaattcatttggaatggttgtaggtaatttgttaggtggttctttgtttgataaacttggtggttacaaaacgattttaataggtacatttacgtgttatgttagtaccacattactcaacttgtttcatggctggccatggtatgcaatttggttagtactacttggatttggtggcggaatgatagttcctgctatttatgcgatggcaggtgccgtttggcctaatggaggaagacaaacttttaatgctatctacttagcacaaaatataggggttgctttaggcgcggcattaggaggttttgtggctgaatttagtttcaattatatttttatggcaaacctcattatgtatgtactttttgccatcgtggcgattacacagttcaatttagagattaatgctaaatttaaaccacaagattcgatagatttaaaaagcaaagaaaataaaaaacgatttactgctatgatgctagtatgtgcaatgtttgcaatttgttggattgcatatattcaatgggaaacaacgatagcttcattcacacaatcaattaatatttcaatgtctcaatatagtgtattatggacaatcaatggaattatgattttagtagctcaacctttaataagaccaattattatcttattaaaaggtaatttaaaacatcaaatgtttgtaggtattttaatttttatgagttctttcctagtgacgagttttgcaaatcactttgctatatttgtagttggcatggtcattttaacttttggagaaatgtttgtttggcctgcagtaccaactatagcaaatcaacttgcaccagttggaaagcaagggcaataccaaggatttgttaattcagcatctacagtgggtaaagcatttggaccatttattgggggtatacttgtagatacatttaatatgagtatgatgtttattgggatgattatattattaagttttgcactgttatttttaagtttctatgataaagtgttacccaagaattttaaaaatcaacatcaatcaagaagacgacgaaatcagaatggtatttaa

SEQ ID NO: 2265 - DNA, 471 bp, Staphylococcus epidermidis
ctaattttgaaaagaggtacctatcaaatgagtaaaaatgaattcatcaaaagagtaaataagcaattatggtttttaaatgctaaagaggaggatgcacttaacaaatatattgactcagttgatcagaataaaagtattgatacccataagcccataagattttcaaatgaatatttaaagaaatttatatttaatcataagaaaaaatcgacttctcatgtgttcgtacttttaatttgtatggttttagcttatgcatttttgctcggactttttattttagggttagtggccagcttagctattgtgcatgcctatatcaacccaaatattgatttatcagtttttgttatattaactgttttgattgtcgcgataattataatgattgctagtttatatgctattaaacatacgactgcattgtttactaagaagcttttagaatataaatttaataaaaggtag

SEQ ID NO: 2266 - DNA, 474 bp, Staphylococcus epidermidis
gaggactcgaaaatgaattttgaaggtaaattagttggtaaggatttaaaaattgcgattgttgttagtagatttaatgattttattactacacgtttacttgaaggggctaaagatacacttattcgtcatgaagtagaagatacaaatattgatgtagcttatgtgcctggcgcattcgaaattccactcgttgcaaaaaaattagctcaaaaaggtgaatatgatgctgtgataacattaggatgtgtgattagaggcgcaacttcacattatgactatgtatgtaatgaagtagctaaaggtgtttctaaagcaaacgacatttcagatactccggtgatttttggagttctaacaactgaaagtattgaacaagcagttgaaagagctggtactaaagctggaaataaaggttcagaagcagcagttagtgcaatcgaaatggctaatctaattaagcaaatcaattaa

SEQ ID NO: 2267 - DNA, 498 bp, Staphylococcus epidermidis
cgcaatacgaaaactacgtcgttatttaaattcatctacaaaggattgacatctatgaaatgtatatcaacgcattcacttttatatattcaaactgcgttttcaacaaatgttgaaacctatattcagtatgaacattacgctattcatttaccatgtacacctgaaaaaacattacattatttattggaattacatcaaaaatcctatcataatcaatgtatgttatctaaaaatattttaaacattaaaaaattcatacctatctatattaatgaggaaaccatattatttccagttacgcaaaaacgtgcaccgattaaatattttatcaatgcacgaaatattataggaattcattcttcaattcataccacaatgattgtttttgaagatggtacgactatcgaactgaacatcccctatacacttgtaacaaaaaaatggcagagaaatcttaccgtaggtcatatcataaaaaaaactaccttttattaa

SEQ ID NO: 2268 - DNA, 2508 bp, Staphylococcus epidermidis
ctgttagcgaataagggtggtaacgcggcacaggtcgtccctttcaaatcattaatagtagagatgtctttttatgaattaggaggaaatgtgttgaattataatcataaggaaattgaaaaaaagtggcagaattactgggaagaaaataagacctttaaaacgaatgataatttaggacaaaagaaattttatgcattagacatgtttccttatccatctggtgctggtttacacgtaggtcatccagaaggatatacggcaacggatatcatctcacgatataaaagaatgcaaggttacaatgtattacatcctatggggtgggatgcttttggtttgccggcagaacaatatgctttagatactggtaatgatcctcgtgaatttacacagaaaaatattcaaactttcaaaagacaaattcaagaattaggatttagttatgattgggatagagaagtgaatactacagatcctgaatattataaatggacgcagtggatatttattcagttgtataataaagggttagcttatgttgatgaagttgctgtcaattggtgtcctgcattaggtactgttttgtcgaatgaagaggttgtcgatggggtatcagaacgtggcggtcatcctgtttatcgtaagcctatgaaacaatgggtactcaaaattacagaatatgctgatagattactagaagatttagatgagttagattggcctgaatcaattaaagacatgcaacgaaactggattggacgttcagaaggtgccaaagtaacatttaaaattgagcaatctgaccaaaatattgaagtgtttacgacacgaccagatacaatctatggtacttctttcttagttttaagcccagaacacccacttgtgaatgaaattacgacaagtgataaagaacaagaagtcaaattgtatcaaaatgaagcatcaaaaaaatctgatttagaacgtacggacttagctaaagaaaaaacaggtgtgtttactggaacatttgcaattaatccgctctctggcgataaattacctatttggatagcagattatgttttatcaacttacggtactggtgcagtaatggctgtgcctggacatgatgagcgagatcatgaatttgctacgaagtttaatttaccaattatcgaagttatagagggtggcgaagttcaaaaatatgcatacacaggtgaaggaaaacacattaattctagagaattagacggtctagaaaatgaagcggcaataagtaaagcgatagaattgcttgaatctaaaggtgctggtgagaaaaaagtcaattataaattacgtgattggttatttagtaggcaacgttattggggagaaccaattcctattatacattgggaagatggatcaatgactacagttcctgaagatgaattgcctttactacttcctgaaacagatgaaattaagccatcaggtaccggtgaatctccacttgcaaatatagatgcgttcgtaaacgttatcgatgaaaagacaggtatgaaggggcgccgagaaaccaatacaatgcctcaatgggctggcagttgctggtactatttacgttacattgatccacataacgaaaaaatgatagcagatcctgaaaaattaaagcattggctacctgttgatttatatattggaggcgtggaacatgcagtacttcacttattatatgcaagattctggcataaagtgttatatgacttaggtgttgtaccaacaaaagaaccattccaaaaactatacaatcagggaatgattttaggcgaaggcaatgaaaaaatgagtaagtctaaaggtaatgtgattaatccagatgatattgttgcatcacatggtgctgatacattacgactatatgaaatgtttatgggacctttagatgctgcgatcgcatggagtgaaaaaggtttagatggttctagaagattcttagatcgtgtttggagacttatcattactgatgaaaattcaatcaataaaaaaattgtagattctaacaatcattcacttgataaggtttacaatcaaactgtgaaaaaagtaacagaagattttgatacacttagttttaatactgcaatcagtcaattaatggtgtttattaatgagtgttataaaaccaatgaagtttacaaaccttatatcgaagggtttgtaaaaatgttatcgcctattgcaccacacattggtgaagaattatgggatcgattagggcatgaaaataccattacttatcaaccatggccaacatttgatgaaagtttattagtagatgatgaagttgaaatcgtagttcaagtcaatggtaaagttagagcaaaaatcaatattccaaaagatttatctaaagaagaaatgcaagacttagccttgtctaatgataatgttaaaatgagtattgaaggaaaagaagttaaaaaagttattgctgtacctcaaaagctagttaatatagttgctaaataa

SEQ ID NO: 2269 - DNA, 3534 bp, Staphylococcus epidermidis
ataattaagaaaggtagtgtaattatgagctggtttgataaattatttggcgatgacaacggttcgaatgacgatttgttacgcaaaaataaaaatagacgtcagtctcagcaatcaaaacaaaataatcaagactcattactgcctcaaaataatgatatttatagtcgaccaagaggtaaatttagatttccaatacaagtttctgaaaatgaatatacgcaaaaaaatgaaaattataatgaacataaccaagaagaaacaaacgatataatgagatcatataaccagcatgataatcctgaatttgattcttctggtaaaagacatcgacgccgacgccaagcgtattcaaaacacgatcaatctaagattacacaacaaaagcaatttgcagataacaattatacaaataataacagtgtttttaatcaaaacgacaataagaaatcttcacaacaacgtaaatcaatacaatctgaaaatatcaaaaacaaagcaaacactaagaatacgtcgacatctcctgaatttacatatttaaatcatagttttaaatcaagcgaggtaccctcagcgatttttggtacaaaaaaacgaagaccgattgagaatggtgtcataccgccagaacataaggaattaaatgataaagagattgttcaacaggatgaagtctcgcattcaacgaaatcaatagatgcatcaaaaaatgtttctaatagtaacgataacaatattgaaaaaaatcaacagaaaaaacaacaaacaactgctcaaactgagtcatcatcagaaaatatgcataatgttgaaaagtcaaattatcaaactactaagcgtaaaacaccaaattactctaaagtagataatacgattaatattgaaaatatctatgcttcacaaattgtagaagaaatcagaagagaaagagaacgtaaagttctacagaaacgacgttttaagaaagccttacaacaaaaacgtcaacaaaatcaacagtcagaagaggattcaattcaaaaagctattgatgaaatgtatgctaagcaagcccaacattacacaggcgaaagttcattggatttagaaaatgaaagtaatcaagattcgtcatctaatagtctagagaaacaatcaaatagcagcaacattgacaataaagaagcccaaaataacacacctttatttaactacgaagaaattgacttagatacgacatcagatgtatataaagttaatgaagaagaaactgaatctaaaaatgatgaagatttagtatcatcaaatcattatcattctaatgatgatgcggaagtagaagatgccgaatatcacgaattagatgataaccgacaacaaaaccaaagtaactctcaagacgatataattagttcaaaatcaagtacttcaaatatgtatgataatgcaatcagtgcaagtgtagataataacactgaaagagctaaatcaaatgaagataaaaatgatacagaaattacacacttagatggaacaacaagtgcaaaagttagtgacgagaaaattgaatctaatacaaacaatcatttagaacaagataagaatgtaaaattaaaaaatgtaaattcattaaaatcttcaaattctgatacaggtcaaacaagaaaacaacgttttggtggtagtagaccgtttaatgttttaatgacaccatcagataaaaagagaatgatggatcaaaaccacaaaaaagtaagtgttccagagcttaaacctgaaaaacaagcgaatgcaaatcatagaaaagacagcgaatctaataaatctgaagaatttaaacaaatcaatactaatagagaaaccgattctaatagttatgaatctaatggcatagagcatgatatgaattcatcaagtgatgagcacgtatatgaaacaccatccaaacaacaggatgagcaaatacaaaagctacaagatgattttcattttgaaaacgcaaatcatgctaaaattaacaattcaaatgaaactggcaatcaaagtaatataagtcattcaaaacggtcacaatattcaacaaatgaaagtaaaaatattgatacacaaacttcaaattcaagtacatcaaatcaaaattttcaacgtattcgtaaaggaccgaatattaaattgccgagttatcaattattggaagccccagaaccacatgaaaaagatcaagattggatagataataaaaagcaagaattaaacgacgcattatattatttcaatgtgcctgcggaagtgaaaaatgtaacagaaggaccgagtgttactcgattcgaattatctgttgaaaaaggtgtcaaagtatcaagaatcacggcattacaagatgatataaaaatggctttagctgctaaagatattagaattgaagcaccaattccaggtacaagtttagtaggtattgaagtgccaaatcaaaatcctactaaagtgaatttaaggtcaattattgaatcacctaaatttaaaaatacagagtccaaacttacagttgcaatgggttatcgaattaataatgaacccttattaatggatatcgctaaaacgcctcatgcacttatcgctggtgctacagggtcaggcaaatcggtatgtatcaatagtatcttaatgtctttactttataaaaatcatccagaagaattgcgtttattactcattgatccgaaaatggtagaacttgcaccgtataacgatttaccacatcttgtatcacccgtaataacagatgtaaaagcagctacacaaagtttaaaatgggctgttgaagaaatggaaaaacgttataaattgtttgctcaatatcatgtcagaaatattactgctttcaataaaaaagcaccttatgagcaaagaatgcctaaaattgttatagtaattgatgagttagctgatcttatgatgatggcaccacaagatgtagaacaatcaattgcacgtatagctcaaaaagctcgagcttgtggtatccatatgttagttgctacacaacgaccatcagtgaatgtaatcactggtcttattaaagctaatatacctactagaattgcatttatggtttcatcgagtgttgattctagaacgattttagacagtggtggcgctgaaagattattaggttatggtgatatgctttatttaggtagcggtatgaataaacctatacgtgttcaaggtacatttgtttcagatgacgaaatagatgaagttgttgactttattaagcaacagcgtgatcctgaatatttatttgaagaaaaagaattattaaagaaaacacaaactcaagcacaagatgatttatttgatgatgtatgtgagtttatggttgaagagggacatatttctacttctcttatccaaagacatttccaaattggttataacagagcggcaagaattatcgatcagctagaacaattaggatatatttcaggtgctaatggttctaaaccaagggatgtttatattacagaagcggatttaagtaaagaataa

SEQ ID NO: 2270 - DNA, 831 bp, Staphylococcus epidermidis
aaaatgtggaagtgggaaacagaaaatgacgcaaaaggcgttgttgtcattgctcataatattttagaacatacaggtagatatgcatatgttatcacgatgttcagacgaaatggttatcacgttatcatgggcgatttaccgggacaagggcaaacttcacgagctcaaaagggacaaatagatgattttaatacgtatcatgaaaatatattagagtggataaaaatagctaatgaatataaaattccaacatttgttttaggtgtgggactaggtggtctcatcattttaaatctgcttgagaaaacagaattacctattgagggtatcttgttattttcacctatgttagaactaaagagagactataaagggtgcaaaaataaattgatttctaatgttggtaaaatttctaaagatactagatttaaagttggtataactcctcaagatttaacacgtaatgatgaaattattgaagaaacagcaaatgatggactaatgcttaaaaaggtaacatatagttggtataaccttataaatgaaaagatgaaagaaacaatggatcatatcagagatattaaacctatttcagcattgataatgtatggtaccaatgataaaattttagaaactcaatctattaatgaaatgaaagataaattaaagtcgaaagagatgtactttaaagtttgggatggattatatcatgaaatacataatgaacctgaacgcgatttggtgatgagatatgttctatcatttttgaataatagtgtaaatactatgggttttatagtaaatgaagaggaaattgaagacatttaa

SEQ ID NO: 2271 - DNA, 222 bp, Staphylococcus epidermidis
aacgatgacctaccattggtaattgtacggcactcaagatttgttccggtacaggagttggtccaggtgttaataataaaggttggtaatactgcattgtacattcctcccataataagatttatttattttagcaaaaattctgaatatttaaaacccttattatatagctatcacataattaaaacgtttacatgtttaaaatttgtgatagctatatga

SEQ ID NO: 2272 - DNA, 1665 bp, Staphylococcus epidermidis
gttatgagtgaaagtaaagaaatggttcgtggaacctttttaattacaataagtattttaattacaaaagtattaggtgtcttatttattattccgtttactgctttaataggtggacaagccaacatggcaccttttacttatgcttatgcaccatacaatatagctatagctatagcaacagctggtgttccgcttgccgcgtcaaaatatgttgctaaatataatgcactaggtgcatataaggtcagtcagaagttttataaatcaagttttgtagtcatgagtattacaggaattgtaggtttcctagttttatatttattagcaccatacatagctgaactaaccttatcacgtaatactcatggtaatagtggatggacagtagctgatatcacttggattattagaataataagtatggtagttatatttattccagttctcgcaacttggagaggaatatttcaaggatacaaatcgatgggacctactgcagtgtcagaagttacagagcaaattgcaagaattgtatttattttagtaggtagttatttaacgctcaatgtatttggaggtacagttcttcaggcaaatggtattgcaacgtttgcagctgcaataggtgcaatcgcaggaatacttacattatggtattactggattaaaagaagaaaaaatattaaaaaaatggtcgactcagatacagcgaatctaaatgtttcatacgggaaaatgtataaagaaattattgcttatagtataccgtttgtcatagtaagtttgaattttccactatttaatttggtcgatcagtttactcataatggtgcgcttaaccttgtaggtgtcaaacctggtttgcaagatatattctttaacatgttaaacatgtctacaaacaaaatagtaatgattccaacatcattaagtgctggatttgctgtcagtttaataccatttataactaaaacctatgaagaaggtagatatgcagagatgcatcgacaaattagaacttcgattggagttttaatgttcattactgttccagctagtattggtatcatggcattagcgcaacctttgttcacagtattctatggttttgatccagttgttcacggtcacgatccaaatttcgatggaagtagattattattttattatgctcctgttgcaattttaatttcattattaagtgttacagcatcaatgttacagggtatcgataaacaaaaactaacagtttttgttattttaggatctgttttaattaaactgattctcaattatcctttaattatgttattacacacacctggcgctgtattaagtacagcaatagctttattatttgcaatttgttgcaatttctatattcttaaaaaatatgcaaactttaaatttagttacagttggatacatttagctaagattattctaatttcaatcatcatgatgattggggttgaggtgattttcttcattttaagattattcttggaaccaactagatttaattacttgattattgttgcaattggtgtcattgtgggagcaatcatttatggtggtattacaatcaagactaaattagctgatgaatttttaggtgatattcccgctaaaataagacgtaaagtgaagatgttgcgatga

SEQ ID NO: 2273 - DNA, 258 bp, Staphylococcus epidermidis
atgaccttagatatgcccgcttcaatgattttatccacacaaggtggcgttgaaccatggtgtgtacaaggttctaatgaaacgtatatggtagcaccttgggtatttaaacctgccatttcaatagcctgtacttcggcatgtttatctcccttttttaaatgtgcacctaaacctacaatcctaccgtttttaacaacaacggatcctactggtggattaacacctgtttgtccatttaccatttttgctaattga

SEQ ID NO: 2274 - DNA, 1242 bp, Staphylococcus epidermidis
caaatgtcagaacaagaaaagaatcaacaccactatcgtaattcttcacagaagcgacacacttttccatggattaaaacaattattgttgcaataatcgctggaattattggagcacttctcgtcttaggtattggtaaactcctaaataaaactggttttaacaatgaaggtgctactgttcatcaagtttcaaatagtcatggtggcaatcagctagatggtaaaagtaatcaatacaaatcagtacatgacatgattaaagacgtttctcccgcaattgtcggcgtgataaacatgcaaaaatctacaaaccttgatgatttattcaacggtaaggcatctaaatcaaaagaagcgggaattggttccggtgtgatttatcaaataagtgatggttccgcatatatcgttacaaataatcacgttgttgatggtgcttcggaaattaaagttcaactacataattcaaaacaagtagatgccaaattaataggtaaagatgccctaacagatattgctgttctaaaaataaaagatacaaaaggaataaaagcaattcaatttgctaattcgtcaaaagttcaaacaggagatagtgtttttgcaatgggtaatcctctaggattagaatttgcaaattctgttacatcaggaattatttcagctagcgaacgtacaattgacgccaatacttctgctggtaatactaaagttaatgttttacagacagacgctgcaataaatcccggtaattcgggtggtgcattagtggatattaacggaaatctcgttggtatcaattccatgaaaattgcggcagcacaagtagaaggtataggttttgctatacctagtaatgaagttagagtgaccatcgaacaactcgttaaacatggtaaaatcgaacgcccttcaatcggtataggtcttataaatttaagtgatattcctgaaaactatcgtaaagaactacatactcataaagacaaaggcgtttatgtagctaaagtagacagtgaaaatgccattaaaaaaggtgatattattactggaatagatggtaaacaaataaaagatgatacagatttaagaacttatttatacgagagcaaaaaaccaggtgaaatggttactctaaaagttatcagagatggtaagacacaagacattaatgtaaaattaaaaaaacaagcatctgcatctgaatcatctcaatcacaaagtcaatttgctcaataa

SEQ ID NO: 2275 - DNA, 792 bp, Staphylococcus epidermidis
aaacacttggattttattaaggaaaagcgcatgccaatcgaatatgaaactcatttttttaatgaagtaacatatcttgtagattatttaaaagtcaaggctctgatgatgattccgaaaaataaaaaagatatcaaacgtatcgttatatacttaagaggtggtaaagggcaagttggaagagtgagagctgcaagacttatgcaatttgcaaatgaatatactttagttataggtccttactatagaggaaataatggaagtgaaggaagagatgaattttaccgcggtgatttaaatgatgtaacgcatttgattcgacttttaaatcaaaactatccttctgcatttatacatatggtaggattttcacgtggaggtctacaaggattacttacttttaatgatttgcctgtagatagttatatgatttggggtggcgtatctgatatacatttaatgtatgaagaacgagttgacttgagaggtatgctacgacgaatggttggacatccaaaaaaagatgcgaaagcttataaaagcagagatgcaatgcaatttataaaaaaagatagtcctcctattctcattattcatggtggcaaagatattcaagttggaatacatcaagcttatgatttagaaaaaaaattaaaatccaaaggaatttattatcaaacctattatcaattggatgaaggtcatgtaccacgacctcctgcgatgagagacgtaattcgatatatacatcaatggatgaacgacgtcgaaaataaaaatttaaatatatag

SEQ ID NO: 2276 - DNA, 1284 bp, Staphylococcus epidermidis
aaaggtatggaggttatcatcatgtatcaaacaattgttatcggaggtggcccaagtggggctatggctgcggttgctgcaagtgaaaaaaataaatcagttttattaatcgaaaagaaaaaaggtcttggacggaaactaaaaatctcaggtggtggtcgttgcaacgtaactaatagacttccatatgatgaaatcataaaaaatattccgggtaatggtaaattcctatatagccctttttcagtttttgataatctttctattataaatttttttgaaacccgtggagtcaaacttaaagaagaagatcatggtagaatgtttccagtttcaaataaatctcaagatgttgttgatgtgcttattaaccaactcaaagaaaatcatgttgaggttaaggaagaaacaccagttgtcagtgtttcgtatgaccataattttaaagttaaaacacaaataggtgaatttgaaagtcacagtttaattattgctacaggcggtacatcagttcctcaaaccggttctactggagatggttacaaatttgcaaaatctctaggtcattctataacagaattattccctactgaagtgcctatcacttcatcagaaacttttatcaaatcaaatcgcttaaaagggttaagtttaaaagatgttaatttatcggtcttaaagaaaaatggtaaaaaaagagtaagtcatcaaatggatatgatattcacacattttggaattagtggtcctgctgctcttagatgtagtcagtttgtttataaagagcagaaaaatcaaaaaaagaaaaatatccatatgcaattagatgtttttcctgaactaaacgtagatcaactatctcaaaaagtgagaaaaatacttaatgcagaaccagataaatatattaaaaatagcttgcgaggattaatagaagagcggtatttattgtttattctcgaacaatctggtattaatgatgaaatgactgcacatcatttatcaaatcaacagtttcaaacttttattaatcttctaaagacttttacctttacagtagatggcacacttccattagacaaagcttttgtgacaggcggcggtatttctttaaaagaaatagaaccaaaaactatgatgtctaaattagtgccaggattatttttatgtggcgaagtcctagatattcatggatacactggaggttataatataacaagcgcattagttacgggtcatgttgctggaatgtttgctggtgaatttaaaatagatcaaaacaaataa

SEQ ID NO: 2277 - DNA, 1494 bp, Staphylococcus epidermidis
gctcaactactgatatttaataagcaagtaggtataattatacgtgtatataatttggaggaatgcattgtgaatttttggttacaggaacaagctcaatcaaatggaaatcgattagcgattgttacaaatcagttatctttaacgtacgaagaattatatcatcgtgcaaaaacaatcgcggaatatttaacttctttaaatcagaaaaggattggtttatatataagcaatgatattgattcagttgttttgattcatgcttgttggttagctcatattgaaatagctatgataaatacacgtttaacgcgacatgagatgataaatcaaatgaattcagtcgacatagcaacgattgtacacacgttgcctttagaattagaagggtttaatttatatcattttaatgatttaacacaattagataaacatgatgtttcaggttacaaatttaatttagaatcgattgcatcaattatgtttacgtctggaacgacgggacctcaaaaagctgtgcctcaaacgtttaataatcatttagccagtgctaaaggctgtaaacaaagtttaggattcgaacaaaatactgtgtggctttcggtcttacctatatatcatatttctgggctcagtgttattttgcgcgcagtgatagaaggattcactgtcagacttgttaaaaagtttcaaactgatgatatgttaacacaaataaagacttatccaatcacccatatgtcccttgttccacaaacgttaaagtggttaatggatgcaggattgactcaaccattttctttagaaaaaattctgctaggtggtgctaaattatcaccacaattaattgagcaagcattgacttatcgtttacctgtatataattcttttggtatgacagaaacttgctctcagtttctaacagcctcacctcaaatgctcaaagaacgtttcgatactgttggaaaaccaagtgaaaatgtcgaagtgaaaataaaaaatcccaacgcatatggacatggagagttattaattaaaggtgaaaatgtgatgaatggttatttatatcccaaatatttaaaagacacatttgataatgatgggtattttcaaactggagatatagctgaaatagatgatgaaggttacgtcataatatatgatcggcgcaaagatttgattataagtggtggagagaatatttatccttaccaaattgaaacaatcgcaaaagactttgaaggcattgaagatgccgtatgtgtaggaatatcagatgatacttggggtcaagtaccaatattatattatgtgacaaatcaagatattaatcaaactgaattaatagaacattttgagaatcatttagctagatataaaattcctaaaaaatattatcaggtcaaatctttaccttatacatcgacaggtaaattacaacgtaaaaaggtcaaaagtgaagacttgaatgagggaaagaataatgaaagttaa

SEQ ID NO: 2278 - DNA, 372 bp, Staphylococcus epidermidis
cccattggttttagcaccattgacttccctttcagtatcactatttgtaatattagatttggcttcaattttcgctttttcaaccagctttctagcctctgctttttcttcatctgttgcatcgttgttaccattgatgattgtaacttgttgctcagcttttttatcaatagccgtttttgcatctgttttaattgttgttgctggtattatggtagcaatctcattcatgccgttatctttagcattatcaacttgattattagtttgcgcttgattgatatttgttatagttttatttttactaatctcaagaagtcgtttggcttcatctttttcttcattagttgcatctttgttattattaattaa

SEQ ID NO: 2279 - DNA, 1473 bp, Staphylococcus epidermidis
atgtataaacttttgcaacatttgggtaggtctctcatgttacctgtagcagttctgccagcagccgcaattattgtaggcataggtcatgttttagatgctttaaatatacttcctcaagctgcactctttttcacaagtgttgggaccactatattagagcaattaggtatattatttgctattggtgtagctatcggtatggctaagaagaatgatggcgcagtagcattagcggcagcgttaggattttttatagttacagtagtactatctccagaaaaattagcaactttgttacaaattaaagaatctaaaattgatttagcattcagtcaaatgaataatggaaatgtgtttgtagggattattataggtttgattgctgcatatagttataacaaatttagtgaaacgaatttacctatggccttatcattcttcagtgggaaacgacttgttccaatcatgacagcattcttttgtacaattttagcgattattttattattgatttggcctccagtttataatgggatagttacttttggtaagtggattgttggtatgggtccattcggtgcattattatatggtttttttaatagattgttaatacctactgggttgcatcatgcgctcaataatgtattttggtttgatactgctggaataaatgacataggtaaatttcaaagtggtaaaaatgccattaagggaattactggcagataccaagcaggatttttccctgttatgatgtttggtgtaccggcagcagctttggcgatgtatcatactgcaaagacgaatcaaaaaaaacaagtttatgcttggtttttagcaagttcagtttcggcattctttgtaggtgtaactgaacccatagagtttgcattcatgtttgtagctccagttttatttgttattcatgctgttttaactggattatcattatttatagcagcaatgtttcattggacagcaggattttcatttagtgcaggtcttatagattatgtgctttcattggttaatccgatatctaatcaaccttggatgttattattgcagggtgtagtcttttttattatctattacgttatctttagagttgtcatacaagtctttaatttaagtactataggtaggggagataatgaacttatcgatccaacatcaaatgatacttctgaaatggaagtattacagaacaaaaccactacaagtaaatattatcaaaacgcaaaacgtattttagacggattaggtggtaaagaaaacattattagtttaaatcattgtgcaacaaggcttagattggagcttaaagataattcgattatagatgagcagaaaattaaaaatgctggagctattggtataactcaaaatggacaccattatacccaagtgattattggaacacacgtacaacaagttgccaatgaaatggatcaccaaatgaattag

SEQ ID NO: 2280 - DNA, 276 bp, Staphylococcus epidermidis
atatttagttggaggcctttatcaatgttgaaaaaaatattattatctctagttgtattttatcaacgttttatttcgccacttacaccaccaacatgtcgattttatccaacatgttcacaatacactagagaagccatcgaataccatggtgcactaaagggactttatctcggtgtacgacgcatacttaaatgtcatccattgcataaaggtggctttgatcctgttccattaaaaaaagataaaaattctaaaaccacacatcatcattaa

SEQ ID NO: 2281 - DNA, 1620 bp, Staphylococcus epidermidis
ctcaatttatggaggttattagacatgagtcataagatattagtatcagacccaatttctgaggatggtttacaaagtattttaaaacatccagaatttgacgtagatatacaaacagatttatctgaaaatgatttagtaaatatgatttcaacttatgatgctcttatcgtacgaagtcaaacccaagtaacagagcgaattattaatgctgcaacaaatttgaaggtcattgcaagagctggtgtaggtgtggataatattaatatagaagcagcgactttaaaaggtattttagtaattaatgctcctgatggtaatacaatttctgctacagaacattcagtagctatgttgcttgcaatggcacgaaatattcctcaagcacaccaatctttacgtaacaaagaatggaatcgtaaagcatttagaggggttgaactttatggcaaaaccttaggtgttatcggtgctggtaggattggtttgggcgtcgctaaacgtgcgcagagtttcggtatgaaaattttagcgttcgatccttatttaacagaagataaagcgaagtcattagatattcaaattgcaactgttgatgaaattgccgaaaaatccgactttgtaacagttcacacaccattaacacctaaaactcgaggaattgttggttcatctttctttaacaaagctaaacaaaacttacaaatcataaatgttgccagagggggtattatagatgaaactgcacttattgaagcattagataataacttaatagatcgtgcagctattgacgtatttgaacatgaacctcctactgattcccctctcattcaacatgataaaattattgtcacaccacatcttggcgcctctactgtagaagcgcaagagaaggttgcagtctctgtatctgaagaaataattgaaattctaactaaagggaatgttgagcatgctgtgaatgctccaaaaatggatttaagcaaagttgataaaacaactcaaagctttataggtttaagtacaactattggtgagtttgctattcagcttctcgatggtgctccgagtgaaattaaagttaaatatgctggtgacttagcgcaaaatgacactagtttaattacaagaacaattataacgaacatcttgaaagaagatttaggtaatgaagtcaatattattaatgcattagcaatacttaaccaacaaggtgtcacgtataatatagaaaaacaaaagaaacattctggctttagtagttacattgagctagaactagttaatgatcaagataaaatcaaaattggcgcaacggtattcgcaggttttggcccaagaatagtacgtattaatgattactcacttgattttaaacctaaccaatatcaattagtaacatgtcataaagataaacctggtatagtaggacaaacaggcaacctattgggaagtcacggaattaatattgcgtcaatgactttaggacgtaacgatgctggtggagatgctttaatgattctttctattgatcaacaagcaagtgaggaagttataaaaattttaaatgaaacaagcggattcaacaaaattattagcactaagttaacaatttga

SEQ ID NO: 2282 - DNA, 1188 bp, Staphylococcus epidermidis
atcttattatgggaggaatgtacaatgcagtattaccaacctttattattaacacctggaccaactcctgtaccggaacaaatcttgagtgccgtacaattaccaatggtaggtcatcgttctactgactttgaggaaattgctagtgaagcatttaaaggtttaaagccagtatttggtagcaaaaacgaagtacttattcttacatctagtggcactagcgtattagaagcaagtatgcttaacatcgcgaatcctgacgatcatattgtgataattgtttctggtgcatttggaaatcgctttaaacaaatcgcacaaacttattataatcatgtacatgtatatgatgttaactggggtgaagctgtaatagttgatgactttatcacttatttaaagcaattaaacgttccagtcactgcagtattcactcaattttgtgaaacatctactggtgtcatacatccagttcaccaattaggtcatgcacttaaagcttttgataattccttatattttattgttgatggtgtaagctgtatcggtgcagtggatgttgatttaacaaaagataaaatcgatgtattagtttcgggaagtcaaaaagctatcatgctaccaccaggtctagcatttgttgcttatagcgatagagcaaaaaaacgatttgctgatgtaaaaacaccgagattctatttagatttaaataaatacataaaatcacaagagcaaaattcaacgcccttcacccctaatgttggtctatttagaggaataaatgcttatgtagaacttgtaaaaaaagaaggattaaatcacgttatttcacgccattttaaaatacgtaatgccttaagagcagcactaaaggcacttgaattagaattattagtaaaagatgatgctcatgcctcacctactgtgacctcatttgttccaaaaaatcaagaagaacttaatatcattaaaaatcaacttaaatctcaattcaatataactattgctgggggacaaggacacttaaaaggacaaattttgagaattggtcacatggggaaaatatctccttttgatattttagcagtcgtgtctgcattggaaattattttaacttctaatagaaatgtcaattatattggaacagggataactcaatttatggaggttattagacatgagtcataa

SEQ ID NO: 2283 - DNA, 969 bp, Staphylococcus epidermidis
aaaggaaaatgtattatgggtaactatttcccgtatgcctttgaagataaacgctatcacacatggaactatcatttaaaaaacaagtttggtcagaaaatatttaaggtcgcattagacggaggttttgattgcccaaatagagatggtactgtagctcatggaggttgcacattttgttctgcagcaggaagcggtgactttgcaggtaatagagctgaaccaattgaagttcaattcaaaaaaataaaagaacgtatgcatgaaaaatggagtgaaggtcaatatattgcatactttcaggcgtttacaaatacgcatgcacctgttgaagtactaaaagaaaaatatgaacctgtcttaaaagaagatggcgtcgttggtttatcaatcgcgacaagacctgattgtttgcctgatgatgttgtagaatatttagctgaacttaatcagcgcacttacttatgggtagagttgggcctacaaactgtgcatcagtcaacttccgatttaataaatcgtgctcatgatatgcaaacatactatgacggcgtaacaaaattacgcaaacataatataaatgtttgtacgcacataatcaacggcttaccaggtgaaaattatgacatgatgatggagactgctaaagaagtcgctcagatggacgttcaaggtattaaaattcatttattacacttgctaaaaggaacgcctatggttaaacaatatgaaaaaggtatgctcgagtttatgagtcaacaagattataccaatcttgtttgtgatcaacttgaagtattacccccagaaatgattgtgcacagaatcactggagatggacctatagatctaatggttggaccaatgtggagtgttaataaatgggaagtattaaatgaaattgataatgagcttgctagacgaaactcctatcaaggtaaaatgaacaagcagagtatacaatcatga

SEQ ID NO: 2284 - DNA, 201 bp, Staphylococcus epidermidis
ggaatatttcgtgccattgcaagcaacatagctactgaatgttctgtagcagaaattgtattaccatcaggagcattaattactaaaataccttttaaagtcgctgcttctatattaatattatccacacctacaccagctcttgcaatgaccttcaaatttgttgcagcattaataattcgctctgttacttgggtttga

SEQ ID NO: 2285 - DNA, 225 bp, Staphylococcus epidermidis
attggtatgctgctttacaattacgttcctcaaaacaaatggtctcagtggtttaaaacttatggcgttgaagaaagtgtcaatttgaataaacgtatgaaatggtacacagttattcaagcaataggtcttattcaatggtatgaagaacaaaaacgctatagagatatgaatacatggctgaaatttttaaatgaagtaatgaatagtaacttatttatataa

SEQ ID NO: 2286 - DNA, 330 bp, Staphylococcus epidermidis
tgtttatctaggaggcagtttatggctcggtcaaaaaagtacttttatcttagtctattaatgataattttaagttttttctttaataccaataattcattattgagtaatatatttcaatcgtttatgaaaattgttgtagttacaagtatcgttaatattataatacttattttatcgattgtttttgccgataaatctataaagtatgctaaggaaagttcagattggattagatttgcaagcaaaatattaccattgattattttaatcactattattatccatattctttcatctttacatacttttggttacatttttaaataa

SEQ ID NO: 2287 - DNA, 420 bp, Staphylococcus epidermidis
aaaacttatagtcgtaaagcaaatgaaattatcttggctacacgggtcgaaaatttattatcaaaagatgaaatcatatatacgtatttaaatatcgtcccatttggtcatgactacaacggtgccaatataactggtatatcgtctgcttcatatagtctgtttggtatacctgcaaaagatttgaacattgcacaatcagcttatctcattggcttactgcaaagtccatacggctatacgccttatgacgaacacggcaaagtaaagccttaccatcttttaaaattgagcatgaaacgtcaacaatacgtacttaaacgtatgcgtgttgaaggaaaaatttctaaacaacaatacgaaaacgctaaaaaatacaatattaaacagcacttgctgaaacaatcgaaagacgaataa

SEQ ID NO: 2288 - DNA, 1341 bp, Staphylococcus epidermidis
caaagcatcagagatgattctaaagccactgctgatgcacctgtgggaccaggaccgagagaagctcttgattacatgtacaatttaggtaaaagagatggtttttcaacgcatgacgttgatcatatagctggtagaattgaagctggtaaaggagaagatgtattaggtattttatgtcatgtcgatgtagtacccgcaggcgatgggtgggattcaaacccattccaaccagtagtgacagacaatgcaattatagccagagggacactggatgataaaggacccaccattgctgcctattatgcagttaaaattttaaatgagatgaaggtagattggaaaaaacgtatacacattattatcggaactgatgaagaatcagattggaaatgtacagacagatatttcaaaacagaagaaatgcctaccttaggttttgctccagatgcagaattcccagcaatacatggtgaaaaaggtataacaacctttgatttagtacaaaatgaagtgacagaagatacagatgaacctgactatgagttattaaaatttgaatctggtcaaagatacaatatggttcctgattatgctaaggcagaagtgctcgtcaaagaaaatatgacagatgtcattcaaaactttgaaaactttttacaacaaaatcaactacaaggtgaaagtacagttgacagtggtattttaatattaacaattgagggtaaagcagttcatggcatggatccatctttaggtgttaatgcaggattgtttttacttaaatttttagcaagtcttaatctaaataaaagcgcaaaagatttcgtagaattcaatgagcgatacttatttgaatctcactttggtgaaaaaatgggtatgaagttccatactgatattatgggagatgtcactactaatatcggggttatcagttatgataaagaaaaagcaggcagttatggtattaatctaagatatcccgaaggatttaaatttgaagacgcaatcgatagatttagaagtgaaattaatgaactaggttttaatttagaacttggcaaagttcaaaaaccacactatgtcgataaaaatgatccatttgtaaaaacacttgtaaacgcatatagaaatcaaacaggtgatatgactgaaccatatacgattggtggaggaacatatgcgagaaatttagataagggtgtcgcatttggtgcgatgtttgcagattcagaagatttaatgcatcaaaaaaatgagtatataactaaaaagcaattgatcaatgcaacaagtatttatttagaagctatttacgctttatgtgtggaggattaa

SEQ ID NO: 2289 - DNA, 630 bp, Staphylococcus epidermidis
  unsure (616): Identity of nucleotide at the above locations are unknown.
aatatatggctcacgaaaaactatttcttgagccattttctagttgaaagtgaggtgaacgtgttggagcagttttatcagttagggtggacacttgattcggcaggaggagcttctggtgaagcatatatggctgaacaagatggacaaaaattatttttaaaacgaaattcaaatccttttattgctgcgctatctgcagaaggaattgtacctaaacttgtttggacgaaacgtattgaaacaggtgaagtagtaacagctcagcattggaaaaatggcagagaattaaatgaagatgaaatgaaccaaacaagagtcgctgaactactacataaaattcacggttcaagacctttattaactatgctaaagcgtatggagatggaacctattacgcctgacattatgttgaataaaattaacgcatcactttcaagagaagttttgacacatcatgttgtgagaagagctttaacttaccttgaagatcatttaccgaatttagaaccccgtttctttactgttgtacatggaagagttaaacataacaactggttattatcagaatcggatgaactttaccttgtggattggggaaggtgcatgattgccnaaccagcgaattga

SEQ ID NO: 2290 - DNA, 216 bp, Staphylococcus epidermidis
gttttaaaaagtgaaaggcttaatgcgccgatactacccattaaaaaagcacctaataaatttgcaacaaatgtccccaacggaatggttgaaccttcattaagcattgataaacagaatcttatcaatgcacctaaagcaccacctacaaaaatatatagatattgcatctatatttcacctcaaaatataaaagagttgattattattatttaa

SEQ ID NO: 2291 - DNA, 1017 bp, Staphylococcus epidermidis
atgagggaaagaataatgaaagttaaggcaatcaatctatatacttataaggaaccttttaaatcaccaatttcaacaccgaaagtgaagttaacgcatcgagaaagtttgtttacggaaatagtaacttatagtggagaaacttattatggagaatgtaatgcatttttaactaattggtatgataaagaaacaatactcacagtcgtaaacagattaagacagtggataccgcaagtacttcataaagatatgacatcttttgattcatggttaccttacctaaatcaaatgaatgatgtgccagctgctagatcaatggttgtcatggctgtttatcaaatgtataacgacttgcatgattttgaagtacaatacggtgctacagttagtggcttaactaatagtcaaattgaaacattattagaaacaagaccgaaacgtataaaacttaaatggtcaacatcactcatcaaagatcttgaaactatacgtttattaaattttgattgtgatattgctatagatgcaaatgaatcattaacaaagccatcatttttacaattagccaacgtaaatacatcagatattatatatattgaagaaccttttaaaattctagaagatttaaatgatattgatatgtctatttttcctagaattgccatcgatgaaaaggcactttctatagaaaaaatacaatcaataattcagcaatatcccatacaagtcgtcgtgttaaaaccatttagacttgggggaatagatagaatgttaaacgccatgaaaattttgaaagaaaaaaatataaggtttgtagttgggggcatgtatgagtttggtctaagtagatattttacagcaatgttagctaaagaaggaagttatccgggtgatattacgccacacggttattatttttctaacgatatcgtagagacaagtggcatattaaaagggggaatgatttatttcactccccctaaagtcaaacgttctttacttaacaaagtttaa

SEQ ID NO: 2292 - DNA, 654 bp, Staphylococcus epidermidis
ttaatgatgagagttcgttacaaaccgtgggccgaagattatttaaagaaccatcctgatttagtagacatggatggtgctcacgcaggtaaaatgtctgagtggttcgaaaaagaacaaccgatttatattgaaattggttcaggaatgggacaatttataacaacattagcagcacaatatccagagattaattttgtatcaatggaacgtgaaaaaagtgtgatgtacaaagttcttgataaaacaaaagaaatgggtcttaaaaatttaaaaatgatttgtaatgatgctattgagcttaatgagtatttcaaagataaagaaatatctagaatttacttaaatttttcagatccttggcctaaaaagcgccatgcaaaaagacgtttgacgtatcatacataccttgcattatataaacaaatacttaaagatgacggtgaaattcattttaaaactgataatcgtggtttgttcgcatttagtatagaaagtatgtcgcaatttggaatgtactttactaaaatgaatttaaatttacacgatgaagatgatgaagataatatagtgacagaatatgagaagaaattctctgaaaagggatctcgtatttatcgaatggaagctaaatttcataaatgtttcgaatag

SEQ ID NO: 2293 - DNA, 483 bp, Staphylococcus epidermidis
gaggaagtgaggaacgtggagtttgaggataaagatggaaggattgtaacattgaactataaaaatgaaaatgatatgcctaatggcaatcacgttcttgcaattccggtatacaataatcagttattatttacaaaccatcaacatcgtgggatagagtttcctggtggtaaagttgaaataagcgaacaaagtaaagaagcagtaattagagaactatacgaagagacgggggcaatcgcaaaatttatctattattttgcacagtatagtataaaaatggagcatgatgagccgtttataaaggacgtttacttcgttgaagtaagtcatttggaatatgtagatacctattacgagactttaggcccttgtctttatcatcaaattaatgatattcctttaaataaaagaagttttttaatcaatgataaggcgattcttcattgtttggaaagggtgaaaacacttggattttattaa

SEQ ID NO: 2294 - DNA, 462 bp, Staphylococcus epidermidis
ttaaattggaggtcaattcatatggttagacatgattttaaagttaaaactgaatggctaggtggacgcgaagaagtaggtaaacttcgaggagatattatcaatgaaaatatatccatcccctcttcactcggtggccaaggagaaggcacaaatccagatgaattactagtaagtgcagcatcatcttgttacatcatttcactcgctgcaacactagaaaagagtggttttactaatgtaaaaattaatcaacagtcaataggtacagcctcgtttgaaaataaaaaatttaaaatggaacgtattacacattatccctcaattaaagtaccctcttctcaaacagaaaagcttaaaagtattttagataaattattagtgattgcagataataattgtatgatatctaatgcaatacggaataatgtcattatttcaattgaacctaatttaatataa

SEQ ID NO: 2295 - DNA, 351 bp, Staphylococcus epidermidis
actaatgatatgaattatgtaagaggagaatttgtgatgaagtcagttaattttaaaaaaataactatattgtttttttctacagcttttttaatattaatcttttctctcatttttttgacgaagaaaaaactgtataacgccgaattattactaaatgaagtcaaaacttattttagagaagtaaaaggttcctatattgtgcaagaaccaatcgttttagaaaatataaatcataatcaaccaatataccaaggtggtatcacagtattaaaaaatgaccatcttattaattatgaattttatgcagatgctgtgtcaggacaaatcattgatataattgaactctga

SEQ ID NO: 2296 - DNA, 1329 bp, Staphylococcus epidermidis
gtaaggagtattgaaatgacacactatcattttgtcggaattaaaggctcaggcatgagttcattagcacaaatcatgcatgacctcggtcatgaagtacaaggttcagacatagaatcatacgtttttacagaagttgcattaagaaataaagggattaaaattttaccttttgatgcaaataatattacaaaagaaatggttgtcatccaaggtaatgcatttcctgataatcatgaagaaattgttagggcacatgaattaaagcttgatattataaaatatcatgactttcttggtcatgttataaatcaatatacatctgttgctgttacaggtgcacacggtaaaacgtctacaactggtttgttgtcacatgtgatgaatggagataaaaagacatcattcctaatcggtgatggtacaggtatgggactaccaggaagtgactattttgcttttgaggcttgtgaataccgtaggcacttcttaagttatcatccagattatgcaattatgactaatattgattttgaccatccagattattttaaaaatatcgatgatgtttatgatgcattccaacatatggcgttaaatgttaagaaaggaattattgcttggggtgatgatgaatatttacgtaaattagatgtagatattccggtttattattatggctttaaagaaacagatgacatctatgctaaaaatattcaaattactgaaaagggtacgcaatttgatgtatatattaaaggcgaattttatgatcaattcttatccccacaatatggaaatcacaacattctaaacgcacttgctgtaatagcaattagttatttagaaaacatgaatgtagaaaatattaaagaagcactgataacatttggtggtgtaaaacgtcgttttaatgaaacaaaagtatcaaatcaagtaatagtagacgattatgcacaccatccaagagaaattagtgctacaattgagacagcgcgaaaaaaatatccgcaaaaagatgttgttgccgtttttcaaccacatacgttctcaagaactcaagcatttttaaacgaatttgctgagagtttaagtaaggcagaccaagtatttttatgtgaaatattcggttcaataagagaaaatacgggagatttaactatagaagatttaatcaatcgtattgacggctcgacgcttatagatgaaaatagtattgatgtattagaaaaatttgataacgctgtaattttatttatgggcgctggtgacattcaaaagttactaaaagcttatttcgaaaaattaggcgtaaaaaatgatttttaa

SEQ ID NO: 2297 - DNA, 198 bp, Staphylococcus epidermidis
ttgtttttcattacgaagttttattctgttaatttagtaacattaaacattatcagttacagtttaaattctctttattcctattggaatgttagaatgagtgagttttgtagcttcatctatttcccttcaatctatagtttattattcggtgaaatatctcggaaaaagtatttaacaatttcggtactcatataa

SEQ ID NO: 2298 - DNA, 240 bp, Staphylococcus epidermidis
ttaggtttcatcactagtaaaaaagacatggactatataactaagaacatcaacagttttactaagagacttgcagaggctatcaatggtagacaaataaacgcactaaaaagcaacccatctagcaaaaagataacttggaactggggaggtactttctaccctaacgcacctaaaagtggtattagagttagaaggtcgctaggtatcaatggcgctattgttgaaagtggctcgtga

SEQ ID NO: 2299 - DNA, 636 bp, Staphylococcus epidermidis
gcaggtgacattatgtacaattttataagtaagattttagatgttattttagtgaaaatgtctaaatcattatatgttattggtaaggaaaatattcctaaagatagtaaatatgttgtaacttgtacgcatgaaagttataacgaagtaatcatgttaggaatggcattactacctaatcaaatccattatatggctaaaaaagaattatttaagaatcagtgggctggtaaatttttgaaatcactaaatgcatttccagttgatagagaaaatcctggtccaagtacattaaaaaaaccagtgaatttacttaaagaacataaaactataggtattttcccaactggtcatcgtacttcagtagagggagccccattaaaacgtggtgcagctactatagcaatgcttgggaaagcacctatcttaccagcagcttatgtgggtccaaaaaaaattcatggtttgattacaggtcaagcattaatcaaaattggtaaaccaattgagatggatgatattccaaaggatttgaagcggaacgagaaagttgatttcttaaccaaagaaatcgaaagacgcacaactcaattacaaaaagaacttaatgaaatttcatgtagtttaaagaaatag

SEQ ID NO: 2300 - DNA, 867 bp, Staphylococcus epidermidis
ggagtgttaataatgaatgtcttccaaatgagagataaattgaaagcgcgtttaaaacatttagacgtagaattcaagtttgatagagaagaagaaacgttacgtattgtaagaattgacaatcacaaaggtgtaacgattaaacttaacgctatcgtcgcaaaatatgaagaacaaaaagaaaaaattatagatgaaatttgttattatgtcgaggaagcaatcgctcagatgggtgatgaagtgattaataatgttgaggacatacaaattatgccggttataagagctacaagtttcgacaaagaaactaaggaaggtcatgcatttgtgttaacagaacatactgctgaaactaatatatattacgctcttgatctagggaaatcttatcggctaatagatgaaaatatgttacaaacgttaaatttaactgctcaacaagtgaaagaaatgtcactatttaatgttcgtaagttagagtgtcgctatagtacggatgaagttaaaggtaatattttttacttcatcaacacaaatgatggatatgatgcaagtcgtattttaaatacttcttttttaaatcatattcaacaccaatgtgaaggtgaaatgcttgttggtgtgccacatcaagatgtattaattcttgcagatattagaaataaaacaggttatgatgttatggctcatttgactatggaattctttactaaaggacttgttccgattacttctttatcatttggttatgataacggacatctagagccaatatttattttggggaaaaataataaacaaaaaagagatcctaacgttattcaacgtttagaagcgaacagaaaaaaattcaaaaaagattaa

SEQ ID NO: 2301 - DNA, 312 bp, Staphylococcus epidermidis
atggagtcaataacagtagatgaattaaagaaaaaaatattagattcaaatccagttaacattgtagatgttcgcacaaacgaagaaactgaaatgggtgttattcctggagcaaaaacaattcctatggatgaaattcctgataatttaaaagaattcaataaaaatgacacgtattatattgtgtgtgcagcggggtcacgcagtgctaaagtagtttcatatttagaagaacaaggtgttcatgctgtaaatgtcgaaggtggaatgaatgcatggggcgatgaaggtactgtaattgataatatttaa

SEQ ID NO: 2302 - DNA, 1695 bp, Staphylococcus epidermidis
ttatataaaatcaaggggctgaatattttggcacaattatcagatttagaaatagcaaacttatcaaaacttaaaccaataagtgaaattgcaagaaaagtagggattactgaggatgctttagaaccatacggccactataaagctaaaatagatattaatcagatacaagaacagaagaaaaaagggaaagtcgtattagtaactgctatgagcccaacaccagctggtgaaggaaaatccacagtaactgtaggtttagcagatgcatttaacaagttgaatcataatgttactgttgcattacgagaacctgccttaggaccaacttttggtattaaaggaagcgcaacaggtggtggttatgctcaagtacttcctatggaagatattaatttacattttaatggtgattttcatgcaattactactgcaaacaatgcactttccgcatttatcgacaaccacctacatcaaggaaatgaattgggaattgatcaacgaagaattgaatggaaacgtgttttagatatgaatgatcgtgcgttacgtcatgttaacgtaggattaggtggtacaactcacggagtacctagagaagatggttttaatataacagttgcgtcagagataatggctattttatgtctaagccgaaatatcaaagatttaaaagaaaaaataagtcgaattaccattggttatacacgtcatcataaacctataacagtttctgatttgaaagtagaaggtgcattaactttaatacttaaagatgcgattaaaccaaatttagttcaaacaattgagggaactccagctcttgttcacggaggcccttttgccaatattgctcatggttgtaactctatattagcaactgaaactgctagaaacttatctgatattgttgttacagaagcaggatttggttctgatttaggtgccgagaagtttatgaacattaaagctcgtgaagcaggtttcgatccatcagcagttgttgttgtagcaacgattcgtgctttgaaaatgcacggtggtgttgcaaaagaccaacttcaacatgagaacatagaggctgttgaagcgggacttgttaatcttgaaagacatgtgaataatattaaaaaatacggtgtcgaaccaatagtagctttaaatgcatttattcatgacacaccttctgaaacagcgtgtgtgaaacaatgggctaaagataatcaagtacgtattgctttaacagaagtatgggaaaaaggtggagaaggtggaattgaacttgctaaccaagtgttcgatgtaatgcagaaacctcaaaactttaagcatttatatgagttaaaacaaccactcgaagctaaaattgaaacgattgttaaagaaatttatggaggttcaaaagtaaatttcagtagtaaaacacaaaaacaattaaagcaatttaaagagaatggctgggatgaatatccgatttgtatggctaaaactcaatattcatttagtgatgatcagacattgttaggtgccccgaatgattttgaaataacaattagagaacttgaagccaaaacaggcgctggattcatcgttgcattaactggtgctataatgactatgcctggtttaccaaagaaaccagctgcactaaatatggatgttactgatgatgggaaagcaataggtcttttctaa

SEQ ID NO: 2303 - DNA, 360 bp, Staphylococcus epidermidis
attttcttgattactattttgctcgttatgttaggtggaggaataggtgctgtacttagagcccttatcacaaatatatgccaacgcttattcaatagtaaaattcctattgcaacatctatagtaaatattacaggtagcttaattatcgggtttatgatgggacacgcactcgatagccatcatatgtttcctttctttgttacaggtgttctcggaggtttaactactttttcaacattatcatctgaacttgttaatatgttaagccctcaatttaaaccaatacgttttgtagtttattccctattacaatttattttaggtttcattgcttgcttttatggatatcgcatctaa

SEQ ID NO: 2304 - DNA, 1284 bp, Staphylococcus epidermidis
tttaggaggattttatcaatggctaatgctttaatagaagatttaaaatggagagggttaatttatcaacaaacagatgaagagggtatcgaagaattattaaataaggaacaggtcactttatattgcggcgcagatcctacagctgatagtttacatattggtcacttgttaccttttttaacattaagacgcttccaagaacatgggcatcgtcctatcgtcttaattggtggaggtactggtatgataggagatccttctggaaagtctgaagagcgcgtgttacaaacagaatcacaagttgaagctaacgtcaaaggcctgtctaatcaaatgcatcgattatttgaatttggcagtgataaaggggcaaaattagttaataataaagattggcttggtcaaatttcgttgattagttttcttagagattatggtaaacatgttggcgttaactatatgctaggaaaagattctattcaaacacgtttagaacatggtatctcttatacagaatttacttatactattttacaagctattgattttggctatttaaatcgtgagttaaattgtaaaattcaagtaggcggatctgatcaatggggtaatattacaagtggtattgaattaatgcgacgaatgtatggacaaactgaggcatatggcctaacaatcccattagtaactaaatcagatgggaagaaatttggtaaatcagagtctggagctgtgtggttagatcctgaaaagacaagtccatatgaattttatcaattttggattaatcaatctgacgaagatgtaattaaattcttaaaatattttacttttttagaaaaagaagaaattaatcgattagaacaatcaaaaaatgaagcgcctcacttacgtgaagcacagaaagcactagcggaaaatgttacgaaatttattcatggtgaagcagctttaaaagacgctatacgtatttcaaaagcactgtttagtggagatttaaaatcattatctgctaaagaacttaaagaagggtttaaagacgtacctcaagtaacgttatctacaaaaacgacaaatatagttgaagcacttattgaaacaggtattgcttcatctaaacgccaagcacgtgaagatgtaaacaacggtgcaatatatattaatggtgaacgtcaacaatcagtcgattatgagttaagtagtaaagaccttattgaagatgaaattacaataattcgacgaggaaagaaaaaatatttcatggttaattaccaatcataa

SEQ ID NO: 2305 - DNA, 708 bp, Staphylococcus epidermidis
acctgctacttttcatcaaatagatacacaggaggacgttttatgcaacaagaaacgacatcatggtacaaacaagaatggtttatagttttatcacttttattcatttttccactaggtttatttctcatgtggaaatttagcaagtggccatctattgcaagaacaatcattactgttgcaatttcagttatcgtattagcaagcattacctattatggtaatctacaaatgattgtaccagcaacatcaaattcaaataacgaaactaaagaaactacagagaataatgtaaatgataaagacgagcgaaatcataaaactgcagtagaagaaacaaaaactaattatgactccaccaaagaaaatactaaagaacctggaaaagaaaatgaatctgcaacacgattggagaactctgcgcttgaaaaggcaaagtcatattatgatgattttcacatgtctaaactaggaatttatgatattttaacatctgaatatggagaaaaatttgataaagaagatgcacaatatgctatagatcatctagaggctgattatgaaaagaatgcacttgagaaagcaaaatcatatgccaaagatatgcatatgtctaatgactcaatttacgatcttttggtgtctaactacggtgaaaaatttacagaatcagaagcaaaatatgctattgagcatttggataattaa

SEQ ID NO: 2306 - DNA, 1284 bp, Staphylococcus epidermidis
caaatgcacttaaatgaggcttttacttatttaagtgcttttgttttaggaggaaagtttatggaacattataatcgtgataatttcgagaaaagccatacaagcgaagaattgtatcatcgcacatctcgttcacaatctaactcattgaagcgtaaggattttgtagttagtttcatagcaagtgcgatagtaggttctgctgttggattgtactataaaaataaaatatataaaaaaacggatgaattgaaagaaaaagaacaagatttacgtagtaaagttgaaaactatagacaacgagcggaagatacagtggtttctgttaaatctaaagttgagcaattaaaatatgattccaaagataatatccatgcagatgaattacaagctcaaaaagctgctattcaacgcgaaacagacttagcggatgaatcaccggaagcgcaagcaattcaagaagcaaaaaaagaaacaaaacaagtggatgatgtgagaccatcagcaacagaattagcagctcaacaaaatgctattcaacacgaaacagacttagcggatgaatcaccggaagcgcaggcaattcaagaagctaaaagtgaagttgattcaaacaataaaacatctacgacgcacatagatagtgagaaagaaccttctgctgaagaaattgcaattgctcaaacggcagttaaagaagaagcacgcaatcatgatttagcaaacctttctgcaagtggagaagatactaaaagtaagtcagaaactgaaacagaaaaattagctgcagcggcaaaagcaaaaaaagatagaataaataataataatgaagttgctagtaacacgaaaaatctaatgcaagaagaagctataaaagcttcaaataactctgatgttccaaatcttgtaactaatttaaatcaatctcaagcatcagatactaattcagttgcttatcgcttagcacaggcagcaaaagaaaaaagatctaagctcacaaatggctctaaagaaacacaacttacagaagcgttgttaaaagaaccatcaattgctaaagctcaaacaaaattgaagcgtatccctacacttattactgaatctaaaaaacattcaaataatccgcacagccaaaaaaattcgaatcagactaagaatataacagcaactaaagaggattccaaaggcaaacagcaacatacacctaaccaaaacaaacgtaataaacaacaaaaagtagaaaaaactagtagcaaaattgaaaaacgaacatttaatgattaa

SEQ ID NO: 2307 - DNA, 924 bp, Staphylococcus epidermidis
aggagcgttgttttaatggatttttcttcaccgacagtaattggcttaattgttgcaatacttgtggctgttttattctttatactcttcttaatagcgaaccatagtaagaagaaagtgaagaatcaaacagaagcacattataaagaaaaagaacaacatctaaaagaatctcatgaagaagctttagaaaaagagagagttgagaataaaaaagttgttacaaaacaaaaagaagattttgacgtgacagttagtaacaaaaatcgtgaaattgatgcgttgaaactattctcaaaaaatcatagtgaatatgttacagatatgcgattaattggtattcgtgagagactagtaaatgaaaagagaatacgccctgaagatatgcatattatggcaaatattttcttgcctagtaatgagttaactaatattgaacgtgtgagtcatcttgtacttacacgaactggcttatatataattgattctcaattattaaaaggccatgtttataatggtattagtggtgcgcaatttaaagaattacctacgatgtcacaagtttttgacacgctcgacttagattcatcacagccacagacattggtcttagatcaaaatgaagatcaacattcattatcttttgttaattattcagataagattaaacatattgaaaaattagcaggagatttacaaaatgaattgaataccaaatatacgcctacatcaatactgtattttaatcctaaaaaggataatgatgttacaatttctcattatacgcagtcatcaaatgttaaagttttagttggtcctgaacaattagatgaattcttcaacaagtttgttttccatggacgcatacagtacaatgtggatgatttacaagatatcatggttaaaatcgagtcattcaattaa

SEQ ID NO: 2308 - DNA, 708 bp, Staphylococcus epidermidis
agtgaagatgttgcgatgagattagataaatttctagctaatatgggtgttggaacgcgatcagaagttaaacagttactcaaaaaaggatctgttaaagtcaaccaaaatatagttaagttacctaaacttcatgttaatcctaattctgatgagataatggtaaatgatgaagtagttagttatatcgacaaagtgtatatcatgttaaacaaaccaaaaggttatatttcagcgacagaggatgaggtgcatcctactattattgatttgatacctgaatatgcacatttaaatatttttccggtcggacgtttggacaaagatacagaaggattactccttgttacaaatgatggacagtttaatcatgaagtaatgaatcccaataagcatgtttcaaagacttatgaagtctattcaaaacacccaataactcaattcgatattgataaatttaaatccggaatagaattatcagatggaaaattaaagcctgcaattttaaagaaagttgataattatgtatcacatgtcactatttacgaaggaaaatatcatcaagttaaaagaatgtttcatagtatcgaaaatgaggtattagaattgaaacgcataaagattgctcaactagaactagatcataatttagatttgggtagttaccgtttgttaacacaaatagattttgataatcttaagaactaa

SEQ ID NO: 2309 - DNA, 189 bp, Staphylococcus epidermidis
ttcctatgtgtttattatcatttcgtagatgtcgatatcaaaattttaaccattttactaaaaggtatgttttttattttggcagaaatctgtaatagtctgtttaaaacattttgtatatgtttcatatcttttatagcaattgaaatgattttattagctgattttgtcatagtacttcttaaatga

SEQ ID NO: 2310 - DNA, 411 bp, Staphylococcus epidermidis
agattatttttctgcacgtcacttgctaaaagaaagtattattcatttaacaagtggacaaattcaacaattacaatatggaaaggaattttgatatttatgattaaacttgaatcagaacaacaatttgaagaattaaaaaaagggtatacagtatttgaattcactgctggatggtgtccagattgtaaagtaattgaaccggatttacctaaattagagaaaaaatacagtcaattacaatttgtgtctgtagatagagatcaatttatagatatttgtgttcaaaatgatattttaggcattcctagttttcttatctttaaagaaggtcaacttttaggaagctatataggtaaagagagaaaatcaattgatcaaattgatcaatttttatctcaacacatttaa

SEQ ID NO: 2311 - DNA, 567 bp, Staphylococcus epidermidis
atgaacttattttacaatcctaaaggtgttggagatgttgcatttattcaaattgaaccttcagttggtccttttgaatatgaacaaaaacatggtgtggtagaaatcaaaaaagaaaatgaggtagtaggttataatatatttaatgtgtctaataatgtgacaataaatgataatggacatattaaactaactactgaattaatcaaagatttacaacaactgattactgaagcaggttttgattatcaacttgatactgatgtatcgcctaaatttgtagttggttacgtaaaaactaaagaaaaacaccctaatgcagacaaactaagtgtgttgaatgtaaatgtcggtactgaaaaacttcaaattgtttgtggggctccaaatgtaaaatctggtcaaaaggtcgttgttgcaaaagttggggccgttatgccaagcggaatggtaattaaagatgcccaattacgtggggtagattctagtggtatgatttgctcaatgaaagaattaaatttgcctaatgctcctaaagaaaaaggaattatgggtactaaccgatga

SEQ ID NO: 2312 - DNA, 1110 bp, Staphylococcus epidermidis
aaatactctttaagtgttcaaactctttatgtaaacgctttcttaaacttaattttcatgatacactatttaaaaatatcatactctagtataacggaggtattgcatatgtcattatttaaagattttttcattgcgttatctaatcatacatatcttaataaaatagctaaaaagatgggacctcaaatgggagcaaatcgtgtagtcgcaggaaatacgattcatcaattaattgagactatacaatatttaaatgattataatatttcagttactgtcgactcattgggtgaatttgttaatactagagaagaaagcattaaagctaaagaagagattttagaaattatcgatgcaatatataacaataatgtaaaggcacatatgtcagtcaagataagtcaacttggaagtgagtttgatttaaatcttgcttatgaaaacatgagagaaattttacttaaagctgataagaatgggaagatgcatattaatattgatacagagaagtacgatagtctttctaaaattcaacatattattgatagattgaaaggtgaatttaaaaatgtgggtacagtcgttcaagcctatctgtatgaagccgatgatataattgataaatatcctgaattacgtttgagacttgtgaaaggtgcttataaggaagatgcgtcaatcgcttttcaatcaaaaaaagaaattgacgcaaattatattagaattattaaaaaacgactactaaattcaaagaactttacatcggtggctacccatgacaatgaaataatcaaccaagtcaaacaatttatgaaagaaaatcatatcagcaaagataaaatggaatttcaaatgttgtacggtttccgcacggaattagcacaaaaaatagctaatgaaggttatttttttacagtttatgtaccatacggtaatgattggtttgcgtactttatgagaagactagcagaacggcctcaaaacttgtcattagctataaaagaatttactaaacccaaaatcttaaaaaaggcaaccttgggtataggtatatttgcaactttattgacgtctcttattcttggcattaaaagacataaaaaataa

SEQ ID NO: 2313 - DNA, 1053 bp, Staphylococcus epidermidis
ggtgatcaattgagtagatttatggatgatgctattcaattagcaaaaatggtaaatggacaaacaggtgttaatccaccagtaggatccgttgttgttaaaaacggtaggattgtaggtttaggtgcacatttaaaaaagggagataaacatgccgaagtacaggctattgaaatggcaggtttaaatacccaaggtgctaccatatacgtttcattagaaccttgtacacaccatggttcaacgccaccttgtgtggataaaatcattgaagcgggcatatctaaggtcatctatgctgttaaagatactactttagtaagtaagggtgacgagattctgagagaagctggtatagaggttgaatttcaatataatgaaaatgcagctgcattataccgtgacttttttactgctaaaagaaacgaagttccagaagtaactgtaaaggtctcatctagtttagatggtaaacaagcaacagactttaatgaaagtaagtggataacaaacaaagaagttaaagaagatgtttatcaattaagacatgagcatgatgcagttattactgggcgtagaaccattgaagcagacaatccattgtatacaaccagggttcctgatggaaagcatccgattcgagttattctttctaagaaaggtcaactcgattttaatcaacaaatatttaaagatactgcatcggagatatggatttacactgaaaatgaaaaattaaaaacaaataaaagttttattaaaataataaatataagtaattgtgatacaacgacaatattacaagacttatatcaaagaggtattgggaaactgctagtcgaggcaggcccaaatattacatctcaatttctccaatccaaacatctaaatgaactcattttatatatagccccgaaattaattggtggttctggcaaacatcaattttataagactgacgaggtcattgatttgcctgaagcaactcaatttgaaattgttgattccaagttaattaatcaaaatttaaaattgaaattacgaaagaagtga

SEQ ID NO: 2314 - DNA, 450 bp, Staphylococcus epidermidis
aattcacaattttttatttgggaaatgttaattttggctaatagtgaaaaaaacagggtttatggtattttacaattaaaaacattattcaaaaaaattgattcaatttttaatacaatcaaaaaaaaatatggaatgtctaaagaggaaattttgattttacttacacttttggaaaaaggctcaatgactttaaaggaaatggataaatatgttcatattaaaccgtataaacgtacacgtacttataataatttagttaatcttgagtggatttacaaagaaagacctcaagatgatgaacgtacagttattattcattttaatgacaagcaaaattctaaaaaagaagatttgttaaagtttattgatgactcaattaaaatcaagtctgaaccaatgcaatctattttacaatctattttagcagttgaatttaacgtgctttaa

SEQ ID NO: 2315 - DNA, 192 bp, Staphylococcus epidermidis
atgaattcttcaacaagtttgttttccatggacgcatacagtacaatgtggatgatttacaagatatcatggttaaaatcgagtcattcaattaaattattaaagaaatactttatttttcatatgagtgcttattatagtcttcaaaacaattactacaaattaattgttttgaaggcttttttgatttga

SEQ ID NO: 2316 - DNA, 915 bp, Staphylococcus epidermidis
attggccttcccgtggctgaaggacgattaagtattagaaattgcccgggaaagatttcaaacactagttatcaaacgttcataaaagatacgcaactctactcacttaaaaatgacgaagccattatattagtaagtctgcctttcaatgcgagttggcttaatcagcgatattcagaaattatgcaggctattatttatgatgtcatcggttatgaagtgaaaccacattttatttctgaagatgaacttgcatcctacaacaatgtaaatacacaagaagttcaagaaccccaagtacaacattcttctatagatgataagacttggggaaaagaacaatttaatatgcacaatacattcgatacatttgtcattggacctggtaaccgtttcccacatgctgcaagtttagctgttgcagaagcaccggcagaagcttataatccattatttatatatggaggcgtaggtctaggtaaaacacatttaatgcatgcaattgggcaccatgttcttagcaacaaacctaatgctaaagtcatttacacttctagtgagaaattcacaaacgaatttattaaatcaatacgtgataatgaaactgaagcatttcgtgaaaagtatcgtaaaattgatgttttattaattgatgatattcaattcattcaaaataaagaacaaacgcaagaagagttcttccatacttttaatgaattacatcaaaataataaacaaatcgttatttcaagtgatcgtccaccaaaagaaattgctaagctggaagaccgtctacgttctcgttttgagtggggactaatagttgatatcacaccacctgattacaaaacaagaatggcaatattacaaaagaaattgaagaagaaaatcttgatattccgccagaagctttga

SEQ ID NO: 2317 - DNA, 729 bp, Staphylococcus epidermidis
ttttattattttattggagagactggggctgataatatgactcaccttacgtttaaacaaggtgtgaaagagtgtattcccacgttacttggttatgctggtgtaggactatcgtttggaattgtggcagcctcccaaaatttcagtgttttagaaattattttattgtgtctgattatttatgctggtgcagcccaatttattatttgtacattagtgattgcaggcacccctatttctgcaattgtgcttacaacacttatcgttaactctcgaatgttcttattaagtatgactttagcacccaattataagcaatatggattttggaatagggtagggcttggaacgttattaacagatgaaacttttggagttgctataacgccatatgtcaaaggtgaaaaaattaacgatcgatggctacacggactaaatattactgcttacttattttggactgtttcatgtgtaatcggtgccattttcggagagtatatttcaaatcctgatgcgcttggcctagactttgccattaccgcaatgtttatttttttatgtatatctcaatttgaagggattaagaaatcacgattgagaatatatattgtactcattgtatgtgtgattgtgatgatgcttcttctaagttcaattctaccttcatacgtagcaattttaatagccgcaattgttgctgcattgttaggggtggtgatggaaaaatga

SEQ ID NO: 2318 - DNA, 1017 bp, Staphylococcus epidermidis
tcacaccatcaaatgaaacgaggtgtaacaatattgaattggcaacgtaaatgtatactaactactttattggttttaagtagtttatttttagtattttcgactatcacatatgcgagtgaacgtgattctaaagacagtcttaaaatcactacacataacgtgtatttcttacctactgctatctaccctaattggggacaatctcagcgcgctgatttaatttcaaaagcagattacattcaaaatcaagatgtcgtgattctaaatgaattatttgataaaaaagcttcaaatagattgttaacacgtctacattcacagtacccttatcaaacacctatcgttggtaaaggtacagaaggttggcaaaatacttctggtacttatagaaaaattaaaaaagtaagtggtggcgttggtattgtgagtaaatggcctatcgtacaacaagaacaacacatttataaaaaaggctgtggggctgatatggcaggtaataaaggctttgcctacattaaaattaataagaatggcaaataccaccatattatcggaacacatctacaagctgaagatccaacatgctttaaaggaaaagataaagacattagacagagtcaaatgaatgaaattaaacagtttatcaaagacaagaatatccctaaaaatgaacccgtctatatcgggggtgacttaaatgtcattaaagattcagatgaatatcaacaaatggcaaataacttaaatgtttcattacctactcaattcgatggtaatgcatatagttgggatactagcagtaatagtattgcgaaatataattatcctaaattagaacctcaacacttagattatattttattagatcgtgaccatgcacaaccaagctcatggcataatgatacacatagagtgaagtcaccagaatggtccgtaaaatcttggggaaaaacatacaaatacaatgattactcagatcattacccactctctggctatgcatcaaatgaatag

SEQ ID NO: 2319 - DNA, 1407 bp, Staphylococcus epidermidis
atagggtggcaacgcgtagaccacgtcccttgtctgggatgtggtctttttttattgttttatcacacgaagtcatccataaaattgaatatattttatttgggaaaggatgaaggttacatgttagacattcgtttatttagaaatgaacctgagaaagtgaagagcaaaattgaattaagaggcgacgatcctaaagttgtcgaccaagttttagaattagatgaacaacgccgtgaattaatcagtaaaactgaagagatgaaggcgaaaagaaataaagtgagcgaagaaatagctcaaaagaaacgtaataaagaagacgctgatgacgtcattgctgagatgcgtcatttaggtgatgaaattaaagatatcgataatcaacttaatgaagtagataataaaattagagatatcttaattcgtattcctaacttaattaatgaagatgtacctcaaggtgattctgacgaagaaaacgttgaagttaaaaaatggggtacgccacgtgattttgaatttgaacctaaagcgcactgggatttagttgaagaattaaaaatggctgactttgaacgtgctgctaaagtatctggtgctcgtttcgtatacttaactaaagatggcgcattacttgaacgtgctttaatgaactacatgttgacaaaacatacaacgcaacatggttatactgaaatgatgacacctcaattagtgaatgctgatacgatgtttggaacaggtcaattacctaaatttgaagaagatttatttaaagttgaaaaagaaggcttatatacgattccaactgcagaagtacctttaacaaacttctatagagatgaaattattcaaccaggtgtactacctgaattatttacagctcaaactgcatgtttccgtagtgaagcaggatcagctggtagagatactagagggttaattcgtttacatcaatttgataaagttgaaatggtacgtattgtacaacctgaagattcttggaatgctttagaagaaatgacacaaaatgctgaagctattcttgaagaattaggtttaccataccgtcgtgttatcttatgtactggcgatattggtttcagtgctagtaaaacatatgatttagaagtttggttaccaagttacaatgattataaagaaatcagttcttgctctaactgtactgatttccaagcacgtcgcgcaaatatcagattcaaacgtgatgctgcttctaaaccagaattagtacacacattaaatggtagtggtttagctgtaggtcgtacatttgcagccatcgttgaaaactatcaaaacgaagatggtacattaacaattcctgaagcattagttccatttatgggtggcaaaactaaaattgaaaaaccaatcaaataa

SEQ ID NO: 2320 - DNA, 2709 bp, Staphylococcus epidermidis
actgaacttttgaaggaggatctcttgatggctgaattacctcaatcaagaattaatgaacgaaatataaccagtgaaatgcgtgaatcattcttagactatgctatgagtgttatcgtttctcgtgcattacctgatgttagagacggattaaagccagtacatcgtcgtattctttatggtttaaatgaacaaggtatgacgcccgataaaccttataagaaatctgcacgtatagtcggggatgtcatgggtaaatatcaccctcatggtgattcttcaatttatgaagcaatggtaagaatggcccaagactttagttatcgttatccacttgtagatggtcaaggtaactttggctctatggatggtgacggtgcagctgcaatgcgttataccgaagcacgtatgactaaaataacattagaacttttacgtgatattaacaaagacacaattgattttattgacaactatgatggtaatgaaagagagccgtcagtcttacctgcacgtttccctaatttactagtaaatggtgcggcaggaattgccgtaggtatggctacaaatattcctccccacaatttaactgaagttattgatggtgtgctcagtttaagtaagaatccagacatcacaattaatgagctgatggaagacatacaaggtcctgattttcctacagctggtttagtactagggaaaagtggtattcgtcgagcttatgaaacaggtcgtgggtcaattcaaatgcgttctcgtgctgaaatagaagaacgtggtggtggccgtcaacgtattgtcgtaacggaaatacctttccaagtcaataaagcgcgtatgattgaaaaaatcgcagagttagttagagataagaaaatcgacggtattacagatttacgtgatgaaacaagtttgcgtacaggtgtaagagtagttattgatgtacgtaaagatgcaaatgcgagtgttattttaaataatttatataaacaaacgccattacaaacctcatttggtgtgaatatgattgctttagtgaatggtagacctaaactaatcaatttaaaagaagcacttattcattacttagaacaccaaaaaacagtggttagacgacgtactgaatataatcttaaaaaagcaagagaccgtgcacatattctagaaggtttacgaatagcactagatcatattgatgaaattatcacaacaattcgtgaatcggacactgataaaattgcgatggcaagtttacaagagcgttttaaactaactgaacgtcaagctcaagcaattttagatatgcgtttaagacgtttaactggattagaaagagataaaatagaatctgagtataatgaacttctagaatatattaaagagttagaagagattttagctgatgaagaagtactattacaattagttcgtgatgaattgactgaaattaaagagcgtttcggcgatgaacgtcgcactgaaattcaattaggtggtctagaagatcttgaagatgaagacttaatccctgaagaacaaattgttattacattaagtcataataactatattaaacgtttaccagtatctacatatcgttctcaaaatcgtggtggtcgtggcatacaaggtatgaacacgttggatgaggacttcgttagtcaattggtaacaatgagtacacatgatcatgttctgttctttacgaataaaggtcgtgtatataaactcaaaggttatgaagttcctgagttgtcacgtcaatccaaaggcatacctattattaatgcgattgaactcgaaaatgacgaaacaataagtacgatgattgcagttaaagaccttgaaagtgaagaagattatctcgtattcgcgacaaaacaaggtatcgttaaacgttcatcattaagtaacttctcccgtattaacaaaaacggtaaaattgcaattaactttaaagaagatgatgaattaattgcagtacgtctaacaacaggtaatgaagatattcttattggaactgcacatgcatcattaattagattttctgaatctacattacgcccattaggccgtacagcagcaggtgtgaaaggtatttctctacgtgaaggggatactgtcgttggtcttgatgttgcagattcagaaagtgaagatgaagtattagtagttactgaaaatggttacggtaaacgtacacctgttagcgaatatcgtttatcaaatcgtggtggtaaaggaatcaaaactgcgacaattaccgagcgtaatggtaacatcgtttgtatcacaactgtaaccggtgaagaggatttaatggttgtaactaacgctggtgttattattcgtcttgacgttcatgatatttctcaaaatggacgtgcagcacaaggtgtacgccttatgaaactcggagatggtcaatttgtttctactgttgctaaagtaaacgaagaagacgataatgaggaaaatgcagatgaagcgcaacaatctactactactgaaacagcagatgtagaagaggtagtggatgatcagacaccaggcaatgcgattcatacagaaggtgatgcagaaatggaatctgtagaatctcctgaaaatgatgatcgtattgatatcagacaagattttatggatagagtgaatgaagatatcgagagtgcttcagataatgaagaagatagtgatgaataa

SEQ ID NO: 2321 - DNA, 267 bp, Staphylococcus epidermidis
attcatagtaatagtagtaggcactgtggattggtggataagtctaaaaaacttacgaatagcacagttatacacatgtggataaactgtgtatgttgtgtattattttttcacattatccacaattgctattttttattcagagggacaactccccatctttttaagtgtttaggaattgatttacatagtaattattccctaaaagacagtttacaatctgctaattttcaatttattcaatatggatttatttcccattactga

SEQ ID NO: 2322 - DNA, 516 bp, Staphylococcus epidermidis
ttacaaaacaagaatggcaatattacaaaagaaattgaagaagaaaatcttgatattccgccagaagctttgaattacatcgccaaccaaatccaatcaaatattcgtgaacttgaaggcgcattaactcgacttttagcgtactccaaattacaaggaaaacctattacaaccgaactcactgcagaagcgttaaaagatatcattcagtcacctaagtctaaaaagattacaattcaagatatccaaaagatagttggtcaatattatagtgtaagaattgaagattttagtgccaaaaaacgtacaaagtcaattgcttacccacgacaaatagctatgtatctatctagagaattaactgatttttcattacctaagataggtgaagaatttggaggtcgcgatcatacaacagttatccatgcccatgaaaagattgcaaatgatatcaagtctgatcctacatttaagcaagaagtagaaaacttagaaaaagaaattagaaatcagtaa

SEQ ID NO: 2323 - DNA, 453 bp, Staphylococcus epidermidis
agacgcatgaaagtaattttcacacaagatgttaaaggtaaaggtaaaaaaggcgaagttaaagatgtaccagtaggttacgcaaataacttcttacttaaaaataaatatgctgtagaagcaactcctggtaacttaaaacaattagaacaacaaaataaacgtgccgaagcagatagacaacaagaaatcgatgatgcaaaagcacttaaagaacagttaaaagatatcgaagttgaagtatcagctaaaacaggtgaaggcggcaaactatttggttcaatcagtacgaaacaaattgccgaagcactaaaaaaacaacatgatattaaaatcgacaaacgtaaaatggacttaccgcatggtattcatgcactaggatatactaatgttccagtgaaattagacaaagaagtcgaaggtacaatccgtgtgcacactgtagaacaataa

SEQ ID NO: 2324 - DNA, 1947 bp, Staphylococcus epidermidis
agtaacgagaaagtgatggtgaatacattgtcagatgtaaacaacacagataattatggtgctggacagatacaagttttagaaggtctcgaagcggttcgtaaaagaccgggtatgtatattggttcaacttcagaaagagggttgcaccatttagtatgggaaattgttgataatagtattgacgaggcattagcaggttatgctagtcatattgaagttgtaattgagaaagacaattggattaaagttactgacaatggccgtggtattcctgttgatattcaagaaaagatgggacgccctgctgtcgaagttatcttaactgtacttcacgctggaggtaaattcggaggtggcggatacaaagtatctggcggtcttcacggtgttggatcttcagttgttaatgcactctcacaagatcttgaagtttatgtacatcgtaatggcacgatttatcatcaagcctataaacaaggtgtgccacaatttgatcttaaagaaattggcgatacagataaaacaggtacagctattcgattcaaagccgataaagaaatctttacagagacaacagtttataactatgaaacacttcaaaagcgtatacgtgagcttgctttcttaaataaaggtattcaaattactttaaaagatgaaagagaagaggaagttagagaagactcatatcattatgaaggcgggattaaatcctatgtagatttattaaatgagaataaagaacctcttcacgatgaacctatatatatccatcagtctaaagacgatattgaagtggaaattgcacttcaatataacagtggatatgcaaccaacttattaacgtatgcgaataatattcatacatacgagggtggtacgcatgaagatggctttaaacgtgctttaacacgcgttttaaatagctatggtacgcaaagtaagattattaaagaggataaagatagactttcaggtgaagatacacgagaaggtttaacagcagtcgtatcaattaaacatggcgatcctcagtttgaaggacaaacaaaaacaaaattaggaaactctgaagtacgtcaagttgttgatagattattttctgaacactttgaacgtttcttatatgagaatccatctgtaggacgcattattgttgaaaagggtattatggcttcacgcgcacgtgtggctgccaaaaaagcacgtgaagttacgcgtcgtaaatcagcattagacgtttcaagcttaccaggtaaattggcagattgttctagtaagaaccctgaagaaagtgaaattttcttggtagaaggtgactctgccggggggtctactaaatctggtcgtgattcaagaacacaagccattttacctttaagaggtaaaattttgaatgtggaaaaagcacgtttagatcgtatcttaaacaataacgaaattcgtcaaatgattactgcatttggtacgggtattggaggagaattcgatatatcaaaagcacgttatcataaaatcgtaatcatgactgatgccgatgttgatggtgcacatatacgtacgttattacttacattcttctatcgtttcatgagacctttaattgaagcgggctacgtttatattgctcagccgcctttatataaactaacacaaggaaaacaaaaatattatgtatttaacgatagagaactagacaagttgaaacaagaattaaacccgtcaccaaaatggtcaattgcacgttacaaaggtcttggtgaaatgaacgcagaccaattatgggaaacgactatgaatcctgaacatcgctctatgttgcaagtgagacttgaagatgcaattgatgcagaccaaacatttgaaatgttaatgggcgatgtagtagaaaatcgcagacaatttatcgaagacaatgcagtttatgccaacctagatttctag

SEQ ID NO: 2325 - DNA, 186 bp, Staphylococcus epidermidis
tgtagcagttttatttatttaattaaaaatattaatatagaaatagaacgtaaggtgacattacaagcagttaattataataatgttgaaattctctcgcctctcatccgagaaaaattgtatgtatatcgtcacaatgtatctactattacacagaacaaaatatttagtttcaacaagttgtag

SEQ ID NO: 2326 - DNA, 1119 bp, Staphylococcus epidermidis
acaatgaaacttaatacactccaattagagaattatcgtaactatgaacaggtgacattagattgtcatcccgaagtgaatatccttattggtgagaacgcacaaggaaagacaaatttacttgaatcaatttataccttagcgcttgctaaaagtcatcgtacgtcaaatgataaggaactcatacgtttcaagtctgattatgctaaaatagagggtgagctaagttatagacatggtacgatgccgcttacgatgtttataactaaaaaaggtaagcaagttaaagtaaatcatcttgagcaaagcagactaactcaatatattggacatttaaatgtcgtcttatttgcacctgaagatttaaatatcgttaaaggttcaccacaaatacgtcgacgattcatagatatggagttaggacaaatatctgctgtctatttgaatgatttagctcaatatcagcgtattctaaagcaaaagaacaattaccttaaacagttacaaattgggcagaagacagatacaacaatgttagaagtcttaaaccaacaatttgctgaatatgcactgaaggttacgttacgtcgagagcactttataaaggaattagaaacacttgcacaacccattcatgcaggtatcacaaatgatcgagagacactgacactcgattatgttccaagtttgaagttaagtaattatgaagccaatcaatctgagttaattgaagaagtattagcattgttaaatgacaatttacaaagagaaaaagaacgaggcgtatgtctctatggcccacatcgtgatgacttaagtttcaatgtaaatggcatggatgctcaaacgtatggttcacaaggtcagcaacgtaccactgcgctgtcaattaagttggcagaaattgaattaatgaatattgaagtaggagaatatccaatcttacttttagatgatgtcttgagtgagcttgatgattcacgtcaaacacatttgttaagtacgattcaacataaagtacaaacatttgtgacaactacgtcagttgaaggaatagatcatgaaataatgaataacgctaagttataccgtattagtcaaggtgaaatactaaagtaa

SEQ ID NO: 2327 - DNA, 1989 bp, Staphylococcus epidermidis
aaagtgattagaggtggaagaatgaaccgtcaatccactaaaaaagctttgctcataccgtttattttaatggtactcactgccatagcacttgtcgtcgtgtggtttatttttaaccaactagtggcaggtattgctacagctatactcattgtgatgattattattagtggcgtgttattgagaaaagcatttctaaaaatggataattatgtggatgatttaagtggtcacatctcggcaagtagtaataaggcgattaagcacttgcctatagggatgattgtgttagatgaagataatcacattgagtggatgaaccaatttatgacagatcacattgaaacgaatgtgatttctgaaaatgtcaatgaagtcttccctaacatcttaaaacaactggaaaaagttcaagaagtagaaatagaaaacaacaattattattatcatgtacgatattcagaaaacgagcattgtttatacttctttgatatgactgaaactgaacgtacaaatgaactatatgaagattccaagccgattattgcaacaatatttttagataattacgatgaaatcacacaaaacatgaacgatacacaacgttctgaaattaactctatggtgacacgtgtgattagtcgttgggcgcaagattacaatatttacttcaaacgttacaactcagatcaatttgtagcttactttaaccaaaaaatactggctgaactagaagattctaattttgaaatcttaagccaattaagagagaagagtgtgggttaccgcgcacaactaacattaagtattggtgtaggtgaaggcactgagaaccttattgatttaggtgaattatcacaatctggtttagacctcgcgttaggtcgtggtggtgaccaagttgcaattaagaatatgaacggcaatgtaagattctatggtggtaagactgaccctatggaaaaacgtacgcgtgtacgtgcgcgtgtgatttcacatgccctcaaagatattcttactgaaggcgataaagttatcgttatgggacataagcgaccagatttagatgctataggtgcagctatcggagtttcgcgctttgcatcaatgaataatttagaggcatttatcgttcttaatgattctgatattgatccgacattacgtcgtgttatggatgagattgataagaaaccggaactaaaagaacgctttgtaacatcggatgaggcttgggatatgatgacttctaagacgactgtcgttgttgtagatacacataaacctgaaatggtcttagatgaaaatgtcttaaataaagcaaaccgcaaagtagtcattgatcatcatagacgtggcgaaagctttatttcaaatccattacttgtgtatatggaaccttacgctagctcaactgctgagctcgtaacggaattactagaatatcaaccaactgaacagagattgactcgtttagaatcaactgtcatgtatgcaggtattatagtagatacaagaaactttacgttaagaacaggttccagaacatttgatgctgcaagttatttacgtgcacatggcgctgatacaatcttaacgcaacatttcttaaaagatgatgtcgatacgtatatcaatcgttcagaattgataagaacagttaagatacaagatcaaggtgtagccattgcacatggttcagatgataaaatttatcatcctgtaacggttgcacaagctgccgatgagttgttaagtttagaaggcattgaagcatcttatgtagtagctaaacgtgaagacaacctgattggtatctcagcacgttcattaggttccataaatgttcaattaacaatggaagcgttaggtggcggtggccatctgacaaatgctgcaacacaaataaaaggtgcgacaatagatgaagcaatagaacaattacaacaagcaattacagaacaaatgagtaggagtgaagacgcatga

SEQ ID NO: 2328 - DNA, 291 bp, Staphylococcus epidermidis
tggcacctaagacagattgttcagcttcattgctatgtggcatttgattttgctcatacattccatccattatctacttacacctcttatttcaatccatcttttattttatcgtcatctgatattgtcacgagatacactacagatatttcagaggttaacaaattgtataagtcatacatcttatataattgcacctataatagtaatcatgtactatcctcgcgtcatatctttaaattattgttctacagtgtgcacacggattgtaccttcgacttctttgtctaa

SEQ ID NO: 2329 - DNA, 1158 bp, Staphylococcus epidermidis
acgactggaaggagtttaaatttaatgatggaattcacaattaaaagagattattttattaatcaacttaacgacacattaaaggctatctcacctagaacaactttaccgattttaacaggtatcaaaattgatgctaaagaaaatgaagtcattttaactgggtcagattcagaaatatcaatagaaatcactattccaaaacaagttgatggtgaagaaattgttgaaattacagaaacaggatcagttgtacttcctggtcgtttcttcgttgatattattaaaaaacttcctggaaaagaagttaaattatcaactaatgaacaattccaaacgttaatcacatcaggtcattcagaatttaacttaagtggcttagatcctgatcaatacccattattacctgaggtatcacgagatgacgctattcaattgtcagttaaggtactaaaaaatatcattgcacaaactaattttgcagtgtccacctcagaaacacgaccagtacttactggtgtaaactggcttatacaagataatgaattaatatgcacagcaacagattcacaccgcttagctgtaagaaagttacagttagaagatgaatcagaaaataaaaatgtcatcattcctggtaaagctttatctgaattaaacaaaattatgagtgacagcgacgaagatattgatattttctttgcttctaaccaagtgttattcagagtggggaatattaatttcatctcacgtttacttgaaggtcattatccagatacgacacgtttattcccagaaaattatgagattaaattaggaattaacaatggagacttctatcatgcaattgatcgtgcatctttattagcacgtgaaggtggaaataatgttattaaattaagtacaggtaatgaattagttgaactttcatctacttctcctgaaattggtactgttaaagaagaagttaacgctaatgatgtagaaggcggaaacttgaaaatttctttcaactcaaaatacatgatggatgctttaaaagccattgataatgatgaagtagaagtagaattctttggtacaatgaaaccatttatcttaaaaccaaaagatgatgattctgtaacgcaattaattctgcctattagaacatattaa

SEQ ID NO: 2330 - DNA, 987 bp, Staphylococcus epidermidis
aggaggtatggaactattatgacgaattacacggttaatacattagaactaggtgagtttataactgaatctggtgaaacgattgatcatttacgtctacgttatgaacatgtaggacttcctggtcaaccccttgtcgttgtttgccatgcacttactggcaatcatttaacatacggtaccgatgcgcaacctggctggtggcgagaaatcattgatggtggctacattccagttcatgattatcaatttcttacattcaatgtcattggaagtccatttggttcgagttctaaattaaatgatgacaacttcccagaacatttaacattgagggatatcgttagagctattgagttaggtatacaagcattagaatttaagaagattaatattctcattggaggcagtttaggtggcatgcaagcgatggaattgctttataatcgtcaattcgaggtggaaaaagcaatcatattagccgctactgataaaacgtcctcctatagtcgtgcttttaacgagattgcaagacaagctatacatataggcggtaaagaaggtttaagtatcgcacgtcaactcggcttcctcacgtatcgatcgtctaaaagttatgatcaacgttttacaccagatgaagtagtgagctatcaacaacatcaaggtgataagttcaaagaatatttcgatttaaattgttatttaacactgctagacgtcttagatagtcatcatttagatagagggagagatgatgttgatgaagtctttcaatcgttggaaacgaaagtactaactatgggctttattgatgatttactttatcctgatgatcaagtaagagctttaggagaacgttttaaatatcatcgtcatttcttcgtaccagataatgttggacatgatggttttcttctaaattttaatgattgggcacctaatttatatcatttcttaaatctgaaacaattccgacgtaaatag

SEQ ID NO: 2331 - DNA, 1404 bp, Staphylococcus epidermidis
ataatggatggaatgtatgagcaaaatcaaatgccacatagcaatgaagctgaacaatctgtcttaggtgccattattatagatccagaactcattaatactactcaggaagtcttgcttcctgagtcgttttatagaggcgcccatcaacatatttttcgagcaatgatgcacctaaatgaggataataaggaaattgatgttgtcacattgatggatcaattatcaagtgaaggtagcttgaacgaagcgggtggccctcaatatcttgccgaactatcgacgagtgtaccgacaacacgaaacgttcagtactatacggatatcgtttttaaacatgcgttgaaacggaaacttattcaaaccgctgatagtatagcgaatgatggctataatgatgaattagaattagatacgattttaagtgacgccgaacgacgtattttagaactatcttctactagagaaagtgatggttttaaagatattagagatgtcttaggacaggtatatgagaccgcagaagaactcgatcaaaatagtggtcaaacaccaggtattccaactggttatcgtgacttagatcaaatgactgctggttttaaccgtaatgatttaatcattctagcggcacgtccttcagtaggtaagactgcctttgccttaaatattgcgcaaaaggttgccacacatgaagatatgtatactgtcggtattttctcacttgagatgggcgccgaccaattagcaacacgtatgatttgtagttctggtaacgttgattccaatcgtttaagaactgggacgatgactgaagaagattggagtcgctttacgattgcggtaggtaagctatcacgaactaaaatcttcatagacgatacgccaggtatccgtatcaatgatttacgttctaaatgtcgtcggctcaaacaagagcacggtcttgatatgattgtgattgattatctacaattgattcaaggaagcggatcacgtttctcagataaccgtcaacaagaagtttcagagatttcacgtacacttaaggcgattgcacgtgaattagaatgcccagttattgcactgagtcagttatcacgtggcgttgaacagcgacaagacaaacgtcctatgatgagtgatattcgtgaatctgggtctatagaacaagatgccgacattgtcgctttcttatatcgtgatgattattataatcgtggtgaaggtgatgaagatgatgacgatgctggttttgaaccacagacaaatgatgataacggtgaaattgaaatcatcatcgccaagcaacgtaacggtccaacaggtactgtgaaacttcactttatgaaacaatataataaatttacagacattgattatgctcatgcagatatgtcataa

SEQ ID NO: 2332 - DNA, 840 bp, Staphylococcus epidermidis
catgttatgggaggttatgtcgttatgaaaacgttagattctgttaatattcctataagaaaagacgaaacacataaaggtgactatggtaaaattttattaatcggtggatcagccaatatgggtggcgcaatcatgcttgctgcacgcgcttgcgtttatagtggaagtgggctcattactgtagcaacacacccaaataatcatgctgcgctacattctcgttgtcctgaggcgatggttatagatattaatgatactaaaatgcttacaaaaatgattgaagcaactgatagtatccttatcggtccaggtcttggagtagatttcaaaggtaataatgccatcacgtttttacttcaaaatatacaaccacatcaaaatttaattgttgacggagatgctataacaatattcagtaagttaaaacctcaaattcctacatgtcgtgttatattcaccccacatcaaaaggaatgggagcgtttgagcggtatacctattgaagaacagacatatgaacgtaaccttgaagcggtagaacgtattggcgcgacagtagtattaaaacaacatggtacggaaatctatttctgcaatgatgatgtctataaattacctattggcacacctgctatggctacaggtggtatgggtgatacacttgcgggcatgattacaagcttcgtaggccaatttgataattttaaagaagctgttacaagtgcaacttacatgcatagttttatcggtgaaaaattatctgacacaatgtatgttgttccaccttcacgtctaattagtgaaataccgtatgtgatgaaacaacttgaaggttaa

SEQ ID NO: 2333 - DNA, 1365 bp, Staphylococcus epidermidis
tgttcgatttttatttgcaaattcaaaatcatattggtaaaatacctagtggttaaacgagaaaaacttggaggtgctcatatgtcatcaatcgtagtagttgggacacaatggggagacgaaggtaaaggtaaaataacagactttttagcagagcaagcagacgtaattgctagattttctggtggtaacaatgcgggacatacgattcaattcggtggagaaacttacaaattacacttagtaccatcaggcatcttttataaagataaattagcagtaatcggtaacggtgtagttgtagatccagtcgcattattaaaagaactagatgggttaaatgaacgtggcatttcaactgacaacctacgcatctcaaatcgtgcacaagtcattttaccttatcacctagctcaagacgaatatgaagaacgtcgtcgtggcgataataaaattggtacaacgaaaaaaggtatcggcccagcatacgtagataaagcacaacgtatcggtattcgcatggcagacttattagaaaaggaaacattcgaacgccgacttaaagaaaatattgaatataaaaacgcatactttaaaggcatgtttaacgaaacttgtccaacattcgatgaaatctttgacgaatattatgctgcaggtcaacgtttaaaagactatgtgacagacacagctaaaattttagacgatgcaaatgtggctgatgaaaaggtattattcgaaggtgcacaaggtgtcatgttagatatcgaccatggtacatatccattcgttacatctagtaatccagttgcaggtaacgttacagtaggtacaggtgttggccctacatcagtgtctaaagtgattggtgtatgtaaatcatatacatctcgtgtaggtgacggtccattcccaactgaactttttgatgaagatggccaccatattagagaagtgggtcgtgaatatggtacaactactggacgtccacgtcgtgtaggttggttcgactcagttgtattacgtcattcacgtcgtgtaagtggtatcacagatctttcaattaactcaatcgacgttttaacaggattagacacagttaaaatttgtactgcttacgaattagatggtgaaaaaattactgaatacccagcaaacttagatcaattaagacgttgtaaacctatcttcgaagagcttccaggttggactgaagacattacaggttgccgtagtttagacgagcttcctgagaatgcacgtaattacttagagcgtatttcagaattatgcggtgtccatatttcaatcttctcagtaggtccagaccgcgaacaaacgaatttattagagcaactttggtag

SEQ ID NO: 2334 - DNA, 936 bp, Staphylococcus epidermidis
tcaaaaagtatgggagtggcgtatgtgttttcaaaaatacaacctaaagcaactattttagcaattatttcattattagtagtcgctttagtaacacatgtattacctgttctcggcttgattttatgtttatttgcaacgattcctggtattgttttgtggaatcgttccatacaatcattcggaattagtgcattagtaacagtcgtacttacaacattattaggtaatacatttgtcttaagtatgatggtcttaatcttattattaagtgcgattatcggacaattacttaaggaaagaacatctaaagaacgaattctttatatttcaacagcttcattaagtttagttacacttattggatggatgttattacaaacattcgataaaattccgacggcagctgtattaattaagccttttaaaaatgcaatgcatgaggctttcttaacaagtggaatcgattcaaactatagacagattcttgaggaaagtttccgacaaatgacggtccaactccctagttttctaattatagttattttcatttttgtcttaattaatctgattattacatttccaattttacgcaaatttaaagtagcaacacctatttttaaacctttattcgcatggcaaatgagccgtaatttactatggttttatcttatagtacttatttgtgtcatgattgcaagtgaaccaagtacgttccaaagcatcgtgttaaactttgatgttgtgttatcattagtgatgtacatccaaggattaagtgtcattcacttctttggtaaagctaaaagatggccgaacttcgcaacaattcttgttatggtagtagggacacttcttacaccagcaacgcatattgttggattacttggggtaattgatttatgtattaatttaaagaaaataataaaaaaatga

SEQ ID NO: 2335 - DNA, 471 bp, Staphylococcus epidermidis
gaaatcacgattgagaatatatattgtactcattgtatgtgtgattgtgatgatgcttcttctaagttcaattctaccttcatacgtagcaattttaatagccgcaattgttgctgcattgttaggggtggtgatggaaaaatgacgacagatttacatacattagtacttattgttttatgtggcgtggtcacattactcgttcgagttattccatttattatgatatcacgtgtcaacttaccagcaattgtaattaaatggctttcttttattcctatcactttatttacagctcttattatagatggtgtaattcaacaacatgatcatgcatttggttatacgcttaatttaccttatattattgcaatcgtgccaactgtgatgctcgctattttcacacgtagtctaacagtgacaattctcggaggtatatttgttattgcttgcttacgtttaatcttttaa

SEQ ID NO: 2336 - DNA, 207 bp, Staphylococcus epidermidis
aatcaaaatgtttacaaccttacttttaaagattatcaaaaaataataatgactaaacttttgcaactctttaagacatcattgatttttaattttttattaaaattttatttagaaatagtaattttcaaaagatacttaattttgtttgatataatcacaccatcaaatgaaacgaggtgtaacaatattgaattggcaacgtaa

SEQ ID NO: 2337 - DNA, 243 bp, Staphylococcus epidermidis
gaaattttggttcaagaagttgttgtagaaggaaatatcactttaggtcaatttcttaaaactgaaggaatcatagaatcaggtggacaagctaaatggtttctacaggattttgaggttttaattaatggacaacgtgaaacaagacgtggcaaaaaattagaacacaacgaccgcattgatattacagatatccctgaagatacgggttcctttttaatcatccatcaaggtgaacaatga

SEQ ID NO: 2338 - DNA, 636 bp, Staphylococcus epidermidis
agaagaatctctatgatagttaaattttgtggttttaaaaccgaaagtgatattaagaaaattaaaaaattagaagttgatgcagtagggtttatacattatcccgatagtaagagacatgtctcactgaaacaattaaaatatttggctaaaatagtgccagatcatatagagaaagtagtggtcgtagtaaatcctcaaatgtccaccataaagagaataattaatcaaactgatattaacacaatccaattacatggaaatgaaagcattcaattaattagaaatattaagaaacttaattcaaaaataagaatcataaaagcaattccagcaacaagaaatttaaataataacattcaaaagtataaagatgagatagacatgtttattatagatacaccatcaatcacatacggagggacaggtcaaagttttgactggaaattattaaaaaaaataaagggcgttgattttctcattgcgggtggtttggattttgaaaagataaaacgattagaaatatattcatttggacaatgtggttatgacatctcaactggcattgagtcatataatgaaaaagattttaataagatgactcgaatattaaaatttttgaaaggagacgaatga

SEQ ID NO: 2339 - DNA, 189 bp, Staphylococcus epidermidis
attcagacatcatcgtggcttaatataagaaaagtaacagctcaacgagctgaaaataatcaaaaaaattataaaaaagacaatttctatattttttcaatagaaattgtcttttttacttatcttgaacctttttgtcccagcctcttcagggattcattttttaattatcttcaaagaaatttttga

SEQ ID NO: 2340 - DNA, 327 bp, Staphylococcus epidermidis
atagctgctcctaaaccaatcggaactgctacgattgtagcaataacagtaattttcaatgtgccgatgatgagtgcccaaattccaaattctggtgatgaaccagttgggttccaagtaccagataaaaagaatttagataatggcactcgtgtgaaaaacgtaatcgtctcggttaaaagtgtaaataaaatagcaattgtagttaatatagatatagctgaaataatggctaaaataattgggacaattttatcacttagcccgccctttttagcattattcttagctatcatttctctcacctttgtttgtgaagccatgtaa

SEQ ID NO: 2341 - DNA, 3033 bp, Staphylococcus epidermidis
gatttgaagcctttacatatagttatggagaactttggcccttttattaaagaaactattgattttgagcaagttgaaactgatcaactctttttaattagtggtaaaactggatctggtaaaacaatgatttttgatgctatagtatacgcattatacggtatggcttcgaccaaaactagaaaagaaggagatttaagaagtcattttgcagacggtaaatcgccaatgtctgtaatttatcaatttaaagttaataatcaaacttttaaaattcatagagaagcgccatttattaaagaggggaatataactaaaacacaagccaagttaaatatatatgaattagttgataatcaatttgaattaagagaaagtaaagtgaatcaaggtaatcaatttatcgtacaattattaggcgttaatgctgaacaatttcgtcaattatttattttgcctcaaggagaatttaaaaagtttcttcagtcaaatagtaaagacaaacaatcgattcttagaacactttttaatagtgagcgatttgatgagattagacatctacttgtagaaaatgtaaagcaagaaaaagtacaaattgaaaatagatacactcaaattgaaaatttatggaatgatatagatacatttaataatgatgaattggccttatataaagaattagagagttctcagacagataaaatgattgaaaaattcccacaatttaatgattatggatgcaaaattctcaagtcatttgaagaagctaagaataaaataactaaggaattagatgatttaaatcataaatataaagtgaatgttgaattaagtgagaatactaaaaaattaaaagcggaaaaaatcaaatttgacgatttgaaaaaagaacaaaattatattgataaattaaagcaagaattaaaaatgattcaggaatctaaagtattaatcacttattttactaggttacaaagtttaaaaaaagataaagatgaattagtgtcacttcatgagcaatcaaaattaaacgaaacaaactatcacaatgaaattaaaggttttcaaaaacaactcgaacatttatcaacacgagaaaatgaaataactcaatttaatcagtatctagaaaaaaaccaagttttcttcaatcaattagataagattattagtagttatcaacaaaaaccggtaattgaagaagaaataaaaagattatacagtgaatataatgatttaataaccaaaaaagaagaattgacgaaagaaatgaacaacaagaacaaagattttgcaattattgaacattacactgaagagatttataagctgaaaaagattatagatgaatctgaaagacaaaaaaaggatgagaaattatttgataaattacaactagataaatcatcttatcttagcaaattaaaagagaagaaagaacagttaaatgaaattgaatcatcaatcaccaatatagatgcgactttaattgatttgaatgacaaaaaggattttgtaaatgaaataaagtccgctatgtcaattggagatacctgtccaatttgtggtaatgaaatacattcattgggagaacatattgattttgaatcaattgctcaaaaaaataataaaataaaacggttagaaagtaagaaggtaaaaattcgtgatgaaataatcaaaatagaaactcgaattgaagaattaaatcatagagaaaatgaattaaattttgagaaacaagaaaagaaggatattagtgagcttcaaaaacagcttaatcatttgaatcaactaaaagacgagcaacaaagcataaataagttagtagaaaattttgagaaacaagaaaaagaaatagttaataaaatacatcagtttgatttagatttgagtcgaaagaacacgcaaaaagaaaaactggaaattcaaattaatgattttgaacgacattcacaattttcatcagtaaatgattttgaaacttattattctcatgctaaaaaacaagttgagacgtatgagtatgagaatgagaaaactaaagataaattgaacgagttgaataataagttaaagatagaaatgaatgatcaaaaacatttaactgagaatttaactcaaacaagtaaggaaataaataatttagaattaaaaatggaaaaagaaatgcaacaacttggttttgagtcttatgatcaagtcaaaagcgctgcagatttaagtgctcaaaaagatgaaatagaaagagaaattaatatttataataagaactatcaaagttatgaaatagagattaacagactcaaagaattggttaagggcaaaaaattattaaatttagaagaattacgacaatctatagaaaaaacaaacttgaaactagatgaaacgaattcacaaatagctacgattagctataaaatagataataactctaacaaatttaataaaataaaaaatataattcagattctcgatgatgaattaaaagtgcaaaaagaaattttcttgctatcagaaatattagctggtaaaaatgattataaattaacactagaaaattatgttttaatttattacttggaaaaaataatttttcaagcgaatcaacgactttcatttatgagtggaaatagatatcaactgattagaagagagaccatttccttagggttaagtggattggaaattgacgtgtttgattttcattcaaataaatcgagacacataagttcactttcaggaggagaaacatttcaagcatcactagctttagctttaggattaagtgaagttgtacaacaagaatcaggtggaatcactttagattctatgtttatagatgaaggatttggcactttagatcaagaaacactcgaaactgcgatagatacattaattaatttaaaatcatctgggcgcatggttggtataatctcacatgtaagcgaacttaagcaacgcatacctttgattttagaagtgacaagtaaccaatacgaaagtcatacacaatttagaaaaaattaa

SEQ ID NO: 2342 - DNA, 270 bp, Staphylococcus epidermidis
gcgaataagtttatgtcaaaagagggtgtcaatttgacttatttagtcttttccattgtatttgcatttctaatgggtgctgtcgttatagtgataagaatgaaagcacaacagtttccagtcaatgaaaagaaaattatcttaccacctttttccatgctaccgtgcattgatgtattgtacccatactttcgattaactggtatggacaatgttagaatcattgatattaggtgttttgttttctactgttttaatctggacttctag

SEQ ID NO: 2343 - DNA, 564 bp, Staphylococcus epidermidis
aagatatttactctggtaaagctaaaacatggaaagaccgttaactctagttggccagataaaaaaatcaatgctgtttcacctaactcaagtcatggtacttacgacttctttgaagaagaagttatggacaaacaagatatcaaagctgagaagaacgctgatactaacgcgatcgtatcttcagtaactaaaaacaaagaaggtatcggttacttcggttataatttctacgaacaaaataaagataaattaaaagaagttaaaatcaaagatgacaatggcaaagttacagaaccaactaagaaaacaattcagaacggttcatacgcactaagcagaccattatttatctacgctaaagacaaatcattaaaagacaataaagtaatgtcagaattcatgaaatttgtacttgaagatgaaggtaaagcagctgaagacgctggttatgtagcttcacctaagaaaacttataaatctcaattagatgacttaaaagattttttagataaacatcaaaaatctgataagaaagacgacaaaaaatcagaagataaataa

SEQ ID NO: 2344 - DNA, 309 bp, Staphylococcus epidermidis
ttaaatcatactctaatcttaaatcttcttggaatctttttaactgatttattcttaatttgctatgttgttattttttctgtgaaatttaattctgggataactattattagtatgattttatgttacgtggtcataaagattacagacaatattaataaaatcaagttttccccttcaaatttcacaaatttagataccgataaaagttttattttcaacttatcaataatgagctctattactattgtttatatattcattatttacctcttagcaattacgattttcagaaaaattcaattttaa

SEQ ID NO: 2345 - DNA, 1023 bp, Staphylococcus epidermidis
cggcttgatacatatcccttgatgtatcaagccgctttatttttggcaagatttaaagtattgatgtcattgattcaatctctatataacagtaaaaaatttcaaaatagattccttttcaatttaggtattaagcattataattttaataatgatattagaaaggtgattatgatgagcaagtatgtaataacgaaaacactcaataacaatgtcatcatatgcacaaaaaatcatcaagaggttgttttaattggtaaaggtattggttttaataaaaaggttggtatgacagttcaagagaatgcttcaatagaaaaaatttataaattagaacaacaagagcaacaagaacactacaaaacacttttggagctcggagaagatcatgttgttcaagcggtgatagaatcagttaatattatcaatgaatctggtctaattacagatgataaaaatttggttgttgcacttacagatcacatcatttatgcctataaaagacttaagcaacatcaaatgattacaaatccatttgtgattgaaacaaaacatctctatagtaatgcatacaatgttgctcgaaaggtaatcgataaattaaataaaaccttagacgtacattttccagaagatgaaattggattcatcgcattacatattgcatccaactctgaaaaattatcaattcacgatatttcagtaataaacaagttaatcaataagagtattacaattattgaaactgatttacaacattcaattgataaacaaacaatacaatatcagcgttttataagacacatacaatttttaatatatcgattaactaaaggtgagtatttagaagcacaggagaattttatatcgatgataaaaactatgtatcctcgtagttttaatacggcttataaaatattaaaaatgattcaacgtgagtttagtgtgtatgtatacgaagcggaaatagtttatttaacattacatatcaatcattttgaagttcaaattagtagtgaataa

SEQ ID NO: 2346 - DNA, 309 bp, Staphylococcus epidermidis
ggtgataacactatgaatataaaattaactcaaaaggcagtagaatggtttaaaaacgaattggatttacctataagcaataaagttcttcaattttatgtaaaatatggaggagaattccaattaaaacaaggatttagtccagcgttcaccgtagaaaataaagatgctattgatataggttttgaacaaacattctatgaaataaatgtcgttattgcggaaaaagatttatggtattttcaagatgaaaaactaactgtagatgcaatcgatcatgaagatgagatcatctacaaacgaaattaa

SEQ ID NO: 2347 - DNA, 183 bp, Staphylococcus epidermidis
gaattcctaacaacattagaaagggtgtttaacgtgcgcgtaaatattacattagcttgcacagagtgtggcgatcgtaactatattactactaaaaataaacgtaataatcctgaacgcattgaaatgaaaaaatattgtccaagattaaataaatatacgttacatcgtgaaacaaaataa

SEQ ID NO: 2348 - DNA, 942 bp, Staphylococcus epidermidis
gagagagggttttacatggcttcacaaacaaaggtgagagaaatgatagctaagaataatgctaaaaagggcgggctaagtgataaaattgtcccaattattttagccattatttcagctatatctatattaactacaattgctattttatttacacttttaaccgagacgattacgtttttcacacgagtgccattatctaaattctttttatctggtacttggaacccaactggttcatcaccagaatttggaatttgggcactcatcatcggcacattgaaaattactgttattgctacaatcgtagcagttccgattggtttaggagcagctatctaccttaatgaatatgcatctgatcgttcacgtagaatcattaaaccaatattagaaattttggctgggattcctacaattgtatttggcttctttgctttgacatttgttacacctatattgagaaatctaattcctaacttgggagagtttaattcaatcagtcccggtattgttgtgggtataatgattgtccctatgattacaagtatgagtgaagatgcaatgtcatctgtacctgataaaattcgtgaaggtgcatttggattaggcgcaactaaatttgaagtcgctacaaaagttgtattaccagctgcgacttctggcgttgttgcttcaattgtattaggtatatcaagagcaataggtgaaacaatgatcgtttctttagctgctggtagttcaccaacatcatctctaagtttaactagttcaattcaaacgatgacaggatatattgttgaaattgctacaggtgatgcagcatttggttctgatatttactacagtatttacgctgtaggttttacacttttcattttcactttaattatgaatttattatcacaatggatctctaaacgattcagagaggagtattaa

SEQ ID NO: 2349 - DNA, 282 bp, Staphylococcus epidermidis
aataacagaacgaatttagtaaaatgcataaggataaagaaagcgggtgaaacaatggcaatttgggtagcaattattctaatcgttatagcacttattgcaggtttaattggtggtttcttattagctagaaaatatatgaaagattacttaaagaaaaatccacctatcaatgaggaaatgctacatatgatgatgatgcaaatgggacaaaaaccatctcaaaagaaaattaatcaaatgatgacaatgatgaataaaaatatgaatcaaaaaatgtaa

SEQ ID NO: 2350 - DNA, 933 bp, Staphylococcus epidermidis
acgttattgacctataacatcacatctaggtctcaatatataaaggagtttttaattatggctaattcacaagtagcagaaaaagagaaactagacgcacaaacaaataatcaagactcagttgccacaatagtaactactgaaaacaataagaaaaatacaattccagacagtgaaaagaagattgtttattcaactcaaaatctagatttatggtatggagaaaatcatgcgttacaaaacattaatttagatatattggaaaataatgtaactgcaataatcggaccttctggatgtggtaaatctacatacatcaaagctttaaatagaatggtcgaattagttccatctgtgaaaactgcaggtaaaattttgtatcgtgaccaaaatatatttgatgcaaagtattctaaagaaaagctacgtactaacgttggaatggtctttcaacaacctaacccattccctaagtcaatttatgataatattacttatggccctaagactcacggtattaaaaacaaaaaaattctagatgaaatcgtagaaaaatcattacgtggcgctgcaatatgggatgaattaaaagatagattgcatacaaatgcttatggattatcaggtggacaacaacaacgtgtttgtatagctagatgtttagcaattgaaccagatgtcattttaatggatgaacctacatcagcattagatcctatttctacgttaagagttgaagaacttgtacaagaattaaaagaaaattactcaattatcatggttacgcacaacatgcaacaagctgcgcgtgtttcagataaaactgctttcttcttaaatggatatgtcaatgaatatgatgatactgataaaatcttttcaaatcctgccgacaaacaaactgaagattatatatctggtcgttttggataa

SEQ ID NO: 2351 - DNA, 996 bp, Staphylococcus epidermidis
gtaaatatgactgaacagaaggatattaaagaaacagagtatcgacgacagaaaggaacaacttcgacaccttttaggcgaagaaataaaaaaagaatgcggaagttaccttttatcattttagtcatccttattattttaatttctatcattgtgtatattacccatcagtataacagtggtatgaagtatgctaaagaacatgctaaggatgttaaggtgcataaatttaatgggaatatgaaaaatgatgggaagatttcagttcttgtccttggcgcggataaggctcaaggtggtaaatcacgtactgactcgattatgattgttcaatatgattacgtacataaaaaaatgaaaatgatgtctgtcatgagagatatttatgctgatattcctggttatgataaatataaaattaatgccgcatattcacttggaggcccggaattgttaagaaaaacacttaacaaaaatttaggtgttaatcctgagtattacgctgtagtagattttactggatttgaaaaaatgatagatgaactacagcctaatggtgtcccaattgatgtggaaaaagacatgtctgaaaatataggtgtgtctttgaaaaaaggacatcataagttaaatggtaaagaattacttggttatgctagattccgtcatgatccggaaggcgattttggtcgtgtgagaagacaacaacaagtgatgcaaacattaaagcaagagttagttaatttcaatacagttgcgaaactaccaaaagttgctggtattttaagaggttatgttaatacaaatatgcctaactctgcgatttttcaaacaggtataagttttggaattcgtggagataaagatgtgcaatctttgacagtccctattaaaggaagctatcaagatattaatacaaataatgatggtagtgcgcttcaaatagactctgagaaaaataagcaagcaatcaaaaatttctttgaagataattaa

SEQ ID NO: 2352 - DNA, 300 bp, Staphylococcus epidermidis
ctggtatggacaatgttagaatcattgatattaggtgttttgttttctactgttttaatctggacttctagattcgaagttaaagatgataatatttatatgaaacggtctaaagcatttccaattattttaatatcattattaataataagaacagttattaaaatatttataagtagcgaaattgatccaggtgaaattgctggtatgttttttttactcgcattttgtatgatagtaccttggagatgtgcaatgctttataaatataaaaaattgcaaaagaatcttattaagtaa

SEQ ID NO: 2353 - DNA, 732 bp, Staphylococcus epidermidis
aagcaagctgcaaaaggaggacaacatctaattatgattcaatttgatcatgtagattattcatatcatcgaaaacagcctgttttaaaagatattaatataagtattcaacgtggtgaaaaaataggggttttaggggaaagcggtgctggaaaaagtactattggttctttaatattaggtcaattaaagccaacaaaaggaaaaataagtatcgattcaggaaaggttctacctatttttcaacatgcgacagaaagttttgatcgtcaattcacgattgaacagtctttgagagagccacttttattttatcgacaattaatacgacaaaatatcaaaaatatcattcttaactatttaattgaatttaatttgtctacagatctaataacaaagtttcctcaagaggtaagtggtgggcaactacaaagattaaatattatacgttctctcttagcacaaccagatatattggtttgtgatgaaataacttcgaacttagacgtcatggccgaacaaaatgtaatcaatattttacttaacgaaaaaaacattcaaaataaaacactaatcgtcatctcgcatgatttatctgttttacaaaggttaacgaataggataatagttatcaaagacggtcaaatagtagatgattttaaaagtaaagatttatttagccataaaagacatccatatacaaaactattaattcaaacgtatgaatattga

SEQ ID NO: 2354 - DNA, 390 bp, Staphylococcus epidermidis
tttgattattttttaagcaagtctctaatttctgttaataaaacagtattttcttctacttcttcttctttctcttcttttttcataactgtattagctatcttaacaaagataaataaagcaaaagcaattatgatgaagtcaattattgattgtatgaaaagtccatacttaatcccccaaaaagaccaatcttcagcaaaattaactgaaccaaataatttaccaattaatggcatgatgatgtattggactagggatgtaactattttattaaacgctgctcccataactacagcaatagctaagtctaaaacattgcctttgagtgcaaactctttaaattcttttaacataaagcataacccttcttttaaaatatatttctga

SEQ ID NO: 2355 - DNA, 243 bp, Staphylococcus epidermidis
gttggtaacgcagagaattggtcgagtaatccacttggtgttgctaaaagtatcgtaggtatacctatcattacaagtggtgctgtttctcctaatgcgcgtgataaagataaaatgaaacctgttaaaataccaggtaatgctgcaggtaaaacaactcttctaattgtttgccatttattagcaccaagaccatatgatgcttctctgactgaactaggaactgctctgatagcttcctga

SEQ ID NO: 2356 - DNA, 654 bp, Staphylococcus epidermidis
gatgcaatggcaattattagacaaaaatatgaaggtcagctagatggattaattaaagatttacggcgtcttggtcttcgtgtatattttaatattaacaatgcactagtatctttaggggaagaaaagaaatcattcgcaagacaaaccattgagaaagacaaagaaattaaccatttagatcatgaaattaacgagaaggtaatcatgctaattacgagacaacaacctattgccaaagatttacgtatgatgatggcagcactcaaaatctctactgactttgaacgaatgggggataatgctgctagtatcgctcatatacgtttaagagttaaaataaatgataactatgtgtttacacgtttaaaaaccatgggtaaattagcgatgctcatgttagaagatttaaataacgctattagaaataaagatttaccactgataaaagaagtcattgagagagatgaagatattgatgatttatacgttaacatcgtcaataccagttacttaattgataatgacccattcgtagctggtcaagcacacttagcagctagacacttagaacgaataggtgatcatataagcaatattgctgaaagtgtttattattatttaacaggccaacattttgaaacttttgattaa

SEQ ID NO: 2357 - DNA, 438 bp, Staphylococcus epidermidis
gtattgttttatctatcattgcattattgcttatcgcttctttgctttgttacttcagctgactcagcaacattcgtattaggtatgcaaactacatttggatcattaaatccaagtagtctagttaaagtaacctggggagttgcgcaagcacttattgcctttgtactattattagctggtggaggagatggctctaaagccttgaatgctattcaaagtgctgccattataagtgccttcccattctcattcgtcgtcataatgatgatgataagtttctacaaagatgcaaataaggaacgtaaattccttggattaacacttacgccaaataaacatcgcttacaagaatatgttaaatatcaacaagaagattatgaaacagatattcttgaaaaaagagaagttagaagaaataaagaaaaagaagaatag

SEQ ID NO: 2358 - DNA, 1272 bp, Staphylococcus epidermidis
gaagggaattatctaattatgaaatttacagagttaacagttaaagaatttgaaaactttgtacaaaatccatcattagaaagtcattatttccaagtgaaggaaaatattgctacacgtgaatcagatgggtttcaagtagtgttattaggtgtaaaagacgacgacaatagagtgatagcagctagcctgttttctaaaatccctacaatgggcagttatgtgtattattccaatagaggccctgtaatggactattcagatttaggtttagtggatttttatttaaaagagcttgataaatatttacatcaacatcaatgcttatatgtaaaattagatccttactggttgtatcaagtttatgataaagatattaatcctttaacagaaaaaaatgatgctttagtaaatctatttaaatcacatggttatgatcatcacggatttacaacccaatatgattcttccagccaagttagatggatgggggtattagatttagaaggcaaaacccctgcatctctaaggaaagagtttgatagtcaaagaaaacgaaatattaataaagcgataaactacggtgtgaaagttagatttcttagtaaggatgaatttgatttattcttagacttataccgagagactgaagctagaactggatttgcttctaaaactgacgattatttctataactttatagagcattatggcgataaagtattagttcctttagcttacatagatttaaatgaatatatacaacatttgcaagaatcactaaatgataaagaaaatcgacgtgatgatatgatggcgaaagaaaataaaacagataaacagttaaagaaaatagctgagttagataaacaaattgatcacgataaaaaagaattgcttcaagctagtgaattacgtcaaacagatggcgaaattttaaatttagcttcaggagtatactttgctaatgcatatgaagtgaactatttctctggagggtcttcagaaaaatataatcaatatatgggaccatatgcaatgcattggcacatgattaattattgttttgataacggttatgatagatataatttctatggcttatcaggtgattttactgaaaacagtgaagactatggtgtttatcgctttaagagaggttttaatgttaggattgaggaattaatcggtgatttctataaaccaatcaataaagtgaaatattggttattcaatacattagatcgcatacgtaataaattgaaaaagtaa

SEQ ID NO: 2359 - DNA, 1041 bp, Staphylococcus epidermidis
tattttttatattcgttgaaagtgaaaggatgccaacatatgtttaaaatgataatttataaactttcacaaatgattgtcgtactatttatattaactacaatcacatttatattaatgaaactctctccaggtaatcctgtagacaaaattttacatcttgatatttcgcatgtatctaatgagcaaatagaaacgacagagaataagcttggcttaaataatcctatttttattcaatggtgggactggttaaatcaattgtttcattttgatttaggaacaagttatcaaacaagcgagcctgtaattagggaaatagcaaattatcttggtcctacacttattattacttttggtacgcttatagtgtcattagttatttctataccattagggattatagcagcggtttactaccataaaatttgggataggataatccgtgttatgacatcattatccgtaagcctaccatcattttttatcggtcttatcttattatatatatttagcttgaagttgaatattttaccaacttcagatgaggggcgtttcgtttcatatattttaccaataattaccatgagtattggaatgtgtgcttattatattcgatttattcgttctactttattagaacaatatcaaacacctatagttgaatcgtctcgtctcagaggtatgcccgaaagatatatactttttcaagatatccttaaacctacgatactaccaatcatacctctattaggattatccattggtagtttgataggtggaacagtagtcattgaaaatttatttgatattcctgggttaggctattttttagttgacagtataaagtcgagagattatccagtcattcaaggttgtgtattatttattggtttctttgtagtgattataaacacaattgcagatttactttcattacttatcgatcctaaacaacgttatgctattactcagaaagaaacatcaaagtttaaatggtttaattcacatagaaaagaaggtcgtaacgatgaagtttaa

SEQ ID NO: 2360 - DNA, 810 bp, Staphylococcus epidermidis
ctattgtcatatatgttaaaaatttatatttgtattttaaaatcatccaatatcactcctagaacatttgtttgtataagtaatttatcagaacataaattctgtgtcaacaacattacgaacaaatgtgtgttagaaaatgtaattaatgatataataatctcaaacaacaataaggagtgcctatttatgagagaactcactaagcgacaaagtgaaatatatgattatattaagaaaattgttcagacaaaaggttatccaccaagtgttcgagaaattggcgaagctgtcggtttagcttcaagttctacagtacatggacatttatctagattagaagaaaaaggatatataagaagagatcctactaaacctagagctatcgagatagttagtgaacaattagatgaggtaaatgtagaggaaacaatacatgttccggttatcggtaaagttacagccggcgttccaattacagctgtagaaaatatagaagaatattttccactaccagagcacttaacttcaacacataacagcgatatatttattttaaatgtagttggggaaagtatgattgaagctggaatattagatggcgacaaagtaattgtacgaagtcaaactattgctgaaaatggtgatattatagtagctatgactgaagatgaagaagctactgttaaacgcttctataaagaaaaaaatcgttatagactacaacctgaaaatagtactatggagcctatttacttagataatgtcattgtagtaggtaaagtaataggattatatagagaaatgtaa

SEQ ID NO: 2361 - DNA, 1029 bp, Staphylococcus epidermidis
ttttataaatatagcaacgagaggaagttgaaaatgacccttcttgagaaaattaaacaaaataaatctttatctaaaaaagatatgcaatcatttattgttacactgtttgattcaaatatagaaaccaatgtaaaggttgaattattgaaagcttatacaaataaagacatgggtcaatatgagctaacgtatttagttgaatattttatccagacaaactatccaaaccaaccattttataataaagctatgtgtgtttgtggcacaggtggagatcaatcaaatagctttaatatttctacaactgtagcttttgttgtagcaagtgcaggagtgccagtcattaaacacggtaataaaagtattacttcacattcaggaagtacagatgtattacatgaaatgaatataaaaacaaacaaaatgaacgaagtagagcaacaattaaatttgaaaggattagcattcataagtgcaactgattcttatccaatgatgaaaaagcttcaatcaattagaaaatcgattgcaacacctacaatttttaacttgattggaccattaattaatcctttcaaattaacttatcaagtgatgggggtatatgaagcttcacaacttgaaaatatagcacaaacattaaaggatttaggtagaaaacgagcaattttaattcatggtgcaaatgggatggatgaggccacgctttctggtgaaaatatcatttatgaagttagcagcgaaagagcattaaaaaaatatagtttaaaagcagaagaagtcggtttagcttatgcaaataatgacacgttgataggtggttcacctcaaacaaataaacaaattgcattgaatatcctaagtggcacggatcactcaagtaaacgagatgtagttttgttaaatgctggaattgctttatatgttgctgagcaagtggaaagtatcaaacatggcgtagagagagcgaaatatctcattgatacaggtatggcaatgaaacaatatttaaaaatgggaggttaa

SEQ ID NO: 2362 - DNA, 954 bp, Staphylococcus epidermidis
atttattatcacaatggatctctaaacgattcagagaggagtattaatatgtctacacattcaaatactgctaacaaaacattgattgataaagatgccgtagaaaaaaatatttcttctcgtgataggaaaaactcggtaaacaaatggttatttttattatgtacattaattgggctcattgttttagtagcactattaattcaaactttcgttaaaggggcgggacatctaactcccgaatttttcactaatttttcatcttcaacaccagcagatgctggtattaaaggggctttagtaggttctatttggttaatcttaagtattattccaattagtatcattttaggaataggtacagcaatttatttagaagaatacgcaagagacaatatttttacacaaatcgtaaaggtgagtatatctaatttagctggtgttccttcaattgttttcggtttactaggttatacattatttgtaggcgcggcaggtttaggtaatagcgtgctagccgctgcgcttacaatgtcactactaatcttgcctgttattatcgttgctagtcaggaagctatcagagcagttcctagttcagtcagagaagcatcatatggtcttggtgctaataaatggcaaacaattagaagagttgttttacctgcagcattacctggtattttaacaggtttcattttatctttatcacgcgcattaggagaaacagcaccacttgtaatgataggtatacctacgatacttttagcaacaccaagtggattactcgaccaattctctgcgttaccaactcaaatttatacatgggcaaaaatgcctcaagcagaattccaaaacgttgcatcagcaggtattatcgttctactcgttatcttattattgatgaacactgtagcgatacttcttcgtaataaatttagtaaaaaattctaa

SEQ ID NO: 2363 - DNA, 972 bp, Staphylococcus epidermidis
acacaattgcagatttactttcattacttatcgatcctaaacaacgttatgctattactcagaaagaaacatcaaagtttaaatggtttaattcacatagaaaagaaggtcgtaacgatgaagtttaagttgtcaaagaaaaacactatatttttcatttttacggtctatattatatgtcttattgtattgcaatttataatcaatgatgaagctgcgtatcaggtacatttgtcaaactcatttgaacctatgagtatgaatcatttacttggcacagatgattacggacgtgatttattcagtcgtttagtcgtgggctctcgtgcaacattgtttgttacactacttactttacttttcactgtagtggttggagtacctttagggttacttgcaggctataaaaaaggttggattgatacgattatcatgcgaattattgatataggattaagcataccagaattcgttattatgattgccttagcaagtttttttcatcctagtctttggaatttagtaatagctattacaatcataaaatggatgaattatactcgcgtgacaagagggattgtcaataccgaaatgaatcaatcgtatatacagatggcacaattttttaatgtctcaactttgaatatcttatttaaacacttattaccaaaagttttaccatctatatttgttattatgatagttgattttggaaaaatcattttatacattagttcattatcatttttaggtttaggtgcacaaccaccatctccagagtggggggcaatgttacaagcagggcgtgaatttattacttcacatcctatcatgattatcgctccagcatctttgatatcaggtacaatattgatatttaatttaactggtgatgctgtaagagatcgtttattagaacaaagaggtgtaaaagttgaaacttttaacaataaaaaatctaaacatcaatga

SEQ ID NO: 2364 - DNA, 1266 bp, Staphylococcus epidermidis
atggtagttaattataatgataatggcgaactgacaatgggaggtacaagcttaaaaactattgcacaaagttttggtacaccttcgattgtttacgatgaagaccaaattcgtaatcagataagaagatatcataaagcatttgaagcaagtggtttaagctacaatatatcttatgcctcaaaagctttcacttgtattcagatggttaaattaattgatgaagaaaatttacaattagatgttgtttctgaaggtgaactttatactgctcttgaagcaggatttgattcgaaacgtattcacttccatgggaacaacaagacgaaacgcgagattcaatatgcattagataatcagattggttattttgtagtggatacgctcgaggaaatagagcttattgataaatatgctgatagtaatgtagatgttgtattacgtgtaaatcctggggttgaagcccatacacatgaatttattcaaactggacaggaagatagtaaatttggattatcaatcaaacacggtctagcattaaatgcagttaataaagtaaaagcaacgaaacatttgcaacttaaaggtatacatttccatattggctctcaaatcgaaggcactgagccgatgattaagacagctaaaattgtgcttaattggttagcaagtgaacgaattgaagtgagtttactaaacataggcggtggtttcggaattaaatatgtcgaaggagatgaaagtttccctattgagcaaggaatatctgaaattactgaagctattaaagaaactgcgcaagcattgcagtacaatattcctgaaattgggatagaacctgcccgttcaattgttggagaagcaggtatcactttatatgaggttggtacaattaaagatatccctggagttaataaatatgtatcagttgatggcggaatgagtgatcacatacgaactgcactttatggtgcacagtatgaggcgttgttagttaacagaaatgaaaaagctaatgaatctgtaacaattgcaggtaaactctgtgaatctggtgatattatcgtacgagatgccccattaccctcttctgttcatagaggtgattacctagcaatactttctactggtgcgtatcattattcaatggcttcaaattataatcaaatgcaaaaacctccagtatttttcttgaaagatggaaaagcacgtgaagtgattaaacgtcaatcattgagacagttaattattaatgatacgaaataa

SEQ ID NO: 2365 - DNA, 1167 bp, Staphylococcus epidermidis
gggatggataattttatgaacgagttagaattcgttacattgcacagaagacatttacatcagtatccagaattaagtttacatgaatttgaaacgacatcgtatataacatcatttttagaggatttaggcgtaccttacgaccgaccacttaaaactggtgttattgcttatttggaaggtaatagtcaccacactattgcattcagagcagatatagacgcgttaccaatttatgaagaaaatgatattgattttaaaagtaagaatgataatgtcatgcacgcgtgtggtcatgatggtcatacgacagcacttatgctttttgttaaaaggtgtaaagcattgtatgacaaatctgaattacctcataatgtagtgtttatatttcaacctgccgaagaaaccggtggaggagctaatcgtttaatcaaagctggcgcttttgacaagtaccctattgaagcggtgtttggttttcacgttaatccgtttgaaaaagaaggtaaaattgtaattcgagatgaagaaatcactgcaagtgccactgaatatcgcttctttttaaaaggattatctagtcatgttgctgataaggagcaaggtcattcatgtggtgaggggttacagcatgtcttaagtcaaatcggccaaatccaacaatttcatttgaatggattgaaacgtaacattattcatatgggtcattttgaagctggtgaagctattaatacagtaccgagtcatggttatcttgaaggtacaattcgtacatatgacacagaagatttagctattgtaaaacaccaaatgcataaaattgcgaaaagtgttcaattattatttaatgttgaatgtgaggttaaatttgaagaaggatatccaccaacaatgaatcatccacaattacgtcaagccgttgagaacgctataaaaggtgcaaatttagaaatagttgaaaaaaaactacccttcctgttcggtgaagattttagtttttatggtcaacaacttgccccttcatattttgtatttgttggtacacaaaacaatgaaaaaggttttgtgactggtcttcatactgcccatcttaattttgatgagaaaatattaattgacgttgtaaattattacgagcatttgttaagaaattataaagaggtgtaa

SEQ ID NO: 2366 - DNA, 1287 bp, Staphylococcus epidermidis
tgtttttgtaagggaggatcagttatgtatgattacaatttattagaagatagggatgtactctgcatagaccaaaaaagcttttttgcgagtgtatcatgtatggaaaaaggattggacccattaacaactaaactagcagttgtagcagatacgaaaaggcaaggttcggtcgttctagcagcaactccaaagttaaaagaattaggtattaaaacgggatcaagactttttgagataccacatcgtaatgacatttatattattaatccaagtatgagaaagtatttaaatgtatctgttgcaatttcaaagattgcactgcggtacgttccacctgaagatttacatcagtatagtattgatgaatttttcatggatgtaacggatagttaccatagatttaattcaacagtttttgctttttgtaaaagatttcaaaatgaaatattagaagaaacaggtattcactgtaccattggaataggctcgaatatgctattgagcaaggttgcaatggatattgaagctaagcattcggaaaacggtatagctgaatggcgttatcaagatgtacctgaaaaattatggccaattcaaccacttagagatttttgggggattaataagcgtacagaaaagaaattgaataaaagaggaatatttacaataggagatttagcaaagtatccatatcattatttaaaaagagattttggagttttaggtatagatatgcatctacatgcaaacggtattgatcaaagtaaagtaagagaaaaatataaagtaacaaatccttcaatatgtaaaagtcagattctaatgcgagattatcaatttgaagaatccaaagttgtcatgcaagaattgatagaagatgtagcaagtcgtttaagagcagaaaagaagcttgctcgaacaattcatttttctttcggttatgctgaaggtggtggcatacataagcaatatactttggaggatcctacaaatttagaaagagatatattcaaagtcattaattattttgcaaatcgtctgtgtgacaaaaaagcattgtatagaacgttaagtgtatcgttaactcagtttattaaagaaagcgatcgacaactcaacttattcattgatgaatatgaacgtaagaaagatgtaaaacttgctaaaaccattgatcacttacatttaaaatatggaaaaggaattgtgtcaaaagcgacttcatacaccgaagctggtacaaagcatggtcgattaggactaatggctggtcataaaatgtag

SEQ ID NO: 2367 - DNA, 1002 bp, Staphylococcus epidermidis
ttctattgtaaggggttaaaaaagatgaaaatttttgattatgaagatatacaattaattcccaataaatgtattgttgaaagcagatctgagtgtaatacttcggttaaatttgggcctcgtacttttaaattgccagttgttccagcaaatatgcaaacagtcatgaatgaagaacttgcacaatggtttgcagaaaacgattatttttatatcatgcatagatttaatgaagaaaatagaattccatttataaaaaaaatgcatcatgcagggttatttgcttctatttctgttggagttaaagaaaacgaatttaattttattgaaaaattagcttcttcatcgctcataccagaatatataacaattgatattgctcatggtcactcaaattcagttataaatatgattaagcatataaaaaaacatttaccaaatagttttgtgatagctggtaatgttgggacgcctgaaggagtaagagaacttgagaatgccggtgcagatgctacaaaagtaggtattggtccaggaagagtatgtattactaaaattaaaactggatttggtacaggaggttggcaactttctgcgttaaatctttgtaataaggcagctagaaaacctattattgcagatggagggttaagaacccacggtgatatagccaaatcaattcgttttggtgccactatggtaatgattggctctttatttgctgcccacgaggaatcaccgggtgaaaccgtcgagctagatggcaaaaaatataaagaatattttggtagtgcctcagaatatcaaaaaggtgaacataagaacgttgaaggtaaaaaaatgtttgtagaacacaaaggatctcttaaagatacccttactgaaatggaacaagatttacagagttcaatttcatatgcaggaggaaaggacttgaagtcattaagaacagttgattacgtcatagtaagaaattcaatctttaatggtgatagagattag

SEQ ID NO: 2368 - DNA, 516 bp, Staphylococcus epidermidis
atgaatatcaatactgcatactttgctggtggctgtttttggtgtatgactaaaccttttgatacattcgatggtatcgaaaaagtcacgtcgggatatatgggaggacacttagttaatccttcttatgaagaagtaaaaactggatctactgggcattatgaagtggttaaaattgagtatgatgttgctctattttcatatcataaattattagaaattttcttttcagttatcgatcctttggatgatggtggtcaatttcaagatagaggttctcaatataagactgctattttctattcaaatgaacatcaaagacagttagcagaacaatatatatgtgaactccaagatagttttaacgctgataaagcaattgcaacaaaaattttaccggcatcaactttttatgaagcggaagcataccatcaagatttctacaaaaagaaccctgaacgttatgaacaagaacaacaagatcgtgctagttatgtcaaaaataatcatatgtaa

SEQ ID NO: 2369 - DNA, 378 bp, Staphylococcus epidermidis
ataataaccaaggtggaggcccacattattatcctaataatcaaggtatatatgagtcacagcctgaacacaagaaacccaccattcccgacagatggtgatggttatgaatataattatcgccaggatgatgacaattactttgaacagccaggtaaattattcagattacagtctgaagatgcaaaagagcgtatcttcacaaatacagctaatgcaatggatggggtttctaaagatgtcaaagttcgccacattcgccattgctataaagctgatccagaatatgggaaaggtgtagcaaaagctttaggtattgatatcaatcaaatagatttagagacaaatcaagacgaaacatatgaaaactttaaataa

SEQ ID NO: 2370 - DNA, 318 bp, Staphylococcus epidermidis
gtattattaaaactaacagaatatttgttaattattatgatagcaataataaaatttaatgcattaagaaagaggtttcaaatgagtaaagaaaatttaaatattgatagaataaatgaattagccagaaaaaagaaagaacatggcttaaccaatgaagaggctaaagaacagactaaattaagaagacagtatttagaagaatttagaaaagggtttaagcaacagatagaaaatactaaggtcattgaccctgaaggaaatgatgtgacacctgaaaagttaaaaaagatacaagaagagaaacacaataaataa

SEQ ID NO: 2371 - DNA, 2745 bp, Staphylococcus epidermidis
cggcatataaatatatataaatatcaagggggatataaaatggcttctaatattaaagaacaagcaaagaaacaattcgaattaaatggccaatcatatacttactatgacttacaaacattagaagaaaaagggctagctaaaatttctaaattaccatactcaattcgcgtattgttagaatctgtgttacgacaagaggatgattttgttataacagatgatcatatcaaagcattaagtaaattcggaaatgcaggtaacgaaggtgaagttccattcaaaccttctagagttattttacaagactttacaggtgtgccagcagtagtagatttggcttctttacgtaaagctatgaatgatgttggtggggatattaataaaatcaacccagaagtacctgtggatttagttatcgaccattcagttcaagttgatagttacgctaatccagaagcattagaacgtaatatgaaattagaatttgaacgtaactatgaacgttatcaatttttaaactgggcaacaaaagcttttgataactataatgcagtacctcctgctacaggtattgtccatcaagtaaacttagagtatttagcaaatgtagtacatgtaagagatgttgatggtgaaaaaacagcatttcctgacactttagtaggtactgattcacatactacaatgattaatggtattggtgttctaggttggggcgttggtggtatcgaagccgaagcaggtatgttaggacaaccatcatatttcccaattcctgaagttatcggagtgcgtttaactcactctttaccacaaggctcaacagctacggatttagctttacgtgtgactgaagaattacgtaaaaaaggtgtagttggaaaatttgttgaattcttcggtccaggtgttcaacatttaccattagcagacagagctacaattgctaacatggctccagaatatggtgcaacgtgtggtttcttcccagtagatgaagaatcattgaaatatatgaaacttacaggccgtgacgaagaacatattgaattggttaaagaatatttacaacaaaaccatatgttctttgatgtagaaaaagaggatcctgaatatacagatgttattgatttagacttatctacagtagaggcatcactttctggtccaaagcgtccacaagacttaattttcttaagtgatatgaaaaaagaatttgaaaaatcagtaactgctcctgctggtaatcaaggacatggacttgatcaaagtgaatttgataaaaaagcagaaattaattttaatgatggatctaaagcaacaatgaaaacaggagatatagcaattgctgctattacctcatgtactaacacttctaatccatatgttatgttaggtgctggtttagttgctaaaaaagctgtagaaaaaggattgaaagtaccagagtttgttaagacgtcacttgctccaggttcaaaagttgttacaggatatttaagagattctggattacaacagtatttagatgatttaggtttcaatcttgttggttatggttgtactacatgtattggtaactcagggccactattaattgaaattgaaaaggcagttgcggatgaagatttattagtaacttcagttttatcaggtaatcgtaattttgaggggcgaatccatccattagtgaaagcaaactatttagcctcaccacaacttgttgtagcttatgcgcttgctggtacagtagatattgatttacaaaatgaaccaattggtaaaggtaaagatggtaaagatgtatatttacaagacatttggccttcaatacaagaagtttctgatactgtagataaagttgttacacctgaactattcttagaagaatataaaaatgtatatcataacaatgaaatgtggaatgaaatagatgtaaccgatgaaccattatatgatttcgatcctaattcaacatatattcaaaatccaacatttttccaaggattatctaaagagccgggtaaaattgaaccacttaaaagtttgagagttatgggtaaatttggtgattctgttacaacagaccatatttctccagcaggtgctatcggtaaagatacaccagcaggaaaatacttattagatcatgatgttgcaattcgcaactttaactcttatggttcccgtcgcggtaaccacgaagttatggtacgtggtacatttgccaatattcgtatcaaaaaccaacttgctccaggtactgaaggcggatttacaacatattggcctaccggagaaataatgcctatatatgatgcagcaatgaaatataaagaagatggaactggcttagttgtcttagctggtaatgactatggaatgggatcttctcgtgactgggctgcaaaaggtaccaatttattaggagttaaaactgtcattgcacaaagctatgaacgtattcatcgctctaacttagttatgatgggtgtactaccgcttcaattccaacaaggagaatctgcagaagcactgggtcttgatggaaaagaagaaatatctgtagatattaatgaagatgtacagccacatgatcttgtaaatgtgactgcaaaaaaagaaaatggtgaaatcattaatttcaaagctattgtacgttttgattcactagtagaattagattattatcgtcatggtggtattttacaaatggtactaagaaataaacttgcgcagtaa

SEQ ID NO: 2372 - DNA, 1089 bp, Staphylococcus epidermidis
agaggtgtaaagcaattgacagcaatttggtcattagacacagaagcattttatcagaatgcagtaaaagtaaaaaataacgaaccaataatggcagttgtaaaaaacaatgcatatcattatggacttgagtttgcagtgaaaacatttttaaaagcggaaattaatacatttagcacaacttcattaaatgaagctatacgagttagaaaaatagcacctgaagcaactatatttttaatgaatcctgtttatgattttgatttagtaaaacgttatgatattcatatgacactcccctctttaaactattattataaatataaacaagatttaaaaggcattcatgtacatttagaatatgaaaatttattacatcgttccggttttagaaatatcgaagaaatacgtgaagttttaaaagatcatgatcaaaataatcaagataaaatgattatttcaggaatatggacgcattttgggtatgcagacgaatttgacgtagatgaatataaaatggaacgtgatgcttggttaaacttgataaatacacttttaaatgaaaattatcattttgatatgatacattcacaaaatagtgcaagttattttcgtgagaatcaaatgttacttcctcatcacactcatgctagagttggaattgccctttatggttcaagaccatatagtcttataaatgaagaacgcattactcaatctttgactgttaaaggtaatgttatacaagttcgtgatgtaaataaaggtgattattgtggatatagtttcgcctttgaagtaaagaatgaccacactcaattagctgttgttgatataggttatggcgatggtattctaaaatcaagagcaaaacacgaagctataattaatggcaagcgatatccaattagagcactaatgatgagtcatatgtttattgaagttgatgacgaagttcatgcacaagacgaagtcatattatataataaggatatacgtatagatgaatttacatttaaaggtgttggcgcaaattcagaacaattaagcgcaatgaatcacgattctcttatgaaggagtatttataa

SEQ ID NO: 2373 - DNA, 1272 bp, Staphylococcus epidermidis
ttaattatgaattcttcttcacaagagaagaaaaataaaaagttttcttcggttttcatctatagttcaattattgcagctatagtagtgattatcggtgctgtttggcctgagaaattcgatagcgttactaatacggctaagatgtggattactaataatttgggttggtattaccttattttaacaacagtaattgtattcttctgtgttttcttgattttcagtccaattgggaaacttaaattaggtaaacctaatgacaaaccagaatttaatacaatttcttggttcgcaatgctattcagtgctggtatgggtattggtttagtattctatggtgcagctgaacctatggcacattttgctgctccaccaacagctgatcctgaaacgacaaaggcctacactgagtctttaagatctacatttttccattggggattccatgcttgggcaatttatggcgtggtagctttagcacttgcttattctcaattccgtaaaggtgaacctggattaatttctagaaccttacgtccattattgggagataaagttgaaggaccaataggtactcttattgatgtactttctgtttttgctacattagttggtgtagctgtgtctctaggtatgggcgcacttcaaattaatggtggcttgcattatttatttggtgtgccgaacaacacttttgttcaaggtattattattgttgtcgtaacaattttatttattgctagtgcttggtcaggtttaagcaagggaattcaatatttaagtaatttaaatataggtcttggtacgatattaatgattgtaaccttaattgttggaccaactgttttaatcttaaatatgatgacaagttctacgggtagcttattaaattcattcttatttaacagttttgatactgctgcgttaaacggtcaaaagcgtgattggatgtcaacttggacattatactattggggttggtggctaagttggagtccattcgttggtgtattcatcgcacgtgtatctaaaggacgttctataagagaatttatttcaggtgttttattagtaccggcacttgttagctttatatggttcagtgttttcggcgtattaggcattgaagctggtaaaaaagattcgggtctctttaaaatgtcacctgaaacacagttatttggtgtattcaaccatattccgttaggtattgttttatctatcattgcattattgcttatcgcttctttgctttgttacttcagctga

SEQ ID NO: 2374 - DNA, 771 bp, Staphylococcus epidermidis
ctaataatgaattttatttttgatattgatggtacgatttgttttgatggatgttccatcgattcatctattaagcaacgacttttcaagctacgtcaagctaatcacaatgtaatatttgcttcagcacgtcccattagagacttgcttccagtcattcctgaatttgcggatgataccttgattggtggtaatggctcaattatctctaaaaatggacaaatcgaaattgtttcggtaatcaatgagcatgatatcagtctaattaaaaaaattataaagaaatatcaattatcatacatcattgatgataaatttaattatgcttcaaatttggatagtaataatgaactgtatcaacgcattgatcctgatggtaaagcacaatctctagatatggatgagattcgaaatcctataaaagcaattctattaaatatagataacaaagattttgacatgattgctcatcaattagtaagtcagtctcatggtattgaattaattcgtcattacagtgagtcctatattgatgtaacggcacgtggcgttgataagtatactactattcaatatattttaggaactaatagtgattatatcgcttttggtaatgatcacaatgatgttcatatgcttgaacatgcgagccaaggttattttgtgactaatcaatttatagaacacacatcattttttaaaaataaaaatattacagttattgatgacacaatatatgcaatatgtgaggttttagatcgatatctgtaa

SEQ ID NO: 2375 - DNA, 729 bp, Staphylococcus epidermidis
acaataatgaacatactattaattggatatggtgcaatgaatcaaagagttgcacgattagctgaagataaaggtcatgaaattgttggagttatagatagaacttcaaaagcgtcgacaccttattcacaatatcaacacattagtgaatgtaaagaagctgatgttgctattgacttttcaaatcctgaattgctctttcctctattagaagaacaattcaatttgcctcttgtcatagcaactacaggtgaaaaagaaacgttaatacaaaaattggaaacgctaagtcaaagaacacctgtattttttagtgcaaatatgagttacggtgtccatgcattaactaaaatattagaaactgcagttcccctactacaagatttcgatatcgaactaacagaagcgcatcataataaaaaagtcgatgctcctagtggcacattagttaaattgtatgatgtcattaaagaattacgtgacaatgtctcacctgtttatgatagacacgaaaaaactgagaagagaactcatgatgagataggtatacatgctgttcgtggtggtacgattgtcggggaacatgacatattatttgcaggtactgatgaaacaattactatctcacataaagcacaatcaaaagatatctttgcaaatggtgccattggcgctgcagaaaaattaattcacaaaaacccaggtttttatacttttaataatctataa

SEQ ID NO: 2376 - DNA, 1233 bp, Staphylococcus epidermidis
ggcgtggtgaatttaatgaaaaatgaaaaagaaataaatggaaaaaaaagccatttttttagtttgtcagagtctagatttatgaggtttttaggcggaaatgaccttatttatgctttaattgcattggttcttttaggtattgtcatttttatctttgataaaatttcatatgtctttcaaccatttattattgtatttaatacaatagcagcacctattattgtttcattagtgctattttatttattcaatcctattgtaaatatgatggagagatatcgtattccaagactattaggtataacaattatttatgttgcaattgttggtattattacattaatagttaatttacttattccaattattggatcacagatagaaagttttatcaaaaatacacctaattatttacataaaattacgcgttcacttgataaacttaataataataccattttatctggttacatgggacaagtgaacgaatggttagaatctgctcagaaaaagataccatctatggtttcagattactcagacggatttggatctaaactcgcaacttttgctgaggcagtcgcaaatatcggtattgttattgggactacaccttttgtgttattctttatgttaaaagatggtcataaatttaaagattatactacaaaaattatgccacctaaatttagaaaagattttcatgacttgttagaaaagatgagtgtacaagttggttcatacattcaaggtcaaattattgtgtcattttgtattggattattactatttattggctattcaattattggtcttaagtacgccttagttttagcaagtattgctgcagtaactagtgtggttccttatttaggaccgacaatagcaatatcacctgcgattgttatcgcgattattacttcacctttaatgttattaaagttagctgttgtatggacgcttgtccaattctttgaaggccactttatctctcctaacgttatggggaaaacattgaaaattcatcctttaacaattattttcattttattatgtgcaggaaatttaatgggcattgttggtgtgattattggtattcctctatacgctgtacttaaggtattggtttcacacatatttatgttatttaaacgaagatacaatcgctactatggaaatgatgctggtgagtacattatcactgaagaagaaaaaggaattaaacaataa

SEQ ID NO: 2377 - DNA, 273 bp, Staphylococcus epidermidis
tatatggcgaagaaatctaaaatagcaaaagaacaaaaaagacaagaattagtaaataaatattacgagttacgtaaagaattaaaagcaaaaggggactatgaagcattaagaaagttgccaagagattcatctccaactagattaactagaagatgtaaagtaactggtagacctagaggtgtgttacgtaaatttgaaatgtctagaattgcatttagagaacatgcgcataaaggtcaaattccaggtgtaaaaaaatctagttggtaa

SEQ ID NO: 2378 - DNA, 912 bp, Staphylococcus epidermidis
attaaggagaatagaatggcactagataaagatatagtaggttcaatagaatttttagaagtcgtaggattacaagggtcaacatatttacttaaagggccaaatggtgaaagtgtcaaactcaatcagtcagaagttgctgatgaagataattttgaattaggtgaggaatatagttttttcgtttatccaaaccgttcaggagatttatttgcgacgcaaaacatgcctgatattacaaaagataaatatgattttgctaaagttataaaaaccgatagagacggtgcacatattgacgtaggacttcctcgtgaagtcttagttccatgggaagatttaccgaaacttaaagaactttggcctaaagcaggtgattacttgctagttactttgagaatagacagtacgaatcaaatgtttggacgattagctagcgaaacgattgttgagtcaatgttcaccccagtaaatgacgatagcaaacaaaacgaatatatttctgcacgcgcttatagattactcagagtaggtagcttcttattaagtaatgagggttataaaatctttgttcacgaatctgaacgtaaacatgagcctcggttaggtgaggcagtagaggtccgaattataggtcataatgaaaaaggtgaattaaatggttcgtttttaccattagctcatgaacgccttgatgatgatggacaggtcatatttgatttacttgttgagtatgatggtgaattacctttttgggataaatctagtcctgatgcaatcaaagaagtctttaatatgagtaaaggctcgtttaaacgtgcaatcggacatttatataagaaaaagataatcaatatagaaacaggaaaaatcactcttaccaaaaaagggtggagccgtgtagatgattaa

SEQ ID NO: 2379 - DNA, 495 bp, Staphylococcus epidermidis
gttaaagttgaaagaaggattattccaatgatatacagtttgactgaaattgaagcaagatatcaagaaaccgataaaatgggggttatctatcacggtaactacgcaacatggtttgaagttgcgagaacagactatataagaaagcttggcttcagttatgcctctatggaagaacaaggtgttatttcaccagttgtagatttaaaagtgcaatataaaaaatcaatttactatcctgaaaaggtgacagtaaaaacatgggtggaaaaatattctagattacgttcaacttattgttataaggtttataatgaaaatggagagttagctactactggttcaacagaacttatctgtattaaagcagatacatttaaacccatacgcttggatagatattttcctgagtggcatgagacttatagtaaagttaaccagttaaataaagaaggtaaagatgctgaggttacgtttggcattaatcatttataa

SEQ ID NO: 2380 - DNA, 495 bp, Staphylococcus epidermidis
aatcgaagtgaaaacatgacacaagaattaaaaagtaaattactttctttttttaaatttattttcgccactgctttatttatctttgtaatttttacactctatagagaattatcacatatcaattttaaagagacattcatacagttcggcaaaattaatagattatggctcgtactactatttgctggtgggggactgtcactcatcttattatcactgtacgatattattttagtaaaggctcttaaacttaaaatgccgttgattagagtctttagagtgagttatattatcaacgcccttaattctataattggttttggagggtttataggtgcaggcgtaagagcttttgtgtataaaaattatactaatgacacgaaaaaacttgtacaatatatttttattattttagtatctatgcttacgggattaagtttattatccattttagttgtcctgcgtatatttaatgcttcttcacatgattga

SEQ ID NO: 2381 - DNA, 2415 bp, Staphylococcus epidermidis
ggaggaaacgaattgagtgagataattcaagatttgtcacttgaagatgttattggtgaccgatttggacgttatagtaaatatatcattcaagaacgtgcattacctgatgtacgtgatggtttaaaaccagtacaacgacgtatactattcgcaatgtattcaagtgggaatacgtatgataaaaatttccgtaaaagtgcgaaaactgtcggtgatgtaataggtcaatatcatcctcatggagactcttcagtatatgatgctatggtgcgcttaagtcaagattggaagttacgtcatgttctaattgaaatgcatggtaataatggtagtatcgataacgatcctccagctgctatgcgttacacagaagctaaacttagtcaattatcagaagaactattaagggatattaataaggaaacagtatcatttattccaaactatgatgacacaactttggaaccaatggtattaccagcgagattccctaatttattaattaatggatctacggggatttcttcaggatatgctactgatatcccgccgcataacctcgccgaagtaatacaaggcacattgaagtatatcgatcaacctgatattacaattaatcaactgatgaaatatatcaaagggcctgactttcctacaggtggtatcattcaaggaatagaaggtataaaaaaagcgtatgagaccggtaaaggaaaggttgtcgtgcgttcacgagtagatgaagagcctttaagaagtggacgtaaacaattaattgtgactgaaattccgtatgaagtgaataaaagtagtttagttaaaagaattgacgaattacgtgccgataaaaaggttgatggtattgtagaagttcgagatgagactgatagaactggattacgaattgcaatcgaattaaaaaaagatgctaatagcgaatcaatcaaaaactatttatataagaattcggatttacaaatttcatataattttaatatggttgctattagtgaaggtcgccctaagttgatgggattacgtgaaattatagaaagttatttaaatcatcaaattgaagtggttacaaatagaacgcgttatgacttagagcaagctgaaaaacgtatgcatattgtggaaggattaatgaaagctttatctatacttgatgaagttattgcattgatacgtaattctaaaaataaaaaagatgctaaagataatttagttgcagagtatgactttactgaagctcaagcagaagctattgtcatgttacagctgtatagattaacaaatactgacattgaagctttgaaaaaagaacatgaagagttagaagctttaataaaagaattaagaaatatcttagataatcatgaggcacttttagcagtaattaaagatgaactaaatgaaattaaaaagaaatttaaagtggatcgactatctacaatcgaagctgaaatttccgaaatcaaaattgataaagaagttatggtgcctagtgaagaagtgattttaagtttgacgcaacatggctatataaaacgtacatctacacgtagttttaacgcaagtggtgtgactgaaatcggtttgaaggacggcgaccgtttattaaaacatgaaagcgtgaatactcaagatactgttcttgtatttacaaataaaggtagatatttgtttatacctgttcataaattagccgatatccgttggaaagagcttggtcaacacatatcacaaattgtgccaatagatgaagatgaagaagtggtaaatgtatacaacgaaaaagattttaaaaatgaagccttttatattatggctacaaaaaacggcatgattaagaaaagtagtgcttcacaatttaaaactactcggtttaataaaccactcataaatatgaaggttaaagacaaagatgaacttattaatgtcgttcgattagagtctgatcagttaattactgttctaacccataaaggcatgtcattaacttattcaactaatgaattatcggatacaggcttaagagcagctggtgttaaatcaattaatcttaaagatgaagactatgttgttatgacagaagatgtgaacgactcagattccataataatggttacacaacgtggtgctatgaagcgtattgattttaatgttcttcaagaagctaaacgcgcacaacgtggaattactttactaaaagaattaaagaaaaaaccgcatcgaattgtggcaggtgcagtagttaaagaaaatcacacgaaatatattgtattctctcaacatcatgaagaatatggtaatatcgatgatgtacacttatctgaacaatatactaatggatcatttattattgatactgatgattttggagaagtagaaagtatgattctagagtaa

SEQ ID NO: 2382 - DNA, 2028 bp, Staphylococcus epidermidis
ttaaaaatagatattaattgtagaagggaagacacaacgatgtttaatgaaaaagatcaattagctatagatacgatacgtgctttaagcattgatgcaatcgaaaaagcaaattcaggacaccctggattacctatgggagcagcacctatggcgtatactttatggacgcgccaccttaattttaaccctcaatctaaagatttttttaatagagatagatttattctatcagcaggtcatggttcggctttattgtatagcttattacatgtctctggtagtttagaacttgaagaacttaaacaatttacacaatggggttcgaagacgcctggacatccagaatatatacatactgatggcgtacaagttactactggtccattaggtcaaggttttgccatgtctgtacggatggcgttagcagaaagtcatttagcaggtaaatttaataaggaccaatttgatatagttaatcattacacttatgtattagcgtcagatggtgacttaatggaaggtatctcacatgaagctgcatcttttgcaggtcataatcagttagataaattaattgtcctttatgattcaaatgatatatctttagatggagatttatataaatcattttctgaagatacaaaacagcgtttcgaagcctatggttggaactatattctagttgaaaatggtaacgatttagatgagattgataatgcaatcactcaagctaaatcacaacaaggacctactattatcgaagttaaaactattatcggttttggttctcctaataaagctggttcaaatggagttcatggtgccccacttggtgaagaagaacgtgcacttacatttaaagaatatggattagatcctgaaaaacgttttaatgttcctgaagatgtatacgaaatatttaaatcaacaatgttaaaacgtgcaaatgaaaatgaagaggcttggaataatatgcttaaaaattatagtgaagcctatccggaattagctgaagaatttaaattagcaatgagtggtaagttaccaaataattacgctgatgccttaccagaatatgatttaaatcacagtggtgcttctagagctgattcaggagaaataattcaaaaattaagcgagtttgtaccttcattctttggtggatcagcagacttagcaggttcaaataaatctaacgttaaagaagctaaagattataataaagatactccagaaggtaaaaacgtatggtttggtgtacgtgaatttgcaatgggagcagcaataaacggcatggcagcacatggtggacttcatccatatgcagcaacattctttgtattcagtgattacctaaaaccagctttacgattatcatcaatcatgggactcaattcaacgttcatctttactcatgattcaattgctgtaggtgaagatggccctacacacgaacctattgaacaattagcaggtcttcgtgctattcctaacatgaatgttattcgtccagctgatggtaatgaaacacgtgtagcttgggaagttgcacttgaatcagaacacacaccaacatcattagtgttaactcgtcaaaatttaccaactttggatgttgataaacaaacagttgaaaatggtgtgagaaaaggcgcatatattgtttttgaaacagaacaacaacttgaatatttattattggcatctggatcagaagttaatttagctgtagaagccgcaaaagaattagagcaacaaggtaaaggtgtacgagttatttctatgccaaactggtacgcatttgaacaacaatcttctgaatataaagaatcaattttaccttctgatgttactaaacgtatagctatcgaaatggcatcaccacttggttggcataaatatgttggaattgaaggtaaagtcattggtataaatagttttggcgctagtgctcctggagatttagtagttgaaaagtatggattcactaaagaaaatattttaaaacaagtccgttcattataa

SEQ ID NO: 2383 - DNA, 699 bp, Staphylococcus epidermidis
tgtcagatagaggtatgcccaaaaggattccgaaatatgcatggattcggttctcataagtattctatgtataatgataaaggtgaacgtgtatgggtaaaatatcatttccgtacacaacaaggaattgaaaactatactgacgaggaagcagctaaaattgtaggtatggatagagattcttcacagagggatttatataatgctatcgaaaatggagattatccaaaatggaaaatgtacattcaagttatgacagaggaacaagctaaaaatcatccagacaatccttttgatttaacaaaggtatggtataaaaaagactatccactgattgaagtgggagaatttgaattgaatcgtaatcctgagaattattttcttgatgtagagcaggcagcgtttacgcctacaaatattgttcctgggttagattattcaccagataaaatgctacaaggacgtttattctcatatggagatgcccaacgttatcgtttaggagttaatcattggcagattcctgtcaatcaacctaagggagttggagttgagaacttatgtccatttagtcgtgatggacaaatgcgtttcttagataataaccaaggtggaggcccacattattatcctaataatcaaggtatatatgagtcacagcctgaacacaagaaacccaccattcccgacagatggtga

SEQ ID NO: 2384 - DNA, 900 bp, Staphylococcus epidermidis
aaggagcaagataatatgacacacatgtttgaaggcgttggtgtagcattagcgactccctttaccaataatgaggttgatttcaacgcattagaaagacatgttcaatttcttttaaataacaatattcaagcaattatagtgaatggcactacagcagaaagtcctacattaagtgacgaagaaaaagagaaagtattggcgacagtagttaaactcgtgaatcatagcgttcctgttattgcgggtactggcactaataatacgtataaatcaattcaagcttcaatacgtgctaaagaaattggtgcagatgcagtcatgttgattacgccctactacaacaaaacgaatcaacgtggtttaattcaacattttgagacaatcgcaaatgaagtgaaattaccagtaattctttacaatgtgccatcacgaacaaatatgacgatagaaccagaaacagttggaattctcagtcataatccatatatcgttgctttaaaagatgcgacaaatgattttgattattttgatcaagtaaaacaacgtattaatacaaatgaatttgcattatatagtgggaatgacgacaatgttgtgaagttctatcaacgtggaggtaatggtgtcatctctgtaattgcgaatgtaattccacaagaatttcaatatttatatgaccaaagacaaaatgaaaccgatattactaattactttaaacctatcgagaaattgttagaagcgttgtcacttgacgttaacccaatacctattaaagttcttaccgcatatttgggttatggtcactacgaagtgagattaccattagtgcctttagaagaagcacaatgtaaacaagttgaacgagcatttgaacaatttaaagcaggtgaacaataa

SEQ ID NO: 2385 - DNA, 780 bp, Staphylococcus epidermidis
aagttgaaacttttaacaataaaaaatctaaacatcaatgataaagaagggcaagcaattattaaaaatgtcgacttaaatatatataatcaatctctaaatgtcattataggtgaaagtggtgctggaaaaagtttgactgttaaagcaatattaaatcatttacctactcagttacatatgagtttcgatgaatttaaaatgcaaggtcaaaatacttctggtatcaagcaacttttaggtaaacatatcggctatatctctcaaaattatgctcaaagttttaatgaatatactcgtttggataaacaacttatagctatatatcgttatcattttaatgtttctaaggataatgcattgaaaaagataaaaaaagctttaacttgggttaacttaaatgatgaatcaatcattaataaatatagtttccaactttcaggaggacaattagagcgagttaatattgctagcgttttaatgttagatccagaattaattattgcagatgaacctgttgcatctttagatgtagtgaacggtcatcaaataatgcaactccttcaacacattgttaaagatcatcataatactgtattacttatcactcataacatgaatcatgtcctcaaatatgctgattattttaatgtaatgagaaatggcatgatgattgaatctggagaaatagacaaattatttaatcaccatcatcttcatcggtatacagaacaattattaaactatagaagcaagctgcaaaaggaggacaacatctaa

SEQ ID NO: 2386 - DNA, 204 bp, Staphylococcus epidermidis
aaaaatatttttatcaaaattcttcattcatattttttattctcaagatggaatgatatattcaaaatgaatcatggtccaatctattatttacatatgattatttttgacataactagcacgatcttgttgttcttgttcataacgttcagggttctttttgtagaaatcttgatggtatgcttccgcttcataaaaagttga

SEQ ID NO: 2387 - DNA, 588 bp, Staphylococcus epidermidis
aagtttattggaggtaactccatgatattaataatagataactatgattcttttacctacaatcttgtagatattgtagaaaaacaatgtgaaacgattgttaaatatcccgatgatacagatatatgtaatctgaaaggtattacagcagttattatttcaccaggacctggacatccattagacaatcaattattaattaaattaattgaaaatttcgaaaatttacctattttaggtgtttgcttaggtgcacaagcgctcacttgttattacggtggcgatgttatacaaggtagttgtgtcaaacatggaaaagtagatactttaactattgttaatcagtcaccactatacaaaggaattaagtcaagtttcaaagttatgcgttatcattcattaattagtgatccatgctcatttccagaaagtttattaatcactggccaaacatatgatagtatacaatctttccaacacaaaaacagaaaacattatggcatacagtttcatccagagtcattcgctacagaaaatgggaaacaaatcattattaattttataaatatagcaacgagaggaagttga

SEQ ID NO: 2388 - DNA, 1275 bp, Staphylococcus epidermidis
aacaagttcggcattccgaacttgttcttttttatactgtgtatgtctcctctaattataggaggactgaaattgaatagaagtgttttaaaatttggcggttcttccgtcagtgattttaaaaaaataaaaaatatcgctgaaatgcttaaaacacgcattgaagatggtgaagaattaatcgttgttgtcagtgctatgggtaagacaactgatcaattgatgaataatgtatcaagtcttacttctacccctaaagatcaagaacttgcattgctattaacaacgggtgaacaacaaacggtttcttacctttctatggtactcaatgatataggtgtaaatgctaaagcgatgacaggttatcaagctggcattaagactgtaggacatcacttaaaaagtaaaatagcagaaattaatcctaatatttttaatgaggcttttaaaaatcatgacattttagttgtagctgggtttcaaggtataaatgaagatttcgaacttactacacttggacgaggtggttctgatacaacagctgtagctttagcagcaagtaatcagacaccttgtgaaatttacactgacgttgatggtgtgtatgcaacagatcctagaatacataatgaagcgaagcgtttagaatatgtctcttatgaggaaatgatggaaatgagcgcgcttggtgcaggtgtacttgaaacgagaagtgttgaattagctaagaattatgatattccactttacttaggaagaacgttatcaaatgtgaaaggaacatggattatgtctaaaagtgatttattagagaaaaaagcagtaactggtgtcgcattggatacacacatgatgcacgtcacgataagttatcccctaccggataatcagttactgacacaattgtttaccgcattggaagaagaatctgtaaatgttgatatgatttctcaaattgtaaatttagaaggtttacaattatctttttcaattaaagatagtgatgcacatcaaatttcttcaattctggaaaatttatcaacacacttttcagcacttgattataaaattaatgaagcatatgtcaaaatatctttaattggatcaggtatgagagatatgtcaggagtagcatcaaaagcttttacgacacttatcaattcagatattccattttatcaaacgacgacatcggaaattagcatttcttatgtaatagacgaagaaaatggtgaaaaagcagtagaagaattgtatcatgccttcgaaatttag

SEQ ID NO: 2389 - DNA, 1812 bp, Staphylococcus epidermidis
atgagtgaaggtttacctttgagagaagaagttccggtaaaagaaacttgggatttgaaagatttatttacaagtgatcaagcattctatcaaacattggaacaagtagtacaaatgtctttagattttaatcatacatattatcagaaacttaataacatagaaacaatagaaaaggcattagatgaatatgaaaggatacttatagaaatagatcgtttatataattatccagaacttagattaagcgttgatacgtctaatgaagaagcacaaaaagttaacgcaaaacttaatacgacttctggaaaacttgctggtttattatcttttgttgattccgagattttggagttacccgatgagataataagcgaattgaggtctcaaacaaaataccctcattttattaaacaacttcaagatcgtaagccttatcaattatctgctgatgttgaaaaagtattagctacattaacaccaacattgagaagtccgtttgaattgtatggtactacaaagagtttggatattaattttgaatcgtttgattatgagggtgttacctatccattggattatgcaacatttgaaaatgaatatgaagatcatccatctcctgaatttagacgtaaaagttttagagcttttagtgatgcattacgacaatatcaacatacgacggccgcaacatataatatgcaagtccaacaagaaaagattgaagcggatttacgaggatatgattctgttattgattatctactacaagatcaagaagtaacaaaagatatgttcgatagacaaattgatgtcattatgagtgatttagccccagttatgcaaaagtatgcaaaaattattcaacgtgtacataacctggataaaatgcgatttgaggatttaaaaatttcaatagaccctaactttgaaccagaaatatcaattgaagaatcgaaaaaatacatttatggagcgctcaaagtacttggtgatgattatgtcaaaatgttagagtctgcctatgattaccgttggattgattttgctcagaataaaggaaaagatactggagcatattgtgcaagtccatacattacacattcatatgtatttatttcatggactgggaaaatggctgaaacattcgttcttgcgcatgaattaggacatgcaggtcattttacattagcgcagaatcatcaaaatttgttggaatctgaagcgtctatgtattttgtagaagcaccttccacaatgaatgaaatgttgatggcaaattacttatttaatagtagtaataatcctcgatttaaacgttgggttattggttcgattttatctcgaacttattatcataatatggttacccaccttttagaagcagcttatcaacgtgaagtgtatagccgagtcgacaatggagagtcattaactgccccactgctaaatgaaataatgttgaacacttataaagcatttttcggtgacactgttgaaatgacagatggggttgaattaacatggatgagacaaccacattattatatgggattgtactcatatacgtactctgctggattgacaattggtacagttgtatcacaatgtatcaagaaagaaggtcaacctgctgttgatcgctggttaaaaacgctacaagctggtggtagtcaatctccaattgaattggcgcaaatagctggcgttgatattacgactgacgcccctttaaaagagacaattaactatatttcaaatttagtagatgaattagaagtattaacatatcaaataaaagaaaattcataa

SEQ ID NO: 2390 - DNA, 900 bp, Staphylococcus epidermidis
aagaaaaagggccaattatctaaatcattagttaaaaaagcaattaaagctcaacaagcacgcgaggctgctcgtaaagctagagaagatgcacgctccggaaagaaaaataaacgtaaagatacattgttatcaggtaagttaactcctgcgcaaagtaaaaatactgataaaaacgagttatatctagttgagggtgattcagcgggaggttctgcaaaattgggacgcgaccgtaaattccaagctattttacctcttcgtggaaaggttattaatacagaaaaggcacgtttagaggatatttttaaaaatgaagaaattaatacgattattcatactattggtgctggtgttggtactgactttaaaattgaggatagtaattacaacagaattattatcatgacagatgctgatacggatggtgcacatattcaagtattattgcttacatttttctttaaatatatgaaaccacttgttcaagctgggcgtgtctttattgcgttaccgcctttatacaaattagaaaaaggcaaaggtaagaataaaaaagttgagtacgcttggactgatgaagaattagaaaatttacaaaagcaattaggaaaaggtttcatattacagcgttataaaggtcttggtgaaatgaatccagaacaattatgggaaactaccatgaatccagaaactcggacattaattagagttcaagttgaagatgaagttcgttcatcaaaacgtgtcactactttgatgggggataaggttgccccacgaagagagtggattgaaaaacacgttgaatttggtatgcaagaagatcaaagcattttggataataaagaagtccaaatactagagaatgaaaaatatattgaggaggaaacgaattga

SEQ ID NO: 2391 - DNA, 360 bp, Staphylococcus epidermidis
atattacttataggagcacgtgcaatgacaatatttgatatgccaaactatttgtggattaccattcttggtatgattttattaactgtattttacacacttgtattaaataaatggttccagtctgcaatcattacttttgtagttttagcagtacttgccttttttataccaaattttcaaaacatttcatatcaaccactgcttggatatgcaggattcttaggcataatgagcttaatcataagctttcttatttggtatttttctagaaactggagaaaaaatcgtagaaaaataaaattggaaaaagagattcgcaaatatgatgatgaagagtcacttcgtcgtcataaataa

SEQ ID NO: 2392 - DNA, 999 bp, Staphylococcus epidermidis
ctatttattatgacaagattagcagtagccggagcaaccggattagttggaacaaaaatgttagagacactagatcgaaaacaaataccttttgatgaattagtattattttcttctgctcgctcagcaggaaaaaaagttgaatttcaaggacaattgtatactgttcaagaattaactgatgaagcagcaagtgaacattttgattatgttttaatgagtgcaggaggtagcacaagtgagcactttgctccactatttgaagcggctggagccattgttattgataattctagccaatggagaatggctgaagatgtcgatttaattgttccagaagtgaatgagcctcaatttacacgtggtattattgctaatccaaattgctctacaattcaatcagttgtacctcttaaaattttacaagatgcatatggtttaaaacgtgtcgcttatacgacttatcaagccgtatcaggttctggtgttaaaggtaaaagagatttagctgaaggtgctaatggaaaagaacctgaagcatatccgtatccaatttacaataatgtattaccacatatagatgtttttcttgaaaatgggtatacaaaagaagaacaaaaaatgattgatgaaacgaaaaaaattctcaacgaccaagacttaaaagtgactgccacatgtgtacgtgtaccagtacaagatagtcacagtattgaaatcgatgtgactttaaatcaagacactacagttaaagagatacaagaattatttgcacaagatcaacgtgttgttcttgtagataatccaagtaaaaatgaatatccattagccattcattctactggcaaagatgaagtatttgtaggacgtatccgccgagatgactctcttgaaaatacgttccatgtatggtgtacctctgataatttgctcaagggcgcagcattaaatgcagttcaagtgttagaacaaattttaactttgaaaggagcaagataa

SEQ ID NO: 2393 - DNA, 1269 bp, Staphylococcus epidermidis
atgggagttatgaagatgaagtttacgaatttgacagctaaagaatttagtgactttactgatcgtatgacatatagtcattttacacaaatggaaggtaattacgaattaaaggttgctgaaggtaccgagtcacatttagttggaattaaaaataatgataacgaagtgattgcagcttgtttattaacagctgttcctgtaatgaaaatatttaaatatttttattccaatcgcggtccagtaatagattataataataaagagcttgtacattttttctttaatgaattgagtaaatatgtaaaaaaatataattgtttatatttaagagttgacccataccttccatatcaatatttaaatcatgagggagaaataactggaaatgcaggtcatgattggatttttgatgaattagagagtttaggatataaacacgaaggattccacaaaggatttgatcctgtattacaaatccgatatcattctgttctaaatttagcaaacaaaagtgctaatgatgttttaaaaaacatggatggtttaagaaagcgtaatactaaaaaagttaagaaaaatggagttaaagtccgctttttatctgaagaagagttacctatatttaggtcatttatggaggatacctctgaaactaaagattttgcagatagagaagatagtttttattacaacagattcaaacattataaagaccgtgttttagtaccactagcctatattaactttgatgagtatatagaggaactaaataatgaaagaaatgtgcttaataaagattataataaagctttaaaagacattgagaaacgtccagagaataaaaaagcacataacaaaaaggaaaatttagaacaacaactcgatgcaaatcagcaaaaaattaatgaagctaaaaacttaaaacaagaacatggcaatgaattacccatctctgctggcttctttataattaatccgtttgaagtagtttactacgctggtggaacttcaaatcgttatcgccattttgcagggagctatgcggttcaatggaagatgattaactatgcaattgaacatggtattaatcggtataatttctatggtattagtggtgactttagtgaagatgctgaagatgctggcgtagttaagtttaaaaagggctatgatgccgatgttatagaatacgttggtgactttattaaacctattaataaaccaatgtataacatttatagaacacttaaaaaactaaagaaatag

SEQ ID NO: 2394 - DNA, 792 bp, Staphylococcus epidermidis
gtaatgactattttaaatgaaattattgagtataaaaaaactttgcttgagcgtaaatactatgataaaaaacttgaaattttacaagataacggaaatgttaagaggagaaagctgattgattcacttaactatgatagaacattatcagttattgctgaaataaaatcgaaaagcccatctgtacctcaattaccgcaacgtgatcttgttcaacaagttaaagattatcaaaaatatggtgctaatgctatttcaatattaactgatgaaaaatactttggcggtagttttgaacgattaaatcagttatcaaagataacatcgttaccagttttatgtaaagattttattattgataaaattcaaatagatgttgcaaaacgagctggtgcatctattattttattaatagtaaatattttaagtgatgaccaattaaaagaattgtattcatatgcaacaaaccataatttagaagctctagtagaagttcatacaattagagaacttgaacgtgcacaccaaattaaccctaaaattattggtgttaataatcgtgatttaaaacgatttgaaaccgatgttctacatacaaataaattacttaagtttaaaaagtctaattgctgctacatttcagagagtggcattcatacaaaagaagatgttgagaaaatagtagattcaagtattgacggtttacttgtaggggaggcattaatgaaaacaaatgacttaagtcagtttttgcctagtttaaagttaaagaagaatctctatgatagttaa

SEQ ID NO: 2395 - DNA, 405 bp, Staphylococcus epidermidis
aatatttatatgttgtataatcagaaatatattttaaaagaagggttatgctttatgttaaaagaatttaaagagtttgcactcaaaggcaatgttttagacttagctattgctgtagttatgggagcagcgtttaataaaatagttacatccctagtccaatacatcatcatgccattaattggtaaattatttggttcagttaattttgctgaagattggtctttttgggggattaagtatggacttttcatacaatcaataattgacttcatcataattgcttttgctttatttatctttgttaagatagctaatacagttatgaaaaaagaagagaaagaagaagaagtagaagaaaatactgttttattaacagaaattagagacttgcttaaaaaataa

SEQ ID NO: 2396 - DNA, 1497 bp, Staphylococcus epidermidis
atatattatattctgctaataaaggtggtaccgcgcgtcagcgtccttataacgaaggaggctgatttttttcggaaaaggaggaaatcaatggatattgtatacaaaaaggtgaatgctcaaattacgccagaagctttagcaaaattaaaacaaaaaaagatcatttttgaaagtacaaatcaacagaaacttaaaggtaggtactcgatagtagtattcgatcattatggcaaaattacattagataattctcaacttttaattaagttagacaatcattgtgaaatagttaagaatcaaccgtatcaacgacttaaggaatttgtagataaatattattttgaaatcaaagataaatatttaaaagatttaccttttatttcgggctttatagggacatgtagctttgatttagtacgacatgaatttaaaaaattacaagatattaaattagaagatcatcaaactcatgatgtccaattttatctagtggaagatgtatttgtttttgatcattataaagatgaattatatattatcgcaagtaacttattttctgatagaacaaaagagagattaaaggaatctattgaacgtaaaattgaagatttaaaaaacatacatttttcggttgaggatataaattataaatccatccctcgacatataaccaccaatatatcagagcaacaatttgttcaaactattagaattttaaaaaagaaaattactgaaggagatatgtttcaagtagttccttcaagaatttatagttataaacaccattttcaacacaatttacatcaattaacttttcagttatatcaaaatttaaagcgacaaaatcctagtccatatatgtattatattaataaagatgtaccgattgtaataggaagttctcctgaaagttttgtaaaggtaaaagatggaaaagtttatacgaatcctatagctggaacaattaaaagaggtcaaaataaaaaagaagatgaaaataatgaaaagacattaatgaaagatgaaaaggaattgagtgaacatcgtatgctcgtagatttaggaagaaatgatattcatcgaataagtaaaacaggcacttcacaaattaccaaactaatgacaatagaacgttatgaacatgtcatgcatatcgttagtgaagttattggagaattaaaaccccatctatctcctatgagcgtcatcgcaagtttgctaccaacgggtactgtctcaggtgcacctaaacttagagctatacagagaatatacgaatcttatccttataaaagaggtatctatagcggtggtgttgggtatatcaactgtaatcatcatttagattttgcattggctatacgtaccatgattatcgatgaggaaaaagtcagtgtcgaggcaggatgtggagtagtatatgattctattccagagaaagaacttgaagaaacaaaacttaaagctaaaagtttattggaggtaactccatga

SEQ ID NO: 2397 - DNA, 1176 bp, Staphylococcus epidermidis
aaaaagcatatagaattaaaacgaacaaacgttcttatcaggaggataattatgaaaattgtacataccgctgattggcatctgggtaaaattttaaatggaaaacaattgcttgaagatcaaaaatatattttaactcagtttaaacaacatatggagaaagaacagccagatttaatagtaattgcaggtgatttgtatgatacctcatatccaagtaaagaagcgataggtttacttgaagagactattgaatacctaaatatagaacttaaaattccaataatcatgataagcggtaaccatgatggtagggaaagattgaattatggctctaaatggtttgagaataatcaactttacataagaactcaactagaaaatattgatgatccaatagaattgagtggtgttcaatttttcactttacctttcgcaactgtgagtgaagtacaaaattattttaaagataagcaaatagaaacatatcaacaagcattaaacgaatgcttagagcaaatgtctagttccatagataataataaggtgaatatattaattggtcatttaactattgagggcggtaaaacttcagattcagaaagaccattaactattggaacagtagaatcagttgatatgcattcttttcggttgtttgattatgtaatgctcgggcacctacatcatccatttagtataaataactcttttatcaaatatagcggttcgattttgcaatactctttctctgaagtaaatcaatctaaaggatatagagttcttgatattgaaaacaaccaactattaaatgaaaccttcgttcctttaaaacctctaagagaactagaagttattgaaggtgattatgaggatattattcaagaaagaattaaagtaaaaaataaaaataattattttcattttaagttaacgaatgtttctcatattactgatccaatgatgaaactgaaacaaatttatcccaatatattagcactatcgaatgtagtatttgatcatagtgagaattttagccatgttgaaatcaaaaaacaagatgatcagacaattatagaaaatttttataaaaatatgacagatcaacatctgagtcaagttcaatcagacaaaataaagcacttgttaagttttatattggatagggaggggtaa

SEQ ID NO: 2398 - DNA, 1026 bp, Staphylococcus epidermidis
gtgaatacaattaaaagatttcttttattgattacagttttactttgcatcgttatttttacgccagtcaaagaaactacttttatgattaaagctcaaaatgatatacgtcatcaaattaatcgatggattgattctgattcaaatgacgataatactcaattagcgattcctaaaaagcaagaatttgcaatcaacaatatacagatgaatatgactaaaaaagatgttgaagcacaattgggacaacataagcgtatgacttcgagtgtgtatggcacaaattggtacacatattattcaaatgattataatcaatttttgatggtgagttatattaacaatcatgttaatgcactgtatacaaatcaaaatcttatttcatcaaaatctcaaattaagtatgatactcctaaagatgttgttagggaaagatatgggcccccgattcaagttataaaaaaagggaaagttggttttgatgtaaaaagtaatgaatatgatgttttccataaagaccatatttataccacagtattttatgataagcacagagataatggtgtgaagtcattattacaagttagtgagaaaatggaaaatcgattaagatatcaatatgggaaaccatctaaattacttgcaaagagttttgagttgcaaaattttgacattgtcaatgctgaaagaaaacagcatggcttaaaaacattagattattctaaggatgtttctcatactgcgcgtaagcatagtgttgacatggttaagcataattattttgaccatgtaaatcaaaagaaactttctccttttgatagattaaaaaaagatggaatagaatttaatgctgctggagaaaacttagcatatggacaattgaatagtatctatgcacatgaaggtttgatgaattcattggggcatagaaagaatattttaaacacccattttgattatttgggcgtaggtgtatatttcaatgatcgaagacaacccttttggaccgaaaattatacaagttaa

SEQ ID NO: 2399 - DNA, 1212 bp, Staphylococcus epidermidis
ttaatgaaaattcaaacagaagtagatgaattgggctttttcggtgaatatggtggccaatatgtacctgaaacattgatgccagctattattgaacttaaaaaagcatatgaggacgcgaaatcagatactcacttcaagaaagaatttaattattatttaagtgaatatgttggtagagaaacgcctttaacatttgctgaatcatacacaaaattgttaggtggtgccaaaatatatcttaaaagagaagacttaaatcacactggtgctcataaaattaataacgcgataggacaggcactattagctaaaaggatggggaaaactaaattagtagccgaaacaggtgctggtcaacatggtgtagcaagtgccaccatcgctgctttattcgatatggatcttattgttttcatgggaagtgaagatatcaaacgtcaacaacttaacgtatttagaatggaattgctaggagctaaagtagtgtctgtgtcagatgggcaaggaacactatcagatgctgtaaataaagctttgcaatattgggtgaatcatgtcgaggatacacattatttattaggctcagcgttgggacctgatccgtttccaactatggtcagagattttcagagtgtgattggtaatgaaattaaaagccaaattttaagtaaagaaggacgatttccagatgcgttagtcgcgtgtgttggtggaagatccaattcaataggtacgttctatccatttatacaagatgatgttaaattatatggggtagaagctgcgggaaaaggaagtcatacgcataatcatgctttagctatagggaaaggtaaaccaggtgtattacatggttccaaaatgtaccttattcaaaatgatgatggacaaattgaattggcacactctatatcagcgggactagattatccaggtattggacctgaacattcgtattataatgatattggtcgtgtatcatatgtaagtgctacagataatgaagctatggaagcacttataacattctcaaaagttgaaggtatcattccagcaattgaaagtgcacatgcattgagttatgttgaaaaattagcgccaaatatggatgaaaaagaaattattgttgtgactatttcaggtcgtggagataaagatatggaaacaattaaacaatacaaagaaaacggtggtgaacaaaatgagtaa

SEQ ID NO: 2400 - DNA, 1152 bp, Staphylococcus epidermidis
atacttgaaatgactcatatacaatattgttattctgaaaattctgaaacaaggaggcgctctatgcgaaatattttatttgtagggttaggccttattggcggtagcttggcgagtaatttaaaatatcattacagtaatttcaatattcttgcatacgattcggactacacacaacttgatgaagccctttctataggtattattgatcaaaaagttaatgattatgctactgctgttgagatagcggatataatcatctttgcaactcctgttgagcaaacaattaaatatctatctgaacttacaaattacaatacaaaaactcatttgattgtaacagacacaggtagtaccaaacttactatacaatcattcgaaaaagaattattaaaacatgatattcatttaattagtggtcatcctatggcaggaagtcataaatctggtgttttaaacgcgaaaaaacatttatttgaaaatgcttattacattcttgtatttaatgaaatcgaaaataatgaagccgcgacatatttaaagaaattacttaaacctacgttagcaaaatttatcgttactcatgcaaatgaacatgatttcgtaaccggtatagtgagtcatgttccacatatcatcgcttcaattttagttcatctaagtgctaatcatgtcaaagaccattctttaatcgaaaaattagcagccggtggctttagagatataactcgtatagcaagtagtaatgctcagatgtggaaggatatcactttaaataatcaaaatcatattttatctttacttaacgagattaaagaacaaattactggtattgaaaatttgatacgagaacaaaatagtaatagtatttacgatttcttcgttaaagctaaagattatcgtgatcaacttcctgttaaacaacacggtgcaatatctactgcgtatgatctttatgttgatatccctgataagccgggtatgataagtcaaattacaaacatcataagttcacataatatttctattataaacttaaagattttagaagtacgggaagatatttatggagctttacaaatcagttttaaaagtcccgaagatcgagagaatgctataaaagccctcgcaaattttgatacttattattaa

SEQ ID NO: 2401 - DNA, 204 bp, Staphylococcus epidermidis
caaaggagaatgttgattatgccaatcattaatgtgaaattattagaaggccgttctgatgaacaacttaaggatttagttacagaagtcactcatgctgtagaaaaaactacaggtgcaaataaagaagcgattcacgtggtcattgaagaaatgagaaaagatcattatgctgtcggtggcgtaagaaaatctgatcagtaa

SEQ ID NO: 2402 - DNA, 615 bp, Staphylococcus epidermidis
gtttttatgatgatcatcgtcatgttaatcttgagttatctgattggtgcattcccaagcgggttaattattggtaaattattttttaaaaaagatataagacaatacggtagtggaaatactggagcaactaacagttttcgtgttcttggaagaccagctggatttatagttacgtttttagatattttcaagggatttattacagtcttttttccactatggttcccagttcatgcggatggtgttataagcaccttctttacaaatggtttaatagtaggattgtttgcaatactcggtcacgtgtatccaatatatctgaaatttaatggcggaaaagcagtagctaccagtgcaggagttgtattaggtgtcaatcctattttacttcttatcttggcaattatcttttttagtgtattaaaaatctttaaatatgtttctttatcaagtatcattgcagcaattagttgtgtgattggttcaatcatcattcatgattatattttacttgctgttagcggaattgtttcaatcatattaataattcgacacaaatctaatatagttagaatttttaaaggagaagaacctaaaattaaatggatgtaa

SEQ ID NO: 2403 - DNA, 240 bp, Staphylococcus epidermidis
tattggatgattttaaaatacaaatataaatttttaacatatatgacaatagtcatagtatgttgtattattttttcaaatttctttttaagcgttaaccaaggtgttcaatcagaacaaacgtacgaaatgactgaccacaagattcatcaacataatcaacaaggaactactcaaaactataaagacaaacaaaatagcgaacagaatgatcagtctgtgttcgcattagttaattaa

SEQ ID NO: 2404 - DNA, 1470 bp, Staphylococcus epidermidis
gagggattcgttttgcaagattttgataacttaattcctggctggtttaaaacatttgttcaagtcgggaatgacttaatttggtctcaatatcttattggattattattaacagcaggttttttctttacaattagttctaaatttattcaactcagaatgttaccagagatgtttagagcattaactgaaaagccagaaactttaagtagtggtgagaagggtatttcaccatttcaagcttttgcgattagtgctgggtcaagagtaggaactggaaatattgccggtgttgcaactgctattgttcttggtggccccggtgcagtcttctggatgtggattattgcttttattggtgcagctagtgcatttatggaagcaacgcttgctcaagtttataaggtacatgacaaagaaggtggattccgtggcggaccagcctattacataacaaaagggctaaaccaaaaatggcttggaattgtatttgctgttttaattacagttacatttgcttttgtatttaatactgttcaagcgaatacaattgctgaatcattaaatacacaatacaatattagcccggtaattactggaatagtacttgcagttattacaggtattatcatctttggtggtgttcgtagcatagctacactatcttcacttattgtgcctattatggctattgtttatataggtatggttttaatcattttattactcaatatagatcaaattgtacctatgattggcactattattaaaagtgcattcggagttcagcaggttactggtggtgctgtaggagctgctattcttcaaggtattaaacgtggtttattctcaaacgaagctggtatgggatctgcacctaatgctgctgctacatctgctgtgccccatcccgttaaacaaggtttaattcaatcattaggtgtattctttgacactatgcttgtttgtacagctacagcaattatgattttattatattctggtttgcaatttggtgatagcgcgcctcaaggtgtagcagttacgcaatcagcgttgaacgaacatttaggttcagcaggaggtattttcttaactgtagcagttaccttatttgcattttcatctgttgtaggtaactattactatggacaatccaatattgaatttttatctaacaataagatgatattatttatttttagatgttttgtagtacttttagtatttgtaggtgctgttgctaaaacagaaacagtttggagtactgccgatttatttatgggtcttatggcaatagtaaatatcatatcaattataggtttgtcgaatattgcgtttgcagtgatgaaagattatcaaagacagcgtaaagaaggtaagagacctgtgtttaaacccgaaaacttagaaataaatttatttggcattgagacttggggacaacatgcaaaaatgccaaaaaaatag

SEQ ID NO: 2405 - DNA, 1155 bp, Staphylococcus epidermidis
cgaacgtacgtttgtaggagggcgaaatcattggcaatgaataaacaaaataattattcagatgattcaattcaggtacttgaaggactagaagcagttaggaagagacctggtatgtacattggatcaactgataaacgaggattacatcatcttgtatatgaagttgtcgataactccgtcgatgaagtattaaatggttatggtgatgcgattacagtaacaattaatcaggatggtagtatttctatagaagataatggtcgaggtatgccaacaggtatacatgcgtctggcaaacctactgcagaagttatatttactgttttacatgctggaggtaaatttggacaaggaggttataaaacatctggaggtctccatggggtgggtgcttctgtagtaaatgcccttagtgaatggcttgaagttgaaattcatagagatggtaatatctacacacaaaatttcaaaaatggtggtattccagcgacaggtttagtaaaaactggaaaaacaaaaaaaactggtactaaagttacatttaaaccagactcagaaatatttaagtcaacgacgacttttaattttgatattttaagtgagcgtttacaagaatctgcatttttacttaaagatttaaaaattacacttactgatttacgtagtggaaaagaacgagaagaaatttaccattacgaagaaggaattaaagaatttgttagttatgtcaatgaaggtaaagaagtattacatgatgttactacatttgcagggcattccaatggaatagaggtagacgtagcattccaatataatgatcagtactctgagagcatattaagttttgtaaataatgttcgtacaaaggacggaggtactcatgaagttggtttcaaaacggcgatgactcgtgtttttaatgaatatgcacgtcgtataaacgaactgaaagataaagataaaaatttagacggtaatgatatacgcgaaggtttaacagcgataatttcagtacgtataccagaagaacttcttcaatttgaagggcaaacgaaatcaaaacttggcacttcagaagcaaggagtgctgtagactctgttgtttcagaaaaattaccatattacttagaagaaaaagggccaattatctaa

SEQ ID NO: 2406 - DNA, 438 bp, Staphylococcus epidermidis
attgaactagttaaacttagagatgatgttggtgaactaccagcagctaaagaaacgatcattgtttcacctattgctcttgatatacctaatacaattgaagcaacaacgccagaagtcgcagctggtaatacaacttttgtagcgacttcaaatttagttgcgcctaatccaaatgcaccttcacgaattttatcaggtacagatgacattgcatcttcactcatacttgtaatcatagggacaatcattatacccacaacaataccgggactgattgaattaaactctcccaagttaggaattagatttctcaatataggtgtaacaaatgtcaaagcaaagaagccaaatacaattgtaggaatcccagccaaaatttctaatattggtttaatgattctacgtgaacgatcagatgcatattcattaaggtag

SEQ ID NO: 2407 - DNA, 1608 bp, Staphylococcus epidermidis
atgttacaagtaactgatgtaagtttacgttttggtgatcgtaaactatttgaagatgtaaatataaaatttacagagggtaattgttatggattaattggtgcaaatggtgctgggaaatctacattcttgaagattttatcaggcgaaattgattcacagactggtcatgtatctctaggtaaagatgagcgtttggctgtgttaaaacaagatcattttgcttatgaagatgaacgtgttttagatgttgtgattaaaggacatgaacgtttgtatcaagtgatgaaagagaaagatgaaatttatatgaaacctgatttcagcgatgaggacggtattcgcgctgcagaacttgaaggagaatttgcagaaatgaacggttggaatgctgaagctgatgctgctaacttattatcaggattaggcatagaacctgacttacatgataaaaatatgtctgaacttgaaaataatcaaaaagttaaggtattgttagctcaaagtttatttggtgatcctgacgttcttttactagatgagcctaccaatggtttagatataccagcaataagttggttagaagactttttaattaattttgaaaatactgtcattgtcgtttcgcatgaccgtcacttcttaaataatgtttgtactcatattgctgatttagactttggcaaaattaaactttatgttggtaactatgatttttggtatcaatcaagtcaattagcacaaaaaatggcacaagaacaaaataagaaaaaagaagaaaaaatgaaagagttacaggatttcatcgcacgcttctcagcaaatgcttctaaatctaaacaggcaacaagtcgtaagaaacaattagaaaaaattgaattagatgatatccagccatcatctcgtagatacccttacgtgaaatttactcctgaacgtgaaattggaaatgatttacttacagtagaaaatctttctaaaacaattgacggcgaaaaagtactagacaatgtttcattcactatgaatcctaatgataaagctattttagttggtgatagcgaaattgctaaaacaacattgttaaaaattttagctggagaaatggaaccagatgaaggtacatttaaatggggtgtaacgacatctttaagttacttccctaaagataactctgagttctttgatggtgtcgatatgaatttagttgaatggttacgtcaatacgctccagaagatgaacaaactgaaacatttttacgtggtttcttaggtcgcatgttatttagtggtgaggaagttaagaaaaaagcaagcgtgctttcaggtggagaaaaagtacgttgcatgttaagtaaaatgatgttatcaagtgctaacgtacttttacttgatgagccaacaaaccatttagatttggaaagtatcactgctgtaaatgacggattaaaatcatttaaaggttctatcatcttcacttcttatgattttgaatttattaatacaatcgcaaatcgagtgattgacttgaatcaagctggtgccctttctaaagaagtaccttatgaggaatacttacaagaaattggtgtattacaaaataattaa

SEQ ID NO: 2408 - DNA, 744 bp, Staphylococcus epidermidis
atcaaaggagttattcaacttatggtacaacatttatcagctcaagaaatcattcaatatattagtgatgctaagaaatcaacaccactcaaagtttatgtaaatggtcattttgaaaatgtcacattcccagaatcttttaaagtttttggctctgaacattcaaaagtaattttctgtgaagcagatgaatggaaacaattttatcaacaaaatcattcattaatcactgaattagaaattgagatggatcgtcgtaattcagctataccgcttaaagatttaacaaacacaaatgctcgtattgagccaggtgcgtttattcgtgagcaagcaatcattgaagatggtgctgtggttatgatgggtgctacgattaatattggagctattgtaggagaaggaacaatgatagacatgaacgcaacacttggtggacgagctacaacaggaaaaaatgttcatgttggtgcaggtgctgttttagctggtgtcattgaacctccaagtgcttccccagttgtcattgaagacaatgttttaattggagcaaatgctgttattcttgaaggtgtacgcgttggtgcaggtgctattgtagcagctggagctattgtaactcaagatgtgccagctggagctgtagttgctggtacgcctgctaaagtaattaaacaaacttcagaagttcaagactcaaaacgtgagattgtgtctgcactgcgtaaattaaataatgaataa

SEQ ID NO: 2409 - DNA, 801 bp, Staphylococcus epidermidis
ctatttcaggtcgtggagataaagatatggaaacaattaaacaatacaaagaaaacggtggtgaacaaaatgagtaaattattcattccgtatattatgggtgatttaaattttattcatcatttaaaaacattaactgagaatggagcagacattgttgaaattggtgtgccattttctgatcctgttgcagatggacctataatcatgaaagcagggcgcaacgctattgacgagggttcaaacattaaattcatttttgatgaattaataaaaaataaaaatactatttcatctaagtatgtattaatgacttattataatattctaagtgcttatggagaagaattatttttggataagtgtgatgaagctggtgtttatggtttaattattccagatttaccttacgaacttacaaaaaagtttaaaaaagatttttatcatcattctgttaaaataatatcgttaattgccatgaccgcaagtgatgctaggattatgcaaattgcaaagaactcagaaggatttatttacacggtaacaatgaatgccacaacaggtaacagtggggagttccatccagatttaaagagaaaaattgaatatataaaaaaagtttcaaaaattcctgtggttgctggatttggtatcaaaaatcctgaacatgttaaagatatagcgtccgttgcagatggtattgtaattggtagtgaaattgtaaaacgtattgaaatagattcaagaaaagaatttatcacttatatcaaatcaataagaaccacgttgaattctttataa

SEQ ID NO: 2410 - DNA, 681 bp, Staphylococcus epidermidis
tttgaagaggtgtatatattcatgagtaaaaaagttttatttgttttaacaagtacaagtcaatttacagacggtacagaaactggattatggttagaagaagctggagcaccatataatatattgactgaagaaggtatcaatgttgatgttatttctattaaaggtggaaaagtaaatcttgatcctaattctgtttctaatgaatcactgaatcagtatgctaaattcgtgtcacacttaaacgatacacctagtatcgaaaatgtaaatgcagatgagtatgacgctatttatctaccaggtggacatggtactgtatacgattttgccaataatgagaaattagctgatattttacttcaatttaaaaatagtaataaaataatctcttcagtatgtcatggacctagtgcgtttgtaggtgtaaaagatgcaaataatcactatctagtagatggtgtcaaaataacttcatttactgatagtgaagaaaaagcaatgggatttgaaaataaagtaccatttttaactcaatctaaattagaagagcaaggtgcaaattttgtagtgaaagatgactttacatctcacgtagaaaaagacggtcaatttatcactggacaaaatccccaatcaagtgaagacattggtaaagcacttgcaaatgaattaaaataa

SEQ ID NO: 2411 - DNA, 246 bp, Staphylococcus epidermidis
ttattggtattcctctatacgctgtacttaaggtattggtttcacacatatttatgttatttaaacgaagatacaatcgctactatggaaatgatgctggtgagtacattatcactgaagaagaaaaaggaattaaacaataatatatataattttagactggaacaacaaaacaacaatgttccagtcttttttatttttaaatcacatacatttgcaatcatgatatgcttagtaatcatatga

SEQ ID NO: 2412 - DNA, 642 bp, Staphylococcus epidermidis
  unsure (12),(13),(14),(15),(16),(27),(36): Identity of nucleotide at the above locations are unknown.
ccaaataaattnnnnnggtgcctgctngaggagaancttgctgggtcggcccacgatggaaaattaactggactttttggtgcgccagtttcggatagagaaaatagtatgacagcaggacaacgtggaccattattaatgcaagacgtttattatttagaacaaatttctcacttcgatagagaagtgattcctgaacgtcgtatgcatgcgaaaggttcaggtgcatttggtacgttcacagttacaaatgacatcacacaatatacaaatgcgaaaatattctcagaagtcggaaaacaaacagagatgtttgcacgtttttctactgtttcaggagaacgtggagcagcagatttagaacgtgatatacgtgggtttgccttgaaattctacactgaagatggaaactgggatttattaggtaacaatacgccagttttcttctttagagatcctaaactatttattagtttgaatcgtgctgtaaaacgagatccacgtacaaatatgagaagtgcacaaaataactgggacttttggacaggtctaccggaagcattgcatcaagtgacaatattaatgtcagatagaggtatgcccaaaaggattccgaaatatgcatggattcggttctcataa

SEQ ID NO: 2413 - DNA, 2049 bp, Staphylococcus epidermidis
ttgatgaaattttcgtgggtacgttggattttatatattgttgcattatttttaccaatttttattttttataccgtcgcacgacctgtagatagaaataatcgtaatatgggtgtgtattgtacagttgtatcatgtgttgagtggatggcagcagctactgtattatattttgctgcattgattgtcgatatacatatctcatttatgacttttgtacgtatatttgttattgcagctttatctggtttagttagttttattccaggtggttttggcgcgtttgatttagtcgtgttactaggactgaaatcacttggtatttctgaagaaaagatacttctagcattagttttatatcgatttgcttattattttgtgccagtgatgattgcacttatactatcttcatttgaatttggaaatactgctaaaaaatatctcgacaattcgaagtactttatacctgtaaaagacttcacttcatttttgaggtcttatcagaaagatattttagctaaagtgccttcattttcgttagcgattttaatatttttaactagtattattttctttattaataatttaactattgtctatgatggattgtatgatggaaatcattttgcctattatattgctttagctgtacaaacgagtgcttgtttgttacttattttaaatgtaagaggtatttataaaggcagtcgtcgtgcaataatttatgcctttatttctattattttaattgctagtgcgactatatatacttatgcgtcatttttattattgtcatggctcattatcatatttgtgttactgattttagcttatcaacgtgctcaagtacttaaacgaccattacgctttaaaaagttggcggttatgctacttcttagtatctttattctttatttaaatcatattttaatatcaggaactttatatgcattagatgtttatcatattgagattgatacgtctttattacgatattacttttggatgaccattgttattattatgctactcgttggcgttattgcttggctttttgactataagtataaatgccctcatcatagcattgatttaacactttgcgatgcaattattcaaaaatacggtggtaattatttaagtcaccttgtttatagtggtgacaaagattgtttctttaatgaaaataaagattcatttattatgtatcgatataagtccaatgcccttgtcgttttgggtgatccaattggcaatactaaatcattcgagtcattattagaagcattttatcagtttgcagagtatcaaggttatgagattattttttatcaaataagtgatcaatatatgcctttatatcataattttgggaatcaattcttcaaattaggtgaagaagctattattgatttaacaacgtttacaacatctggtaaaaagcgacgtggtttcagagcgacgctcaataaatttgatgatttaaatatcaattttgaaattattgaaccaccatttactcaagatttctttgatgaacttaaatttgtgagtgataaatggttggatggaagaagtgaaatgcatttttctgtaggtcaatttactcaaacttatttatcgaaagcacctattggagtaatgagagatcactctggcaagatgattgcattttgtagtttgatgcctacttattctaataatgcaatatctgttgatttaattagatggttgcctgaattggatttacctttaatggatggattatatcttcatatgttgttatggagtaaagaaaaggggtataaagcatttaatatgggaatggcgacactctcgaatgtaggtcaattgcattattcttatttaagagagagaatggcaggacgtgtatttgaacatttcaatggtttataccgttttcaaggattaagacgttataaagaaaaatatagccccaattgggaacctagatttttagtttatcaaaagcattattctctgtgggagagtatgcttaaagtgatgagagtcatacgccataaataa

SEQ ID NO: 2414 - DNA, 204 bp, Staphylococcus epidermidis
tcatatatttcactttgtcgcttagtgagttctctcataaataggcactccttattgttgtttgagattattatatcattaattacattttctaacacacatttgttcgtaatgttgttgacacagaatttatgttctgataaattacttatacaaacaaatgttctaggagtgatattggatgattttaaaatacaaatataa

SEQ ID NO: 2415 - DNA, 471 bp, Staphylococcus epidermidis
gaggatgtttcaatgaaaaagtggcaattagtcggtactactgtattaggagcttcggttttacttggcgcttgtggcggaaatgatggaggttcaggagacggcaaagatcttaaaggttctgctaaaggtgaaggttcgtccacagtagctcctatcgttgaaaaattaaacgaaaaatgggctaaagatcataaagacgccaaaatttcttcaggtcaagccggtacaggtgctggtttccaaaaattcattgctggcgaaactgatttctcagacgcttcaagacctattaaagacgaagaaaagaaaaaattagaagataaagggattaaatatcacgaattcaaaatcgcacaagatggtgtaacaattgcggttaataaagataacgactttgttaaagaattaactaaatcacaattaaaagatatttactctggtaaagctaaaacatggaaagaccgttaa

SEQ ID NO: 2416 - DNA, 207 bp, Staphylococcus epidermidis
attcagacatcctcgtggcttaatataagaaaagtaatagctcaacgagctgaaaatcatcaaaaaaattataaaaaagacaattcctatattatttcaatagaaattgtctttatttacttattttggaactttttgttccaggctttccacatctatatagatattgatttaattataattacaatgtttgtaggaattaaatga

SEQ ID NO: 2417 - DNA, 996 bp, Staphylococcus epidermidis
gaggttaaatcattggtgaaaagtggcaaagcacgagcacatacaaatattgcgttgattaagtattgggggaaagctgatgaaacttacattattcctatgaataatagtttatcagttaccttagatagattttatactgaaacaaaagtgacatttgaccctgattttactgaagattgccttattttaaatggtaatgaagtgaatgccaaagagaaagaaaagattcaaaactatatgaatatagtgagagatttggctggaaatcgtttgcatgcgcgaattgaaagtgaaaattatgtgccaacagcagcaggacttgcttcttcagcgagtgcttacgctgctttagctgccgcttgtaatgaagctttgtcattgaacttatcagatacagacttatcacgattagctcgacgtggttcaggttctgcttctagaagtatttttggtggatttgccgaatgggaaaaagggcatgatgatttaacttcatatgcacatggtattaattccaatggttgggaaaaagatttatcaatgatatttgtagtgattaacaatcagtcaaaaaaagtatctagtaggtcaggaatgtcactaacaagagatacttctagattttatcaatattggttggatcacgttgatgaagatttaaatgaagcaaaagaggcagtcaaaaatcaagattttcaacgcttaggagaagtcattgaagcaaatggtttacgtatgcatgccactaacttaggcgctcaacctcctttcacgtatttagtgcaagaaagctacgatgctatggcgattgtggaacagtgtcgaaaagccaatttaccttgttactttacaatggatgcgggtcccaatgtaaaagttttagtagaaaagaaaaataaacaagctgtgatggaacaatttttaaaagtatttgacgaatcgaagattatagcaagtgatatcatcagctctggcgttgaaattattaagtaa

SEQ ID NO: 2418 - DNA, 273 bp, Staphylococcus epidermidis
acgcataaatctttgaggaggatacaatatatgactaaaaacacattaaatgacttaaacaatcatttatttgcgcaattagaaagattaagcgatgaagaattaaaaggcgaagaattacaagaagaattgaatagatctaaagcagtttctgatgtagctaaaaacattgtgagtaatggaaacctaattttacaagcgcataagtttaaagatgagcaaatgaatgctgacgctaaattacctaaaatgttggaaaacaaagaaaaatga

SEQ ID NO: 2419 - DNA, 327 bp, Staphylococcus epidermidis
aataatccgtcatctaattcaccacgtaacatagagttagtaattgtcgtaacttcatcttctgtcttaaattctgctaactcctctatccacatgatagaaaaagggaaccgactatcttttaacgactttaatcgttcagggttctgcgcccctctgaagataatccgattccctctaggtacatatgttatttccattggcgacactttaactttaaacaggtgtgacaccttttgttcttctatcgcccacttgatttgctcaaatactgatgtagctaatgtattatcagtcttacgtactacaactgcattcataggatag

SEQ ID NO: 2420 - DNA, 426 bp, Staphylococcus epidermidis
ggtggaactttgagtaaatacaattctaaaaaagttgaatataaaggtgtcgtgttcgatagcaaaattgaatgtgacttctaccagcatttagaacgtaacttgggaaatgaatatgatcatatagaattacaacctagatatgagttgatacctaagtttgataaccaacgtaaaacagaatatatagccgactttgcattatggaaaaataacaagctgcttgaagtgatagacgtaaaaggtatgccaacagaagtagcgaagttgaaagcgaagatattcagatatcaaaacagagaagtaccactcacgtggatatgtaaagcacctaaatacacagggcaagagtggataacgtatgaagaattaattaaggtacgcagaaagcgtaaaaaggagaagatgaaggatggtaaagattaa

SEQ ID NO: 2421 - DNA, 996 bp, Staphylococcus epidermidis
tttggagtgttatatatgtgtactgccatttctttatatacaaaacaacgttaccattatttagctagaacaatggactttgcatttgaatttaatggtatcccaaccattgttccacgccattatcactaccaatttgatctagattcagacatgcgtcttgaatatggttttgttggaacaaatttaaaagtaggacgttatagatttggtgatggtataaacgaaaaaggtttagctatttcgaaccattacttcactggtgaagcctcatacagtacccataaacgttatggttattttaacttagcacctgaggagtttattgtttgggttttaggttttaataaaagtattagcgaattaaaacaaaaggttaagaaaatcaatattatgaatgaaaaaaatacgactttgaatatcgttcctcctttacatttcatggtcactgatgaaacaggacataccgtagccatagaacctcacaatggcttattaatagttaaagataattatgttcataccttaacaaatgaacctaaattagattggcatctatctaacttaagaaattacgcttttttaacgccacagaaatcaaccaatcaattaataggtaaagtgctagtaagatcaatgggctgtgaagcaggaacaaatggcttaccgggtggttatacgtcaacagatcgttttatacgcgctacatatttaagacaccaactacgctgttcccataatgaagatgaaaatttaatgaattgttttaaagttctagaatcagtcagtatccctcaaggtgcagttatcgatgccaataaaatacattacacacaatatcaattagtgatggaaagtaaagaaagaagttattatattaagccttactttagcaatcaaattttcaaaataaaattaactgaagaccttttaagtaagaatgagatgacattcttacctattaatcacgaattaaagataacatcaatacaatag

SEQ ID NO: 2422 - DNA, 1218 bp, Staphylococcus epidermidis
gcgggggaacccgcttttttacataaaaagtggtatacttaccacaaggtgattaatatgaaaataataaataataattttacatttcacaaaggtaaaaattggataaatttaagtgggctaccaaggaagaaaacaaaaagaggcgaacaaattatttggaaaaattccataggttataatgtgaattatttttttgaaggtatcagtggagatataaaaatattagactcttacaggaaaaatgatgaaagatatttaaaagtggaagtaaaaaacgaaacatatgaaatacgttcatctaacttcaaaaattgcgaaataaagaaaattgtgactgatggttataaacataatttaggatttattataaatggttgtaaagtaattggtaaaagacttaatccaagaagtaaagaaagagaatataaaatgttgtgtctaaatacaaacttgacattttatagaagagaatcaagaatagatgtcggtgcgccaagtccatacattagcggtaaatatgtttatgaaggaaattggttatacaacgaaaaaaatgttttaccttttttaaaagatgttaatgatgcaaaaaaatatacaaagttctcaaggagagaaataaattgcgtttgccctaattgtaaaactgaaaaaacaacgcctgttaataacttggtccaacaaggtttcttttgccacgtatgttctactaacatatcatatccagaaaaattaatgattgctttattaaatgaaaatagtgtagtttttgaatatcaaaaaatattccaagatcttaaacccaaaagatttgatttttacttaccagaatataatttagttatagaaacccatggaaagcaacattataaagaaaacgaaatttggtatagaaaatctaaggaatctgatgttgtaaaaatgagttattgcaaaaagaaaaacataaaatatgttgaagtggattgcagtttatctgattacaactttataatgaataacattaataaaactgaattgaaacatgtactaaaattatatgacaaagaaaatataataaaaagaataaaagaattagagcaaataaaagatgtggatgaaataattaaactatacaagaatggtagaaaccttacatatatcagtcgaaatgttggattaaccaaatggaaaatagaggggctattgaaacgtctgggatatattgcacgctaa

SEQ ID NO: 2423 - DNA, 681 bp, Staphylococcus epidermidis
aggaggttgccaatcatgactgatgaaagacacgtacttgtgattttcccccatcctgatgatgaaactttttcgtctgctggaactatcgcaagttatattgaaaaaggtattcccgtcacatatgcatgtcttaccctaggacaaatgggacgtaatctaggtaaccctccttttgcaacaagagaatctttaccatttatacgtgaacgtgagttagaagaagcatgcaaagcaattgggattacagatttaaggaaaatggggttaagagataaaactgttgaatttgaaccttacgatcaaatggatcaaatgattcaatcacttattgacgaaacaaatccatcattaattatttcgttctatcctaaatttgcagttcaccctgatcacgaggcaactgcagaagctgtagtacgtacagttggacgcatgcatgaatcagatcgaccccgtcttacacttgtagcgtttagcaatgatgcatcagaaattcttggagaacctgatattcaaaatgacatatctcaatatagtgatataaaacttaaagcttttgaagcacatgcttcacaaacaggaccatttttaaaacaacttgctagtcccgaaatagatggtcaagcacaaagtttcttaaaaatagagccattttggacatatcactttgaatcttaa

SEQ ID NO: 2424 - DNA, 834 bp, Staphylococcus epidermidis
atgatggctttaaaaaaagtattaacgatagctggttcagatacaagtgctggtgccggtatgcaagcagatcttaaaacgttccaagaacttgatgtatatggaatggtcgctttaacatctattgtaacaatggataaagaaacatggtcccatgatgtaacacctattgatatgaatgttttcgaaaaacaacttgaaactgcaatatcaattggacctgatgctattaaaacaggaatgttagggacacaagacattattaaacgtgccggagatgtttttgttgaatctggtgcagactattttgtagttgatccagtaatggtttgtaaaggagaagacgaagtacttaacccaggaaacacagaagcaatgattcaatatttactacctaaagctacagttgttaccccgaatttattcgaagcaggtcaactctctggtttaggaaaattaacatcaattgaggatatgaaaaaagctgctcaagtgatttatgacaaaggcacacctcatgtcattattaaaggtggtaaagcactcgatcaagataaatcttatgacttgtactatgatggccaacaattttatcaattaactactgacatgttccaacaaagttataatcatggtgcaggatgcacatttgctgctgccacaacagcttatcttgcgaacggtaaatctccaaaagaagcaatcattgctgctaaagcatttgtagcttcagcaatcaaaaatggttggaaaatgaatgactttgtaggacctgttgatcatggtgcatataaccgtattgaacagattaacgttgaagtcactgaggtttaa

SEQ ID NO: 2425 - DNA, 276 bp, Staphylococcus epidermidis
tcaaaatatacggaggtagtcaagttgagacacaaattattaaaaacggccaatgatttaaataaattgattttgcatagtgatgaaaaagtgaaagcagaatttcatacttttgataatggagaagttggtattaccttttggcactattctcaaaaatatgaaagtgactgtaatcatctgaatttctacgaatttttcacagataaagaattacaaagaagttttgaattagcaaaagatgtcattgcaggggagtgtttaatcgatgagtaa

SEQ ID NO: 2426 - DNA, 339 bp, Staphylococcus epidermidis
tctgctgatacaatgttaaccaaattacttacaacaagtggtaatgatgtggaatatacgataaacccacaagctataataaaaggaaacactagctttttattgaaacctaaatttcttatcatcgctaaagcgataggcgtcaaaattaaggttgctccatcattagcaaaaaatgctgcaataattgcacctaatatcatgataaacacaaacatttttaatccatgtccttgtgatgctttaaccatatgtatggcagaccactcaaaaaatcctatttcatcaaggattaatgaaataaggataactgcgacaaaggtaagtgtggcattttaa

SEQ ID NO: 2427 - DNA, 522 bp, Staphylococcus epidermidis
ggtattccaacacatatgaaaaaaaatcatgattacatgcgcttagcaattaatgaagcacacaaagccaaagcattaggagaagttccaatcggagcagttattgttaaagaggatcaagtcattgcacgtgcacataatttaagggaaacattgcagcaacctactgcccatgcagagcacatagcgatagaacgggcgtcagaagttgtcggcagttggagattagaagaatgtacgttgtatgttacattagagccctgtgtcatgtgtgcgggcactattattatgagccgtattccaaaggttgtgtatggtgctactgatcccaaaggaggatgttcaggaagtcttatgaatttattagaacaaccgcagtttaatcatagggcaatcgtagaaaaaggaattttagaagaagagtgtgcagaactattgagaagtttttttaaggaaatacgtgaaaagaaaaaagcagaaaaacaggggaagatacaaaaggatataaatttgttaaaatga

SEQ ID NO: 2428 - DNA, 528 bp, Staphylococcus epidermidis
agaatggcaacgtgtgctagattatgcagattatataagaagcaaacgcaaataaagggtgtctttatggggttatatgaaaaaatgttaatagaacatgattatatagaagtcagagagacagatgttatgcctaatgacttacatggtctatggttaggtgatttaattttaattaagcgaaacttatcagaaatacgaaaagccgaagtattatacgaagaactagcacaccataaacttacatatggaaacatcttagatcaatctaaattcaacaaccgcaaatttgaaaactacgcaaggcgttacggatatgaaaccgctctacctttgcgcattattgtggaagcgcataactatggtgttagtaacttatatgaattagctgaatatgttcaattaagcgaagaatatatatcagaaatattgaaacattacaaaaacaaatatggcattggaactaactacggagaatacttaattacatttgatccgttaagagtttttaaatataaagaaatataa

SEQ ID NO: 2429 - DNA, 255 bp, Staphylococcus epidermidis
tattcaaaaactacactattttcatttaataaagcaatcattaatttttctggatatgatatgttagtagaacatacgtggcaaaagaaaccttgttggaccaagttattaacaggcgttgttttttcagttttacaattagggcaaacgcaatttatttctctccttgagaactttgtatatttttttgcatcattaacatcttttaaaaaaggtaaaacatttttttcgttgtataaccaatttccttcataa

SEQ ID NO: 2430 - DNA, 927 bp, Staphylococcus epidermidis
gaaaacatgactagacaaggatacggagaatctactggaaagattattctaatgggtgaacacgcagttacatttggtcaaccggcaatcgcaattccatttaatgctggaaaaattaaagtcctcattgaaagtttagatgaaggtaattattcttctatcacaagtgacgtatatgacggaatgttatacgatgcccccgaacatctaaagtctatcattaatcgctttgttgaaaaaagtggagtgaaagaaccactatcagtaaaaattcaaactaatttgcctccatcaagaggtttaggttcaagtgctgcagtagcagtagcgtttgtacgcgccagttatgattttatggatcaacctttagatgacaaaacattgattaaagaagcaaattgggcggagcaaatcgcacatggtaagccaagcggtattgatacgcagacgattgtgtcaaataaacccgtctggtttaaacaagggcaggccgaaacattaaaatcactaaaattaaatggttatatggttgtcattgatactggagtaaagggttctaccaaacaagcagtagaagatgttcatgtattatgtgaatctgatgaatatatgaaatatatagagcacattggtacacttgttcacagtgctagcgaatcgattgaacagcatgatttccatcatttggctgacatatttaacgcatgtcaagaagacttgagacatttaacagtaagtcacgataaaatagaaaaattacttcaaattgggaaagaacatggtgccattgctggtaaactaactggtggaggaagaggtggcagcatgcttcttcttgcggaaaatttaaaaactgcaaagactattgttgctgctgttgaaaaagctggcgcagcacatacatggattgaacatttaggaggttaa

SEQ ID NO: 2431 - DNA, 210 bp, Staphylococcus epidermidis
ccacaaatgactttaggaaatcgtattaaacagcataggcaagacaaaggtttgaatatgagagagtttggagaattcatcgacaatgcctctgacagcatagtaagtaggtgggaacgaaatatttctgtacctaatgctaaaagacttaaattaatagctgatgacatgaatattactgtaacagagttactgaaaggagtgaaataa

SEQ ID NO: 2432 - DNA, 441 bp, Staphylococcus epidermidis
tatacgatgacgaaactgaaccttaaacaacaagcatttgttgatgagtacattaagacaggtactgcttatcaatcggcaatcagggctggttatagtgagaaatacgcaaaatcaagtagtcataaattgttggaaaatgtgggaataaaagcagaaatagacaaacgaatggaaaaactgaaaaaagattcaattgcagaccaagatgaaatacttcaatatctcacctctgtattacgtggggaggtaacagaccaagagttgatacctattcaagttggcagaggcgaaatggaagtagaagaactagaaaaaaggtcagatactaacgctagaactaaagctgcagaattattaggtaagcgatatatgatgtggacagataaacaacaaatcgaaacgactgcgatggtgcatttcgatgatgatatcaattaa

SEQ ID NO: 2433 - DNA, 204 bp, Staphylococcus epidermidis
ccacctactgcatttgtacctaatgcgataggaaaaacattgacatcagatttacctaatcgtacttgttttaccattaaaagtcatctcctttatttaaaatacttaaatatattatacccaaatcataacttattcattcatgttaattatctattagaagcaagtatcttgaccttaaaatcattatacgctttaatgtaa

SEQ ID NO: 2434 - DNA, 747 bp, Staphylococcus epidermidis
tacacttatgcatatggctgcactgctttctgctacagcggaaaagaaaccactagttgcctgggatttgaatatgggggacttataaatacactcgaagcagcaagaaggtatcaattaaaatattttacgccaagttcaataggagcttttggtatttcgacacctaaagtaaatacacctcaattaacaatacaacaaccaacgactatgtatggtataaacaaagtaactggggaattattatgtcagtattattatgtcaaatttggagtagatacacgtagcgttagatttcctggtttaatttcacatgttaaagaacctggcggtggcataacagattatgcagttgatatgtattttaaggcagttagaaaaggacattatacaagttatattaatcgttacacttatatggatatgatgtacatggaagatgctattgatgcgattatcaaattaatggaagaagacagtgttaaattaaaaacaagaaatggctataacttaagtgcgatgagtattgaacctgaaatgctaaaacaagctatacaagtatactatccagatttcaccttagattatgacattgatttagagcgtcaagatattgcattaagttggccagatagtatagatacgagctgtgctcaggaagagtggggatttgatcctaaatatgatttaccaactatgactaaagtgatgttagaggcaattgagaaaaaacaaaaagaatgctga

SEQ ID NO: 2435 - DNA, 357 bp, Staphylococcus epidermidis
atggaaatcgcaaaaatgagagttaaaaataaatacttctctattacacctaatgtagtagagaaaatgaaagaagcagatatcaatcccgatatcttaagacaaagattagcttctggttggaagtttgaagatgcaatagaagctcctttgggagtaagacgtagtgaatgggatagtttaaaacctaaagaggacggaatcgctagttataaagagagaatggcacaacgtagattacaagagttgaaacgtaagaaaccacatttattcacagtgcctcaaaaacaccctcgtagtgaatggtgtacgtaccttatggaaaatgacatcttccctagaaaggttgcgaaatga

SEQ ID NO: 2436 - DNA, 318 bp, Staphylococcus epidermidis
gtaatgaacgcacaagacgttaaaatattaaataatctttcactcgatgatacttctaacgatgaaacaatagaattacttattgaaaaatatctgaatgtagcagaagaatattgtaaccaaacattcaatagacagtcattacctagtaacgtagagaaatttattgctaattgtattaaacaaggtacgactagcaacatttcttcacgtactatgggaactgtaagctacacattcgttactgacctacctaaggaaacatacggttacctaaaaccatttagacgtttacgttggactggttatcatgtttaa

SEQ ID NO: 2437 - DNA, 246 bp, Staphylococcus epidermidis
tcttcattagctcctgtatccggtaatttatcttttgtattcttatctgagctattgtctaatcctgagtcactgtctgagtcggaatcgctgtctgaatctgaatcactatctgagtctgagtcactgtctgaatctgaatcactatcggaatctgagtcgctgtctgagtcggaatcgctatcggagtctgagtcgtcgctatctgagtctgaatcactatctgaatctgagtcgtcatcatag

SEQ ID NO: 2438 - DNA, 531 bp, Staphylococcus epidermidis
ataatgaaagctatacctaaaattttcgacaaagaaaaagggcaatggattgaactaatggctaaacctatcgccgaagaagtagttaagataatgaaagaggattggttatctaataagaaaacaattgactattggttattacaatatacagagggtgtagttgagcctatacaagttgctatatttactgacggcaatgaagtcgatgaaatcttaaaaagtaacttagaatggatgtttaatggttatgtatctaatctagaaaacaaaaagctctttaatttacaagattttataaactattgttacagcactaaaacagagttgcctaaacagttcaaagtcaacgctattgtaaaattcgatagtttagacgaacctattaaattacaagagatagataatatcacgactaatcctgatgttttaggcatattagatgaaacttctgaaggatctatagaggttaaatatatctataatgatcattctatcgaagataaaaagttaataaaagagaataaataa

SEQ ID NO: 2439 - DNA, 3558 bp, Staphylococcus epidermidis
atctgtttggcaggtcaagttgtccaatatggaagacatcgtaaacgtagaaattacgcgagaatttcagaagtattagaattaccaaacttaatagaaattcaaacaaaatcttatgattggttccttaaagaaggtttattagaaatgttcagagatatttctccaattgaagatttcactggcaacctatctttagaatttgtagattacagattaggtgaacctaaatatgatttagaagaatcaaaaaaccgtgacgctacttatgctgcacctcttcgtgtgaaagtgcgtcttattattaaagaaactggtgaagttaaagaacaagaagtcttcatgggtgattttccactgatgacagatacaggtacgttcgtaattaatggtgctgaacgtgttatcgtatctcaattagttcgctcaccatccgtgtattttaacgagaaaatcgataaaaatggacgtgaaaactatgatgcaacaatcattcctaaccgtggtgcttggttagagtatgagacagatgctaaagatgttgtatatgttcgtatcgatagaacacgtaaattaccattgactgtattactacgtgcgctaggtttctcaactgatcaagaaattgttgacttattaggagacagcgaatatttacgtaatacattagaaaaagatggaacagaaaatacagaacaggctttattagagatttatgaacgtttacgtcctggcgaaccaccaacagtagaaaatgctaaaagtttattatattctcgtttcttcgaccctaaacgctatgatttagccagtgtaggtcgttataaagcgaacaaaaaattacacctaaaacatcgtttgttcaatcaaaaattagcagaaccaattgttaacagtgaaactggtgaaattgttgttgacgaaggaacagtgttagatcgtcgtaaacttgacgaaatcatggacgtattagaaacaaacgctaatagcgaagtatttgaacttgaaggtagtgtaattgacgaacctgtagaaatccaatctattaaagtgtatgtgcctaacgatgaagaaggtcgtacgactactgtcattggtaatgcattacctgattctgaagttaaatgtattactccagcagatattgttgcctcaatgagttatttcttcaacttattgaatggtattggttatacagatgatattgatcatctaggtaatcgtcgtttacgttctgtcggtgagctattacaaaatcaattccgtatcggtttatccagaatggaacgtgttgttcgtgaaagaatgtcaatacaagatacagattctattacgccacaacaactcattaatatcagaccagttattgcatcaatcaaagaattctttggtagttcacaattatctcaatttatggaccaagctaacccgttagcagagttaacgcacaaacgtcgtttatctgctctagggcctggtggattaacacgtgaacgtgctcaaatggaagtgcgtgacgttcactactctcactatgggcgtatgtgtccaattgaaacacctgagggtcctaatattggtttaataaactcattgtcaagttatgctagagtgaatgaatttggttttattgaaacgccatatcgtaaagtggatttagatacaaactcaatcactgatcaaatagattatttgacagctgatgaagaggatagctacgttgttgcacaggctaattctagacttgatgaaaatggtcgtttcttagatgatgaagttgtttgtcgtttccgtggtaataacactgttatggctaaagaaaaaatggattacatggacgtatcaccaaaacaagttgtttcagcagcaacagcatgtattccattcttagaaaatgacgactctaaccgtgcgttaatgggagcaaacatgcaacgtcaagcggtgcctttaatgattcctgaagctccatttgtgggtacaggtatggaacacgtagccgcaagagactctggtgctgcaattactgctaagcatagaggacgcgttgagcatgttgaatctaatgaaattttagttcgtcgtttagtcgaagaaaatggaactgaacatgaaggtgaattagatcgttatcctttagcgaagttcaagcgttcaaactctggtacttgttataaccaacgtccgattgtatcaattggtgatgttgttgaatataatgagattttagcggacggtccttcaatggaattaggagaaatggcattaggacgaaatgtagttgtcggtttcatgacatgggacggttacaactatgaggatgctgtaattatgagtgaacgactagttaaagatgatgtatatacatctattcatattgaagagtatgagtcagaagctcgtgatacgaaattaggacctgaggaaatcacacgtgatattccaaacgtatctgaaagtgcacttaagaacttagatgatcgtggtatcgtttatgttggtgcagaagttaaagatggtgacatcttagtaggtaaagtaacgcctaaaggtgtaactgaattaacagctgaagagagattattacacgctatctttggtgaaaaagcacgtgaagttcgtgatacatcattacgtgtacctcatggtgctggcggtatcgttttagatgttaaagtctttaatcgtgaagaaggagacgacactctatctcctggagttaaccaattagtacgtgtatatattgtccaaaaacgtaaaatacatgttggggacaaaatgtgtggtcgtcacggtaacaaaggtgttatttctaagattgttccagaagaagatatgccttatttaccagatggtcgaccaatcgatattatgttaaacccattaggtgtaccatcacgtatgaacattggacaagtattagaattacatttaggtatggcagctaaaaacttaggaattcacgttgcttccccagtgtttgatggtgccaacgatgatgacgtttggtcaactatcgaagaagctggaatggcgcgtgacggtaaaactgtcctatacgatggacgaactggtgaaccattcgacaatcgtatttcagttggtgttatgtacatgcttaaacttgcacacatggtagatgataagttacatgcacgttctactggaccatactcacttgttacacaacaaccattaggtggtaaagcacaattcggtggtcaacgtttcggtgagatggaggtatgggcacttgaagcttatggtgctgcttatactttacaagaaatcttaacttataaatctgatgatactgtaggtcgtgttaaaacttacgagtctatagttaaaggtgagaacatttctagacctagtgttccagaatcattccgagtattgatgaaagaactacaaagtttaggtttagatgttaaagtgatggatgagcatgataatgaaatcgaaatggctgatgttgatgacgaagatgcagcagaacgcaaagtagatttacaacaaaagagtgctccagaatcacaaaaagaaactactgattaa

SEQ ID NO: 2440 - DNA, 876 bp, Staphylococcus epidermidis
cttatctattattacagctgctcaagctttacaataatggacttagcaactaaatattttaatcaaatcaactggcgttatgtcgatcattcaagtggtttagagcccatgcaatcttttgcgtttgatgacactttttccgaaagcgttggtaaagatttatcttgtaatgtagtacgaacgtggatacatcaacacaccgtgattttgggcattcatgattcgcgtttaccatttttaagtgatggtattcgttttcttacagatgaacaaggatataatgcaattgttaggaattctggtggcttgggtgtcgtattagatcaaggaattttaaacatatctttgatttttaaaggacaaaccgaaacgactattgatgaagcctttacagtgatgtatttattgattaataaaatgtttgaggatgaagatgttagtatcgatactaaagaaattgagcaatcgtattgcccaggaaaatttgatttaagtattaatgataagaaatttgccgggatttcgcagcgacgagtacgtggtggtatcgcagtgcaaatatacttatgtattgaaggttctggctcagaacgggcattaatgatgcaacagttttatcaacgtgcgcttaaaggggagactactaaatttcactatccagacatagatccctcatgtatggcatctttagaaacccttttaaatagagaaattaaagtgcaagatgttatgtttttattattatatgcactaaaagatttaggggcaaacttaaatatggatcctattacagaagacgagtggacacgttacgaagggtattatgataagatgttagaacgcaatgcgaaaatgaatgaaaaattagatttttag

SEQ ID NO: 2441 - DNA, 771 bp, Staphylococcus epidermidis
catgaatattactgtaacagagttactgaaaggagtgaaataatggcggtttttagagtttacaaagaaactggaaacttcgtaactgtacacaaaaattttattcatgacgataacctaagctggaaagctaaaggaatcttgctttacttattaagccgacctgatgactggcaaatatacgaatcagaattagttagacattcaactgacggacttagtggcctcaaaactggcataaaagaattggagaaagtcggttatattcaacgaactagaaagcgtgatgataaaggtaggttgaaagagtatgaatatgctgtctatgaaaaacctaaccacattcgattttccaacgtaggaaaaacctatataggaaaaacctacgtaggagaatcgcacactactaataataatagtactaataatgatttaactaataataaaaacactaataatgtgacagacgagacatcaaaatcatttcaatatattagtaataatttagaaatcatacaaagtccattaaaagcacaacaactagaagaagctataaaggattttaaagataacaaactagagattgttactgtagctactgattattgcaaagaaaataacaaaggcattaactatcttatcaaagtattagaaaactggagtaaagacggtgtcgatactaaagaaaaagcgatatctaaagttaaacctagaaacaataaagaagataattacctagctaagaagaaacaggaactattaggaggttag

SEQ ID NO: 2442 - DNA, 825 bp, Staphylococcus epidermidis
aacctttactataattataataatgatttattcttaattttaaaaaaatttggtgatgaaatgaataaggatacaattgaaacatctcgtgaagcattgataaaagatgttgttatgattgctgctcgtatattacttgaatctggagctgaaggtacacgggtagaggataccatggcacgtattgctacaaaattgggctatcctgaaagtaatagtttcgtgactaatactgtaattgaatttgttttacataatgaagcatatcctcggttgtatagaattaaaactcgagatacgaacttaataaaaatttctcaagctaatgaaatctcacgtcaaattacaaatggcacaatgacgcttgaagaagctaagtatcaattagaggaaatatatgttgctaaaagagatagcagtctaccttttaaaggaattgccgcagcaattatcgctacgagcttcctctatctacagggaggtcgtctggttgatatcatcacagctgtattagctggaacgattggatacttagtagtagaaatattagatcgaaagctacacgcacaatttattccagaattcataggttctttggtaataggtattatttctgtaattggacatgcatttgttcctagcggagatttagctacaattatcattgcagcggtcatgccgattgtacctggagtactgattacaaatgctatccaagatctattcggaggacatatgttaatgtttactacaaaatctttagaagctttagtcaccgcctttggtataggcgctggtgtaagttcaatattaattttagtctag

SEQ ID NO: 2443 - DNA, 1506 bp, Staphylococcus epidermidis
attatgtactattttgtaggtaataacatcggtcataaaactgctggtatagaaaaagcaatgattaatcgattaaacctatttaaagcatatcattatcaagctaaaatcttattactagcatggaatcgctatttaactcaaacagcatcgcaatatattaatagcgaagattatataaacatgtatgattattttcaagaagcaagtaacgtaacatcagtgttcagtaaaaattggattcattactggagaaatgaatgtggctatactataaaacctgtttctgagacaaatgacgttcggatttatgatcaacaacaatttataatgtatgcgcattttgctgatgaagcttatcaaaaaattgattatattaattactttgatacatctagaagaaaaataaaaagagagttatacgatacacgtggatttttaagttgcgttagagttttatcaacggaccaaaaaatacaagcagagtactatctttctcctcaaggaaacgtgaaaattgaaaagtattatgatattaattcaaatcatccctatgtggcaaaaaagattatattaaatcatttaggtaaaacgcactttttaaacaatgaaactgagctaggtgctttttttattgaaacaatatatcaaagtagtgacttattctttagcgatcgtaacctcgttacatcacatatatttaacatagttgcatcttacatccctgttattgcagtgttacatagcactcatgttaaagatgttactgatttaacgcattcaccaatcaaaaatgtttataaaggggtttttgaacatttacaaaggtataaagccatcattgtttcaacacaacaacaaaaagctgacgtaattgagagaatcagaggagtcattccagtatatgctattccagttggttattcatcttttgaaatgaacgatgactctaataaaaataactatgtttcacctaaaaaaattatttctgtcgcaagatactcacctgaaaagcaattgatacaacaaattgaacttattaataggcttaaagatacgtttccaaatatcgaactacatatgtatggttttggtaaagaagaacaacatttaaaagaacgcattcaagaattaggactagaaaaacacgtaatattaagaggttttttaaaagatttaactgatgaatatcaagatgcatatctaaatttaataacaagtaatatggaaggcttttccttagcattattagaatgtgaatcacatggtgtgccttctatcagttatgatattcaatatggtccaggtgaattgatacaggacggtaagaatggatatttaatagaaaagaataatcaacacatgctatttgaaaaagtaaaattattgctcaacaacccccaacttcaacaatctttttctcaccattgtattgaaactgcacaaaagtattctcaaacacaaatcatgttactgtggaaaaatttacttcaacattttaactaa

SEQ ID NO: 2444 - DNA, 219 bp, Staphylococcus epidermidis
gtcatgttatattctttatacataaggcacccggttaatttagtttattggtatttattaaattatacgaaaaggccttattttttaaagtattttaatataaaattacatataagcacaaagtattttggcgagactcttgagggaacaggacaagctgaagactacaggctgaagctgtcccctaagaaagcgagccaacaatacgaagcattgtaa

SEQ ID NO: 2445 - DNA, 996 bp, Staphylococcus epidermidis
ataatcctatataatacattaaacgcgtgggggggattcataataatgaaatatatagatgagcaaacacaagctcaattattagacatgaatgaagtcattttagaagtagaaaaagctttgcaagctttttcagagaataagacgataacgccattaagatatgttttgccatttaatgagcaaaatcgttatttagtgatgccagcattatcagatgaattaaatatcgttggacttaaaacagtctcatttgcacctgaaaattcaaaaaaagggaaagcgactattactggatcagttattttaagtgactatgaaacaggagaaacattgtctatattagatggtggttttcttactaaagtaagaactggtgcaatttcaggtgtagctactaaatatctagcaaaagaaaacgctaaaacacttagtgtaataggggcaggtgtacaagctgaaggtttaattgaagcgatacttgctgttagagatattgaaaaaattcacatcgcaagtagaacgttcgaaaaagcagaaaaatttgctcaaaatatacgaaatcgatttaatattaaagtgagtgtatttagatcggcagatgaagcgatagacagtgcagatattgtagttacagcaacaaatgcaaatcagcccgtttatactcattctttacatccaggcgtgcatttaaatgcagtcggatcctttaaaccagatatgcaagaaataccttcagaaacaatgcttgttgctaataaaattgttgttgaatctatggaagcagctttagaagaaacaggtgatttaaaaattcctcaagcagaaggaatattaactaaaaatatgctacatagtgaattaggcgacattatttctggtgaaaaagttggccgcgaaactgaagaagaagtgacagtctttaaatcggtcggtctagcaattgtagatatcattgtggcacaatatttttataaaaaattaatacaatcttag

SEQ ID NO: 2446 - DNA, 384 bp, Staphylococcus epidermidis
tggaggaaatataaaatggctaatcaagaacaaatcattgaagcaattaaagaaatgtcagtattagaattaaacgatttagtaaaagcaattgaagaagaatttggtgtaactgcagcagctccagtagcagcagcaggtgcagctggtggcggaaatgctgcagctgaaaaaactgaatttgatgttgaattaacttcagctggatcttcaaaaattaaagttgttaaagcagttaaagaagcaactggtttaggattaaaagatgctaaagaattagtagatggagctcctaaagtaattaaagaagctatgcctaaagaagatgctgaaaaacttaaagaacaattagaagaagttggagctagcgtagaattaaaatag

SEQ ID NO: 2447 - DNA, 408 bp, Staphylococcus epidermidis
tatttagtgtattcaaaagcatctatattaaacatgattgatggatataaaatgaattgtaatatcttagaggatgtagtacctgaatgtgatagtaattctatagcacaatatgggatacaagctacgttacctaaaccacaaggagaaaacggcagtaaagttgaagatgtagtaattagattagaaagaacaaataaaagatacgcacaaatgttaaaagaagttgagttcatcaatcaatctcaacaaaaattagggcatgttgatttttgttttctagaacacctcaagaaaggcagacgtagagataagataatagaaaagatgcctaatgctaaattgaatagaaataattttttagcacgcaaagatgagttagcagaaaagatttatttattgcaatga

SEQ ID NO: 2448 - DNA, 378 bp, Staphylococcus epidermidis
ataatacatcttgatcaatattgctatcagttaattctttgtataagtttgttgttttatcaaaatttgaatcatgataatcatggttatcattttgatgatcatgattgttgtgacgataatcatcatttctatcgtaattgtcttgatagtgtcgatcattataattacgttcatcatgatgagtatggtcgccatcttgagtataaagtgattcatagtcgatatcatcacgttgattatcatattgatgttggcgatgatgctggtcatgatgattatttaaatgcacagaacggttataatcttcgtcattataattgcgattgtagttacgtttgtcattttgataaacatagttatctttgtcttgtctag

SEQ ID NO: 2449 - DNA, 516 bp, Staphylococcus epidermidis
tggttttttcaaacaaaaatcacgtcaattctggacgcaaatgaacatagcaccgtctatggcaaaagaggaagagaaagagtctacgaagaacggtatcgagttcatgaagaacaactacaaagaaatcatgggcgagctaccttactagattattcagaaatacggcagataaccagtcaatacataggctatcttccttatgatgaattaatgagtttgacgcctaatgaatggaaagactgggttatcggtcgtagattggcgttacttgatgaacaagaaactttattgtttggtgctcaagctaacggccttgtacaagctggcaagtcgttaaaacgactacaaaaacagttagagcgtgcaagatacgaagttcgcgggcaatctgatgagtacgaacgtatgaaaaaacgtaagctagcacaaaacaaacgtaatagagaagctcaaaaacaaggtacacgtcgttttatgaattcattacgtaatactagtcaaagaggaggttag

SEQ ID NO: 2450 - DNA, 465 bp, Staphylococcus epidermidis
gagtgcactcatatgttttggatatttaattttatatttagctttcttgcttcactctttttctgtgtcatatttgatgcccctaggaagttgtattttgcttgtggctttgtcggcgcttgtggatggatggtttatactgtattatttaacggctttgaactccatacgatttactcaagctttttcggtagtttagcgttaggtttacttagtcattatatggcccgtcgaaaaaaagagcctgtaattatttttatggttacaggtattatacctctggttccaggaggacttgcttatgatgccactaaaaatttagtgttattacactttggaaaggcgattaacacaatgcttgaagtgacattaatagcaggtgctattgctttaggtttattatttgctgatcaaatttctaaaatcgttatttcaggttttgctcgtaccagaaaaagattgtaa

SEQ ID NO: 2451 - DNA, 489 bp, Staphylococcus epidermidis
gggagaagtcacatgtatagtgtcagacaagcaactgaaaaagatgttgtagcgataagagatgttgcgacaaaagcttggtataacacatatttaaatatttatgctgcttcaacagttaatgaactgttggccgcttcatataatgaaacgcatttaaaaaagagactaaatgagcaattatttttagtggcagaagaagatagtgagattgttggttttgcaaatttcatttatggtgaagagctttatttatctgcacactatgttagacctgaatctcaacatagaggttatggaactcgtttgctagaagcggggttgaaaaggtttaaagaccagtatgaaacagtttatttagaagttgataacaataatagtaatggcatcgaatattatcaaaatcatggattcgagattattcgctcatatcaacctgaaatgtatggtgaaatcatggatttagctttaatgaagaaatcattttaa

SEQ ID NO: 2452 - DNA, 393 bp, Staphylococcus epidermidis
tacgtaaaccaaggaaaaagcaaaacgaaacaatcagattcaccagctttaaacagaggtttcaatagtaaaaagaaacaatttactaacttaaactcacctcaaaaacgtggtgtatgtactcgtgtaggtacaatgacacctaaaaaacctaactctgcgttacgtaaatatgcacgtgtgcgtttatcaaataacattgaagttaacgcatacattcctggtatcggacacaacttacaagaacacagtgttgtacttgttcgtggtggacgagtgaaagacttacctggtgtgcgttaccatatcgtacgtggtgcacttgatacttcaggtgttgatggacgtagacaaggacgttcattatacggaactaaaaaaccaaaaaattaa

SEQ ID NO: 2453 - DNA, 939 bp, Staphylococcus epidermidis
ttgatattacatgatgttgaggtatacaaaaataaagaacgtttgcgtattagtaacaatcgctttactggtactgcgttgagagttgtttcttacgatgttaaaggtgcaggctatgaccgaaagtttgatgaaattgatcgtgttaacggtagatttcataatgctactaaagaagaaaagaaaagtatatctatgacggttaggtacgatgtagaaaagatagcttacgcttctcatttaaaagcgaacatacaagctatgctaagaggtcatttttatcttagagaattagcaacgtccgaaagtgaagttaaattcgagaatatattcgaacctaaggaacaatcttttgaactagaatatgttgacggtaggcagatacttgttggcttagttaatgaagtgtcattcgatactactaaaacgtcaggtgaattcacactagatttcgaaacgattgaattaccatactttgagagtattgggtatagtacagatttagaaaaagagagtggtaatttgaataaatggggtattccagacaaaaacccgttcaacacatctcataaagaacgtagatacacattctatgatactaaagtaggcgatgtatattacggtggtacagctgaaattaaccaattcaaccaagatagtgttgtagaaatgacacttggagaaaatgtcagtaaaaatgatagcgatggttttaacttctatatgacacatagtgacattatgaaaataagtggattagaattgagagccggtgatgttatcaaatttgacggcattcatgtatatcgtaataacttacgcattgatgattacaataagacgaaacaacaacctgtgttaatgcctggttggaatactttccatactactaagaaacttcaaaaaatcacgtttaaacacaaaagatattacttgtaa

SEQ ID NO: 2454 - DNA, 834 bp, Staphylococcus epidermidis
catatggcacaaggaacaacaactaaaagtacacaaatcgttccagaagtattaaaacctatgatgcaagcagaattagataagaaattgagatttgcacaatttgcagacattgacagtacattagtaggacaaccaggcgacactttaactttccctgcatttgtttacagtggtgacgctacagtagtacctgaaggacaaaaaattcctgtagacaaaattgaaactaacagacgtgaagctaaaatccataaaatcggtaaaggtactgatattactgacgaagctttattgtctggttatggtgatcctcaaggcgaagcagtacgtcaacatggattagctattgctaacaaagtagataatgacgtattagaagctttacgaggtactaaattaactgtaagtgcagatattggcacattagcaggtttagaagctgctatcgatacattcgatgacgaagatttagaaccaatggtattattcattaaccctaaagacgctggtaagttacgctctagtgcttctgcaaacttcactcgtgcaaccgaattaggcgacaacattatcgttaaaggtgcatttggcgaagctttaggagctgttattgtacgttctaagaaattagatgagggcgaagctattttagctaaacgtggtgcagttaaacttatcactaaacgtgatttcttcctagaaactgaccgtgatccttcaactaaaacaactgctctatacagtgataaacactatgtagcatacttatatgacgaatctaaagcagttaaggtaactaaaggcgcaggaactacagactcaggtgcataa

SEQ ID NO: 2455 - DNA, 741 bp, Staphylococcus epidermidis
atttcaatgcaaatacaacctgaattctttgagaagttaaaaccccgttattctgataacggggtttttcaattaattaatacaagcatactaaatgcttttggattgaatgataaaattagaggtgaagaaatgagtcattattatgatgaacaacctgatgttaaaagtaacccaaaaagaattagttatcaaattaaaaatgtgcaactagaacttactactgatgctggagttttttcaaaagataatgtggattttggatcagacttactaattaaaacttttttgaaagaacatcctccaggcccaagtaaaaccatcgcggatgtaggatgtggatatggtcctatcggtttagcaataggaaaagcatctccacaccatcaaattacaatgttggatattaacaatagagctttggcgttggcagaaatgaataagacaaaaaatcaagtggataatgtaacgattatggaaagcgattgtttgtctgctgtcaatcatcagtgctttgattacattttaactaatccccctattagagctggtaaggacattgttcatcgaatctttgaacaagcgtttgacagactcaaaactacgggtgaactttatgtcgtcattcaaaaaaagcaaggtatgccttcagctaaaaagaaaatagaagaactatttggcaatgtagaaattatagctaagagtaaaggatattatattttgaaaagtataaaaggttga

SEQ ID NO: 2456 - DNA, 1803 bp, Staphylococcus epidermidis
atacaaacgcaatgttgggatttaccaaactacattttcaatagatattggcattttaaaacaacaggaaatgcgattgctatggcatggtatagatatcctaaaggcttcaaattctataggaacactagaaactttgttccgaaacctggtgacatggcagtttggggaaagggctcctttaataacggtgttgggcatactgctgttgtcataggtccatctaccaaaagttactttactagtgtggatcaaaattggattggtgcaaatagttatacaggctcacctggtgcgaaaattaaacatagttataacggtataagtgggttcgtcagacctccctaccacgcagaaactaagaaaccatcgaaaccaagtagtacaccgtccaaaccttctaatgacaacactcctaaaaacacaaaagaacaaacaaaacctataactaaagagattaccaaagtttcctatacatcattcgcatacgatttagacgatgatttggaatatatttatcattacatggttgaagggcaaaagttgatagggaaggtaaaaggtatatatatcaaagagagtacacatatgcgttctgttgaagaattgtatttacaacgtaataaatatgtgaatgaagatgaataccctcatgtatatattgaccgtgagcgtgtatggacacctagacctgattcagaagaagcaccagaacatccaggttggcttgttatggaagtttgcggaggacaaacggatagcaaacgccaattcatgctcaatcaaatcagagcgttaatctacggcgtttggttgttaagttggagtaaggtgaaactttctgaatcgtcaatcaaagcagatcctaacatatggcgttctatgaaagatttaatcaattacgacttaatcaaaaatggtattcctgatgaaagtaaatataaagaagtcgagaagaaaattatcggtttatatttgaaaagagataaattacttacagaaacaattactacaacaactacaaagacaaagataaaaattaaacctaaaacttcggtcgacaatccttcacagaacgataagtcgacaggtaaaacgacaaacagaacttcaaataaacctcgtgtagttgtagagaaaagtaaatatactttccaacaagcgcttaatgcacaaatggctcatggcatgcctcaaaaatcttatagttggggttggggtaatgcttctaggtcacaaacaagtaagtatatgaatcctaacactatatggaatagttcaactcaacgctatcaaatgctagatttaggaaaatatcaaggtatatcagtaagtaagttgaataagatacttaaaggtaaaggcactttatctggacaaggtaaagcttttgcagacggttgtaagaagtacaatgtaaatgaaatttacttaatcgctcacgctttcttagagagtggatatggccgtagtaactttgctagtggacgttatggtatctacaactactttggtattgcagcttacgacaacaaccctaacgcttctataggatacgctagacgtcaagggtggacgagtccacgtaatggtattataggtggcgctaagttcgttaggaaacaatactttaacaaaggtaaaaacacattatacagaatgcgttggaatcctagcaatccaggtcgtatgcaatatgctactgctatcgaatggtgtaatttccaagcatcaaccattagtaaattatacaaaacagttggtacaaaaggtatgtactacattcgagataaatatagataa

SEQ ID NO: 2457 - DNA, 543 bp, Staphylococcus epidermidis
cgaatggcgcagaataaatacattgcagcgttacaaattgctgacaaagatttagcgagcaagctaaaagaagaagatgctattctgttagctagtttagctgagggtggacacacaatcagcaatgacttagctgaaatgattacaggtggcaaaaaagactacggtcgtaactctgtagaagaagaaatcaagttaactgttgaccgtgtacctggcgacaaaggtcaagaagctttaaaagagtcagttaaaaacttcaaacagttacgtttatggatttgggaagttaaaaagcgtgatggtaagcatcatggtacttttgcttatgtaattatagaagaacaagaatggtcatttgatgatgaggatgacaaaatcgaaatcactgcaaaagttaaatttaacagtgctgacggttctgttgactcattaccaccagaatggcttaaccctagtgctgctgctcctacagttgaatttgaaggcatgggtgaatatacaggaacgtatgaagaacgtacacctagcgctggtgcataa

SEQ ID NO: 2458 - DNA, 675 bp, Staphylococcus epidermidis
tataactttaactatgaggtgaacatcatgaattttgatagttatatttttgattttgatggaacgctaattgatacaacaacatgtcacgtcaaagctacgcaaagcgcttttaaaagattaaatttagatgaacctacagaacaagctattttacatacatatcatttaaatttatataacaattttaaagcgctagcttcacatgaactgtctttttatcaaatagaaaaattaatagatgaatacaatcattgttttagcaacgatgaaatacatcaatcaaaagaatataccggaataagtgaagcattaaaatttttacataaccaaaagaaaaaaatatttgtagtgtctaataaagaaatactaacaactcaaaagtatttagattatctcggattaagccgttttataactgattcattaggtgtctgtattaaaaatgaagacaaacttctttgtgaaacgattcaaaatttgatacagaaacatcatttaatgataggtaaaaccgtgtatataggggacacagcacagaatatcaagagtgcgaatcaagctcatgtgcaaacatgcgctgtcacatggggagcacaatctgcacacgaattgttgcatgaaaatcctcattatattgttaatgatccagaagaatttttaacaattttataa

SEQ ID NO: 2459 - DNA, 411 bp, Staphylococcus epidermidis
gaggttattaatgtgatttggataagtttttcatcggtaataattgtgttagtactgtgtatttttgctatatataagtggattaaagcagagaaaagagttaatgagttacaggaagataaacatggattgcaattagataagttacatttagaaagagaggtatcttggttgaaaaataaggataataaaaacaacataggcaaatacgtggttgagttaaaaaaaggagtatatttagtgaaaaaatatataggtagttatggaaacacatgcataatcactgacaatgtatttgaagctttatcttacgacgatttatattcagctaaagaagatgcatgtagttttaacggacgtgtactagaacacaaacctaatttagaggtggtcaaacaatgtggggcgtaa

SEQ ID NO: 2460 - DNA, 1011 bp, Staphylococcus epidermidis
gagagaattaaggaggatattatggctgatttattatctgtattacaagacaaattatccgggaaaaatgtaaaaatagtattacctgaaggtgaagatgaacgagtgctcattgctgcgactcagctacaaaaaactgactatgtttcacctatcgttctaggaaacgaagataatattaaatctcttgcttctaaacacgctttagatttaactcaaattgaaatcatagatccagcaacgagtgaacttaaagatgagcttgtagatgcttttgttgaaagacgtaaaggtaaggcaactaaagaacaagcagttgaattattagataatgtaaattatttcggaacaatgcttgtgtatactggaaaggctgaaggtttagtgagtggtgctgcacattctactggagatacagtcagaccagcattacaaattatcaaaactaaacctggtgtatctagaacatctggtattttctttatgattaaaggcgacgaacaatatatttttggagattgtgcgattaatccagaattagatgctcaaggacttgctgaaattgcagtagagagtgctaaatcagcacaaagctttggaatggaccctaaagtagctatgttaagcttttctacaaaaggttctgctaaatcggatgatgttactaaagtgcaagaagcattgaagttagctcaagaaaaagctgaagcagatcaattagatcatgtagttattgatggagaattccaatttgacgctgctattgttcctagcgtagcagagaagaaagcacctggtgcaaaaattcaaggtgatgcaaatgtatttgttttccctagtctagaagcaggtaatattggttataagattgctcaacgtttaggtggatacgatgcagtaggaccagtcctacaaggattaaactctccagtcaatgatttatctcgtggttgctcaactgaagacgtttataacttatctattattacagctgctcaagctttacaataa

SEQ ID NO: 2461 - DNA, 195 bp, Staphylococcus epidermidis
gtaatggctaacagagaagaaacaattgaagttgaagcaacaatcaaagtgagatgtaaatatccagtatgggtaaacaatcaaattactgcaagtgatgaaaaggaacgcattttagatttaatcagtaagaaccctgaaaaagagttaatgagcgaagattttgaactagttgaattaatagaggtggagtaa

SEQ ID NO: 2462 - DNA, 816 bp, Staphylococcus epidermidis
aatgaatataaattaattagatttagacagagaaacttttttaacgtatgttttttctgtctttttttatttacacaactaagaataaggagagataaaatgatttatgcgggtatattagcaggtggtattggttctagaatgggaaatgttccattacccaaacaatttttatcattacaaggaaaacctattattattcatacagtagaaaaatttttaatgtataaggactttgatgaaatcatcattgccacgcctcaaaagtggatcaattatatgctcgatttgctaaacaattatcaattagacgataagaaaataaaagtaatacaaggcggagacgaccgaaatcactctataatgaatattatagaaagcattgagcaacataaaaaattaaatgatgaagatataatcgttacccatgatgcagttaggccatttctaacaaatcgaattattagagagaatgtggaatatgccagtcaatatggtgcagtagatacggttgttaatgctgttgatactatcatttcttcaaatgatgcacaatttatttctgggattccaataagaagtgagatgtatcaaggacagacgcctcaaacttttaaaataaaagagttaaaggatagctatttatcgttaactcaatctcaaaaggaaatattaactgacgcgtgtaaaatactcgtagaattgggtaagccagtaaaattagtcaaaggagagttatttaacataaaaataacaacaccatatgatttaaaagttgcgaattcaattattactggagctgttgataatgattaa

SEQ ID NO: 2463 - DNA, 294 bp, Staphylococcus epidermidis
cgtatgtataaagtaatcgaatatttcgaagacttacaagatgacaactacgagtataacgtaggaaaaacgttccctcgtaaaggtttaaatgtaagtgatgagcgattaactgaactatccacaaaagaaaaccgtcagaataagcctcttattgaacgtgtagagagcgataaagacttaaaaggtatgaaagtatctgagttaagagaactcgctaaagaacgtgaaatagagggcttttctagtatgaaaaaagatgaactcgttgaagcattaggaagtgttaagtaa

SEQ ID NO: 2464 - DNA, 1404 bp, Staphylococcus epidermidis
tgtaaacataattatataaagtgtttacaaatggtgatgaagatgaaaaaaataatggaatatttacagcattatattaatcaatacccgcatcgattagctttagtgtttgaagatcgacatctaacgtatggagaattaagtaaagaaatttatcaggctagtatgcgctataaagaagtaaaattaaacaaaaaagtaggtctaatggatgaacatcctgtaaataatattattaactattttgcggtacatcaaagaggtggaattccttgcatttttaatcatcaatggagtaatgaaaggatacatcaacttgtaaaaagttatgacatacaatggttaattaaagataatcatcttacctcaaatcatgataactcaatttataatgatgaggttatcccacgtaatgttatacatataggtttcacgtcaggaactacaggtttacccaaagcgttttatagaaatgaacattcttggatagtttcttttaaggaaaatgagaaattactccagcattgtgaagaaaccattgtagcaccgggtcctttatcacattcactttcattgtacgcatgtatttatgcattaagtactggaaaaacatttataggtcaaaaaaattttaatccactatctcttatgcgtcttattaatcaattgaacaaaacgacagcaatatttgtagtgccaacgatggtacaacaacttatttcaactcaacgacattgttcatcgattaaaagtattttgagtagtggtgctaaacttacattgcaacagtttcaacaaatcagaaatttatatccacaagcaaatttaatagaattttttgggacatctgaagcaagttttataagctacaattttaaccaatcatctcctgctaattctgttggtaaacttttccctcatgtcgagacacgattattaaatcaagatgatgatgcagtaggattattagccgttagaagtgaaatggtgtttagtggttatgttggacaaagcaatcaagagggggcatggattaaaacaggcgacttcgcttatattaaaaatcaacatttgtttttagtaggtagagagagtgatcgtattatagttggggggattaatgtatatccaacagctattgaaagcttaattatggatattgaaggcattgatgaggcccttgtcattggtataccacatgctaaatttggagaaatagcgatattgctttattcaggtaaagtacaattgaattaccgacaaattaaatcttttttaatgaaacatctttcaagacaagaagttccatcaaaattaaagaaaattgaccatatgatttatacagaatcaggaaagattgctagaaaagagatgaaaaataaatttattaatggagagttataa

SEQ ID NO: 2465 - DNA, 489 bp, Staphylococcus epidermidis
tcgatgagtaaattatttgaattaaaagatagttaccaacaagtttacgaccttattgcagaacaagaagatgaacaaattttaaaagatacgctagcaagtattaatgatgctatcgaagataaagcagatggatatgtagcagttattaaatctttagaagcagataacaatgctatagatgaagaaataaaacgtttaagacaacgtaaaacttctaatcaaaacggcgtcaaacgtttaaaagaaagcttacaggaagttatggagcagacaggtaaagaaaagtttaaaactgcgcttaattcgtacagtatcgctaacaatccacctagcttagatgtcacagatgaaagtttgatacctaaacaatactacatcgaacagaaaccaaagttagacaaaaaagagttattgaaagctataaaagacggtttagaactcaaaggagtagaactaaaacaaagtagaagtttgagggtgagatag

SEQ ID NO: 2466 - DNA, 204 bp, Staphylococcus epidermidis
tttaaaatcaatcgactcaattcatcattattcattttcttaagttttggcaagcgaatgataaaaaagattaatcctattaccaaccaaattcctaaagcgatgtatgatggtatcgaaagtgctgcaggagaacctggaataagcaataaacataagaacacaaaggatacaatcgatcctataataccaaaaattttataa

SEQ ID NO: 2467 - DNA, 426 bp, Staphylococcus epidermidis
aagagtgtcctattggctaaggttaaatacggtaattgggacttagttaaggaacttgaggagttcgaaaaagaaacgattagatgggctaaaaaaggtatagctaagacaacgacaattattcacaattcaatagttagcaacatgcctgttgacaccggttatcttagagaaagtgtttctatggactttaagaaaggtggattaacaggggttattaatattggtagtgaatacgcagtgtacgtcaactatggcacaggtatatacgtggttggtccaggtggtagtcgtgcaaagaatatcccgtggcgttataaagacgcagacggtcactggcacacaaccaaaggacaacatgcacaacctttttgggagcctgccattgacgaaggtagagcgtttttcaataagtatttttcataa

SEQ ID NO: 2468 - DNA, 222 bp, Staphylococcus epidermidis
gttaaatacaaacgcaatgttgggatttaccaaactacattttcaatagatattggcattttaaaacaacaggaaatgcgattgctatggcatggtatagatatcctaaaggcttcaaattctataggaacactagaaactttgttccgaaacctggtgacatggcagtttggggaaagggctcctttaataacggtgttgggcatactgctgttgtcatag

SEQ ID NO: 2469 - DNA, 954 bp, Staphylococcus epidermidis
atggcgaacaacaaagacaatccaaaaataaccaaccagaatgacatcgacaattacatcgacagacttgttaatcaagctaataaagaaatcgaaactctgtttgctaaacgtttgaaagaaatcaaacagattattgcaaatatgtatgaaaaatacgatagagatgaaccacaagtgacgtggactgaattcaataaatacaacaggctcaacaaagaacttaatcgtataggacaaatgttgtcacaagactatagagaggtcgctaaggctatcaaacagtcgcaacagaacatctatatagaaaagtacatgatgagcctatttttgtatgaagtagcaagtcaaacgtctatgaactttgatataccaaccacacaaacgatacagacagctatagaacaacctatcgagtttattaagctggtacctacattacagaaacatcgtgatgatacattaaagcgtattcgtatgcatatcacacaaggtattatgagtggcgagggctactctaagatagctaaagcgttaagagatgacttagggatggcaaaggcgcaatcagtaagagtagcacgtacagaaacaggacgtgcattgtcacaagcagggttagatagtgcaatggtagctaaagacaatggactcgatatgaagaaacgttggtattctactaaagatacacgcacacgtgatacacacagacacttagacggcacttcagtcgatatcgaagataactttcattctagtggttgtgtaggtcctgcacctaagttgtttgtaggtgtagctagtgcaaaagagaacatcaattgtcgttgtaagcttctttattacatagacgaagatgaattaccaacaacgatgagaactaaagaagatggcgctattccatttactacatatcgtgaatgggagaaagataaacggaaaggtggtgtttga

SEQ ID NO: 2470 - DNA, 243 bp, Staphylococcus epidermidis
aaggagttaaaaatgaattcgagagtaataactaaagaaaacaagaaagaaatagctcatagaatcaaacaaataagattacaaagaaattttgatataaacgaattcgctgaaatcttatatgtttctcctttctctataaaacaatgggaagaaggcaaaagaattcccaatatcaagaaaataaaattaatagcattcgttttcaagacaacacctgaatggctattgtacggggagtga

SEQ ID NO: 2471 - DNA, 336 bp, Staphylococcus epidermidis
aagagaataaataaaatcgagtcaacgcaatgcgttggctttttaatttatctaaaaggagatatgagtatgaaaacagatgtaggttcaattgtaagaacaatcgtatttattttagcttgggttaaccaatttttagctacgaaacatatttcacctattccggtagacgaagtgactatcagttctattattactggtgcaatttctttgtggacttggtggaaaaacaataatttctctcacgcagcacaaaaaggacaacaaaaattgcatgaagttaaagcaggtacagaaaacacaaatggtaaagcaccaattggaggtaatgattaa

SEQ ID NO: 2472 - DNA, 378 bp, Staphylococcus epidermidis
aggatggtaaagattaaaaagaaagttgaaatgacattaccagaattgattgagtgggcttggaagaatggtgttaaagaaaaagcgttttatagcaatattgacagaggttctgtgtattttgacatggtgcaaacagtgtcgatagagtattcaatcgttgtagatgaaactttcacagtagaagttgaagaagaagttacggaagaaacaaagataccagaaatgttggaaatatttgtaaatggtggtggagttaaacgggttgaaaaatctatcaatgaactaaaagatgattttagcaaagaattttggttgaaagatggagatacaatgacactcatctggaaagatggcgaattggtcggtgatgagtaa

SEQ ID NO: 2473 - DNA, 204 bp, Staphylococcus epidermidis
atttttacaaagataaaaatattacagatgttttggcagatattttacaggaggggtaaaaccatgaaaaattatgatttgattattattggttttggaaaagcaggtaaaacattagcggcacatgctgctagtcacggacaaaaggttgcagtggtagaacgatccacaaagatgtatggcggtacatgcattaatatttaa

SEQ ID NO: 2474 - DNA, 1386 bp, Staphylococcus epidermidis
ttaatgacaaataaaactagaagtcaagcgcatgcttatttagacaggttaaaaggttattggtgggatttcgacggtgtttatggcgcacaatgttttgatttagccaatcaatattggtactacgtaacaggtcatactttaagtggtatgtacgctaaagatataccttttgttaatgattttaacggatacgcgaatgttgtaaaaaattataactcttatattcctaaaaaaggtactttagttgtttttccttacgaatatggtaacggatgtggtcatgttgctattatagaaagtgctactcaaaattatttctatagtttggatcaaaattggtatggcggggcaagaaataatccgccagaggttgctcaaacaatataccacgaatatcaccctgatatgtattttgtagaacctctgtattctaaagaaacaaaagtaagtaaaattaaagcaaaaacaactaaacctaaacctgtaaaaaaagttaaaaaaagaaaagtgatgatcgttgctggtcatgggtataatgatcctggtgctattggtaatggttataacgaacgtgattttataagaaaaaacattgttgataatgtatcaaaatatttgaaagatgcaggacatactgttggtatatatggaaaaaagcaagatatgtatcaggatacagcctatggagtaagagtcggtaatcacagagattatggcttatattgggtaaaatctcaaggatatgatactgttattgaatttcatttagatagtgcaggtcctaaagctacaggtggacatacaatcattccagccggttatcctgctaatataacggataaaaacatccaagcagcactaaaacaaagtgttggtactataagagggataactcaacgtaacgacttattaaactgtaatgttgctaatgatattggtatagaatatagacttgttgaattggggttcattacttcatataaagatatgaagtatattaatgaaaatataaaacctttcacaaagtcaatagcaagcgatattaacggcaagccaattggaggtacaagtgcaggtaaagttaaaagtgtaaaaaaaacatgggattggaaaggtagattttatccgaacacaacaattaaagttagaaaaaaacccaacggcgaaattgtagaaaaaggttcttggttgtacggaaaagacgattgggtagatattgttcaattatacaaagacactaagaaaaaattatggtggggtaaattcaaatatccaaccaatcctagttctggttatttttattgtgctttaggtgaaatcaccgacaaacaagaacgaataaaaaaagaaaagaaattatatggaaagataaagtggcagtga

SEQ ID NO: 2475 - DNA, 213 bp, Staphylococcus epidermidis
gttcatcccctaataaacaatgacattttaatagagtctgatatagttgtcacattgtgtagtgatgcagatgcaaactgtccagttttacctaaaaacgtcactaaagaacattggggatttgatgatcctgctggtaaagattggtcagaatttcaacgtgtaagagatgagattaaagcagcgatcgaaacatttgctcatagagtgtaa

SEQ ID NO: 2476 - DNA, 591 bp, Staphylococcus epidermidis
aagcagcaaaacaatgtagagcagctattgaaggtaaataagatgagtgaatttaataattatcgtcttattcttgaagagttagattctactttatctcaagtagataatacagagtatgaacgttttgctaatgatgttataggtgcagatcgcatatttacagctggtaaaggtcgttcaggttttgttgctaatagttttgcaatgcgcttaaatcaattaggtaaaaatgcctacgttgtaggtgagtcaacaacaccttcaattaaagaacatgatttgtttattattatttcaggttcaggttctacagaacatttaagattattagctgaaaaagcacaatctgagggtgcaaaaattgtcttattaactacaaatgcggaatcgccaatcggtaatcttgcagagacggttgttgaattgcctgcaggtactaaacatgatgttgagggttcgaaacaaccacttggtagtttatttgaacaggcttcacttatattcttagatagtgttgtattacctttaatggatgcatttcacattagtgaaaaaacaatgcaagagaatcatgctaatttagaataa

SEQ ID NO: 2477 - DNA, 2793 bp, Staphylococcus epidermidis
ttaaaaaaaaataatttactaactaaaaagaaacctatagcaaataaatccaataaatatgcaattagaaaattcacagtaggtacagcgtctattgtaataggtgcaacattattgtttggtttaggtcataatgaggccaaagctgaggagaatacagtacaagacgttaaagattcgaatatggatgatgaattatcagatagcaatgatcagtccagtaatgaagaaaagaatgatgtaatcaataatagtcagtcaataaacaccgatgatgataaccaaataaaaaaagaagaaacgaatagcaacgatgccatagaaaatcgctctaaagatataacacagtcaacaacaaatgtagatgaaaacgaagcaacatttttacaaaagacccctcaagataatactcagcttaaagaagaagtggtaaaagaaccctcatcagtcgaatcctcaaattcatcaatggatactgcccaacaaccatctcatacaacaataaatagtgaagcatctattcaaacaagtgataatgaagaaaattcccgcgtatcagattttgctaactctaaaataatagagagtaacactgaatccaataaagaagagaatactatagagcaacctaacaaagtaagagaagattcaataacaagtcaaccgtctagctataaaaatatagatgaaaaaatttcaaatcaagatgagttattaaatttaccaataaatgaatatgaaaataaggttagaccgttatctacaacatctgcccaaccatcgagtaagcgtgtaaccgtaaatcaattagcggcagaacaaggttcgaatgttaatcatttaattaaagttactgatcaaagtattactgaaggatatgatgatagtgatggtattattaaagcacatgatgctgaaaacttaatctatgatgtaacttttgaagtagatgataaggtgaaatctggtgatacgatgacagtgaatatagataagaatacagttccatcagatttaaccgatagttttgcaataccaaaaataaaagataattctggagaaatcatcgctacaggtacttatgacaacacaaataaacaaattacctacacttttacagattatgtagataaatatgaaaatattaaagcgcaccttaaattaacatcatacattgataaatcaaaggttccaaataataacactaagttagatgtagaatataagacggccctttcatcagtaaataaaacaattacggttgaatatcaaaaacctaacgaaaatcggactgctaaccttcaaagtatgttcacaaacatagatacgaaaaaccatacagttgagcaaacgatttatattaaccctcttcgttattcagccaaagaaacaaatgtaaatatttcagggaatggcgatgaaggttcaacaattatcgacgatagtacaatcattaaagtttataaggttggagataatcaaaatttaccagatagtaacagaatttatgattacagtgaatatgaagatgtcacaaatgatgattatgcccaattaggaaataataatgacgtgaatattaattttggtaatatagattcaccatatattattaaagttattagtaaatatgaccctaataaggacgattacacgacgatacagcaaactgtgacaatgcaaacgactataaatgagtatactggtgagtttagaacagcatcctatgataatacaattgctttctctacaagttcaggtcaaggacaaggtgacttgcctcctgaaaaaacttataaaatcggagattacgtatgggaagatgtagataaagatggtattcaaaatacaaatgataatgaaaaaccgcttagtaatgtattggtaactttgacgtatcctgatggaacttcaaaatcagtcagaacagatgaagaggggaaatatcaatttgatgggttaaaaaacggattgacttataaaattacattcgaaacaccggaaggatatacgccgacgcttaaacattcaggaacaaatcctgcactagactcagaaggcaattctgtatgggtaactattaacggacaagacgatatgactattgatagcggattttatcaaacacctaaatatagcttagggaactatgtatggtatgacactaataaagatggtattcaaggtgatgatgaaaaaggaatctctggagtaaaagtgacgttaaaagatgaaaacggaaatatcattagtacaacaacaactgatgaaaatggaaagtatcaatttgataatttaaatagtggtaattatattgttcattttgataaaccttcaggtatgactcaaacaacaacagattctggtgatgatgacgaacaggatgctgatggggaagaagtccatgtaacaattactgatcatgatgactttagtatagataacggatactatgatgacgactcagattcagatagtgattcagactcagatagcgacgactcagactccgatagcgattccgactcagacagcgactcagattccgatagtgattcagattcagacagtgactcagactcagatagtgattcagattcagacagcgattccgactcagacagtgactcaggattagacaatagctcagataagaatacaaaagataaattaccggatacaggagctaatgaagatcatgattctaaaggcacattacttggagctttatttgcaggtttaggagcgttattattagggaagcgtcgcaaaaatagaaaaaataaaaattaa

SEQ ID NO: 2478 - DNA, 300 bp, Staphylococcus epidermidis
tttatgaaaaaaataataatcactggagcacttggtcaaattggtactgaattagttattaagtgtagagaaagatatggaactgaaaatgtattagctactgatataagaaagccagaaccacactctccagttaaaaacggtccttttgaaatcttagatgttacagatagaaatcgtttatttgaaacagtgagatatttcaatgctgatacacttatgcatatggctgcactgctttctgctacagcggaaaagaaaccactagttgcctgggatttgaatatgggggacttataa

SEQ ID NO: 2479 - DNA, 222 bp, Staphylococcus epidermidis
ggtaaagaaaagtctattttagttccaagtctacttttaaagaagctaattttcgatgagaacacaaatttaattacggaaaaaataggtgatgataataacataacttgtaacttaataaaggtagtgttttacttatactgtatacataataaaattaatatctattttgaatatttagaaaattcattgaatagtagaatcacgattgatataatttag

SEQ ID NO: 2480 - DNA, 495 bp, Staphylococcus epidermidis
aacgtaagaaaccacatttattcacagtgcctcaaaaacaccctcgtagtgaatggtgtacgtaccttatggaaaatgacatcttccctagaaaggttgcgaaatgatatgaatataaaattaataaaagaaaaaatcgacaatgaaaataaaagaatgggaagcgagttggaatacactttcaaatataaaggccataaatgtaaggtgaaacgcattgaagaatatggtcatttgtgtggatatatatatttaaatgtcaaaagaggaagcgaagaatatgaaattatagatgagttggcgcattgcggtgtatcttatcacaaaggtaacttgataggttttgattgcgcgcatgcaggagacttttcactgcgtatgtataatctatttgaaaataaaacttatctaagcgatttagaaacatataaagatcttgaatatgtagaaaataacataaaagaaatcatagactctttgcaaaagggtggttaa

SEQ ID NO: 2481 - DNA, 564 bp, Staphylococcus epidermidis
aatgttggaaaacaaagaaaaatgacatattttaaatggcaagataaacatgtgaaatttctaaaagaaaatgcgaatggtaacaattcagaagatttaacgcaatctttcaacaatagattcgggacaaatcaatctaagtcgtctcttaagtccaaaatgtatcaaattggaattaaattcaataacaatacaggaagatttaaaaaaggtgatcattcttataatacttatgcaattggaactaaaagtattgataaagacggatatgtaattattaaacattcaaattctaagggagactataacaaaaattggaaactctatcatcattacttatgggagcaaaaacatggaaggattccggaaggttatgtagttatttttcttaacggggacaacagagattttagaataaaaaatctttattgtgttgagcgtggagtatggttaaaagttatcaataacgatatgagattcgataatccagaattagttgagtctgctattcatctatcaaaattgatgatcaaacaaaaaaatatagaaaaaaggagacgatga

SEQ ID NO: 2482 - DNA, 3648 bp, Staphylococcus epidermidis
tctaaattgaaggaggtaggctccttgattgatgtaaataatttccattatatgaaaataggattagcttcacctgaaaaaattcgctcttggtcttatggtgaagttaagaaacctgaaacaataaattaccgtacacttaagcctgaaaaagatggtctattctgtgaaagaattttcggacctactaaagattgggaatgtagttgtggtaagtacaaacgtgtacgctacaaaggtatggtatgtgatagatgtggcgttgaagtaacgaaatcaaaagtgcgtcgtgaaagaatgggtcatattgaattagcagcacccgtatctcacatttggtatttcaaaggaattccaagtcgtatggggctattattagatatgtctcctagagcattagaagaagtaatatacttcgcttcatatgttgtagttgatccaggaccaactggacttgaaaagaaaacattattatctgaagctgaattcagagaatattatgacaagtacccaaatcaatttgttgccaaaatgggtgcagaaggtattaaagacctattagaagaaattgatttagatgaagaattaaaagagttacgtgatgagcttgaatctgcaacaggtcaaagattaacacgtgcgattaaacgtttagaggtagttgagtcatttagaaattctgggaataatccttcttggatgattttagatgtattacctattataccacctgaaattcgtccgatggttcaattagacggtggacgtttcgctacaagtgatttaaatgacttgtatcgtcgtgttatcaaccgtaacaaccgtttgaaacgtttattagaccttggagcaccaggtatcatcgttcaaaatgaaaaacgtatgttacaagaagcagtcgatgctttaattgacaatggtcgtcgtggtcgccctgtaacaggaccaggtaaccgtccattgaaatctctttcacatatgcttaaaggtaagcaaggacgtttccgtcaaaacttactaggtaaacgtgttgactattcaggacgttcagttatcgcagttggaccaagcttgaaaatgtatcaatgtggtttaccaaaagaaatggcgcttgaattatttaaaccattcgttatgaaagagttagttcaacgtgaaattgctacaaacattaaaaatgctaaaagtaaaattgaacgtatggacgatgaagtttgggatgtgcttgaagatgttataactgagcatccagtactattaaaccgtgctccaacattacacagattaggtattcaggcatttgaacctactctagtagaaggtcgtgcaattcgccttcaccctcttgttacaactgcttataatgcagactttgatggtgaccaaatggctgttcacgttccattatcaaaagaagctcaagctgaagcacgtatgcttatgcttgcagcacaaaacatcctaaaccctaaagatggtaagccggttgtaacaccatcacaagatatggttttaggtaactattacctaacattagagcgaaaagatgccgtgaatactggtgcaatctttaacgatactaatgaggttttaaaagcttatgcaaatggttatgtacatctacacactcgtattggtgttcatgctaattcattcaataatccaacgtttactgatgagcaaaatagcaaaattttagctacatcagtaggtaaaattattttcaatgaaattattcctgattcatttgcatacatcaatgaaccaagtcaagctaacctagaaagaacgacacctgataaatactttgttgatcctacgcaattaggtgaaggtggactaaaagaatactttgataatgcagaacttattgaacctttcaacaaaaagttcttaggaaatatcatcgcagaagtattcaatagatttagcattactgatacttcaatgatgcttgatagaatgaaagatttaggattcaaattctcatctaaagctggtattactgttggtgtttctgacattgttgtacttccagataaacaagacattttagatgaacatgaaaaattagttgaacgtgtgactaaacaatataatcgtggtttaatcactgaagacgagcgttacaatgcggttgtagaaatttggactgacgcaaaagaccaaattcaaggcgaattaatgcagtctcttgagaaaactaacccaatattcatgatgagtgattctggtgcccgtggtaatgcatcaaacttcactcaattagctggtatgcgtggtttaatggcagcaccatctggtaagattatagaattaccaatcacatcttcattccgtgaaggtttaacggtattagaatactttatttctacacacggtgcgcgtaaaggtcttgccgatacagcacttaaaacagctgactctggttaccttactcgtcgtcttgttgatgtagcacaagatgttatcgttcgtgaagaagattgtggtacagaccgtggtttattagtttctgatataaaagaaggaactgaaatgattgaaccatttatcgaacgtatcgaaggtcgttattctaaagaaacaattcgccatcctgaaacagacgaagtaattattcgtccagacgaattaataacaccagatattgcaaaacaaatcactgatgcaggtattgagcaaatgtatatacgctcagcatttacatgtaacacacgtcatggtgtatgtgaaaaatgttatggtaaaaaccttgctactggtgaaaaagttgaagtgggtgaagcagttggtacaattgccgctcaatctatcggtgaaccaggtacccaacttacaatgcgtacattccacactggtggggtagcaggaagtgacatcactcaaggtcttcctcgtatccaagaaatctttgaggcacgtaatccaaaaggtcaagctgtgattactgaaatcgaaggtgtagttgatgatattaaattagcaaaagatcgccaacaagaaataattgttaaaggtgctaatgaaactagatcttatctagcatcaggtacttcaagacttaaagttgaaataggtcaatctgttgaacgtggtgaagttctaacagaaggatcaattgaacctaaaaactatttatctgtagcaggcctaaatgcaactgaaagttacctattaaaagaagtacaaaaagtttaccgtatgcaaggtgttgaaattgacgacaaacacgttgaagttatggtaagacaaatgttacgtaaagttcgcatcattgaggctggtgacactaaattattaccaggttcattagttgatattcataactttactgacgctaacagagatgcattcaaacatcgtaaacgtccagctacagctaaaccagtattacttggtattactaaagcttctctggaaactgaaagcttcttatcagcagcttcattccaagaaacaacacgtgtgcttactgatgcagctattaaaggtaaacgtgatgatttacttggtcttaaagagaatgttattattggtaagttaattcctgctggtactggtatgagacgttacagtgatattcaatacgataaagctactgcaccagtaacagaaacaagtgaagaagttgaaacgatagaataa

SEQ ID NO: 2483 - DNA, 657 bp, Staphylococcus epidermidis
aaacgaatgaaatggtcagaggtatttcatgatataacaacgcgccatgattttcaggcgatgcatgactttttagaaaaagaatatacgactcaaaccgtctatccagataaacaaaatatctatcaagcatttgatttaacgccgtttgaagatatcaaggttgttattttagggcaagatccttatcacggtcctaatcaagcacatggtttagcattttcagtgcaacctcatgctaaatttccaccatctttaagaaatatgtatcaagaactagaaaatgatatagggtgtcatagaacttcgcctcatttacaagactgggcaagagaaggtgtcttgttattaaatacggtattgactgttcgacaaggtgaagcacattcacatcgaaatattggatgggaaacattcacggatgaaatcatacaagctgtttctaattatcgtgagcatgttgtttttattctgtggggaagaccggctcaacaaaaggaacgattcattgatacatctaaacacttaatcattaaatcgccacatcctagtccactatcggcttttagaggattttttggttctaaaccttattcaactacaaataactatttaaaatctaaagggaaaacaccagttcagtggtgtgaaagttag

SEQ ID NO: 2484 - DNA, 228 bp, Staphylococcus epidermidis
acgatgatgaaaatgacaactagcacattagaattatcctcaactatcaaccaacgttacaaatacaacacacaaggcaagacacctacccagatacaacaggaattacgacagataggtgttaaaggctttgtggttaaagtagcaggaagcagagtgacgatgaaagttgagaaagaaaatataagaaagaatagggagtgtatgaggaatggcagaagtaactaa

SEQ ID NO: 2485 - DNA, 1383 bp, Staphylococcus epidermidis
ggggtgatgaattatgaacgtagctatttacgttcgtgtcaggtccgtacattagaacaaaaagaagtgggttattctattgaagaacaagaaagaaagctcaaatcattttgcgagataaacgactggagtgtatcagacgtatttatcgacgctggtttctctggcgctaagcgtgacagaccggaattacaacgtatgatgaatgatattaaacggtttgatttagttttagtgtataagttagacaggcttacacgtaatgtgcgtgatctacttgatttattagaggtattcgaacagaataacgtagcattcagaagtgctactgaagtttatgatacatctacagctatgggtagactgtttgttacgttagttggtgctatggcagagtgggaaagagaaaccattagagagcgtgttatgatgggtaaacgcgcagcgattaaacaaggtatgatactcacaccaccacccttttattatgatcgtgtagataacacttacattcctaatgattataaaaaagtagttttatgggcatatgacgaagtgatgaaaggtaatagttcaaaagctatagctagaaaattaaacgattcagatataccacctcctaatggcaaaaggtgggaagatagaacaataacgagagcgctaagaaaccctataacaagaggtcattatacttggggagatgtatttatagaaaactctcacgagcctattattaccgaagaaatgtatcaacaaataaaagaaaggctagaagaacgaatcaatactaaaatagtcagtcacgtatcagtgttcagaggtaaatttatttgcccgagatgtggtggcacattaacaatgaacacagcaacaagaaagagaaagaaagggtatgttacttataaaacatattattgcaacacatgtaagactaaaaaacaaagtttcggtttttcagagaatgaagcattgagagtgtttcgtgattacctatctaaactagacttagataaatatgaagtaaagacaaaacaaaaagacgatgtcgttactattgatatagacaagatcatggaacaacgtaaaaggtatcataaattatatgctaaagggttaatgcaagaagaagaattatttgaattgattaaagaaacagacgaaacaatagcagaatatgaaaagcaaaaagaattagtacccagaaaatcactagatatagataagataaaaaaatttaaaaatgcattattggaatcatggaaaatattctcgttggaagataaagcagattttattaaaatggctattaaatctattgacatagattatgtaaaacttaaaaacaggcattctatcaaaataaatgatatagaattttattaa

SEQ ID NO: 2486 - DNA, 183 bp, Staphylococcus epidermidis
agaaaggtgaaattcatgattactgtattagtcattactatattttttattacagtaactttaataatttggcaaccaaaaggattagatatagggatttctgcagtcatcggcgcgcttttagctatcgttactggagtagtgagtgtctcagatatattagaagtgacaagtatagtttaa

SEQ ID NO: 2487 - DNA, 861 bp, Staphylococcus epidermidis
aagataaagaataataaatggaggatggaaactatgactgaattaaatactaaagaaatgaaattagacgcactattgaaagacatgcagagtgtagtaattgccttctcaggtggagtagatagtagcttgttactgaaaaaagcgattgatattttaggtgttaactatgttaaacctgttgtagtaaaatcagaattatttagaaatgaagagtttgaactagcgcttaaacttggacaaagtctaggtgttgaagtattagaaactgaaatgtctgaacttcaagatgcgaatatcgttaaaaatacgcctgaaagttggtactatagcaagcgcttgatgtatagtcaacttgagaatattaagaataaactaggatttaattatgtgctagatggtatgattatggatgacttagatgattttcgtcccggattaaaagcaagagacgactttggtgttcgtagcgttttacaagaagcaaaactatataaatctgaagttagagaattaagtcatcaacatgacttgcctgtatggaataaaccagccttatgtagtctagcatcaagaataccttatggtgaggaattaagttttacaaaagttaacaaggtcaacgaagcagaaaaattcattttaagcctaggtattaaccacgtacgagtacgctatcatcacaacatagcacgcattgaagtaacagaagatcaattaaataatcttcttaaattgaaagacagtatcatattacatttgaaagaattaggatttgactatgtaacaatggatttagaaggctatcgtacaggtagtatgaatgaaatcattgataccaaatctacaagttttaaataa

SEQ ID NO: 2488 - DNA, 495 bp, Staphylococcus epidermidis
aaaaaggagaaatgtagaatgaaagaaccgccgcataatagacttacatttaaagagagtatgacagaaggcaaatatctgacgacaataactaaagaagataaaattcgttataaaaaattatctgttgaagaaaaaagaaaagtattaaatgatttcaacgcttctacaccgcaaaaggacgacaaagttagcttattcgattatatgaaacgcactatgttaaaacatggtttagacgaagtgacttctattacagaaaatgctgttttaaaaaacgaaccaggcaaacatatcgacagttttatgacgagattgagtagtttttcaacaacaaaagatggaacaactgttttcacatatgagttaatcaatcaaaactttgttgttataaaaatattagatgaacaactgaaacaaaataaaaaaataatagaacaaaataatgaaatcatcagtttactcaaacaaatagctaacagaggagaaatgtag

SEQ ID NO: 2489 - DNA, 903 bp, Staphylococcus epidermidis
aataagtggaaacgaggtcaactaatgataaagctaatagcaactgatatggatggaacattacttaacgctggtcatgaaatcaccactatgaatcaagaagcgataaaatttgcgcaagcgaacggcattacagtagttattgcaactggtagagcattttatgaggcacaaacacctgttgctgaaacagacttaaaagtaccttacatatgtttgaatggtgcagaagttcgtgatgaatcatttaatataatgagtacatcgcatcttaatcatgatttagtacacaaaattactacagcacttaaaaataatcatatttattatcaaatttacacaaaccgtggcatatatacagaagatcctaaacgtgatttagcaatctatatagatattgcagaacgtgcgggtcaaaaagcagatgtagacaagatacgaaataatatacaaaaacgcatagataacggtactttaaaagttgtagataattatgattcaattgaagatattcctggagaacttattatgaaggtgttagcttttgatgcagatttaagtaaaatcgaccaagtaggtcaagcgttagcatcatcaccaaatttagcagtatcttcatcatcaagaggtaatctagaaatcactcattcaaacgctcaaaaaggcattgccttatcagctattgctcatcaattgggtatagatttaacagatgtgatagcaataggagataatttaaatgatatttcaatgctagaacgtgtaggttatccagtagcaatgaataatgctacagacgaagttaaacatattgctaaatatgtcacagacaccaatgaaaatagtggagttggaaaagcaatcatgaaaatattaaaagaagaaaataatttagaggtgtaa

SEQ ID NO: 2490 - DNA, 420 bp, Staphylococcus epidermidis
gcaactgttgaaactacacgtgaaaaccaacttgctacagtattccaaattctagtaactgcacctgaaatcgcagaccaaatttggttccaacttgtgatgttagtaccgagtattctgtttaaaacgttgaatatgaagttagaaatttggttccagattgacaatatggtattccaaatggtattcatcacgttttgcgtcatagtttgtaatgtctgccacgctccaggtatgtcgcctgataaaagttgtatccatgctgtagctaatccaatgaataattgtgacgcagcttgtagaattccacctatcgcagtgaatactactgaaacgatagtccatagatattggaacgccattactacaccgttaataagactgatgaataagaagcctaaaacttggttagctacttga

SEQ ID NO: 2491 - DNA, 498 bp, Staphylococcus epidermidis
agaatgactgaaaatacaatcaatcctattactacattagaattcaacggagaagaagtagaagcaaaagctactttcttatttgataaaactgctaaaaagtttgctaaagatgagcaagataaaaacggtaaaactactaaagtatcaggttttaatgctatttataacggtattttagaacgtgatactaatgcaattgcagatttttgggaatgtgcaacagcttatttaaataagaaagctcctacacgtgagcaaattgaaacttctttaatgcagtttatcgataaaaatggcgacacgcttgaattactacaaggcgctttagacgtaatgaataatagtggttttttcaaacaaaaatcacgtcaattctggacgcaaatgaacatagcaccgtctatggcaaaagaggaagagaaagagtctacgaagaacggtatcgagttcatgaagaacaactacaaagaaatcatgggcgagctaccttactag

SEQ ID NO: 2492 - DNA, 261 bp, Staphylococcus epidermidis
atgtctaatgaaaaagttgcacgctttaacaaacaacaatatgtagttggtcttaaagaaacgcttaaagcgttaaagaaaggtcaagttacatcattgattattgctcaagacgttgaagttcatttgctaactcgcgtgttaagctatatcaatcataaaaatataccagtatcatttttttctagccaacgtgcgttaggaaaatatgtaggtattaatgttaatgcgacaatagttgcattaataagtgagaattag

SEQ ID NO: 2493 - DNA, 1221 bp, Staphylococcus epidermidis
aacaataatgatatactaatatcaataattaagatggaagaagtgatacatgtgtttgattggtttcaattagcaagtaataaagaaaagagaatggtgcaattacgacgatatttgcatcaatacccagaactttcttttgaggaaaaacgtacgcatgattttattgtaaatcaattgagccaattagcatgcaccatagaaacaccagttggacgtaatggtataaaagcaacttttaaaggatctgattcaaatggaccaacgattgcattacgagcagatttcgatgcactacctgttcaagaattaaatgatgtaccctatcgttcaaaaaataaagggtgcatgcatgcttgtggacatgacggacatacagctattttgcttggagtagctgaaattgttcatgagcatcgtcatttattgaaaggtaatgttgtttttatattccaatatggtgaggaaattatgccaggtggttctcaagagatgattgatgatggctgtctacagaatgtcgataaaatatatggcacacacttatggagtggttatccatctgggacaatctattctagacctggagcaataatggcttcaccagatgaatttagtgtgactatatatggaaaaggtggtcacggtgcaaaaccacacgaaacaatagaccctattgtcattatggctgagtttattttaagtgcccaaaaaataatttctcgaacaattgatccagtaaaggaagctgttcttactttcggaatgattcaagcaggatcaacagatagtgttattccagatacagctttttgtaaaggtactgtacgtacttttgacacaaaattacaaagtcatgttcaaaataaaatggataagctcttacaaggtttatctttatcaaacgatattacatatgaattggaatatattaaaggttatttaccagtacacaatcatcaacaatcatatgatgtagtcaaacaagcagctaatgatttacatttaagatttaatgagtcagacttaatgatgattggtgaggacttttcacattaccttaaagtacgacctggtgcattcttcttaactggttgtggtaataaagacaaaggcattactgcacctcatcataatcctcattttgacattgatgaatcttcattaaaatatgcagctagtgaatttttaaaaatattagaaattgaaaatgttttttaa

SEQ ID NO: 2494 - DNA, 498 bp, Staphylococcus epidermidis
aaaaacagtgacttcggaaaatctgtagattgggcaattcaaggcacagacgcacgtaatggcgttatgcaagaaactaaagatgaacttgatagtgacaacttggataaatatagcttgaaagaaagtgctgaccaagaccaattcaagaaaattcaatctgcttttaaacaacaagaacctatcgtcttcacagcaatggaacctagctggttctctaaagaattagacgttaaaatgttgaaagatccagacaacatttatggtaataataatcaacatattgacttagtatttaacaaagactttaaagaagcacatccagctgcatacacagttgcaacacgtatggcagatgattggagtaaatctgacgaagacaaattagctaaaaaaatctttgttgataacaaaaatccagaacaagtagctaaagactatgtggatgataatgataataaagtagatgaatggttagaaggtattgagactatctaa

SEQ ID NO: 2495 - DNA, 363 bp, Staphylococcus epidermidis
aaccatttagacgtttacgttggactggttatcatgtttaatccattagacgagtttcctcatacaatcgaattaggctcaagagaagttgtaggagagtatccacgtgaacaagagcgctttaagagcgaaaaaacaatacaaggttttatggatacgcctacttcatctgaacaactaaagttccatcaaatgaaccaatcatacgacagaaacctatatacgccgtacagcctgccaataactaacacaaatttattcaaatacaacggtaaaacttacgaagtagtaggagaacctgtcgatcaaggtggacaacaagaaatcaatcttactcggttgaaagagtgtcctattggctaa

SEQ ID NO: 2496 - DNA, 882 bp, Staphylococcus epidermidis
aacatgacagaatttgacttatccactagagagggtcgttggaaacatttcggttctgttgaccctgtcaaaggtacgaaaccaactactaaaaatgaaatgaccgatttacaaagtactcataaaaatttcttatttgaaatagaggaagtaggcattaaaaatttaacttatccagttttaattgatcagtaccaaacagctggtttatttagtttttcaacgagtttaaataaaaatgaaaaaggcattaatatgagtcgcatattagaaagcgttgaaaaacattatgataatggcattgaacttgaatttaacacactacatcaattgttgcgtactctacaagataaaatgaatcaaaatgctgcaggtgttgatgtgtcaggtaaatggttctttgatcgttatagtcctgtgactaatattaaagctgtaggccacgcagatgttacttatggtttggctattgaaaatcataccgttacacgcaaagaattaactattcaagccaaagtaacaacactatgtccttgctcaaaagaaattagtgaatattccgcacataatcaacgtggtatcgttacagttaaagcatatttagataaaaataatgatgtcatcgatgattataaagataaaattttagacgctatggaagccaacgctagttctatcttatatccaatcttaaaacgtcctgatgaaaaacgagtaacagaacgcgcttatgaaaatccacgatttgttgaagatttaattcgactaattgcagctgacttagttgaatttgactggattgaagggttcgatattgaatgtcgtaatgaagagtctatccaccagcatgatgctttcgcacgtctgaaatatcgcaaataa

SEQ ID NO: 2497 - DNA, 330 bp, Staphylococcus epidermidis
ggaatggcagaagtaactaaggaacaattattagaattcattagaaacaatgagttagatttagacgaaagctatccacgtagtgattggtggaagtttagaaatgaacgtgacagtttacgtaagcaacgtgatgaactcatcaatgatatggcagaaacgaaaaggaaagcagaggcgtttgatgagatagtaaaagttttagctagtatctcaaaagagatagtggaatatccaggcgataatgataaacaaaaagaggttatctacaaaagatatgatgatttatttgaacctatgaaattattggaggtaaacgatgaaagataa

SEQ ID NO: 2498 - DNA, 252 bp, Staphylococcus epidermidis
tttctacaagaaaacgcagaggttttatggatgaaagtttatgagtatcagcaacttttaggttttatgtatcgagaggattataaagaagatccaatcatagccaaaatattaatcgagtctgggtgggcagttaaaaggctgcttgatactggaaccattaaaccctttgacgattatgaagaagtgaaagagttaatcatgaatgaaacgaagtggaggcaaccagatgggacttatcgacggacttaa

SEQ ID NO: 2499 - DNA, 552 bp, Staphylococcus epidermidis
atgactaaagaactagaaattaaattattaacagaaaatgcgactatgccgaagagagatagattagatgctgggtacgatatctattcggcagaaacagtaatacttgagcctcaagagaaagcaacgattagaacagacattgctgtgaacattccagaggggtatgtagggctattaacgtcaagaagtggtgtaagtagtaaaacacatttagtgattgaaacaggcaagatagacgcaggttttcaaggtaatatgaagattaatattaagaatgatattgaagtagtagatgcagatgaatttatctataaagatataaaaaatgaaataatcgatgacggaagctttaacgaaccaattgaagagcaaagctctaatccgctagatatttttaaaccaagaaacacaagttatgtcattaaaaaaggcgacaaactcgcacaactcgttatcgtacctatttggacaccagagttaaaagaaatagaggagtttagcagtgggtcagaaagaggagagcaaggctttggatcaacaggattctaa

SEQ ID NO: 2500 - DNA, 252 bp, Staphylococcus epidermidis
acgatgaaagataaagattataaaagtttatggataaagttgaaagagaagaaattaaaagaatatgtggaagtacatcgctcagtaaatcaaattataacaccatacaatcaatatcatttatttgagatagctaacgaaatggtaagtgaaaacgaattaaagcgagatttaaaatatatggaccaactagacggaacgcatgagttccaaaatttattaagtgatttggaggcttgcaatggacaatag

SEQ ID NO: 2501 - DNA, 627 bp, Staphylococcus epidermidis
atgactgaagaaacattatttaatcaattaaatcagaaagatgtaaatgatcatgtagaaaagaaaaatggtttaacctacctagcatggtcatacgctcatcaagaattaaagaagatagacagcaactacagtattaaaacacatgaatttgtacaccctgatgtaccactagataactattttgtaccttatttagctactccagagggttacttcgtacaagtgtcagtaactgtaaaaggacaaactgaaacagaatggcttccagtattggattttagaaacaaatctttagcaaagggtagcgcgacaacgttcgatattaataaagctcaaaaacgttgtttcgttaaagctgcagcattacatggtctaggcctttatatatataacggtgaagaagttccaagtgctaacgacaatgacattacagaattagaagaacgtatcaaccagtttgtaactttatctcaagaaaaaggtagagacgcaacgctagacaaaacaatgcgttggttaggtattcaaaacattaacaaagttactaaaaaagatatagcaaatgcacatcaaaaactagatgcaggactaaaacaattagataaggagaattcgaatgactaa

SEQ ID NO: 2502 - DNA, 639 bp, Staphylococcus epidermidis
atttcattggaactacaattagccattgatttattaaataaagaagaagcagcaaaattagctcaaaaagttgaagaatatgtagatattgttgaaattggtacgccaattgtaattaatgaagggttacctgcagttcaacatttaaatgaaaatattaataatgctaaagtattagctgacttgaaaattatggatgcagcagattacgaagtgagccaagcagtaaaatatggtgcagatattgttacaattttaggtgttgctgaagatgcttcaattaaagcagcagttgaagaagcgcataaacatggaaaagcattgcttgttgatatgatagcagtgcaaaacttagaacaacgtgctaaagaactagatgagatgggtgcagactatatcgcagttcatacaggttacgacttacaagctgaaggaaaatctccattagacagcttgcgtacagttaaatctgttatcaaaaactctaaggttgcagtagcaggtggtattaaaccagatactatcaaagatattgttgctgaagatccagatttagttattgttggtggcggtattgcgaatgctgacgatcctgtagaagcagcaaaacaatgtagagcagctattgaaggtaaataa

SEQ ID NO: 2503 - DNA, 351 bp, Staphylococcus epidermidis
tttattcaggagatacttaaaatgagaaataatgatgaaataatcacaataattaaatcagctatgaaagaacaagatatgtcacttagtgaattagctcgtcgtgtaggagttgctaaatctgctgtatcacgttatttaaacttaactagagagtttccgttaaatcgtacagaagattttgcaaaagcacttagtatcagtacagaatacttacttggttttgacaaaagtgaacaacaagatgaacaaccaaaacatcgtgcagcacatcttgaaggggaattgacagatgaagaatggcaacgtgtgctagattatgcagattatataagaagcaaacgcaaataa

SEQ ID NO: 2504 - DNA, 504 bp, Staphylococcus epidermidis
ctaacagaggagaaatgtagaatgaaaaaggttctttttttaatttttgctagtttattagtattaggtgcatgtggacaagatgaggacaaaaacaaagaagatgatgctaaaaaggttgaagttaaaaagacgaaagaaaacaaaaaagataaacaaagtcaatctaaagaacaaaaacaagaaaaaccttataacaatgatgatgaaccaattttaaatgataacagaaatgcaaacgacaacaattcaaatcaacggaacaataaacaaaatcaaaatgtagataaaattgataacaatgcgtacaaccaacagcaaaacggtcaagtaaatcaaaaagaaaatacagaaaatggacttgacccaaacttcgtacgacataatgacaacatggtaaaagaatggcaaaatcaaatgcgagaacacaacgaaaactttaatcctgaatctggtggagatttgtataacgtcgaaaccggtaactacgttgatgatgaataa

SEQ ID NO: 2505 - DNA, 1314 bp, Staphylococcus epidermidis
gataggagggaaagtatgacgctatcatcatatgcaacgagtaaattaacagaagaaaaggtatttaaagatccaattcatcgatttatccacgtacaggatcaattgatttgggacttaattaaaacaaaagaattccaacgcttgagacgtattaaacaactaggtactttgtatttatcatttcatacagccgaacatagtcgttttggacactctttgggtgtttatgaaattgtgcgccgaatgattgatgagacatttataggacaagacgcgtgggataatactgatcggccacttgcgttgtgtgctgcgttgttacatgatttaggtcatggtcctttctctcatagttttgaaaaaatatttaatacagaccatgaagcatttacacaagctattatcacaggagacactgaggttaatggtgtactaagtcgagtctctgataactttcctaaacaagtagctgatgtaattaataaaacgcacgataataagcttgttatttctatgatttcctcacaaattgatgctgatcgaatggactatttacaaagagatgcatattttacaggcgtaacgtatggctcatttgatatggagcgtattttaaggttgatgagaccatctaaagaagaagtgttaattaaagatagtggtatgcatgctgtcgaaaattttattatgagtcgttatcaaatgtattggcaaatatattttcatccagtaagccgtggtggggaagttttattaaacaattgtttaaaacgagctaagcagctttataatgaaggatatgaatttaaaatgtatccaaaagactttataccattctttgaaggaacaatgacgattgaacaatatgtagaacttgatgaagcagttgtattgtattacttgaagaaatggattcatgaaaatgatacaatattaagtgatttatcaagacggtttatcaatcgagatttatttaaatatattcctttcgacggttcaattattaccatttcggaattgcaagaattatttgaagcgggtggtattaatcctgattattactttgtaagtgaagcattttcagatttaccttatgattatgatcgcccaggctcaaatcgcaaaccgattcatttattaaaaagtaatggtggaattacagaaataagtaatcaatcattggtgattaatagtattacagggattaatagagaagaccataaattatattatcctaaagagatgattttaaaaattaaagattatcaaattaaaggttctattattaacttacttaatgaattaaattaa

SEQ ID NO: 2506 - DNA, 1035 bp, Staphylococcus epidermidis
ggagggctttttatgaaagcagctgtagtaaccaaagatcatagagtaagtattgaagaaaaacgtttaagagaattaagacctggagaagcattagtaaagactgaatattgtggtgtatgtcatactgatttacatgttaaaaatgcagatttcggtgacgtaacaggtgtaacattaggacatgaaggaattggacgtgtcattaaaattgctgataacgtagattcattaaaggtaggggatcgtgtatctatagcatggatgtatgcagcatgtggtaattgtgagtattgcacaactggtagagaaacattatgcagggatgtccttaatgccggatatactgttgatggggcaatggctgaagaagtcattgttgatgcgaattatgcagttaaagttcccgaaaatcttgatccagcggctgcttcatctattacctgtgcaggtgtgacaacatataaagcagtaaaagtgagtggtatcgaaccaggacaatggttaggcgtatttggtgtgggaggattaggtaatttagcattgcaatacgccaaaaacgtaatgggcgcgaaagtcgttgcatttgacattaatgatgataaattaaattttgctaaagagcttggtgctgatgcaatcataaattcaactaatgttgatcctattgaggaagttaatcgtctaacgaataataaaggattagatgcaacggtgattactgctgtagctaaaacaccttttaatcaagcagttgatgttgttaaggcgggtgcacgtgtggtagcagtaggacttccagtagataaaatggatttagatattccacgtttagtgcttgatggaattgaagtcgttggttcattagttggtaccagacaagatttaagagaagcatttcaatttgctgccgaaaataaagttattcctaaaatccaattaagacaattatctgaaattaacgatatttttgatgaaatggaaaaaggaacaattacgggtcgaatggtaattgatatgaaaagcacgcactga

SEQ ID NO: 2507 - DNA, 375 bp, Staphylococcus epidermidis
tggaagagtttatatagaaaggtgggtagcaagatgaaaaataaatttttaatctgtgatgagtgtcaggctgtgaatttaaaatctttgaagcgaaaattagaaaaattagatccggaagctgaaattgaaataggctgtcaatcttattgtggaccaggtcggcgtaaaacatttgcatttgttaataatcgaccacttgctgcattaaccgaagaagaacttatggaaaaggttacaaaacaattaaaaaaaccacgtgatccagaagaagaagagcgactaagaaaacgtaacgaagaacgaaaacgtcgtaaagaagaacaagatcgcaaacttaaggaaaagttaaagaagcacaaagcagagaaataa

SEQ ID NO: 2508 - DNA, 576 bp, Staphylococcus epidermidis
aatgccacacttacctttgtcgcagttatccttatttcattaatccttgatgaaataggattttttgagtggtctgccatacatatggttaaagcatcacaaggacatggattaaaaatgtttgtgtttatcatgatattaggtgcaattattgcagcattttttgctaatgatggagcaaccttaattttgacgcctatcgctttagcgatgataagaaatttaggtttcaataaaaagctagtgtttccttttattatagcttgtgggtttatcgtatattccacatcattaccacttgttgtaagtaatttggttaacattgtatcagcagattactttggtattgaatttgttgaatatttaaagcgtatgtttatacctaatttattttctctattagctagtatcttaatattatggttttactttagaaaatccatccctaaaacatttgatatatcaagtatttttgaacctaaaaatgctatacgagacacacgattatttaaaatttcatggattattttagctttattacttataggttacttagtgagtgagttcatcccctaa

SEQ ID NO: 2509 - DNA, 852 bp, Staphylococcus epidermidis
ttatcattctgtctttatatattgatttggatgcacaacttttctcatgaaggttgtgcattttttcttatacaaataaaaattattgggggcataaagatgaaaaaaactgcaattatcacgggaagtagtcgtggattaggcgctaaaattgcaataactttactagaaaaaggctacaatgttgttgttaattacaaacaaaataaggataaagctgaaaaattaattagaaattataatcaaagtagggctatagctattcaagctgatgtgacagacagaaacgatgtgaatcgaatgattcaaactgccacacaacattttggaaaaatagatatagtcattaataatgcacttgttggttttaaatttgatccaaatcagcaaaaatcgtttaaagatttaacttgggaagattatcaacaacaacttaatggtactttaaaaggagcatttaatgtgactcaaagcgtcataccacaatttatagaacaacaaagtggatgcattgttagtattggaaccaatttgtatcaaaatccagtcgtaccttatcatgagtatacaacagcaaaggcaggtctcattggctttactcgtaatattgctgcagaacttggacaatatggtattacagcaaatgttgtttctggaggattactcaaaacgactgatgcaagtgcagtcactacacctgaagtatttgatttaattgctcaaactacacctcttagaaaagtaacatcacctcaagatgtagccaatatggtcgtatatctcgcttcagatgaagcacgtggcgtaacaggtcaaaatattaccgttgacggtggtttaacaatgaactaa

SEQ ID NO: 2510 - DNA, 252 bp, Staphylococcus epidermidis
ttatggcgactattggcgaataatcgacaccccatgccattaaatttaaattgttattctagcgacaaagatttattcagaataaaactggtagaagaattacctttaaataaaactttaacttttaaatttataactacacgaaaaaatatcacttataagattaaagatttcaaattaccgcaatatagaaggtcattccatagaaaacttaaacatcacaaaaaggtttcaaataaaaacaaagattaa

SEQ ID NO: 2511 - DNA, 228 bp, Staphylococcus epidermidis
acggaaaggtggtgtttgattatggaatttaatgtgaaggttaatgttgatgctgatgaagcaattgagaaattagaacgtatcaaaaaactatacgaagaaattaatcaattaaagaatgatagaccagttgtaaaagtaggaataagcaatgaagccgatgtagaacaaattagaagttatatcaatgagaaaaatgttgaaaatgcaaactttaacttattctag

SEQ ID NO: 2512 - DNA, 519 bp, Staphylococcus epidermidis
gaggtatctcgtttgtctgagaaaaaaggtttcaatttcaatattataaaaaatgatccactagatggtcataaaggaaccaatattggttcgattagtttagataatattgccccggtttttatagatgttgaaaatcagaaggcatttgttgatattggtggtatgcacgcacgtgctgaagttgaaaagggtgtcaagtggattactgacaaatcacaagttgaaggtgaggaggctaaagcatactggctatgttgggtgacgaccgaacgtagtgaagaagggccatattatgcgggtgtgactgcatgctatttattagttaacaaaagtattagacgtggttataagagcatgccagaacatgttaatatgatggataagtctatgaaacatcaatttatcatcgaccaaatcggtgatgataacaaacaaattttaaaagaatttctacaaaatcataacgttgaaatgtggaataattctagtgaagaactatatcgagcatttgaatag

SEQ ID NO: 2513 - DNA, 474 bp, Staphylococcus epidermidis
attatgcctcgtaaaggatcagtacctaaaagagatgtattaccagatccaattcataactctaagttagttactaaattaattaacaaaattatgttagacggtaaacgtggaacagctcaaagaattctttattctgcatttgatcttgttgaacaacgtagtggtcgtgatgcattagaagtgttcgaagaagcaattaataatatcatgccagtattagaagttaaagctcgtcgtgtaggtggttctaactaccaagtaccagttgaggtgcgcccagaacgtcgtactactcttggattacgttggttagttaactatgcgcgtcttcgtggtgaaaaaactatggaagaccgtttagctaacgaaatcttagatgctgcaaataatacaggtggtgcagtcaaaaaacgtgaagacactcacaaaatggctgaagcgaacaaagcatttgctcactaccgttggtaa

SEQ ID NO: 2514 - DNA, 2706 bp, Staphylococcus epidermidis
aaacttttacggtttttatggctaaggaggtcaaaaactttgaaattagacaatttaattacgaaacttcactcgtactttagtcaaaagtttgtaagtcaacttgagaataacttcgaacaaataaaatactggactaataaaagtgatgatagctttaacgagcatttaaccactcaaaaaaatgcgcatacaactgatcaaatcaaacacaaaactacaaaaggtaaagatgtcgtattatctaatcatgaaaattatcaagatgaacttattgaacatcttgtgttaggtcataacggtgatggcaataacgaattaaaagctagtcacacatcaatggacgctcaaagtttcgattctttacaccaacgtctatatcacgactttttaagagaaagtaacgctagagaagaactaagagccgacttaactaagaaaatacaacgtattgttaacgttgatgactttggcggagatcctacaggtcaaaaggacagtacgaaagctttccaagacgcattaggtaacggcaatgtacaggtaactatgagtggtggtacttaccttacaacaggtattaaaatgcctaacaactctcgtttggtaggacaaggtaaagacattactacaattaagtttatggacgaaacacctgcagaaaatattggtatcactaacttaaaaatgagtggtggagctgaaaacatttcattagaaagtttttcgttcaacgggaataagtttagacaaaataaaacacttaaagctaccggtggttctcgttcatctaacattagatttgcgggtgtaactaatggatatatctataacgttaaatcatatgacgctttactacactgtatcgatgtaacatatgcaaatgacaattattactacgaaggcgatggaaacagagtgccttacgcattagaaagtaagcatattcatattgataattgtgaggtatatggttgcggagatgatggtatcactacccatcactctcgttacattacaatttctaattgttatgcacatacaccaacaggcggaagtaataacaacggtgtagaaattgacgatggctcacaatatgtgttcttatcaaacaacagaaccaaaggtaacttcggtggtttagaaatcaaagcacacagtaatgcaagtgctgcaagtggtgtgttcgttaacggtcacgtatcaatcgaagatacaagagcttacaacattcgacacatcggtcatcatagagctaaaacggacaataaaagtttgactgcttatgacgtggtgctaaataattgcttagctttaaaccctaaatacaatggtgtgtatccaggctcaacacctagagcattattaatcagtgcttatagaaatgtttctgtaaataactttacagctataggtgatagtgatttcggaaaattagaaggtggaaaactagataaaaaacaaccagcaatagccatccaattcatgtccgaaaacatctcgcttaataatattaatgtgcgtaactttaaaaatgcagaagtagatattagattatttggcggagataatagaccgtctagagtatcactaaataacataaatatttggaattcatctaacaatatcggtatcggtgttggaagtaaaatatacgacactaaaataactaattgtaacttacacggcaatggttcaggtataggattacgtttgacaaataaccacgctatgattagcggcgtcacagctgataattattcaacttctgcatggatagcaggagaaaagtacgacacaccacctacagtaggaaaaggcggcgctagtatagcgtctacaggaagtgctggtgtagcaaacgctagtgcagttattgcatctacaggtggttcgaaagcatacagtaatcgtagctttgtattaggttctggtgctaactccaaatcttatggttcacgtagcggtattatcaattcacttaattctgaaactgataaaaaaggccatacacaactgattatgaatagtaatcgtgttaagtcacctggtaactatcatgttgtcgctggatatggttctagtggtaatgcttctacatctaacattaaatttgatttaagcacttattcaggaaacttaactttagccggtcaacttaaacaagatagtgccgatatcgcagagttatttgagtcacaaaatggattagcaatcgatttaggaactatcgttacattagacggcgataagataagaaaagcgcaacctaatgacacaccaattggcgttatatctggaactgccgcgttggtagcgaacgaaaaaacattccaccataaagatagatttttaaaaaatgagtatggagtaacgattacaaacagaaaacaagttgaatttgtagacgatgaaggaaatgtttctttcgaatggcgtgacataccagtagaaaaccctgaatataacgacaaaatcgattatcaatcacgttcagaacgacctgaatggaatgtagtcggattattaggtcaaatctacacgaacattgaaaaagacgttataccaggcgactatatcaacggtagagcaggtgtaggatataaagataatgtgaatggtaaaggtcgtgtcatgaaaataacttctgaatacactgaagaacgtggatgtgcaatagcattagtattgtggggtgctaaataa

SEQ ID NO: 2515 - DNA, 402 bp, Staphylococcus epidermidis
atccatcagcgtggactgatacagattatatttacggtcaatatgaatggacggagtgatgaaatgaaagtagtttatttatggaaaaatggacaagcaattattgttcacaaaaacgaagaagatgaatatgtttatcctgatgaaaaatggacagagaaccaacctcctcaaggtattatcttaccttgctattatgacggtaaacaatgggttggacaaacccaagatgagctagaaaagatgttgcctgaagtagaaattcctgttgatgacaaagatattgctatagctaaattaactagcttagttgtcgatttacaagaagaagttatgagtttgaagcagaacatcgcactaataactgaagaacaagcaaatcaaaaattgggggaagcgtaa

SEQ ID NO: 2516 - DNA, 366 bp, Staphylococcus epidermidis
gaaatgcagctttatttgaaagatggtatggaaattagagaagttcaatttacaaatgaagaagttcaaaattattgcgaattgcttaatataaagtatgaccattatgttcctactcttatgtgtgccaagttatggccacaatttgagttatttcaatctttttcaaagaagcctatcatattaaaagagacacacattaagacacaacatcaacttcaagtcgattgtacgtatgaagcgacattgcataaggtttcacaaaaattaattaaaaatatcattaaatatacatatggactcgaaatcaataaagataaaaaacattgtatgtatataaaacaaatatttatcgaggtaagataa

SEQ ID NO: 2517 - DNA, 507 bp, Staphylococcus epidermidis
ttatctattagaagcaagtatcttgaccttaaaatcattatacgctttaatgtaactaatgaagttacattaaggtgggtaaaaatgaatttagaattcaatattgcagtacatgtactatgttttcttgctcaacacgatcaagaacaattcaatagtaaagaattagctaaattaacatgtctgaaccctgtacaacttagacgcgttctagcatatttaactgaacacaactatatcaaagttcagcgtggtaaagcaggaggctaccaagccaatcaacatactgctcaagtagatttagccaagttatatcaacactttgttttagataaaaataatagccaaagacgatttactggcgcttctgacagtcattgtcaaatttctaagaaaattgctcatacaatgtcacattattattctcaagaacatcaaataatattagatttttacaaagataaaaatattacagatgttttggcagatattttacaggaggggtaa

SEQ ID NO: 2518 - DNA, 1089 bp, Staphylococcus epidermidis
ggaagagatagaatgattcaggtaaaagcccccggaaaactttatattgcaggcgagtatgcagtaaccgaaccaggatataaatctattcttattgcagtaaatcgctttgtaacggcgacaattgaggcgtcaaataaagttgaaggtagtattcattccaaaacattacattatgaaccagttaaatttgaccgtaatgaagatagaattgaaatctcagatgttcaagctgctaagcaactgaaatatgttgtgacagctatagaagtgtttgaacagtatgtgcgcagttgcaatatgaatttaaagcactttcatttaaccattgatagtaacttagcagataactctggtcagaagtacggattaggttcaagcgccgctgttttagtatctgttgttaaagctttgaatgaattctatggtttggaattatcaaacctttatatttataaattagctgtaattgcaaatatgaaattacaaagtttaagttcatgtggtgatattgcggttagtgtctacagtggttggcttgcatatagtacgttcgaccatgactgggtgaaacagcaaatggaagaaacatcggtgaatgatgttttggaaaaaaattggccaggcttacatatcgaacctttacaagctcccgaaaatatggaagtccttattggatggactgggtccccagcttcttctccacacttagtgagtgaagtcaaacgtttaaaatcagatccaagtttttatggtgattttttagatcaatctcatgcttgtgtagaaagtttaatccaagcttttaaaactaataatatcaaaggtgttcaaaagatgatacgtataaacagacgtattattcaatctatggataacgaagcatcagttgaaattgaaacagataagctaaaaaaattatgtgatgtcggtgaaaagcacggtggcgcttctaaaacttcaggtgctggtggtggcgattgcggcattactattatcaataaggtaattgataaaaatattatttataacgaatggcaaatgaatgatatcaaaccattgaaatttaaaatttaccatggacaataa

SEQ ID NO: 2519 - DNA, 2118 bp, Staphylococcus epidermidis
tacttattcagtaaatactggaaggagaaaaaatacatggcaagagacttttctttgaaaaatactcgtaatatcggtatcatggctcacattgatgctggtaagacaactacgactgaacgtattctttactacacaggtcgtatccataaaattggtgaaacacatgaaggtgcttcacaaatggactggatggaacaagagcaagaccgtggtattactatcacatctgctgctacaactgcacaatggcaaggtcaccgtgtaaacatcattgatactcctggacacgtagacttcacagttgaagttgaacgttcattacgtgtacttgatggtgccgttactgtacttgatgcacaatcaggtgtagaacctcaaactgaaacagtttggcgtcaagcaacaacttatggtgtacctcgtattgtttttgtaaacaaaatggacaaattaggtgcgaactttgaatattcagtaagcactttacatgatcgtttacaagcaaatgcagcacctattcaattacctattggtgcagaagatgaatttgaagcaatcattgacttagtagaaatgaaatgctttaaatatacaaacgacctaggtacagaaatcgatgaaatcgaaattccagaagaccataaagaaagagctgaagaagctcgcgctcaattaattgaagctgttgctgaaaacaacgacgatttaatggagaaatatcttggggatgaagagatttcagttgatgaattaaaagatgctatccgccaagctactactgacgtagaattctacccagtactttgtggtacagcgttcaaaaacaaaggtgttcaattaatgcttaatgcagtaattgattatttaccttcaccattagatgttaaaccaattattggtcatcgtgcgaacaaccctgatgaagaagttgttgctaaaccagatgattcagcagaatttgctgctttggcatttaaagttatgactgacccttatgttggtaaattaacattcttccgtgtatactctggaacattatcttcaggttcatatgtgaagaactcttctaaagataaacgtgaacgtgttggacgtttattacaaatgcacgcgaactcacgtcaagaaattgacactgtttattcaggtgaaattgcagctgcagtaggccttaaagaaacaggtactggtgatactttatgtggagagaaaaatgacattatcttggaatcaatggaattcccagaaccagttatccacttatcagttgaaccaaaatctaaagctgaccaagataaaatgactcaagctttagttaaattacaagaagaagacccaacattccatgcacacacagatgaagaaactggacaagttatcatcggtggtatgggtgaattacacttagatattttagttgaccgtatgaagaaagaattcaacgttgaatgtaacgtaggtgctccaatggtttcttatcgtgaaacatttaaacaacctgcacaagttcaaggtaaattctcacgtcaatctggtggtcgtggtcaatatggtgatgttcatattgaattcactcctaacgaaacaggtggcggtttcgaattcgaaaacgctattgttggtggtgtagttcctcgtgaatacattccatcagttgaacaaggtcttaaagatgctatggaaaatggtgtcttagctggttatccattaattgatgttaaagctaaattatttgatggttcttatcatgatgtcgattcatctgaaatggccttcaaaattgctgcatcattagcgcttaaagaagctgctaaaaaatgtgatccagttatcttagaaccaatgatgaaagttactatcgaaatgcctgaagaatatatgggtgatatcatgggtgacgtgactgctcgtcgtggacgtgtagacggtatggaaccacgtggtaatgctcaagttgttaacgcatatgtaccactttcagaaatgtttggttatgcaacttcattacgttctaacacgcaaggtcgcggtacttacacaatgtactttgaccactatgcagaagttcctaaatcaattgctgaagaaatcatcaagaaaaataaaggtgaataa

SEQ ID NO: 2520 - DNA, 210 bp, Staphylococcus epidermidis
gttatatacagttctcaaaagagaacgaacggaggtgaaaacatggtacttaacttaaaaagattgagagcagaaagaatagcttgcggaataactcaagatgagatggcacaaatgatgggatggaaaaaagaactccatatgctaaaagagaaaacgggattgtggatattggagctaatgagtttattaaaatggctaaaatattag

SEQ ID NO: 2521 - DNA, 246 bp, Staphylococcus epidermidis
ctttgcaacagaacctgttttcttatatatctccttaatacacgctattttcaccaacaatttttccaaagtgttgcattttccaacgacgtaaaacttttaatggtaccgaacgtgggtataacttgttacattatcaaatgtaacattttaaatatgcttaatttgaggtatcgatttaatgtaattgctcacaaaacatcagcacactacccatactttaagcgatataaattaatgaaatag

SEQ ID NO: 2522 - DNA, 183 bp, Staphylococcus epidermidis
ggagtgagcaggttgattaaacgaatattaaagatttggtttactatcgcaatgtatgagttgggcaaatggattggcagagaagtttattataagttaactgcaaatgatgaggtggaagtgcctaaggactttgacgagaatgaccacgctcatttaaatggcatatacggaggttattaa

SEQ ID NO: 2523 - DNA, 642 bp, Staphylococcus epidermidis
cgattgataaggagtggtcaaatggacattgtaggaatgcagtttaattatcttaaagttctagagttttatggcagaaataaacataaaaagaaactatataaatgttactgtacgagatgcggtaataaaaaaataatgattggtaccgaagtgaaaaatggttattctaaaagttgtggttgtttgaataaagttagtcattctaaaaaacatggtatgactggaactttaatttataataaatggaaaggtatgaagcaacgatgttacaactctaactatgatttttacagcgcatatggcggtagaggtataaaggtttgtgatgagtggaaagatgactttatgcaattctacaaagatatgggggatgtaccattcgaaggtgctgaattagacagaattaacaacgatgacgattataaaccatcaaattgcagatgggttagtcatgaagaaaatgcaaacaatcgacgaaaatatcataataagacaggatatacaggagtaacttacaaaccacatctaaacaaatatcaagcgcagctttacaaaaacaagaaatttatatacttaggtgtttatgaaactgcagaagaagcacacttagcttataaaaaagctaaaaatgaatattaa

SEQ ID NO: 2524 - DNA, 270 bp, Staphylococcus epidermidis
atgaaacgaagtggaggcaaccagatgggacttatcgacggacttaaaaagcaatacacgttatatcagattgacggttggaagatgtgcagtgtaacgccgttaggggaagatacattcaaactaggtaactatgcaggcatacactttagaaacacattctcaggaacagtaacgaaagatgaactagaaaaactgaaacgcaaacataagcttttcagaaaagaagaactgcaacaacaaatgacaattaacgaattattattttga

SEQ ID NO: 2525 - DNA, 210 bp, Staphylococcus epidermidis
atgaaacgaagttcatacctacgtcgtcaatcaaatttaattatatctatgattattttcgttatttttttaattgtagatatcaatgtacttattaataaacatcaagttgtgcctgtgctattatcaagtatcagtttaattatttttatcatgctatttgtagttgcattgttcaaatgtataactaattataaacatcaatcttag

SEQ ID NO: 2526 - DNA, 783 bp, Staphylococcus epidermidis
gtacctatgagccatagttataattctatagaagaggtgctcaaagctgtaaaatcaaatcaactatctattaatgatgctaaagcccaactcagtcattatgacgaattgggctttgctaaaattgacttacatagagcacagcgtcaaggatttcccgaagttatctttgggcaaggaaaaacaaaagaacaaatcactaaaatcatctctagtttgatatttcataatgaagttattctagtgacacgtgttgatgaaatgaaagcaaaatacattttacaacattatccaaacttggaatatcatcaaactgcacagttaattagcactccactaaaagatataccacaatctaaatactatgtttctgtactttgtgctggaacttctgatttacctattgcagaagaagctgcattaaccgctgaaatcatgggagtaagtgtaaaacgattttatgatgtcggggtttcaggtattcatcgcttattatccaacattcatgatatacgcagagggaaagtttctatcgttatagctggaatggaaggcgctttagcaagtgttgttggaggattagtcaaccaccctgtatatgcagtaccaacgagtgtaggttatggagcaaacttgaatggggttaccaccctattatcaatgataaatagttgcgcacccggaaccagcgtattaaatatcaataatggatttggtggcggttacaacgctgcacagattattcatatgctagaaaataaagagagtgaggtatctttatga

SEQ ID NO: 2527 - DNA, 198 bp, Staphylococcus epidermidis
gtgatttggaggcttgcaatggacaatagagagtttatccaacgctgcatagtatcatctacagcttttacaggacacgatgggtgtttactaatcaaagagcttaacgaagtatatcgcaaggcagagttgtacgacaaaatagtggaaaataattcaaagagtttagtagaaaatggaggaacaataaatgactaa

SEQ ID NO: 2528 - DNA, 3123 bp, Staphylococcus epidermidis
tcaaagaggaggttagccatgaacaaaaactttatggctcgtatatcggcgattattacagattttcaacggaatatcagaaaagctcaacgtatggcaaaaactgaaatacccgatgaaattgaaacacaagtcgacgccaacataagtaaatttaaacgagccttaaatactgctaaagcaatggctcaacgttggcgagaacataccgttgatatagacggaaacgccaaccctgttaaacgagcaattgcagtagttagagaaaaactacaacagttaagagataaagaagtagacatcaaagggaataacaatcccttaaaacgttctgtactaggtgctaaagctatgcttgcaaccttacatgataaaacagtacacgttaactttgacacaagaggtatgacgagagcacaagtgctgacaagagcgttaggtcaatcgttagatgaatacggcgataaaatggacgccttagcaactaagataagaacattcggtactgtattcggacaacaaatcaaaggtatgttaattgcgagttttcaagggcttattcctatcatagctggattagtacctgcaatcatggcagtagctaacgcattaggtgtagttgctggtggtgcattaggagtagctggtgcatttggtattgctgcgagtggtgcgttcgcatttggtgctatggcagtaagtgcaattaaaatgttgaatgacggaacattacaagctactgcgcaaacaagaagataccaagcgtctttagaacaagttaaatcaacgtgggaaggcattatcaaacaaaatcaagctcaaatattcaatacgttatctaacgctttagatactgttaacgtagctttaggacgtatgaaaccattcttagcaggtatctctaaaggaatggaacaagcgtcacagagcgtcttaaaatgggctcaaaacagtcaaactgcgagtaagttctttaacatgatgaatacaacaggtgttaagacgtttaacacattattaagtgctgcaggacgttttggcgatggacttataaatgtgtttacacagttaggtccattattcttatggactgctaaaggtttagataatttaggtaagaagtttcaaaactgggctaacagtgtagcaggtcaaaatgctattaaatcattcattgaatacacacagactaatttacctaaaataggccaaatattcggcaatgtattcatgggtattggcaacttgatgaaagcatttgctcaaaacagttctaatatttttgattggttagttaaaatgactgccaagtttagagaatggtctgaacaagttggtaaatcagagggctttaaaaagtttgtacagtatgtacaagagaacggaccggttattatggatctaatcggtaatatcgtaagagtgttagttgcgtttggtactgctatggcaccaatagcaagtgtgatattaaaagtagtaacggcgttagctggtttcatcgctaagttgttcgaaacacaccctgctatagcgcgtatggttggtataggtatgatactcggtggtatgttgtgggctttattagctccaatcatcgcagtgagtacagtgttatctaatgtgtttggtgtaggtttaatccaagctatcggtaaaatgttagcttttgctagaaacactcaaatacttagaagtgcattaaacttagtgaaaatagccttcaggctccttatgagccctattagtacaattatgcgtatcttacctatgttaagtggtgctttccaagcattaggagtagctataggtgcgatttcatggcctgtattagctattataggcgttattgtcgctttaataggtattattgtttggttatggaaaacaaacgagaatttcagaaaaacttgcattgaagcttggaacacgattaaagatacgataatgaacgctgtaaaatcagtgattaactggtttaatcagttcagagcgtctatacaacaaacattgcaacctattattcctatcttacaaatgttaggtcaagtagctaaccaagttttaggcttcttattcatcagtcttattaacggtgtagtaatggcgttccaatatctatggactatcgtttcagtagtattcactgcgataggtggaattctacaagctgcgtcacaattattcattggattagctacagcatggatacaacttttatcaggcgacatacctggagcgtggcagacattacaaactatgacgcaaaacgtgatgaataccatttggaataccatattgtcaatctggaaccaaatttctaacttcatattcaacgttttaaacagaatactcggtactaacatcacaagttggaaccaaatttggtctgcgatttcaggtgcagttactagaatttggaatactgtagcaagttggttttcacgtgtagtttcaacagttgctcaaaaaatgatgcaagcgctcagtcgtattatttctggtggtgcacaatgggtttcaagcatcatttctgcaatgagtagatttttacaagcagtagttagtggtttcttcagagtggtcggcgctgttggaaatggcatgagaaacgcattaaatcgagcgcgcagttttattggtcatttctatcaagtaggcgttgatatgatagctggaatgataagaggtatcgttcaaaaagctaaagatttagcagcagctgcatggaacgctgcaaaaggtgcattgaacgctgcgaaaagcgctttagatagtcattctccttctcgtaaattcatacaactaggtaatgatagtatgactggattaggtatgggtatctctgaatatgcaggaaaagctgcaagagaaagtaaattagcggcattaaaagttatggatgccttcaacgcagacttaaaaccggactttttagaagaaggattggctggtttaggaaattctttcgatgcacatatgagtaaagacgtacgccatagcatgcaagagaacaataaacctatcgtcaacgtgactgttcgcaatgagtcagatataccagctattaaatcatacattgaagattccaactcaaaagacgcaagtttcggattattttaa

SEQ ID NO: 2529 - DNA, 387 bp, Staphylococcus epidermidis
gaagaaacaggaactattaggaggttagacattatgtcaatgactgaactagaagcaattgaaatcttagagttaataaataatgtctacgatatgaaattcaatgaaattaaatacaacctttgggtagaacaactcacacaatatggggatttcgatagaacactacacaaaacaaagaaatatgttagagaaagtcgttacaaacctacgatttcacaaattattgatcgcaaaccaccagaaatggaaagcgcagtaataccggaagaacagactgataaatacagaatgcagcacgataaagaatttagagagaaaaggcaacaattaagaaaacaatggcaaaagatgaaagaagattgggggttagatgatgagtattga

SEQ ID NO: 2530 - DNA, 699 bp, Staphylococcus epidermidis
gaagtgggagggttaaatgtgatttacatgtacgaaccatttactcacacggtgactaagacagacttatctcatctgcacaatattacaggtattcccctcaacacactgtggtaccaaaaagaacgtggcacatataacgataagttgaagtgcttctttaccgacacaatgccgagagtgaataagaaacaggtgttcaacgaaagtgttgtagcaaaagatgaaatttggaagtatagcgagaagtatgatctatacgtaagtaacttaggcagaatgaaaagacctgatggaaaatacaagtttgcgaatggatgtaacggtatttccacagtcatttataagaataagaagtatcgtgcagcagatattgtatatgaaacatttatcggcaatttgagaacagggtatcacgcttatcctaaggacagtagatacaacaatcttatggcagataacttattccaatctacattgcaaaaatatagagtgtatcgcagaaataaaggcatatctaagccagtatatcttgtcgataacaacaaccgaattgttgaagaattcgcaagtacagtagaagctcaaaaattattattcatagacagacgcaacatcgcaaggaagtgtaaccgtaaacatgtaagtgacggattgatgtatatgtgggcagacgaatacgaggagttaaacgcataa

SEQ ID NO: 2531 - DNA, 204 bp, Staphylococcus epidermidis
agaggcaagggaggtataaacaacatgattatctacagaagaaatatagaaaatggaacacccatttatgaaatcataactaaaactttcaagacaattactataaagtgtgatgaaacttttaataagtatgaaatctatcaattgctctctctactagagaatgacgttgacaacatgccgacaagttactcatatcgttaa

SEQ ID NO: 2532 - DNA, 1197 bp, Staphylococcus epidermidis
ggtatctttatgacaaaagcattatatttagattgccacgcaggtattgccggagatatgctactttctgctttagttgatttaggagcaaaccctgaagacattgaatcagaactaaaaaaattacctttagatcaatttaagctacattttcaaaaaagagtaaaacaaggtattcatgcaatgacattaaacattgatgttaaagaagcaaatcatcatcgtcacgttaatgatatatttaaaatgatagatgacagtacacttccggaaagggttaaatatcgcagtaagaaaatttttgaaatcattggtcaagcagaagctaaaattcatggcatgtcgtttgaagaagttcactttcatgaagtgggggcaatggactctattatagatattattggtgggtgtattgcactagaacaactagggattaacacattatactgttcagctattccaacaggtcatggtaaaatcaatattgctcatggcatttatccaatccctgcaccagctactgctgaaattcttaaaggtataccaatcgcacattttgatgttcaaagtgaactcacaacccctactggtgctgcatttgctaagggacttgtttcatcgtttgggccatttccttcagcaacaatacaacatataggctatggcgccggcagtaaggattttgatttccctaatatattaagggttattcaatttgaatctgaattcgagcaacaagatagcgtccaagtaatagagtgtcaaatagatgatatgacacctgaagcattaggttattttatgaataatgcgttagagcaaggtgctttagatgcttactatacgcctatatttatgaaaaaaagtcgcccaagcacgcagttaacgttaatatgtaaattacatgataagacatatttcgaacaacttatcttacaagaaacaagttctttaggcgtcagaagtacttctgttaatagaaagaccttgaaccgcgcattcaaaattctttctacacaacacggcactgtttccattaaatttggcctacaaaatggaaaaattatgaaaatgaaacccgagtatgaagatttgaagaaaatagctaaaactacaaaacaaccgtttcaagtaattcataacgaggtattacaacaactctatcaaacatatcatataggaaatatacttcaataa

SEQ ID NO: 2533 - DNA, 1500 bp, Staphylococcus epidermidis
gttttatttatggaaaataaaaataacaatgtagatagaggtaaccttaagcagaatctttccgagaaatttgtatgggctattgcatatggttcgtgtatcggatggggcgcttttatattaccaggagattggattaaacaatcagggcctattgcttcttcaataggtatagtaatcggtgcgttattgatgattcttattgctgtaagttatggcgcactcgttgaaaaatttcctgtttctggtggcgcatttgcttttagttttttaagttttggaagatatgtaagctttttctcttcatggtttttaacatttggctatgtttgtgttgttgcgttaaatgcgacagcattcagtttgttgattaaatttttattaccaaatgttttgaacaacggtaagttatatacagtagctggttgggatgtttacataactgaaattgttatcgcaactgtgctacttatagtgtttatgttgattactattagaggtgccagtgtgtctggttcgttacaatattacttctgtgttgcaatggtccttgtagttgcacttatgtttataggttctttctttagcagtcactttagtttgagtcatttagagccattagcgagtgtagataaaggatggtttcaatcaatcattatgattgtctctattgcaccatgggcgtacgtagggtttgataatataccgcaaactgctgaagaatttaacttttctcctaacaagacgtttaaacttattgtttatagtttactagctgcgtcactcacttatgtagtgatgttactttacacaggctggctaagtacacaagcaacaagtttaaatggtaacttatggcttacaggtgcagtgactcaagatgcattcggttttattggccttgcagtattagcagtggcaattattatggggatttttactggattaaatggatttttaatgagttcgagtcgcttattattttcaatggggcgctctggcattatgccaacagtatttagtaaattacacagtaaacataaaacaccatatgtcgctattatcttcctagtagctgtatctttaattgctccttggttaggtagaacggcattaacatggattgtagatatgtcatctacaggtgtttcaattgcatattttattacttgtttatctgctacgaaattatttagttttaataaacagagtaatacgtatgcaccagtttataaaatttttggtattataggatcgattgtatcctttgtgttcttatgtttattgcttattccaggttctcctgcagcactttcgataccatcatacatcgctttaggaatttggttggtaataggattaatcttttttatcattcgcttgccaaaacttaagaaaatgaataatgatgaattgagtcgattgattttaaatcattctgaagacgaagttttagagatggttcatgaacctggtcaatctaattcaacgaataaatag

SEQ ID NO: 2534 - DNA, 1164 bp, Staphylococcus epidermidis
tggagagttataaaaatgaaacaacctgttattattgcagcaaaacgtatagctttcggtaagtatggtggccgattgaggcatttagaacctgaatcattactagaacctttatttaatcattttacagatcagtatccaaaagtaatgtctcttttggatgacgtcattttaggtaatacggtaggtaatggggggaatttagctagaaaatcattacttgaagcgggattagattttaaaatacctggtataacaattgatcgtcaatgtggctcaggtcttgaagccgttatacaagcctgtaggatggtacaaagtggtgctggaacaatatatattgcaggtggtgttgagagtaccagtagagcaccttggaaaatcaaacgtccgcagtcagtttatgaatctgagtttccacaattttttgaacgggcgccttttgcaagagaaggagaagacccttcaatgattgaagcagccgaaaatgtagcgaagaaatatcatatcagtagaaatgaacaagatgactttgcgtatcgcagtcatcagttggcatcaaaaaatatgaataacggtaatatttcccaagaaattttaccgttcaaagtgaaaggtgaatattttaatcaagatgaaagtattaaacctcaacttactctcagaacacttggcagacttaaaccacttttaaatgaaggaacagtcacagtaggaaatagttgtaagaaaaatgatggtgcagtattactgattgttatggaagaaaatcgggcacgtcaattaggattcacagaagggattaagtttgtgaatagtgcaactgtaggtgttcaaccacagtatttaggagtaggtccagtgccagcagtaaatcaattattagctcaagaacgattaactataaatgatataaatgcagtagaattaaatgaagcatttagctctcaagttattgcgagccaacaacagcttaacattcctttgaataagttgaattgttggggaggagcaattgctacagggcatccatatggtgcaagtggagcagcgttagtcacacgtttattttatatgaaacatcaatttagaactatagcaactatgggaataggtggagggataggaaatgcagctttatttgaaagatggtatggaaattag

SEQ ID NO: 2535 - DNA, 1245 bp, Staphylococcus epidermidis
tatagaattttattaacttatgtacggaagtatagacactcgattaatatcggatgtataccgactaaaacattaattcatgatggtattgaaggtagttcattcaaagaggctattactagaaaaaaagaagtcgtacaggcattgaataacaagaactatcaaggcttaaattcaaaggacaatatagatgttctaaattataaagctaattttatttctaacgaggtaatagaactacaagataataatggaacaattcaagaaacaattacagcagataagatagtaatcaacactggttcacgtgcaaatatcccagatatcaaagggatagatacagctcaaaatatatatgattctactggattactaaatattgactatcaacctcaagaacttgttattattggtggtggttatatcgctctcgaattcgcttcaatgtttgcaaattttggaacacatgtaacaattcttgagcgtggtgatgctatcatgacaaatgaagatcaagacattgcaaatcttattgtcaaagatttacaagataaaggtgtgactataaacactaatactagtactattgcattttcaaacaataaagatcaaactatcatacacacaaatcatggagaaatatcagctgatactgtgctcttagccacaggtcgtaagccaaatacaaatcacttaggtcttgaaaatacagatgtaaaaatcggaaaacaaggtgaagtaattgtaaatacacatttgcaaagtacagtgaaacacatatacgctgcaggtgatgttaaaggtggattgcaatttacgtatatttcactcgatgattatagaatcattaaatcacatctatttggtgatggttctagaacaactgaaaatcgtggtgcaataccttatacggtctttattgatcctcctctatctagagtaggactaattgcaagtgaggcgaaattacaaggatacgatattctagaaaataaagtctttgtcagtaacataccccgtcacaaaatcaataatgattccagaggtttatttaaagcagtaattaataaagatacaaaagaaattttaggagcgtcattatatggcaaagaatcagaagaactgattagcttaatcaaacttgctatagatcaacatattccttacacagtattaagagataatatatacacacatccgacaatgaccgaatcctttaatgacttgtttttagaaccactttga

SEQ ID NO: 2536 - DNA, 501 bp, Staphylococcus epidermidis
atgtctgctatcattgaagcaaaaaaacaacaagtcgatactatcgctgaacaacttaaaaattcagtttcaacagttatcgttgactaccgtggtttaactgtagcagaagttactgaattacgttcacaattacgtgaagcaggtgttgagtataaagtatacaaaaacactatggttcgtcgtgctgctgaacaagcaggtatcgaaggcttggatgaattcttaacaggtcctacagcaatcgcaacttctactgaagatgttgttgcaccagcaaaagttattgcaggatttgcaaaagaacatgaagctttagaagttaaaacaggcgttatggaaggtaacgttatctctgctgaagaagttaaaacagttggttcattaccttcacacgatggtcttgtatctatgcttttatctgtattacaagcacctgtacgcaacttcgcttatgcagttaaagctgttggagaacaaaaagaagaaagcgctgaataa

SEQ ID NO: 2537 - DNA, 882 bp, Staphylococcus epidermidis
ggtgttcatatgacaaataatcactttcttaacataggtgtgttactgtatggatgtggtcatcatcaagcggcatggcgtatgaaagattctaatattgaggatatcggcaacatatcttattatcagcatttagctcaaatagctgaaaaaggtcttttggatatcgtcttttttgcagataatcaagcctttaatgcaagtgataatactactatgcccgctttttggtttgatcctataattaacttatcagctattgcacaagttacatcacatataggattagtgccaacaatatcgagtacattttcaaatccattcaccgcttctcgtcaattattaagtctagactacttatctcatggccgtgtgggttggaatttagtcacatccatgacagatattgaagcccaaaatcacagtcttcaatacttaccagaaagacatgagcgctacaaaaaagcagatgaatttgcatcggtaatgaatcagctattcacttcttggtcaactgcatcttatgtaccagataaaaacaacaacaaaattattgagtctaaagatattaaacctttttatcatgagggagactattttcaagtacgaggaccacatacaacaccacaaagtcctcaaggtaaaccagtatctatgcaagccggtgcgtcaaaagaaggtattgcattagcagcaaaatatgctgatgctgtttactctgtttcatgggatatcaagcaagcacgtagttataaaaagaaattgtctgatgctatttctaaaactcaacatccagatagaaaaattaaaattttccctggtttagtaacttatgtaggtgaaacccatgaaaaaagcattatcaaaaaaagcagaacttga

SEQ ID NO: 2538 - DNA, 447 bp, Staphylococcus epidermidis
atcatgagtattaaagatttgaatagaggcgatagaatcagaatgcaagaagttaatggtgttgaaattacagtgcaaataaaaaatgtttatcgtttagttcagtcaagtcttgatatggataaatgggttgctgatgtagaagcaattgacgggagaacttggactattgatgattgttatgatttttactcattacctaatggaaatgaaggaactaaaaagacattagatgacaaggttaaccacccgtcgcattacacgtatggagatatggaaattatagatttcatagagcaggtcactaaagattacaaaccagagttagcatttgcgattggtaatgcaatcaagtatataagtcgtgctaatcgtaagaacggtaaagaagatttagacaaggcgcgttggtacctgaatagagcatttgagaagtgggagggttaa

SEQ ID NO: 2539 - DNA, 1251 bp, Staphylococcus epidermidis
atgatgagtattgatgtattgagtaccgaagaatctataatatctaacctcatgcgtaatccagaattactaggtaaattcagattaaagcctgaaatgtttactgacgagaaattaagagtgttcattgagtatgtgttagagcaaggcaaagtcgatgtaaatcaaatctactttaaaagtcgtgatgataatgaatttatatctactgaccgattaggtcgtttatacaattcagacggcactgacaaggcgttttttatggacgaccaattgaatctattacaagaatacgtcttgtcacaggctcgtgagaagctcacagagtatcaatcaatgccaagtaaagaaaattttaattatttggtagaggaattagagaaattaaaaggtatgacaataaaaaaatcagacgctaccgatagttttttagctgaagttgtagaaaatattctatctgatgaaccaaaacaatttattaaaactggtattgcttctatagataacaaaatcattggctttgaaccaggtcagttgaatgtattaggtgcaagaccttcgttaggtaaaacttctcttgcattaacaatgatgtggaatatcgcgcagcgtggatatcctacaacgttctttagtttagaaactggaggtaacaatatcgttgagagattagttgcaacaataacaaatattccactatctaaaatcaagcaaggtaacggattaaatgatgatgaagtttcatcggtaatgtctgctatagatcaaattaaaaaatgtaattctttgaagattgaggaccaagcacaaatgacaccacaagacgttcgagaagttgcttcacagaaagcagataagcctcacgttatatttattgattatcttacactcatgcaatcagatgtacctcaacgtgatagacgattagaagttgaaaagatttctcgtgatttaaaaattatagctaaagaaacaggttgtatcattatcgcactatctcaattaagtagaggtgtagaaagtcgtagtgataagcgtccgatgatgtctgatttaagagaagcaggaggaattgagcaagacgcgaatatgattttcttcttataccgtgacgattattacgaccaagaccaacaagacaacattacaggcaagtcggaaattgaattcattatttctaaaaataaagacggagaaacaggggtagcacaccttgatttctacaagaaaacgcagaggttttatggatga

SEQ ID NO: 2540 - DNA, 1245 bp, Staphylococcus epidermidis
gaaactatcatgagagataaatttgaaataacttttattaagaataggagagatttaataatggcaaaagaaaaatttgatcgctcaaaagaacatgccaatattggtactatcggtcacgttgaccatggtaaaacaactttaacagctgctatcgcaactgtattagctaaaaatggtgacactgttgcacaatcatacgatatgattgacaacgctccagaagaaaaagaacgtggtattacaatcaatactgcacatatcgaataccaaactgacaaacgtcactatgctcacgttgactgcccaggacacgctgactatgttaaaaacatgatcactggtgcagctcaaatggacggcggtatcttagttgtatctgctgctgacggtccaatgccacaaactcgtgaacacatcttattatcacgtaacgttggtgtaccagcattagttgtattcttaaacaaagttgacatggtagacgacgaagaattattagaattagttgaaatggaagttcgtgacttattaagcgaatatgacttcccaggtgacgatgtacctgtaatcgctggttctgcattaaaagcattagaaggcgatgctgaatacgaacaaaaaatcttagacttaatgcaagcagttgatgattacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtatgcacgaaacttctaaaacaactgttactggtgtagaaatgttccgtaaattattagactacgctgaagctggtgacaacatcggtgctttattacgtggtgttgcacgtgaagacgtacaacgtggtcaagtattagctgctcctggttctattacaccacacacaaaattcaaagctgaagtatacgtattatctaaagatgaaggtggacgtcacactccattcttcactaactatcgcccacaattctatttccgtactactgacgtaactggtgttgtaaacttaccagaaggtacagaaatggttatgcctggcgacaacgttgaaatgacagttgaattaatcgctccaatcgctatcgaagacggaactcgtttctcaattcgtgaaggtggacgtactgttggatcaggcgttgtaactgaaatctttgaataa

SEQ ID NO: 2541 - DNA, 477 bp, Staphylococcus epidermidis
gtgaaacccatgaaaaaagcattatcaaaaaaagcagaacttgatcaaaaattacccattgaagatgctttaaagcaactcagtttttttgttcaacaagattgttcagattgggaattagatgaaccagttcctcccttacctcctgctaaaaatttcaaaggtccgattggtcgatatgaaacagttttagccattataaaagataaacaaccgactgtaagagaattattaggttacttaagtgccggtggtggtcatcttactcttataggtacacctgaggagatagtggatgagatggagcagtggtttaatgaaggcgttgcagacggctttaatctgatgccaccttcattaccccatagccttgaagattttttaaaatacattataccagaactacaacgtcgtgctttatttaaaaattcttataatcaatctacactacgtacattattaaatctcgactcataa

SEQ ID NO: 2542 - DNA, 690 bp, Staphylococcus epidermidis
aaaggagtcttttgtatgaactatttcagatataaacaatttaacaaggatgttatcactgtagccgttggctactatctaagatatgcattgagttatcgtgatatatctgaaatattaagggaacgtggtgtaaacgttcatcattcaacggtctatcgttgggttcaagaatatgccccgattttatatcagatttggaagaaaaagcataaaaaagcttatgacaaatggcgtattgatgagacgtacatcaatataaaaggaaaatggaactatttatatcgtgccattgatgcagagggacatacattagatatttggttgcgtaagcaacgagataatcattcagcatatgtatttatcaaacgtctcattaaacaatttggtaaatctcaaaaggtaattacagatcaggcaccttcaacgaaggtcgcaatggctaaagtcattaaagcttttaaacttaaacctgactgtcattgtacatcgaaatatctgaataatctcattgagcaagatcaccgtcatattaaagtaagaaagacaagatatcaaagtatcaatacggcaaagaatactttaaaaggtattgaatgtatttacgctctatataaaaagaaccgcaggtctcttcagatctacggattttccccatgccacgaaattagcatcatgctagcaagttaa

SEQ ID NO: 2543 - DNA, 537 bp, Staphylococcus epidermidis
cctttaataattgaagggtggtttctaatgttaataaatgtacttaatttaaatgactcacaagacggcaatcgcattaaacaaggtgacttatcgcacatgcgatacatcttgtctgacaataacaacgaagacttaaaattagaaggattgcctgcaaaagtttttctcactgacagtacaggtgtcaaatatatctacgacactacagttaggcaatatgacaatgcctatgtgtgtgatgttgtaatcaatcaaattatccctgcaaacacgtattcattagaaatatgggtggataacaagtatgtattcccgtccgacaataaagcgaaaattcaagtaacagagagtgtgattggtaggcaattgatcaatacacaaaatcatgatttatggcaagaaatgattgaatacggtgtaaaaaacggattaattaagaatcaaactgaaagcgaagaaaattttgttattggagagaacgcccctaatgacacaactaaaatttggattgatactactggaggtaatgaataa

SEQ ID NO: 2544 - DNA, 369 bp, Staphylococcus epidermidis
gtgagaataatgaacaaagaacagattctacaattgattgagcaagaattgatacaagcagatgaagctcagacagatacggaatttgaaaagcatatgtatgctatacacatgctcacatctcttgttagttctcatcaaagtcgttctacaatagagaaattaaatcattctaaaccaatgaatagtaatatcaaagatgattatgagatgaaacaacagtcttcacaaaaacatcatgtaactgcagctgaaatagaagcaatgggtggtaaagtaccacaatcaatgaaaaagcatcatacttctaataatatgatgattacagatgatcaagttggtaatggtgaatctatttttgatttttaa

SEQ ID NO: 2545 - DNA, 711 bp, Staphylococcus epidermidis
gcgcatgtaatcatgattttttttcatatgtgttggaatacctcacttatggtacaatactcattgtctatcttaacatttggagaagtgattatgaataaaccatttattgcaatcgaaggacctataggtgttggtaaatcctctcttgctcaccgattaagcaagacgtttggtttttatgaagagaaagaaattgttgatgaaaatccatttctatctgatttttatgatgatatagaaaagtggagttttcaaactgaaatgttctttttatgtaacagatataaacagattagagatattgagtcgctaaatcaaggtatagttagcgattatcatattcataaaaataaaatttttgctaaaaatactttagatgctaaagaatttgataaattcagtcgtatttttgatattttaactgaagatatcgaaatgccaaatacaattatctttttagatgctgatttagatgtattaaaatctagaattgcacaacgtaatcgtagctttgaatctcaaatagaagatgactatttacttactttaaaaaaagattatcttgcttattatgaatcattaaagaatgacggtgcaaatgtcattcgaattgatacatctcaacaagatttcgttaaaaatgattacgattaccaaaatattttaaatttagtaaaacctatgattggagaaaataaagatgaataa

SEQ ID NO: 2546 - DNA, 609 bp, Staphylococcus epidermidis
ggagtagtaataatgaaaagagaatttttacgtggtttaggtgtcgaagaagatgctattcaaaagattatcgacgaacatcatgaaggtttgcaatcttataaagaaaaagtagagaaagttgactcactaaaagaacagttggaaactgctaacgaagaaattaaaaatcgtgataatcaaatcgaagaactcaaaaacaatgttggcgataacgatgaacttaaacaagagttagagaaatataaagaacaaaacgccaactacgatcaaaaactcaaagatgttcagttgaacaaagctatcgaagtatctttagctaaagagaaagcaattaaacctgaacaagtaatcaaactaatcgataaagataatttagaagttgatgacaatggaaatgtcaaaggattagacgattacatgagtgagttcaaaaaagagaatgagcatttgtttgaacaatctaaaccaagtggacgcacaccagatgacggtaaaaacgtaaatggtgggattacacaagaagaatttaacaatatgagtgtcgcagagagaactaatctattcgttaacgatagaaaaacttacgacactctaataaacaattag

SEQ ID NO: 2547 - DNA, 687 bp, Staphylococcus epidermidis
atggtagtaataaaaaactacattacagaagatgacggtacaacaactgtagtcatcaaaggagtagaactagataacaaaacatcattacttttagacaatggttacgaagttgaagtggatgtaagggtagttgatccattcaaaattacagataagcaacgtagaaaagtgtttgctctttgtaacgatatagaatgtgcaacgggccaaccccgtgactatatgaggtatatgttcatggattacgtagaagtcctctacggctacgaaaaacgcctctctttgagcaattgtactagagaacaagctagtcaaattatagaggtcattattgactgggtgtttcataacaatatcccactcaactataaaacaagcgacttacttaagaatgataaggcgtttctttactggtcgacagtcaatcgtaagtgtgtaatatgcggtaaacctggagaattggcacatcataaagcgattggcagaggtgctaatcgtaagaaaatggatcattacggatatgaagtgttggcgctgtgtcgtgaacatcatcaatcgcagcatgatatgggtgtagaaacctttgataaattacatcaccttgaaaattcgtggctttcagtagatgagcgcttaaacaaaatgttgaaaggagttaaaaatgaattcgagagtaataactaa

SEQ ID NO: 2548 - DNA, 201 bp, Staphylococcus epidermidis
cctcctaaaatcccaaaatataaaaagtgtaaaaatagcaagatagaaagtaaaaacatggtaacggaaaacccaatcgttacatattccttgtatttaattccttcaacaaaaagatatattataaatatctccattaaaacaaagactatagacaatgttataattgtaatcatatatataatttcacccaatatttaa

SEQ ID NO: 2549 - DNA, 579 bp, Staphylococcus epidermidis
aggtgtaaaataatgaaaggtttaattattatagggagtgctcaagtagggtctcatacgaacgctttatcaaaatatttaaaaggtcaactcggcgaacatgatgttgaggtggaaatctttgacctagctgagaaacccattcatcaattggattttgctggtacaacacaagcagttgatgaaattaaaaacaatgtcaaatctttacagagtaaagcaatggaagcagatttcttaattttaggaacgccaaattatcatggatcgttttcaggtattcttaaaaatgcacttgaccaccttaatatggaccatttcaaaatgaaacccgtgggactcatttgcaatagtggaggaatagtaagttctgagccattatcacacttaagagtcatcgtacgtagtttacttggtattgctgtaccaacgcaaattgctacacatgactctgattatgctaaattagaagatggtaccttatacttagaagataatgaatttcaactacgtgcaaaattgtttgttgatcaaattgtatccttcgtaacaaatagtccatatgaacacttaaaataa

SEQ ID NO: 2550 - DNA, 183 bp, Staphylococcus epidermidis
tataaaaaaatcactttaaaagacggactgctttttaaaaaaatgtttattgagacagaggattttatgtttaactatagtacatctaaagctcttttaagtgattttcaaaataataattttaattactttattcaaaataaaaaagagcgtgttatatttgaagatgggcatttcctctaa

SEQ ID NO: 2551 - DNA, 678 bp, Staphylococcus epidermidis
ttggagaaaataaagatgaataattatggtattcctcaaaatgcagtaataaccattgctggcactgtaggggttggtaaatctacgttaacacaagcacttgctgacaagttaaattttaaaacttcctttgagaatgtagaccataatccttatttagataaattttatcataattttgaacgttggagctttcatcttcaaatttactttcttgctgaacgttttaaggaacaaaaacgcatgtttgagtatggtggcggattcgttcaagatcgttcaatttatgaagatgtggatatttttgcaaaaatgcacgaagaacaaggaacaatgagtgctgacgactaccacacgtattacgaattatttaatgcaatggttatgacaccttattttccaaagcctgatgttctgatttatctagaatgtgattatgatgaagtaattgatcgtattcaacagcggggacgtgacatggaaatcaatacagatccagaatattggaaaaaactatttaaacggtatgaaaattggattaacaattttaatgcatgtcctgttgttcgacttaatattaatgaatatgacatacacgaagacgtagactcccttgattcagtcattgataaaattgctcaagttattaaagcataccgacaagtggatacaagataa

SEQ ID NO: 2552 - DNA, 2706 bp, Staphylococcus epidermidis
attaatgaaatagggggaaatgtcttggcaaagctattatacaaactaggaaaatttatagctaagaacaaatggctaagtgttataggatggcttgttatactaggtgttattatcacgccattaatgataaactcaccgaagtttgacagtgacatcactatgaacggccttaagtcattagacacaaacgataaaatcagtaaagaatttcatcaggacagtgagaaagcctcgatgaaaatagtcttccattctaataagaatgatggactcaataataaagatacgaagaaagatattgaagatgctttagacaatatcagacaaaatgatgattatatccaaaatatctctaatccatatgacagtggacaagttaatgatgaaggcgatactgctatcgctaacgtaagttatgtagttccacaaactggattaaaagattcttctaaacatatcatcgacaaagaattaaaagatgtaactgacaaccataatgtgcaaattgaaaaaactcaaggtggcgctatgaattccgaacctggtggtacatcagaaattgtcggtatcatcgtagcattcgtaatcttacttattacctttggttcacttatcgcagctggtatgccaattattagtgcaatcatcggtttaggttcaagtgttggtatcatcgcattattaacatatatctttgatattccaaacttcactcttacactagctgtaatgataggtttagctgttggtattgactactcactctttattctatttagatttaaagaacttaagaaaaaaggtgtcgatactgtagaagctattgcaacagcagtgggtacagcaggcagtgctgtaatattcgctggtcttacagttatgattgctgtttgtggtttatcacttgtaggaatcgacttcttagcggttatgggattcgcttcagcgattagtgtgttatttgcagtattagcagcattaacactattacctgccctaatcagtatcttccataaaagtattaaaattaaagataaaccaactaaaagtaaagaccctaaagatcattcttgggcaaaatttattgttggtaagccagttatcgctgttattgtaagtttaattattttaattttagctgctataccagtcagtggcatgcgtttaggtattccagatgatagtttaaaaccaactgactcatcagaatacaaagcctataaattaatctcagataattttggcgaaggttataacggacaaattgtcatgttagtaaatacaaaagatggtggaagtaaaagcactatcgaacgtgatttaaataatatgcgtagtgatttagaagacattgataatgttgatacagtttcaaaagcacaactaactgacaacaacaattacgcattattcacaatcattcctgaaaaaggaccgaactcacagtcaacagaaaatctagtatatgatttacgtgattatcatagccaagcgcaagaaaaatatgactatggcactgaaatttcaggacaaagtgttattaacatcgatatgtcagaaaaactaaacaacgctattccagtatttgcaggcgttattgttgtattagcattcttcttattaatgattgtgttccgttcgatcttagttccattaaaagcagtactaggctttatcctttcattaatggctacattaggtttcacaacattagtcattcaacatggctttatgggtagcttatttggtattgaaaacacaggaccattacttgcattccttccagtaatcacaattggattgttattcggacttgccatcgactacgagctcttcttaatgacacgtgtacatgaagaatacagtaagactggcgataatgatcattcaatccgtgtaggtatcaaagaaagtggacctgttatcgtagctgctgcacttattatgttcagtgtattcatcgcattcgtcttccaagatgacagtgcaattaagtcaatgggtatcgcattaggtttcggtgtgttattcgacgcattcgtcgtacgtatgacattaattccagcattgacgaaactctttggtaaagcttcatggtaccttcctaaatggttaggtgcagtattgccaaacgttgacgttgaaggtaaagctttagaagaagataatcatcacgacacatcttctgaaaaaggtcatgtcaacgataaaaatagtgaatactctagacaagacaaagataactatgtttatcaaaatgacaaacgtaactacaatcgcaattataatgacgaagattataaccgttctgtgcatttaaataatcatcatgaccagcatcatcgccaacatcaatatgataatcaacgtgatgatatcgactatgaatcactttatactcaagatggcgaccatactcatcatgatgaacgtaattataatgatcgacactatcaagacaattacgatagaaatgatgattatcgtcacaacaatcatgatcatcaaaatgataaccatgattatcatgattcaaattttgataaaacaacaaacttatacaaagaattaactgatagcaatattgatcaagatgtattattcaaagcattaatgttatacgctcgtgaaaacaacaaaggtgtttacgatagatataaccgatcatctcaacatcgtcatgatgacgaacttagagactaa

SEQ ID NO: 2553 - DNA, 510 bp, Staphylococcus epidermidis
gtggaggaaataagaccaataacctatcaagataaagaggcatactattattatattcaagagtggtatgaaaatgaggaaaaagtggtaccagggaatacagatattgccaattatagttcatttaacaatatggttgatcggcttaattgtagtgaagttgatgagggttttgtaccgactacaacactattttattttaaagattcaattattataggtgctgttgatatcagacatcaattaaatgataaactatctaatattggtggtcatgtgggatacggtgtagctaaatcttatagagggaaaggttacgctactatccttctagaaaaggctttagatgaacttaagacattaaatgtagaggtcgtacttatgacttgtaatccacttaattttgcttctcaaacagtgatgaagaaatgtggtggatatcaaattgaatcctatattaaaaaaaatggtaaacctgttcatcgatatcatatacctaatacaaaataa

SEQ ID NO: 2554 - DNA, 1068 bp, Staphylococcus epidermidis
aagttgcgaattcaattattactggagctgttgataatgattaatcaagtatatcaattagtaagtccacgacaatttgaagcaacatttaaaactattgatttacataatcataatagcaaagttattgttcgacccttatatttgtcaatttgtgcagccgacttgagatattattgtggaaatagagatagcaaaattttatctaagaaattacctatgtcattgattcatgaaagtgtaggtgaaattgtatacgactctgaacatcgactgaaaaatggaactaaggttgttatgattcccaatacaccgtctaaatcgcataatattattgcagaaaattatttaacttctagtcattttaagtcaagtggttatgatggttttatgcaagattatatagtaatgaaacctgatagagtagtcactttaccacaagaaattgatttgagtgtagcgtcgtatactgaattagttacagttagtgttcatgcaatagatcgttttcaatcaaaagcaataccacaatttgaatcattggggatatggggagacggtaatttagggtatatcactgcagttttactaaaaaaactatatcctactacaaaaataatagtttttggaaaaacattatataaattaagccgtttttcatttgtagatgaaattattcaaattgacaatattcctcaacatatcaaaattgatcatgcatttgaatgcgtgggtggtaaaggaagtcagcaggctattgaacaaattattaatattattaatcctgaagggagtatcgctttattaggagtgagcgaactgcctatacaagtgaatacaagaatggttttagaaaaaggtttaactataattggtagtagcagaagtggtttaaaggattttgaaaaaactattgaattgtatcgtaaatatcctgaagttcttaatcaattagcattacttaaaggtaaagaatttgaaataaataccatagaagatctcattacagcgttcgaatatgatatttctaacgcatggggaaaaacagttttaaaatggaatatttaa

SEQ ID NO: 2555 - DNA, 444 bp, Staphylococcus epidermidis
ataaggagaattcgaatgactaatttaactattttaacaggacgtatcactaaagatttagaacttaaacaagcaggacaaacacaagtaactaacttctctatggcagtggacaatccattcaaaaaagatgacacatcattctttgacatcgtagcgtttggcaaaactgcacaactattaaacgactattgcggtaagggaagcaaagttttaatcgaaggcaacttgaagcaagaccgtttccaagataaagaaggacacaatcgttcagtagtacgagtaattgctaacagaattgaatttttagatagcaaaggtagtaaccaacaaaacaaccaacctcaaaagcaacaagaacaaactactgaaacaaaaagcaaaaatccgttcgcaaatgcaagtggccctattgacattactgatgatatgttgcctttctga

SEQ ID NO: 2556 - DNA, 744 bp, Staphylococcus epidermidis
aggtgtttgatattgaaaattattaatttagattcaaaaaatcttgcgtcattttatgtagcatgcgagttgtttaaacaaatacagcagcaccctcatgccaaactcggtttagcaactggtggaactatgactgacgtatatcattacttagtaaatttattaatcaaaaataaagttgatgtgtcgcaggttgaaacatttaatttagatgaatatgtaggtttaaaagcaagtcatcaacaaagttaccatacctacatgaataaagtgctatttgagcaatatcctcattttgttaaaaatcacattcatattcctgatggcttatcagaaaatctagaagcagaagcggaacgatataacaatttattagatgaaagagggccaatcgatattcaaattttaggaattggagaaaatggtcacattggttttaatgaaccagggactgacttcaatagtgaaacacatgtggtgaacttaacagaaagcaccataaaagcaaatagtcgattttttgacaatgaaaaggatgttcctagacaagcagtttcaatgggggtaaaaagtattttaaaagcaaaaaggattatcctactcgcatttggtccaaagaaaaaagaggctataagtaaactgttaaatgaacaggttaccgaagatgtacctgcgaccattttacacacacaccctaatgttgaagtttatgtagacgatgaagcagcgccagattgtttataa

SEQ ID NO: 2557 - DNA, 810 bp, Staphylococcus epidermidis
ctgtttgtgatagaatttgatatgaatccaataaaaattttgaaaaaggagcgaataataatgagtgaagcagcagaaactttagatggttggtatagcttacatttattttatgcagtagactggacaacttttcgtttaattgctgaagatgatcgtgaagcaatgattactgaattggaaacatttattaaagataaaacagttgctagagaatcacatcaaggtgatcatgcaatttataacattacaggtcaaaaagcggaccttttactatggtttttacgtccagaaatgaaagagttaaatcaaattgaaaatgagtttaataaattacgtatcgcagactatctcattccaacttattcctatgtgtcagtgatagaattaagtaattatttagcaggcaaatctgatgaggatccttatgaaaatccccacgttaaggcacgattataccctgaattaccacattctgaatatatatgtttctatccaatggataaacgacgcaatgaaacttataactggtatatgttacctatcgaagaccgtaaaactttaatgtataaccatgggatgataggtcgtaaatatgctggtaaaatcaaacagtttattacaggttcagtaggttttgatgactatgagtggggtgttacattattttcaaatgatgtacttcaattcaaaaaaattgtctatgaaatgcgttttgatgaaacgactgctcgttatggcgaatttggtagtttctatattggtcacattctaaacatcgaagacttcaaacaattttttagtatataa

SEQ ID NO: 2558 - DNA, 582 bp, Staphylococcus epidermidis
gagaatcagataatgccgtcagcaaatcaaaagcgtatgattaaacatattcatgaaacagtgtttatacttttacatgattatcattttgatgaaatcacggttcaaaaaatatgtgatattgcagaaatcaaccgcagtacgttctatagatacttccaagataaatatgaattactctacactttacctgactttattacacaacaaattatagctaaaagtgacacatcagcagacattacaacccctgaatcatttgaagactttatctattacattggtaataataaaaagatttttaagcatctattagtttcgtctcgacaggcagatgtatttagaagtttaacgaatgtgagtcgcgaaatgatgttaaataacccaactcgtaagcgtgcccccttagcgcaaaagattagagaaagtaaacatcctgaaattgtagctgatttttacagtagtggcgtaatagaagtactaagacgttgggtagaaaatgactataactatacagttgaagaagtgtttgtaacattaaataatgtgcttgaaacgtcattatattgttatgataaataa

SEQ ID NO: 2559 - DNA, 1314 bp, Staphylococcus epidermidis
tgtggacagataaacaacaaatcgaaacgactgcgatggtgcatttcgatgatgatatcaattaaattatccgaactgttacctaaacactttcatagcttgtggaaagcgactaaagatagagagaagcttaacatagtagcaaaaggtggacgtggtagtggtaagtcgtctgatatatctattatcattacacagttaatcatgcgctatcctatgaatgcagttgtagtacgtaagactgataatacattagctacatcagtatttgagcaaatcaagtgggcgatagaagaacaaaaggtgtcacacctgtttaaagttaaagtgtcgccaatggaaataacatatgtacctagagggaatcggattatcttcagaggggcgcagaaccctgaacgattaaagtcgttaaaagatagtcggttccctttttctatcatgtggatagaggagttagcagaatttaagacagaagatgaagttacgacaattactaactctatgttacgtggtgaattagatgacggattattttataagtttttctttagttataacccacctaagagaaaacaatcgtgggttaataaaaaatatgaaacctcattccaaccagataacacattcgtacatcattcaacgtacttagataacccttttatctctaaacagtttatacaagaggcagagagtgctaaagaacgtaacgaacaacgttatcgttgggagtatatgggggaagcgatagggagtggcgttgtgccgtttaacaatttacaaatagagaagataccagatgagttgtacgataatttcgataatataagaaatggtgccgattttggttatgctgctgacccgttagcatttactaggtggcattacgataaaaagaaacgcattttatacgctatggatgaaatatatggtgtacaaatgagtaacagagaattcgctaaagaattatggaaacgcggttatcaatcagatgaaatatattgtgactccgcagaaccgaagtcaattgatgaattaaaaaaagaacatgggattaagcgtgtcaaaggtgttaagaaaggccctgacagtgttgaatacggggaacaatggttaaatgatttagacgctattgttattgaccctaacagaacacctaacatagcaagagagtttgaaaatatcgactatgaaacggacaaagacggtaacgttaaaccgagattagaagataaagacaatcacagtatcgattcctgcaggtacgcgctctctagagacatgaggcagaataaacttagcatacttacgtaa

SEQ ID NO: 2560 - DNA, 1284 bp, Staphylococcus epidermidis
ttggaggggataaaagtgaagacgcaagttttgtacggaaaatctgaaattgaaatcaatgtgcctgatgatagcacaatcatagagcctcaaaacatcgacgctattcaagattatgaatcaacaattaaaaatgtattaagaaaccccacaaattctaaacctttaaaagaaatggtaaacagtaatgatattgtttctattgttattagtgatattacacgtccaacgcccaaccatattcttgtacctttactaattgaggaattaaatcatgttcctcgtgagaatttcgtaattattaatggtacagggactcatcgagatcaaacgcgagatgaattgattcaaatgttaggtgaagatattgtaaattcagtaaaaatcgttcacaatcattgctcagaaaaagaaagtctagctaaagtgggacacagtcaatatggatgtgatgtttatttaaacaaagcatatgtagaatccgattttaaaattgtaacaggttttattgaaccacactttttcgccggattttcaggtggacctaaagggataatgcctggaattgcaggtttagaaacaattcaaacatttcataatgcaaaaatgattggcgatccgagatcaacgtggggaaatttagaagacaatccagttcaagatatggcacgggaagttaaccgtatgtgtaaacctgactttttacttaatgttgcattgaataaaagtaaagaaattactgcagcatttgctggtgaaatcttagatacacacaaagaaggatgcgcatatgtaaaagatcatgcaatgtttaaatgtgagcaacgctttgatattgttatcgcatcaaattctggctatcctttagatcaaaatttatatcaaacagttaaagggatgagtgcagcgagtaaagttgttaaaaaagacggtcatattattatggtatctgagtgtgcagatggctttcctgatcatggtaagtttgccgaaattttcaaaatggcagacacacctcaaggtattttagaacttattcacaatccaaactttaaggaagttgaccaatggcaagtacaaaaacaagcaagtattcaaacttttgccaatgtgcatgtttattcagaacttactgaccaacaacttaaagactcgatgttaatcccaacctctaacattgaacatacaatacaagaattagaacatcgatatggccgtaaattaaccattggtgttatgccacaaggtcctttaacaataccgtacgtagaagataaagaataa

SEQ ID NO: 2561 - DNA, 336 bp, Staphylococcus epidermidis
cttgtggtttttattttaagtgaagtaggtgtttatatgacagaaagtagccaaagaggggattacgaaagacgtataaaaagattggaagataacgacgaaaaaatcttcaactctttggaacagataaaagacggacaacacaatcaaaatttgattaatcaaaaaatgaatttcactttggactctatcaacagagagagagaattagaatctcaaaacaaaaaagaaaatcaaaaaaacatcaaagacattaaaatgtgggttttaggattggttggcactatagctggttctttaatcgtagcagtattaagaatgtttttcggtgtttaa

SEQ ID NO: 2562 - DNA, 345 bp, Staphylococcus epidermidis
caaatgaacttcaaacaaatgcatcaattcaattataggttacctgagctattgacaaactatttacatttaatacattcgactagtgaaccaagaatgtgtcatgctatgaagaaaggtgaaattcatgattactgtattagtcattactatattttttattacagtaactttaataatttggcaaccaaaaggattagatatagggatttctgcagtcatcggcgcgcttttagctatcgttactggagtagtgagtgtctcagatatattagaagtgacaagtatagtttaaaatgccacacttacctttgtcgcagttatccttatttcattaatccttga

SEQ ID NO: 2563 - DNA, 258 bp, Staphylococcus epidermidis
tttgtgaatgtaaaaaaggaagggctaattatgcgatttaaattaaaagaagatgaaattttagaatttttagatttaaattttccacaacaaacatttgaaaaaggtcgtctccttattgggcaaaataagagacaaccattacacgtttattattttggaaaaaaattcttggctcttttaaatgtaaattttaacacttttgaatatattaaagtagatgaagtcgattataatgatataaaaaaatcactttaa

SEQ ID NO: 2564 - DNA, 210 bp, Staphylococcus epidermidis
aagttttacgtcgttggaaaatgcaacactttggaaaaattgttggtgaaaatagcgtgtattaaggagatatataagaaaacaggttctgttgcaaagttaaaattatatgcacatctatacaaaactataaaagcaaatattgttttaacagtaaagagctttattagtattaattatttttcgtttttcagtataaatattacatga

SEQ ID NO: 2565 - DNA, 1455 bp, Staphylococcus epidermidis
catacttacgtaaacgaggtgattagcattaattggccatgggataaaccatatcacgaacaagtggtagaacagattaaaccgaagtatgaaacgcaagaagaaatgatattgcgcttagttagagagcataaagagaatatagacaatatcacaatgggtgaaagatattataatcatcacccagatatattagacgctcctttcaaaagagatgtgaacggcgactatgacgaaactaaaccagactggcgcatgtatactaactaccatcaaaacttagtagaccagaaagtagcttatgcagttgctaatcctgtgacatttggtgtagataatgacaaagcattaaaacaaatacaacacacacttaatcacaagtgggatgacaaattagtagatatattaactgctgcaagtaataaaggtatcgaatgggttcaaccatatgtagatgaagagggagaatttaaaacgtttcgtgtacctgcagaacaagctgtacctatttggactaataaggaaagagatgaactgcaagcgtttatacgtgtatatgaattagacggagcagaacgtgttgagtattggactaaagatgatgtgacattctatgagttgaaagaaggacaacttatccctgatttctatcgtagtgaagatcatatacaacctcattattatcaaggtaataaattgatgagttggggacgtgttccttttattccgttcaagaacaacccacaagaagtatctgacttattcatgtacaaaacaatcatagacgcgttagataagcgattatcagacacacaaaacacttttgacgaatcagtagagttaatctatatcttaaaaggttatgaaggtgaagatatgaaagacttcatgcataaccttaaatactacaaagcaattagtgttgcaggggaaagtggttccggtgtggatactatcaaagtagaagttcctatagactctgttaaggaatacacgaaaatgttgcgcgattacattatagagtttgggcaaggtgtagacttccaacaagataagtttggtaatagtcctagtggtattgcgcttaaatttatgtacagcaacttagacttaaaagctaataaattgaagaacaaaacacttactgcgttacaagagttgttacagtacattattgatttctatagattagatgtgaaagtgcaagacatcgagattacattcaacttcaatgtaatggtaaatgagttagaaaactctcaaattgctatgaattctacagggttattatctaaagaaactattctttctaatcatgcttgggttgaagatcctgtagctgaaatggaaagaatagaacaagaaaacatagaactcaatcaacaactccctgacattgaggagggattgaatggcgaacaacaaagacaatccaaaaataaccaaccagaatga

SEQ ID NO: 2566 - DNA, 1089 bp, Staphylococcus epidermidis
gaggcaacagtcatgtcagaaaaagtaaaattcgaaaaaagagagtctttaaaagaaaaacctgatacagcaaacttaggatttggacaatatttcacagactatatgttaagtgttgattatgacgctgatcaaggatggcatgatatgaagattgtgccgtacgcaccatttgaaatttcaccagcagcgcaagggttacattatggtcaggcagtttttgaaggccttaaagcctataaacataatggagaagttgtattattccgcccagatcaaaacttcaaacgtattaataattctttagcacgtttagaaatgccagaagttgatgaagaagcattattagaagggttgaagcagcttatcgacgttgaacgagattgggtacctgaaggcgaaggtcaatcgttatatattcgtccttttgtatttgctactgaaggtgttttgggtgtacgttcttcacatcaatataaattactaattattttatctccgtcaggcgcttattatggtggtgacacattaaagtcaactaaaatttatgtcgaagatgaatatgtacgtgcagtacgtggaggtgtaggtttcgctaaagttgcaggtaactatgctgccagcttactcgcacaaacaaacgctaataaattaggttatgaccaagtattgtggcttgatggtgttgaacaaaaatatgttgaagaagttggtagtatgaatattttcttcgtagaaaatggaaaagtagttacgccagcattaaacggtagtatcttgcctggtatcactagaaagtcaattattcaattagctgaagatttaggttatgaagttgaagagagaagagtttctatagaagagctgtttaacgcatatgataaaggtgaacttacagaagtatttggttcaggtacagcagctgttatctctcctgtaggtacacttcgctatgaagatagagaaattgttattaataacaatgaacctggtaaaatcactcaaaaattatatgacacatatactggtattcaaagtggcaaattagaagataaatacggatggagagtagaagttcctaagtattaa

SEQ ID NO: 2567 - DNA, 378 bp, Staphylococcus epidermidis
tttaagggagtgaacgtgttggaaccaattaaagaacaagaagtgctagatttattaacttcttactcaaatcagcctgtttacctacacgttgaaacaacaaatggtgcttatgcaaatcatttcgatcaacgcgtatttaacgctggaacatttttaagaaatattgtcgtgacttttgaacatgcacaacttaaaggcggcgacaaagatccatatcgtgtaggtcttaaattaaaagatggtggctgggtttacgtgcaaggacttacgcactatgaagttaatgagaataacgaatttttaattgcaggttttaattatgaaggacaattggctgctacaatagaaataagtaaacagccatttactatataa

SEQ ID NO: 2568 - DNA, 945 bp, Staphylococcus epidermidis
cttttaatggtaaaacaagtacgattaggtaaatctgatgtcaatgtttttcctatcgcattaggtacaaatgcagtaggtggtcataatttatatcctaatttggatgaagagcaagggaaagaagttgtacgtcaagctattgataatggtataacattattagatacagcatatatctacgggcctgaacgttctgaagaattagttggacaagttgtaaaagaatatccacgcgagaaagtgcaaattgcaacaaaaggttcgcatgttattaaagaaaatgaagaagttgttcaaaataacgatccagaatatttaaaacagcaagttgaaaatagtttggaacgtcttcaagtggattatattgatttgtattatattcattttcctgatgacgatacaccaaaagataaagcggtggcggctcttaaagagcttaaagatgaaggtaaaattaaagcaataggtgtatctaatttctctttagaacaattaaaagaagcgaataaagatggatatgttgatgttgttcaattagaatacaatttattacatcgtgaaaatgaagaagtaatggcatatgctgcagaaaataatattacatttgttccttacttcccacttgcttcaggtatactagctggcaagtacgatgaaaatcaaacatttgaggatcatcgtgcagaacgtcctgattttcaaccagacgtattcaaagataatgtgcgtcgtgtaaaagcattaactgatattgcagaggcacatgatacaacgattgccaatgtcgtattagcattttatcttacacgtccatcactagatgttgtcatccctggtgcaaaacgtgcagagcaagttgttgaaaatattgatgctgcaaatattgaattatcgcaaggtgaaatagacaaaattgatagtttattcccaattaaaaaataa

SEQ ID NO: 2569 - DNA, 441 bp, Staphylococcus epidermidis
gatatgtgggtatcagtagaacgatatctgtttaacaagatatacaacaaattaaaaagcaaccctatcatcaacaaacaacttgatggtagggtttttgattgcgttcaaaaagacgctgtttacccatatatcgttgtgggtgaaacaaacgtcactaataaagaaacaacgacaagtatgtttgaagatgtgggcgttacattgcatgtttatagccaagctagaaatagagatgaggcctcacaaatcatccaatacttaggttttgtacttaactctgaaatagaaataaataactattcatttataaaaagtcgaattgatacacaagaagtgataactgacattgatcagtacacgaagcacggtatcattcggcttgtttttaaatacagacacaatactttacaaaggagtgtaacgaatggcgcagaataa

SEQ ID NO: 2570 - DNA, 477 bp, Staphylococcus epidermidis
agactaatattaaaaagggggaaacacgttatgttaaaacgacgtagttcgaaattcttaggactactagccacactagccttagccatagtgctaagtgcttgtggtaatagtggtaacggtagtggttcatcagacgatagtcaaacatcacttggtaataaagaaatcgaaatatcttatatcgcgagtgataattcaacaccacgttcactagttatagcagaagtattgaaaaaagcaggttatgatgtaacaactacaccagtaacagcaagtggcccgttatatgctgctgtatcagagaactctgattcattccatgcatcaggtatattccctactactgataaaagttactacgataagttcaaaagtaaattaacaatttatgatgataaacatttaattgataacgcaaaagtaggtttagccgtacctaagtacgtgcaagatgtcgactcaattagtgactga

SEQ ID NO: 2571 - DNA, 1857 bp, Staphylococcus epidermidis
ttgccaatattattaaaaacgttacagggcattgggcaatccctacctgtagaaacaaaattaaacgagaaattaaatgaagatggctccttagaaatagaaatggtagaaaacaaagctacattcgacgctataggggctattactaaaatgtggacgattacaggtgttggtggtgcagatgaccttaatgaataccgtatcgttatgttagataaaacgactgtaggacaaaaagaaaagttaacaatcaaagcacgtcctgttgaattagatgacctaaacaatttaagagtgtatgaagtatataacggtagttttacaggaaaaaggtactttgatttagtttttaaagatacgggttataagtatgaattacacgctaaagtttcatcgtctaaatttgaaaatctaggtaaccatgatacaaacttagaactattcaaaaaaggtttagaacgttacgacctagagtacgaatacgaacctaaaacaaagacttttcacttgttcgatgttgttcaacgtaaggctgactattatatcaaagcaggcgttaacgctaacaatgtaaaggtgcaagaggacgcttctaaatgttatacctacatcagaggttatggtggttttgacgatcaacaaacttttaacgaagctagcttgcaatatgagtacacacaccccttagctgaccttataggtaaacgacatgcgccacctgttgtagatggacgtatgacaaagggtgatacactcaaaaaagctatggagctagttatacaagaaagtttaaaaacatctgtaaccctagacttcatatctttacaaaaacattttaaagaagcagtacctagagttggagatattgtgaatgtagttgacgatttaatagggttaaatgaatttgttagaattatcgaaattactactcatagagatatttacaataaaattatcaaacaagacgtagtgcttggggaatttagattacaagatagatacatgaaagcagtaaacactgctgcaaattatgttaaagctattaagtctaacaaatctgatcctgcgaaagatttacggtcaatgcaagcacaaacacaagctaacactaaaacaacacaagatttacaaaagaaaaccgatgacattaaaaagagattagaaagcgcacatgctaaaagtgttacaactgcaaatggtacgattgttcacgactttacacctaagtctaaaattaggaaagttaaaacaataggtactattggagattcagtagctaaaggtactggtgctaaaactaactttacgcaaatgttagctaagaagataaaagctaaatcaacaaacttagctgttagtggtgcgacaataagcacaaacaaagataatagcatttatgaacaagcaactaaaattaaaggagatttaatcattgttcaaggtacagatgatgattggacaaatgatattaagataggcactgataaaacggacattaaaacgttttacggtgccttttatagtgccatttctaaaattaagagtaataaccctaaatcaaaaataatcgtcatgacacctacaaaacagtgttatataaaagacggtaaggttgtccgaaaagacaccactaagaacgatttaggttacacgttagctgactatgtagacgttcaaatagacgcttgtaatgagttagatatacctgtgtatgacgcttatcactcaacacaattcaaacccaatataccttcatacagaaaatcgagcatgcctgacggtgtacaccctaacgaaaaagggcacgaagtcattatgtatgaactagttaaaaacttttacggtttttatggctaa

SEQ ID NO: 2572 - DNA, 1725 bp, Staphylococcus epidermidis
aatggaatatttaaagaaaaggaaacaactatgacaaagcaaaatatatttatagatgacatttattgggaacgtgtccaactcttcgtcaaaggacattttgaaggagtaaaacctacaagaaatttccttcttagaaatctaacagaaacaaaactattaaatgccaatcatgttaatattcaagggtcaacttttgaggcaagatttaatattgctattttagaaaaaggtaattttttaggtacaggcaattatatattaatcaaccgacaagaagatgaatatgtctgccaaattaaccccaaatttttgaatgataaaaaaaatcagatgactttagaggagttaagagattacaactcacttgagacccaatcgttacaaaaaagttatttattaaaaaagtatggtaaaagtttccaaagatataataacaaagagattaaatcttacgtcattgttccggcaatatcccaagaaattaatgagtttatttttaaagttcaatataaatctgaaataaagaaaataagtaaacttaagcaattatcatacatattacataaagctttgaggaaaattagcttcaatgtgagagataaaatatatttgtcggtatttaacatttccaaaacagtatataagaataataaaaatcatgttttgtttacatcagattctagagcaaatatgtcaggaaattttaaatttatatacgaagaaatgcttaaacaacaattggacaaaaaacttgtcattcattctatttttaaacctaatatagcaaataggagatcgtttattgataaattaaaatttccatattttttaggaaaatctaaatatatcttggttgatgattatcatccgatgatatataaacttcaatttagagaaaaccaagaaatagttcaagtatggcatgctgtgggtgcttttaagactgtaggatttagtagaactgggaaaaaaggaggacctttcatagactctattggacataggaattatagtaaagcttatgtttcgtcaaataatgatattctttactatgctgaagcttttggaattgaagaacatagggttattccaacaggtgttccacgtacggatgttttgttcgatgaatcttataaaacacgcattaaacaaagtttagaaacaaaattaccaattataaaaaataaaaaagtcattctttttgcacctacatttagaggaaatggacatcgcacagcacactatcctttctttaaaattaattttgcaagattagctagttattgtgaagaacatcaagctactgttctgtttaaaatgcatccttttgttagaaataaattaaatatcccagcaatttatagtaaatattttttagatatttcaaattaccgcgaagtaaatgatgtattgttcattacggatattttaatctctgattattcttctttaatctatgaattttcagtttttaaaaaaccaatgcttttttatgcttttgatttggaagattatatttacacgagagatttttatgaaccttatgaaacctttgttcctggtaaaatagtgaaaacttttgatgagcttattttagctttagaaaataatgattttgaattagaaaaggtgaagccgtttttaaataaaaattttaaatataaagatggtaaatcaagtgaacgattagttaaagatttatttaacaaattttttcagtaa

SEQ ID NO: 2573 - DNA, 285 bp, Staphylococcus epidermidis
ttttgcgtatttctcactataaccagccctgattgccgattgataagcagtacctgtcttaatgtactcatcaacaaatgcttgttgtttaaggttcagtttcgtcatcgtatattaccacctactctcacggttaagcacctttatttgacgtataaaaaaaagacactgcataaacagtgcctaatgattatgttttgttatttatttgagtttatgtactcatgtcacatctctatgtcacatcaatacataaaaaagttacccgtgtgttctcacggataa

SEQ ID NO: 2574 - DNA, 387 bp, Staphylococcus epidermidis
aggagtacattcaaaatgatgaaagtttttattattttaggtgcattaaatgcaatgatggctgtcggtactggcgcatttggagcacatgggttggaagataaattatcagataaatacatgtcaatatgggaaaaagcaacaacttatcaaatgtatcatggattaggtctgttagttataggtttaataagtggtacaatatcaattaatgtaaattgggctggttggttattattctttggtattgtctttttcagtggttccttgtatttcttagccttaacacaagttcgtattttaggtgcaattacgccaataggtggtgttctatttataattggttggcttgttcttgtgattgctacacttaaattcgctgggtaa

SEQ ID NO: 2575 - DNA, 804 bp, Staphylococcus epidermidis
atatttttttcactcaagtcgttcccaaaaaagaacagtaaacaaattaaggagggattaaaagtgaacgaattacaaacattcaattttgaagatttaccagtaagaacgctatccatagacgacgagccttactttgtaggaaaagatgtggctgacatcttaggttactcaagaggagcaaaagcgatacaagatcatatcgataaagaggatattcgtgtagtcccaattcaggaccgcaccggaagatatcaaaaagcttctttaataaacgaatctggtttatacacattagttatcgacgcagttcgacaaagcaataacagagatattaagaaaaaagcgaaagcttttaaacgttggataactaatgaagtattgccatctattcgtaaaacaggttcttatcaagttcctgataatccaatggacgcattaaaacttatgttcgacgcacaaaaacaaactaaagaagaaatcgcaacagtgaaagcagatgtgatcgatttaagagaaaaccaaaaattagatacaggagattacaacttgttgtctagaacgattaatcaacgagttgctcacattcaaaagatacatgcaattacaaatcaaaaacagcgcagtgaattattccgagatatcaattcggaagttaaaaagatgacaggcgcaacatcaagaacaaacgtaagacaaaaacactttgatgatgttatctcaatggttgctaactggttcccgtcacaagctacgttatacagaatcaaacaattagaaagcaatttagaaaaaggacaataa

SEQ ID NO: 2576 - DNA, 264 bp, Staphylococcus epidermidis
attatgaaatttacaatagaaatggtgaatgaatatttaactatagttaatgatgagaatccgatccatcgttccattgtaccaggacaactcatatgtgaaaaagtattttctgaacttaatgtgaattggatgaattacaaaattaagtacttaaaacctataaatatagatgaagaagtacaatttttaataaaagaaaatgatgaaattgtagtttttaaaacatatgatgataccaaactaacaattactagaagttga

SEQ ID NO: 2577 - DNA, 789 bp, Staphylococcus epidermidis
agttcagtttcctataattgtcatgtaatctataatacaatagtttatgtaactataattaatataaaaatcattttcaggagagaattaaaattggaatggatattatttgataaagatggtacattgattgagtttgacagtagttgggaaaaaattggcgtacgtctcgttgatcaacttttagaaacctttccagtacatgataaggaagcggcacatcgccaattaggcattatcgataaaaaaattaagccagattctgttatgggatcgggttcattaggtgaaattatagagtcttttaatggtgtaacaggtaaagaaacatcagattggacaaaggatacgagtcaggaactcattgattcaagagtgcctgaaaacaattggattgatggtgtacaagaaactattcaagctcttagaaatgaaggatatcacataggtatagtaacaagtgatactaaaaaaggagtcgatcaatttctggaggaaacgcaaactagaaatctctttgatttagtaatttctacagaaacacacgcagaagaaaagccacatcctaaagttttagatccactatttaatgcttttgatgttaaaccagaaaaggtagcaatagtaggagatacggccaacgatatgaaaaccgcgattaatgctcatttaggattagctatcggtgtgctaacaggcgtggctaaaaaagaggaactctacgacgcagatgtcatcattaatagtgcaaaagatgttaaacaagttatagagcaatacggaaaataa

SEQ ID NO: 2578 - DNA, 309 bp, Staphylococcus epidermidis
gtctgctattcatctatcaaaattgatgatcaaacaaaaaaatatagaaaaaaggagacgatgataatggattttgtagaacaagcagttaaagaaattaaagaaaaaataggaaaagaattagatttagaaaaagaaacatatttactacaaactccatctgcttatatgcaaattggattagaagaagatgatgacgatgaaagaaaattaaatgtacaagtaactggtggtaatattacttgtttaaaaacagacaaagatatattcaaagacttatatgtaaacgatgatgaaaatgacaactag

SEQ ID NO: 2579 - DNA, 1536 bp, Staphylococcus epidermidis
ataatggaattagaaaaagtaggtaaacttgatttaaacgaagaaccatatttacaaccgatatctaatagaggtatcggtttttataatctcgataaaaacactgctaaatttcaatttgtagtacaaaaagacaacaaacctttgttaatcagcgataagaatgttaaaggttatgctttctttaaagctgcgaacggaacagaagaaaaacgacctagtacatcaggtgtattagacgtagaattcattgatccaatgaaaggattaataggtgttacggtacctcaatggtttctgaaaaacgttgtcgattctgaagtgttgggtgaaatttacttatcactcaacgatgtaaacaacgtaggaaaagacgacactgttgtgttaggcacttttaaattcacggtacgcgacagtcttatcaatcaaatcgaaagtgatatcaaagtatcttatattcgaatgtttgatgaattgcgttcggaattagaaaagaaagtgcaacaacttaagcaagatataggcgatacacaaacgttgattgaatctattaagcaaacagctgaagaatacctcattaaaataaacaaggctcaagcagacgctattgtttcaattacagacgcgttaatatcgtctaaccaaagcattgacctagagagagaagaagctttaagacaaattgatgctaaacgtgacgctatcaaaacggattatgatttagcttcagatacattccaaaaaacttatgatagcaatgtggacgcttttaattcaaatgttaatcaagctaacacaacaattgatgaaaagctacaaatatttaatgaaacccttgaaagagatggctttactactcctgaatatgtagaaagtaagtttacagaaaaggattggcaaaaatttaaattaacaaatgatgatggtactaatttttatgatgccaacctacaaatagatttcgacaataacgaacaattaatgtctttaccgataggaactagatatgttgttcttactttgaacaatccagctggaacaaataataatgggtggttaacaaagtacaaaagaaatggagatgctgttctaatacaataccaaccttacaattcaactgtaatctaccaaaaaagattttataagagttggagcaaatgggaacgtgttggttcagatgttgtagatactggttggattgatttacaactagtgaacagtgcgtcgcctcataacgacttagtttccaaaggtggatttactagtgcgtacagaacaatcacacagaatggagttactaagaaaatgttacgcattaatgctacaactatcaaacatggacagactattgcacttttacctaaagaattcgtcaaaaacttaatgtttttctcaataagtgcacctagaaacaaaaacagcggacgtatttcgttgaacacatcaggaacagtgaattttgacgctactgtagatccatcagcgtggactgatacagattatatttacggtcaatatgaatggacggagtga

SEQ ID NO: 2580 - DNA, 501 bp, Staphylococcus epidermidis
tggttatgttcacgtattctgattaaactattcttaaataaaaatagaaaagaggaatacattatgaatacaaaatatttattagcagtcggagcaattgttacatcacttacattaggcgcatgtggaaattctaactcggaaagcgatcacgctaatcacaaagataaacaacaagaagacagtaatgtaaaaacagacacaacgaaaaaattatctggtaattttgaatctaaaaacggagaaaaagtagaaggtaaagctaaaattgaaaatggcaaacttatgttagagaattacaaatcttctaaaggtccagacctatatgtttacctaactaaaaacggagatattaaatccggtaaaaagatttcaacagtagactacaataaatccaaacaaacttttgatttaaaaaatgtagatttagaaaaatacaatgaagtaacaatttattgcgaaaaagcacatgtaatttttggtggcgctaaattaaaataa

SEQ ID NO: 2581 - DNA, 789 bp, Staphylococcus epidermidis
cgtcatacctcatactttaattcaggaggtgaaatgatgaaagaacgcttcagtcccaaaacgctttctgacattaccggagttagtatacgcacgcttcattattatcatgaaaaggggttactcgtgccacaacaaatgagtgctaatggataccgatattataatgttcaagatatttcaaagttacaatatattctctttttaaaggaattagatttaacattaaagcaaatacagacgtattttgaaggtgatagtgattttagaactaaaatattacatgataatttttatcacattgttaaaaaaagagatcgcttaaacgatattatccgtacgttagaacatcattttcacaaagataacgatgagattgaggtaactacaatgcaaaatttcaatttaaatgaacagtatgaaaaagaagcagcaagtaagtatggagatactcattattatcaagcatataaagataaacaaaaatgtaaggatgaatcagaacagcaaaatcattttgaggaaattaataagcaattaaatatgttttttgacgaaatgaatcaactatacttaaacaaagtttctatacttgaagcaagtggaaaaactaagaaattacaatgtattttgaaagaacaagttcctaattgtgacaatcaatttttagaatatatagctcagatttatattgaggacgagcgatttgtaaagtttattaacaagcaacgtgaacgtggtttgaatttatacatttctgacgcgataaaaacatttattaaattataa

SEQ ID NO: 2582 - DNA, 234 bp, Staphylococcus epidermidis
ggattcacctccatatatgttgtgtcacgcttaggtaacacgtatttaaatcatcatgactcaataagtgacaactacatgctaagaccttcccatcgtgacactccccgtaaaaaatgtgattggcttcattctatcataaatcttttgttatatgttaaacatatgccaatactatattgtagacaaaataatttttttattcaaccaatgacaaatcatttgaaagcatga

SEQ ID NO: 2583 - DNA, 684 bp, Staphylococcus epidermidis
ggagtcatatcaatgtcacaaaatgacttaaataaagaaaaagcacttgtcgtatttagtggtggtcaagatagtacgacatgcttattttacgctaaaaaacattttaaagaagtagaactcgttacatttaattacggacaaagacatgataaagaaattgaagttgcaaaaaaaattgcaaaagaacaaaatttgaaacatcatattttagatatgtcattactatctcaacttactcccaatgcacttacacaacatgagttaagtattgaagataatgatgatggtattcctaatactttcgtaccagctagaaatctattgtttttatcttttgctggcgcgttagcctatcaaattcatgctaaacatattattactggtgtttgtgaaacagatttttcaggttatccagattgtagagatagctttatcaaatctatgaatgtaactttaagtctttcaatggataaagactttgtcattcatacaccattaatgtggttagacaaagcacagacatgggcactcagcgataagctaggtgtgttagattatattcgccacaacacattaacatgttataacggtatcattggtgatggttgtggtgaatgtccagcatgtcacttaagagctcgaggtttaaaacattatcttgaacataaaggagaagaataa

SEQ ID NO: 2584 - DNA, 201 bp, Staphylococcus epidermidis
ggagggatatcaatgagcttacatttccaaattttgctgtggctttctatcttatttatcatcgcaggaacgatattattggtaacaatgcttaaaactaaaaaagaagaacgaaaagaatcttatctaggctttactgtaattttcttaatctttggttttgccatcttaatttatacttttatattcggaattttataa

SEQ ID NO: 2585 - DNA, 201 bp, Staphylococcus epidermidis
attcagacatcatcgtggcttaatataagaaaagtaacagctcaacgagctgaaaatcatcaaaaaaattataaaaaagacaatttctatattatttcaatagaaattgtctttatttacttatcctggaactttatgtcccaacctcttatttttatattaatgtctttagtaatcattttgaaattagaatatctttaa

SEQ ID NO: 2586 - DNA, 471 bp, Staphylococcus epidermidis
ggaatcaaatcattcttaaccatgaagactaacgtaattatagatggagatgcttgtcctgttgttaattctgtcattgaattgacgaaagggacaggcatttttgttacaattttaagaagttttagccatttttcacaacaaatacaacccgaacatgtaaaaattgtatacgttgatgacggtcccgatgcggtagactataaaatagtcgaacttgctagcaataatgatatcgtcatcacacaagattatggacttgctagtctactgatagacaaagtacatactgtcatgcatcataaaggaaatatttatcactcaaacaacatccaaagcttattaaatcaaagatatctaaatgctcaaataagaagacgaggtggtcgtcacaaaggccctcctcccttcacaacagaggatagacttaaattcgagcatgcttttagaaaaatcattaatcaaatatag

SEQ ID NO: 2587 - DNA, 291 bp, Staphylococcus epidermidis
actgtcttgtctagttttttttctttcatcagtttttggttcttttgctctcttttctcctgtttgtggattttgtctcaccggagtttgagttgtaggtctttgtggcgtttgaacagtttgttgcgtttgttgcgtttgttgagtttgaggaacttgttgcgtttgttgtgtattattctttttttcttccaccgattttttatcttttttttcctttttgtctttatcgtcttttttcttttcttgctgtgttgttttatcactgagtcgttcgttacctttttttga

SEQ ID NO: 2588 - DNA, 210 bp, Staphylococcus epidermidis
aatcaaatgtctttttatgattttattttaggatttatcaatgacgatacgccactaggtcatttagcacaatacatttttaatgatgcttgtttcccaaaggaagagaaaaataataattctataagaacctatgtgcttcttaattataatgatcgtcagttaatcgaaagtacaaatcgtgcaattagtctatatcaattaatttga

SEQ ID NO: 2589 - DNA, 273 bp, Staphylococcus epidermidis
atcaaatcgtcctgcaacttctctctgctaattgggtcaagagcactaaaaggctcatccatgataataacgggaggatctgcagctaatgctcgcactacaccaaccctttgtcgttgtccacccgatagttcatcaggttttctatttttaaattgctcaggatttaaacctaccattgtcaataattcatccacacgtaaatcaatatcgttatctttccactttttcatttggggtacttgtgcaatgttttctttgatagtcatatga

SEQ ID NO: 2590 - DNA, 276 bp, Staphylococcus epidermidis
ttcactactttgtcatgttattactccgcacttgtaactgttgcgagcatacaaacagttggaattatccttgtagttgctttactaatcactccagcttctacagcttttttaatcagtaaacaactttatgccatgatggtaattgcaagcataatcagcgtgataagttcgattatcggtctaaattttagttatatatataatattccaagtgggagcaactattgttatctgtacctttatgatttatattgtaacgctatcagttactag

SEQ ID NO: 2591 - DNA, 1029 bp, Staphylococcus epidermidis
ctaagggagtctttatttatgtcatatattttaattgtcacgatagctatagttatattttcattaatatttgactttatcaatggtttccatgatacagctaatgctgtagctactgcggtttctactcgagcattaacaccaagaagagctattttattagcagcagtcatgaactttattggggcattgaccttcacaggtgttgctggaactattacaaaagatatcgttgatccattcaaattacaacatggtttagttgttgtgttagcagctattattgctgccattatttggaatttaatcacttggttgtatggaataccaagttcatcttctcacgcactaatcggatctatagcgggtgcagccattgcatcgcaaggttcgtttgcagtattacactatcaaggttttacaaaaattattatcgtattaatcatttcaccaattatagctttttgtgtaggttatatgatgtatacgattgttaaaatcgtttttaaaaattcaaatttaacacgtactaatcgtaattttaggtttttccaaatctttactgcagcattacaatcattctcacatggtacaaacgatgctcaaaaatctatgggtattatcacattagctttaattgtaggtaatttacaagatggtagtaatgttgaacctcaagtatgggttaaagttgcgtgtgcaacagctatgggattaggtacagcagtaggtggttggaaaatcatcaaaactgttggcggaaatattatgaaaattagacctgctaacggtgcagccgctgatatttcttcagcattaacgattttcgtagcgtcatcattacatttcccattatctactacacacgttgtgtcttcatctattctaggtgtaggtgcttcaaatcgtgcgaaaggtgttaaatggagtactgctcaacgtatggttgtaacatgggtgattactttacctatctcagctgttttagcagcaattatttattttattattcatctgttcttaaaataa

SEQ ID NO: 2592 - DNA, 195 bp, Staphylococcus epidermidis
acaggatatcctttggctaacatcgctgaaacacttaaaacaagtaacagtgtgattaaactgaaaataatggaaaatatagggaaccataaaaaactaagtcccaaaaataaagcaattccagatcctaatgatgcaccactagctaatcccaatgtaaaactatctgcaagtggattatttaacacaatttga

SEQ ID NO: 2593 - DNA, 327 bp, Staphylococcus epidermidis
ataaacaatcctacgcctataacggtagttatgacaagacctagagccatcatcataacaggtttgatatacttccttaaatgtactcttgaaacattaacaccctcaacgaatagtagtggtgcaatcaatgtaaccataaataattcagaatcaaaattgaattcaactggaatgggagtgaggtataaaatcatcccaaggaaaatttggataaatgcaagaggtactttaggtatgaaagtatgtacaaaggagctcacaataactagtgcgacaaatatgagtagagtttcaaatatctccacactttcacctctttattaa

SEQ ID NO: 2594 - DNA, 510 bp, Staphylococcus epidermidis
gaaaggctgttagttatgtttatttatctgtttcactttatcattagtttcattgccacagtccttttttcaattatatttaatgcacctaaaaaattgctattagcttgtggatttgttggagctgttgcttggacaatatatcagatgacagtaggtatggatttaggtaaagttggcgcttcatttttaggaagtctaatattaggattaatgagtcatacaatgagtagacggtacaagcaacctgttattatatttatcgtccccggcattatacctctcgttccaggtggcgcagcatatgaagctacaagatttttagtatcaaatgattatacgaatgcagttaatacttttttagaggtaacattaatttctggtgcaattgcattcggtatacttgtatctgaaatagtctattacatttattcacgcatcaagcaatcttatggtaaaatcaagggtaaaacttataaaaaatcctataatatgaataatagagtataa

SEQ ID NO: 2595 - DNA, 939 bp, Staphylococcus epidermidis
gaaaggatgttcaaaacattgaataaaaatgacatcttacgcggattagagtcaattcttcctaaagatattattaaagtggatgaacctctcaagcgttatacatatacagaaacaggaggagaggcagatttttatttatcccctaccaaaaatgaagaagtccaagccatcgtaaagtttgcccatgagaacagtataccggtaacttatttaggaaatgggtctaacattatcattcgagaaggtggaattcgaggaatcgtcctcagcttattatctctcaatcatattgaaacctctgatgatgcaattatagcaggtagtggtgcagcaattattgacgtttcaaatgttgcacgtgaccatgtattaaccggtttagaatttgcatgcggtatccctgggtcaattggtggcgccgtattcatgaatgctggtgcttatggcggagaagttaaagactgtattgactatgcattatgtgtcaatgaaaaaggtgatttattaaagctcactacagctgaactggaattagactatagaaatagtgtggtacaacaaaaacatttagttgtattagaggctgctttcaccttagaaccaggtaaattagatgaaattcaggccaaaatggatgatcttactgaaagacgtgaatctaaacaaccgcttgaattcccttcttgcggaagtgttttccaaagaccaccgggtcattttgcaggtaaactcattcaagattctaatttacagggctatcgaatcggtggcgttgaagtttcaactaagcatgcgggattcatggttaatgtagacaacggtacagcaactgattatgaagcacttatacatcacgtacaaaaaatagttaaagaaaaattcgatgttgaattgaatactgaggtacgtattataggtgatcatcccacagattaa

SEQ ID NO: 2596 - DNA, 258 bp, Staphylococcus epidermidis
ctaaatccaccttcaagtgccttagcaacaggtaaaacacctttagctacacctttaattcctttaattgcttctccacgtgcacgaagtttcgataaattaatggccacaccaccaccaattttactaagttgttttgcagttgaatcaatgaaattgatagaatttaagctatcgtctacttctaataagaaacatgaaacaagttctccacgtcttgctctacctgcattcaagaatgttggtgtcgccggttga

SEQ ID NO: 2597 - DNA, 270 bp, Staphylococcus epidermidis
ggtgtaacacctatgaaattaaacaaagcaaatatattcaatttgatattcaccattttatttttttcatttaacattctcataacctataacgcaaatatagattataagttatggttaatacctggtttagcaatttgtggttttgctcttttttcaagcttgaccttagtaattatctatagtgatttattcagtgaaatattattttttatcaacattatcttagcactgtattacatttatccgattttttatgaatttgtctaa

SEQ ID NO: 2598 - DNA, 762 bp, Staphylococcus epidermidis
atgagaacaccaattatagccggaaactggaaaatgaataaaacagttcaagaagctaaagactttgtaaacgaattaccaacattacctgatcctaaagaagtagaatcagttatttgtgcaccaacaatccaattagacgctttagtaacagctgttaaagatggtaaagcaaaagggttaaaaattggagcacaaaacgcttactttgaagaaagcggtgcttatactggagaaacttcaccagtagcattatctgaattaggtgttaaatatgtagtgattggtcactcagagcgtcgtgactatttccacgaaactgacgaagaagtaaacaaaaaagcgcatgctatcttcaatcacggtatgacacctattatttgtgtaggtgaatctgatgaagaacgtgaagctggtaaagcaaataaaatcgtaggtaatcaagtgaaaaaagctgtcgaaggtttatcagatgatcaacttaaagaagttgttattgcatatgaaccaatttgggctatcggtactggtaagtcatctacatctgaagatgcaaatgaaatgtgtgctcacgtacgtcaaacattagctgacttatctagtcaagaggttgctgacgctacacgtattcaatatggtggtagtgttaaacctaataacattaaagaatatatggctcaatcagatatcgatggcgctcttgtaggtggcgcatcattaaaagttgaagatttcgtacaattgttagaaggtgcaaaataa

SEQ ID NO: 2599 - DNA, 1107 bp, Staphylococcus epidermidis
atgaaaggaccgtcaattgtagtaaaaggtgcacgagcacataatttaaaaggagtagatattgaattacctaaaaacaagttgattgtcatgactggactttcaggctcaggtaaatcttcgttagcgttcgatactatttatgctgaaggtcaacgacgttatgtggaatcgttaagtgcatatgcgcgacaatttttaggacaaatggacaaacctgatgtagataccattgaaggtttgtcaccagcaatatctattgatcagaagacgacaagtaaaaacccacgttctaccgttgccactgtgactgaaatctatgattatattcgattattatatgcgcgtgtcggtaaaccgtactgtccttatcacggtatagaaattgaatcacaaactgttcaacaaatggttgatcgtattttagaattggaagaacgtacaaaaattcaattacttgctccagttatatcacatagaaaaggaagtcatgaaaaattaattgaagatataggtaagaaaggatatgtgcgtttacgtgttgatgatgaaatcgtcgatgtaaatgaagtgcctcaattggataaaaataaaaatcacacaattgaagttgttgttgatagacttgtagttaaagatggcattgagacgcgtttagcggactctattgagacagcacttgaacttgctgaaggtaatttaacagttgacgttattaatggagaagaacttaaattctctgagaaccacgcatgtcctatatgtggtttctctattggtgaattagaacctagaatgtttagtttcaacagtccgtttggtgcgtgtccaacttgtgatggtttaggtcaaaaactaaaagtagacctagatttagtcattcctgataaaaataaaactttaaatgaaggtgcaattgaaccatgggaaccaacaagttcggatttttatccaactttattaaaacgtgtatgtgaagtctacaaaattaatatggataagccatataaaaaattgactgatagacaaaaaaatatacttatgaatggttctggagaaacagaaattgactttactttacacgcaacgaaatggtgttactcgtag

SEQ ID NO: 2600 - DNA, 273 bp, Staphylococcus epidermidis
cagcaggtgccaaaaggtaaacgatttgcgctacctaatgctgaagttatgattcaccaaccattaggtggtgcacaaggacaagcaactgaaattgaaattgcagcaaatcatattttaaaaacacgtgaaaaattaaatcgtattttatcagaacgtacaggtcaatcaattgaaaaaattcaacaagatactgatcgcgacaacttcttaacagctgcagaagctaaagaatatggattaattgatgaagtaatggaaccagaaaaataa

SEQ ID NO: 2601 - DNA, 2571 bp, Staphylococcus epidermidis
gccaaacagtttttagttaaaggagcgacgcgtgcaatgggatttttatcgaaaattgttgacggcaataaaaaagaaattaaaagattaggtaagttagcagataaagtacttgctttagaggaagatactgcgatattaaccgatgaagaaatacgtgaaaaaacaaaatcttttcaaaaagagttagcagaaattgaagatgtaaaaaaacaaaatgattatttagataaaattttacctgaagcttatgcacttgtacgtgaggggtcaaagagagtatttaatatgattccttataaagtacaagtaatgggtggtattgctatacataaaggtgatattgcagaaatgagaacaggtgaagggaaaacattgactgcaaccatgccgacgtatttgaatgctttagctggtagaggtgtacatgttattacagtcaatgaatatctatcaagttcacaaagtgaagaaatggctgaactatataactatcttggcttaactgtaggtttgaacttaaatagtaagtcaactgaagaaaaacgtgaggcttacgcacaagatatcacttatagtacgaataatgaacttgggtttgattatcttagagataatatggtgaactatgctgaagagagagtaatgcgtcctctacattttgcaattattgatgaggtcgattccatattgatcgacgaagcaagaacacctttaattatttctggtgaagcggaaaaatctacttctttatatactcaagcaaatgtttttgcaaaaatgcttaaagcggaagatgattataattatgatgaaaaaaccaaagctgtacatcttacagaacaaggtgcagataaagctgaacgtatgttcaaagtagataatctttatgatgttcaaaatgtggaagtgattagtcatattaatacagctttaagagctcatgttactttgcaacgcgatgttgattacatggtcgttgacggtgaagtattaattgttgaccaatttactggacgtacaatgcctggacgtcgtttttctgaaggtttacaccaagcaattgaggctaaagaaggtgtagcaattcaaaatgagtctaaaacgatggcatccattactttccaaaactatttcagaatgtataataagttagcggggatgactggtacagcgaaaaccgaagaggaagaatttcgtaatatctataatatgacagttacccaaattccaacaaacaaacctgttcaacgtaaagataattcagacttaatttatattagtcaaaaaggaaagtttgatgcggtagttgaagatgttgtagaaaaacataaaaaaggacaacccgtcttactaggtactgttgctgttgagacttctgaatatatttcaaatttactaaaaaaacgtggtgtcagacatgacgtattaaacgctaaaaatcatgaacgcgaagctgaaatcgtttcaaacgcggggcaaaaaggtgcagttacaattgccacaaatatggctggacgtggaacagatattaaacttggtgatggtgttgaagagttaggtggacttgctgttattggtactgagcgtcatgaatcaagacgtattgatgatcaattacgtggacgttcaggacgccaaggtgatagaggagatagtcgtttttacctatctttacaagatgaattaatggtacgttttggttcagaacgcttacagaaaatgatgaaccgtttaggaatggatgattcaacgccaatcgagtcgaaaatggtatctcgagctgtagaatcagctcaaaaacgagtagaaggtaataactttgacgcgcgtaaacgtattctagaatacgatgaagttttacgtaagcaacgtgaaattatttataatgagcgtaatgaaatcattgatagtgaagaaagttctcaagtcgttaacgcgatgttacgttctacattgcaacgtgcgattaatcattttattaatgaagaagacgataatcctgactacatgccatttatcaattacgttaatgatgtgttcttgcaagaaggagatcttcaagatacagaaattaaaggtaaagattcagaagatatttttgaaattgtatggtctaaaattgaaaaagcatatgcacagcaacaagaaacattaggagaccaaatgagtgaatttgagcggatgattttattacgttcaattgatacacattggactgatcatattgatacgatggatcaattgcgtcaaggtattcatttacgttcatatgcacaacaaaatccacttcgtgattatcaaaatgaaggtcatgaattatttgatatcatgatgcaaaatatcgaggaagatacatgtaagtatatcttgaaatcagtggttcagtttgaagatgatgtagtacgtgaaaaatctaaaagctttggtgaagcaaaacatgtaactgctgaagatggcaaagaaaaagcaaagccccaaccgattgtaaaaggtgatcaggtaggtagaaatgatccatgcccatgtggtagtggtaaaaaatataaaaattgtcatgggaaagcgtaa

SEQ ID NO: 2602 - DNA, 753 bp, Staphylococcus epidermidis
aataaaattactatagtgtacgaaatgagggatagaatgacccatgtagatattgcagcgacaattgcaccagaagacaagctttctaaaactttactcaaagatataaaagtaaacgaagaatcaatagatatcattgaattgcgcattgaccaatggccatcatttaataaggcattattaaatgaagtgattaagcaattaaaaatattccatttgaaaatattagtaacatatagaacttcagttcaaggaggaaaaggagctgtaaatgagcaagagtatttaaatatactaggtgaattaattgagtgtccacaatttgatatgattgatattgagtggagcagtgccgtcaaaattgaaaaatatacgcatcttgttcaacgtgcacaacaaaaagggctcgaagttgttctttcgcatcataattttcaagaaacacctgctttagatgaacttaaatttatttactttaaaatgcaaaaactcaatcctgagtatttaaagcttgcggttatgcccaaatgtcaagaggacgtgttacatttattagaagccatgtcactcacagcgaagcacacaacatgccgaattgtcggtatatcgatgtctagtttgggtaaagtcagccgaattgctcaaggcgtatttggtggaacgctgtcttatggttgcatagaagaaccacaagcacccggacagatacatgtctctaagttaaaatccatggtttctttttatgaggattaa

SEQ ID NO: 2603 - DNA, 582 bp, Staphylococcus epidermidis
ggagagattactatgattagatttgaaattcatggagataacctcactatcacagatgcaattcgcaactatattgaggagaaagtaggtaaattagaaagatactttaacaatgtgccaaatgctgtagcacatgttagagttaaaacttattctaattctacaactaaaattgaagttacaattcctttaaaagatgtcactcttagagctgaagaaagacatgatgatttatatgcaggcattgatttaattactaacaaattggaaagacaagtacgtaaatacaaaactcgtgtaaatcgtaaacatagagatcgtggagatcaagatatctttgttgctgaagtacaagagtctacaacaaacaatcatgcagatgatatagaaagtgaaaatgatattgaaattattcgttctaaacaattcagcttaaaaccaatggattctgaagaagcagtattgcaaatgaatttattgggacatgatttctttatttttaccgatagagaaactgatggcacaagcattgtttatagacgaaaagatggcaaatacggtctgattgaaacaactgaataa

SEQ ID NO: 2604 - DNA, 813 bp, Staphylococcus epidermidis
ggaggagttactttgaaaaagttagcctttgcaattacagccgcttcaggcgcagcagcagttctatcacatcatgatgctgaagcttctacacaacataaggttcaatctggagaatccttatggactattgcacaacaatacaatacttcagtagaaagcattaagcagaataataatcttagcaacaatatggtattcccaggacaagttattaatgtaggtggaagtgcttcacaaaatactagttcaaacacttcttcaagttcagcatcttcacatactgtagtagcaggtgaatcattaaacatcatagctaataaatatggtgtttcagttgatgcattaatgcaagcaaatcatctaaatggttatttaattatgcctaaccaaatattaactatccctaatggtggttctggttcaggatcaggtggtacagcaactcaaactagcggtaattatacttcaccttcattcaaccatcaaaacttatacactgaaggtcaatgcacatggtatgtgttcgacaaacgttcacaagctggtaaacctatcagtacttactggtctgatgcaaaatactgggcgtcaaatgcagcgaatgatggttatcaagttgataatactccatctgttggtgcaattatgcaaagtacacctggaccatatggtcatgtagcatacgttgaacgtattaatggtgatggtagtattttaatttcagaaatgaattatgcaaatggtccatacaatatgaactatcgtactatcccagcttcagaagtatcttcatatgcatttatccactaa

SEQ ID NO: 2605 - DNA, 675 bp, Staphylococcus epidermidis
atgaatgagttaggtcaaacaattattgagaattacaatacctttgcgccaaaaaatatgttctcagagtggcttaagaatctgctacaaccacttgccactttatcgttgggattttttgtatataaatacactgataatcgtcataaaaaaagattattaaacgagttagattcgaagtcagaatggagaaaaacgttatttataataggtgggaactctaccgtcacattagatgatgtatatcaattcagaactgcactaagatttaattttaaaaacaatgggaactatatcgataaagagaaaagcaaaaaagaaggctttagttatttctttgacaatatgaatataataattattaaatactgtattaatctaatagaaaagaagcaagcagtatctaactcaatagatttagatataaaagatcaaaacagtataagactattttgtagatatatgttagcagaccactgggagaaaaatcaaaataaaaatttaaaatttgatgatcctaacaaagaagaagagttatgtattttcacattaaaagagtttttgaagctacacaaatattatcaaaattctaaagatgaagattcaaaaaataaatttaagtctttatttgacgaatcgaaagagttagtagaaaaaaaagacaccccttcataa

SEQ ID NO: 2606 - DNA, 552 bp, Staphylococcus epidermidis
agcttagctacacaacagcaaaaattattctttaagctactgttttttactctggtgcacgtaagggcgaaattagagccctcacatggcgcgatattaactacgatgatgattttcatacatataaataaaacggactatcacggtgaagtgacagcccctaaaacaaaagcagcaatacgtgatatatacctaccttttcatatgatgaatgacatagaaaaatatttaaaatggtacaaagaaaacaatgtatataaagatgattatgtattattcggtacattcttcaaggcatacagtgaatcaactatagatcgttggtttaccactgcattaaaagtgttagatgaacaactgccagacgttcagacattccctagaatcgttatacatgaattaagacatagccatgcgtctatgctagtcaatcatggtgcaagtatcatggtaatagcacagcgtttaggtcatgctgatagtaatgaagtatataaccgatacggtcatttgtaccctagtacgcagaaagaaatagttaaatacttgtaa

SEQ ID NO: 2607 - DNA, 1554 bp, Staphylococcus epidermidis
agatttcgtacaattgttagaaggtgcaaaataattatggcaaaacaaccaactgccttaatcatcttagatggtttcgcaaatcgtgaaagtgaacatggcaatgcagttaagcaagcacataaacctaattttgatcgatattatgaaaaatatcctacaacacaaatagaagctagtggcttagatgtaggtcttcctgaaggtcaaatgggtaactctgaagtaggacatatgaatattggtgcaggacgcatcgtatatcaaagtttaactcgtattaataaatcgattgaagacggagaattctttgataacactgtattaaataacactgttaaacatgttaaagacaatggctctgcgcttcatgtattcggattgctttctgatggtggtgtacacagtcattataagcatctatttgctattttagaattagctaaaaagcaaggaatagataaagtatatgtccacgcatttttagatggtcgtgatgttgatcaaaaatctgctttgaaatatatagaggaaactgaagataaatttaaagaattaggtgtaggccaattcgcttctgtttcaggacgttattatgctatggaccgtgacaagcgttgggatcgtgaggaacgtgcctataatgctattcgtaactttgaaggtcctacatttacttcagctaaagcaggcgttgaagctaattataaaaatgatgtgactgatgaattcgtcgaaccgtttatagttgaaggccaaaacgatggtgtgaacgatggagacgcagtaatcttttataatttccgtccagatagagcagctcaactttcagaaatctttactaataaagcgtttgatggatttaaagttgaacaagtggacaacttattctacgctacattcacgaaatataatgacaatgtagatgctgaaattgtatttgaaaaagttgacttaaataatacaatcggtgaagttgctcaagataatggcttgaaacaattacgtatcgctgaaactgaaaagtatccacatgtaacatactttatgagtggtggacgaaatgaagagtttgaaggagaacgtcgtagactcatcgattctccaaaagtagcgacttatgatttaaaacctgagatgagtgcatatgaagttaaagatgcattattagaagagttagacaaaggtgacttagatttaattctactgaactttgctaacccagatatggttggacatagtggtatgcttgaaccaacaattaaagcaatcgaagcagtagatgagtgtcttggtgaagtcgttgacaaaattattgatatgggtggtcatgccatcatcactgcagaccacggtaactcagatcaagtattaactgatgacgaccaacctatgacgacacacacaactaatcctgttccagttattgtcactaaagaaggtgttacattaagagaaactggacgtttaggcgatttagcgccgacattattagatttattaaatgttaaacaaccatctgaaatgacaggtgaatcactgattaaacattag

SEQ ID NO: 2608 - DNA, 723 bp, Staphylococcus epidermidis
atcatgcgtacgaatgataaagtattactcgaaaatattaatgattattttagtcacaaaggaatgtcaccacacttaattgatgatataaaagaaaaatatcgacaagatattaaaaagtctgaagaaaaagatcaagattacattgaatatagaggtaaatcacctgcgcaattaatattaacaattcagcgtaatttgtttgcattacaactcaatccaatgattttctttatcattaactttattcttatttcatatttgtacgataaacaatatgtaccttttcaagcaattaccggtataagcttgttttattgcttagttatatttccaataacactcattttatatgtgcgtattgccaaaaaaaattatctatacagtaataagtatgaaatgagaactggaataatcattggtattattgctttaattctagtaattatgcaagggtttcactttaactgggctattattcctatttctatctatggtcatcagtttgtatttttcgctggaattattttaagtcttgttggtatattctttaaacgtatagaatttgtaggagttggcttactattttgtcaaaaaacaatagatgcaatggtaactgacccggaaattgcacagtttttctctttagcaatttggattatacttgttgtgctaatcattttttatacgatacgtttatctgaacgcactaaatcatcataa

SEQ ID NO: 2609 - DNA, 948 bp, Staphylococcus epidermidis
gaaagttggtttttatcattgttttttctatatcttttaggaatttttgttggcatgttacttcctattcaaacttcaatcaactcaaggctaagccaatttacccgttcatctttttatgcttcaaccatatcttttgctgtcggaacaatatgcttacttgtgcttaatatcattattcatccacaagtattaacaccagaattcttttctaagcaaacacttaactatacttgggtcctaggaggactattaggtgttatctatttaactggaaacttattattattaccaagattaggcgcagcacttactgttgttattacggttacagggcaaattattatgggtgtaatcattgatacatttggattattgggcgcccatcaacaatcttttacattatttaaaggtgttggaattatatttttaattactggaattatatttatgaattatgttcgtagacatcctgttaatagacataagaatacaccaatagtattctggttgcttattggattcgtatttggtttcgctccgccaatccaaacaacaatcaacagcacactggctcaacacacacactcatccatatttgcttcactcatatcatttagcgttggtacaatagcgttatttatattaacattagtatttaatcgtagtctgaaaatatcatctactcataaaacactaggtaagattaaatctatttattttattggagggatactaggaatggcattcgtaacatctaatattattttaatgcctttcttaggagcagctttaactactataattgctatgatgggccaaatgattatgggtattattatcgatcatttcggtttgttgggttcacctaaaaacaaaataacatcacgtaagttaggtggattattatgtatagctataggtattattttattacgattattttaa

SEQ ID NO: 2610 - DNA, 513 bp, Staphylococcus epidermidis
tgggaggtcaccatgaacaatatccgtttattgaatcaaaacgatttggattcctatattgaattaatgaaatttggtcaccataattatgaatgggatcgttactatttagaaaatgttagcattgatagactcaaaactatcttgtctaatcatactgattattggaatatatttggtgcttttgaagatgatgaacttgttgcaacatgcactttaaaacaaatgaattatgtaggtaaatgccataaagctattcttgaaaataattttgttaaaaataatgatgaaattgttaaccgagaattaattaatcatattattcaatacgctaaagaacaaaatattgaaacattgatgattgctattgcatcaaacaatataagtgctaaagtgttctttagttctataggttttgaaaatcttgcttttgaaaaaaacgctagcaaaattggcaatgaatattttgacgaaaattggctcatttattcaacaactgagtcatcagattaa

SEQ ID NO: 2611 - DNA, 183 bp, Staphylococcus epidermidis
actaaattaacggggtgtcttatgtataaaaattatcatatgactaaacatactctaccaatggaaacttcagtaattatctccacacatgatatgtcacaatatgtgaatgatattgtaaaaaaattccaggtactgaattcagacagcatcgttgcgcaacattatagcatcccaaaatga

SEQ ID NO: 2612 - DNA, 1149 bp, Staphylococcus epidermidis
attatgctaactgaaaaagagcaagatattatcaaacaaactgtaccattattacaagataaaggaactgagattacttcaattttttatcctaagatgtttgaggctaacccagaattattaaacatgtttaaccaaacaaaccaaaagaaaggtatgcaatctgctgcattagcacaagcagtactagctgcagcaatgaatattaataatttaggtgcaattaagccagcaattatgcctgtggcacataagcactgtgctttacaagtttatcccgaacattatccaattgtaggtgaaaatttacttgctgcaattcaagatgtgacagggttagaaagtgacgacccagtaattcaaacatgggcaaaagcgtatggagaaattgcagatgtatttatcaaattagagcaagaaatttacaaccatatgttatggaaaggttttaaaccatttaaaatcacaaacattacacaagaaacaagtgacatcaaatctttcacagttgaatctgaagaatatgatttaagtcaattcgaaccaggtcaatacattaccgtagatgtttctagtgaaaagttaccatatagagctaaacgtcattattcaatcatagatggagatgaaaatcacttagtatttggtgtcaaacgtgatgtgactactgaacatgaaggtgaagtttcaacaattttacatgatgaaatatcagaaggtgacatgattaatttatctgctcctgtaggtggcttttcaatagaaaatactgaaagaccgcaattgtttattggttctggcgtaggtatgacaccattagtttcaatgtttaaaaaagctgcatcattaaacgttccaactcaaatgattcaagcggttgtgacagaagatgaacgaccatttgctcaaaaacttgatagcattacagataattatgagcaagcacagctacatttacacgtgaaagataaagaaggttatttagaagctaaagaattagaacaatatttaagtgaacagcctgaaatttatatttgtggtggtacgaaattcttacattcaattataaattctcttaaagaattaaattatgatatgaatcatgttcattttgaaacatttattcctcgtttaagtgttcaagtatag

SEQ ID NO: 2613 - DNA, 204 bp, Staphylococcus epidermidis
atatttgtaacaaatccattaattaaaagagaatattctataaaaataattccacaatcaacttcacgtactttattacttaaccactactatacgcttatttttggaaaagtaaaggattttctatattttataaattgtagagctcttaataatgtcaaaagctatttaaataaggcattgtatagattaatagtttattaa

SEQ ID NO: 2614 - DNA, 249 bp, Staphylococcus epidermidis
tctaatacaacggcatttttaggattctttggtacttcgacagtattagagatttttttcttatcactgccattattttctttaccacttgcttcaaaactatttttgatggttacagtttctttagaatcactatttttctttttcgaagttgaattattattcgaactattactacaagccgttaaaactaaaactagagacaataataaaaataagactgtttttttcatatgtgcaactccctaa

SEQ ID NO: 2615 - DNA, 834 bp, Staphylococcus epidermidis
gtgaataaaactatcagagatatcattttagttatgataggttcatttattttctctgcaggtatcaatgcatttgttatttcagggaatttgggtgagggtggtgtcactggtatagccatcgtattatattatgcttttcatatttcaccgggaataaccaatttcgttttaaatgctattttaattattgtgggttataaatatttgagtaaacgtagtacatatttaacaatttttgctacagtactcatttcaatctttctaggtttaactgaaacatggcatgtagaaactgggaatgttgtgattaatgctgtgttcggtgggacttgtgttggtttaggaattggtattatcgttttagcagggggaacaaccgctggaacggttattcttgcgagaattgttaataaatatttagatattagtacgccttacgctttgttattctttgaccttatcgttgtgcttatttcattgacagaaattcctttagtgaagtgcttagttacagttatgtctttatatataggtacaaaagtgatggaatttgttatagaaggattaaatactaaaaaggcaatgactattatatctagtcgccctaatgaggtagcaaaagctattgatcagcaagttggaagaggattaacaatattaaatggacacggttattacactagagaagaaaaagatgtactttacgtagtcatctctaaaacacaagtatctcgtgctaaacgaatcatcaaaaatattgacgaaaatgcctttttagttattcatgacgttcgtgatgtatatggtaatggttttttgttagatgagtaa

SEQ ID NO: 2616 - DNA, 801 bp, Staphylococcus epidermidis
atgaaaaaaacgctaactgtaacgttaagttcgattgcagcttttattgcaatcaacactgcagctaacgcacaagaatctgagacgtcgcaactagacacatatgcaacgggtgatgtaattacaaatcaatcaaacttaggtatttacattgtaaaacctggagatagtttatataaaattgctttagaacataatctttctttagaagagctttatgcattaaatcctggtgtagaacctcttatttttccgggagatgaaattgtagtatctgaaactgcatttgaacaatttaataacacaaacacattcgtaaattatgaaactaactacattccagtaggatataataatgtatcaactgatacatccaacactacttatgataattatgatagtgaatcaactgatacatactctgtgtcaaacgcctatgatggtctaagaagtgtatctaactcagctaatttatacactactggtcaatgtacttattatgcattcgatcgtcgagctgagctagggaaaccaattggaagtctatggggcaacgctagtaactgggcatattcagctaatcaggctggctttaatgtagatcacacacctgaggttggtgctgtattccaaagtggtccgggtcaaaatggggctggtgcttatggacatgttggcgttgttgaatcaatcaattctaatggttctgtaactgtttcggaaatgaactggaatggtggcgttaacgtaaaatcttacagaactattagcaaccctaattcatataattacattcactaa

SEQ ID NO: 2617 - DNA, 846 bp, Staphylococcus epidermidis
tgtactatgacaaatgatgtccaaattttaaataacggttatccaatgcctgcagttggattaggagtttataagatagcggatgagcagatggaagaggttgtccgtacagctttagatgcaggatatcgtgcatttgatacggcatacttttatggaaatgaaaaagccttaggtagtgcattaaaacattcaaatgttgagagggacgagttattcataacatctaaactttggaatgattatcaaggttatgaccaaacaatagagtactttaataaatcattggacaatttagggttagactatttagatttatttttaattcattggccttgtgaaaatgatcaattgtatattgaatcatataaagccttagaacatttatatgaagaaggtaaaataaaagccattggtgtatgtaactttaagatacatcatttagaaaagttaatgaaagaaactaaaattacaccacaggtgaatcaaattgagttacatccgtactttaaccaacaagatgtacaagacttttgtgatgaacatgatattaaagtaacagcttggatgcctttaatgcgcaataaagggttgcttgatgaccctgtaattacagatattgctcatcgttatgataaaacacctgcacaaattgtcttacgttggcatcttgcacataatcgtattatcattcctaaatcacaaacacctaaacgtattaaagaaaattttgatatttttgattttaatcttgagttaacagatgttgcagaaatagatagtttaaataaaaatgctagacaaggaaaagatcctgatgatgtcagtattggagatttgaaataa

SEQ ID NO: 2618 - DNA, 960 bp, Staphylococcus epidermidis
acatccatgaccaagcaacgcatcgttatttcttcattactattcattttcattctcacaacttgtagttttagttacattactttctctaaattaacttctagaacagaagatattaaaaatattaaaactataaaagcaaagcccaaattactcctttcaacaactggtatacaagcccctcttaacagctatattttctactacactcccactttaggacaactccaaaaacttttagtaaaaaatcatagcaaagtatctaaaaacactccagtgttagaatattacaattatgaaaaagatcatttatatgaggaactccaaaatacacttagtaatgaacgtaacaacaaaactttaaattctaaaaatgatttacattattattcattccttaatcagctaaaattacaaatgattcaaactaaatcctcaattaaatccactttattttcaccaattaatggaagtatttcatatattaattctatcccttcaaaaccaaacgaaaagatagtgcaaattaatagcaacgaacgtattattcgtgctaatatatcagaatctgagttgaatttattaaaaataaatcaaaatatttctgtaacatctagtgacaacactcaatttactagtaaaattaaagaaatttcgaatataccatcaaaaataaaaaatggcgtctcatattacgacattttactttctacacaacccaatcatcaaattggaacacactttaaaatcaaattagcctcaaatgacataaagttacctacgtcagctattgttcaaaaacgctatgttttaattctaaaaaacgggaaaattacaaaaagagaagtaacatacaaaaagagtttaaaaagtgggtatattaatataactaaaggcttattgatagatgaaaaagttgttaaaaatcctacttctaaattaataaacatttatatataa

SEQ ID NO: 2619 - DNA, 495 bp, Staphylococcus epidermidis
atagagatgacagcgatattatggattttaattattatagcctttgcgttagcatttattggtttaattaaaccggtgataccatcacttttaatgttatggattggttttttaatttatcaatttggttttcatgagggaagattatcgtggattttttatgttgcaatgattatctttaccattatgatattagtagccgattttgtgatgaataaatatttcgtcaatcgctttggaggaagtaaaataggtgaatacacagcgctcataggtgtgattgtaggttgtttcgtttttcctccctttggtattatcattattccttttgttgctgtgttcattgttgaattggttcaagggtttaactttcaacaagctataaaggtgagttttggctcagtgattgcatttttagcgagtacaattgctcaaggtctaataatgattgtaatggttatttggttctttttagatgtctttctaataaattaa

SEQ ID NO: 2620 - DNA, 1575 bp, Staphylococcus epidermidis
aataaggagacgattaaaatggctaaaggggaccaatatcaagctcatactgaaaaatatcatgataaaaagtctaaaaaaagttataaacctgtgtggattatcattagttttattattttaattacaatcttgttattacccacaccagcaggattacctgtaatggctaaagcagcactagctattttagctttcgctgtagttatgtgggttacagaagcagttacttatccagtttctgcaacattaattttaggattaatgatacttttactaggtttaagtccagttcaagatttatccgaaaaacttggaaaccctaaaagtggcgacataatactaaaaggtagcgatattttaggaacgaataacgcgcttagtcacgcttttagtggtttttcaacctcagccgtagcacttgtagctgcagcattatttttagcagtagctatgcaggaaaccaatttacataaacgacttgcattacttgtgctatcaattgttggaaataaaactagaaatatagtcattggtgctattttagtatctattgttctagcattctttgtaccatcagctacagcacgtgctggtgcagttgtcccaatattactgggaatgattgctgcatttaatgtgagtaaggatagtagacttgcttcattattaattattactgctgtacaagcagtttcgatatggaatataggtattaaaacggctgcagcacaaaatattgtagccatcaattttattaaccaaaatttaggacatgatgtatcatggggagagtggtttttatatgctgcgccgtggtcaatcattatgtctatagctctttattttataatgattaagtttatgccacctgaacatgatgcaattgaaggtggaaaagagttaattaaaaaggaacttaataaattaggaccagtcagtcatagagaatggcgactaattgtgatttcagtgcttttattattcttctggtcgactgagaaagtattgcatccgattgattcagcttcgattacactagttgctctaggtattatactaatgccaaagattggtgttattacttggaaaggtgttgaaaagaagattccttgggggacgattatagtatttggtgtaggaatctcacttggtaatgtattacttaaaacaggagccgctcaatggttaagtgatcaaacatttggtttgatgggtcttaaacatttaccgatcatagcaactattgcgttaattaccttatttaatatattaatacatttaggttttgcaagtgcaacgagcttagcctctgcgttaatacctgtgtttatttctttgacttcaacgctaaatttaggtgatcatgctattggttttgtattaatacaacaatttgtgattagttttggtttcctactacctgtcagtgcaccacaaaatatgcttgcatatggtactgggacttttaccgtaaaggattttttaaagacaggtatacctttaacgatagtaggttatattttagttatcgtatttagtttgacgtattggaaatggcttggtttagtgtaa

SEQ ID NO: 2621 - DNA, 1944 bp, Staphylococcus epidermidis
caaaatttttttgaaaattcgatagttgacaatttccagtatttgaaaaggaagataagcatggaagcatacaaaattgaacatttaaataaatcctatgcagataaagaaatttttaatgatcttaacctatctatatctgagcatgaaagaattggattagtaggtatcaatggaacaggtaaaagtacactattaaaagtcattggtggtctagatgaagattttactgcagatattacccaccctaatcaatatcgcattcgttattcctctcaaaaacaagacctcaatggccatatgactgtgttcgaagctgttttaagttcggatactcctacattaagaattataaaaaaatatgaagaagcagttaatcgctatgcgttagatcaaagtgactctaattttaataaaatgatggaagcacaagaagaaatggatcaaaaggatgcatgggactataatgcagaaattaaaacgattttatctaaactagggattcacgatacaactaagaaaatagttgaactttcgggtggtcaacaaaaaagagttgtattggctaaaactctaatagaacaaccggatttacttttgctagatgaaccgacgaaccatcttgactttgaatccatccgttggctcattaattatgtcaagcaatatccacatacagttttatttgtaacacatgatcgctactttttaaatgaagtatcgacgcgaattattgaactggatagagggaagttaaaaacatatccaggtaattatgaagattacatagtaatgcgtgcagaaaatgaattagtagaacaaaaacaacaagaaaaacaaaaagcattgtataaacaagagttagcatggatgcgagcaggagcaaaggcaagaactactaaacaacaggcacgtatcaatagatttaatcaactagaatcagacgttaagacgcaacatacacaagataagggtgaacttaatcttgcatattcaaggttaggtaaacaagtatatgaattaaagaatttatcaaaatcaattaataataaagttttatttgaagatgtcactgaaattattcaaagtggtagacgtataggtattgtaggacctaatggagcgggaaaaacaacattacttaatattttaagtaatgaagatcaggactatgagggtgagcttaaaatcggtcagactgttaaggtagcttattttaagcaaacagaaaagacacttgaccgtgatattagagtgattgactacctaagagaagaaagtgaaatggctaaagaaaaagatggtacctcaatttcagttacacaattgttagaaagatttttatttccgagcgctacacacggtaaaaaagtttataaactctcaggtggagaacaaaaacgtctgtatttattgcgtttacttgttcataaacctaatgtactccttttagatgaaccgactaatgatttagatactgaaacacttacgattttagaagattacattgatgatttcggtggttctgtcattacggtcagtcatgatcgttatttcttaaataaagtggtacaagaatattggtttattcatgatggtaaaatcgaaaaaattattggatcatttgaagattatgaatcttttaaaaaggaacatgaacgccaagccatgctatctaaacaaactgaacaacaaaataaacataagcatcaaccaaaaaagaaaacaggactatcttataaagagaagttagaatacgaaacaattatgacgcgtatagaaatgactgaaacgcgtttagaagaccttgaacaagaaatgattaatgcaagtgataattatgcaagaatcaaagaacttaatgaggataaagagcaacttgaagcaacctatgaagcagacatcacgagatggagtgagcttgaggaaattaaagaacaataa

SEQ ID NO: 2622 - DNA, 513 bp, Staphylococcus epidermidis
gaggacattgccatgcaacatcttataaaaaaacatgtattgaatggcgagtttgaactagttagacagttaatgtccgaaacagattttatggaatttgaagaagcatacatctctagtgctcatgaagtagagagtatgatgttttatacatgtattctagatatgattaaggtagaagaatcatcagaattacatgatttagcattccttttacttgtttatcctttaagtgaatatgagggcgcactagattcagcttattatcatgcagattcttccataaaacttactgacggaaatgaagtgaagagtttattacaaatgttattgcttcatgctattcctgagccagttatttcggataaaaaagcgtttgatgtcgctaaacgaattctaaaactcgatccaagtaataatgttgcacgaaatgtacttaaagatacagcaaaacgtatggataatgtagttgtagacattaatgaattgaacaatcaaagagatgcacgctaa

SEQ ID NO: 2623 - DNA, 2136 bp, Staphylococcus epidermidis
aaatatgctgctaaagtcattttagaagctgcaacaaaagcaggtgctcctaaagattgtattcaatggatagaagtgccatcaattgaggcaactaaacaattaatgaatcataaagatattgctttagttctagcgactggaggctctggaatggtaaagtccgcatattcgacaggtaaacctgcattaggagtcggtccaggtaatgttcctacttatattgaaaaaactgctcatatcaaacgtgctgttaatgatatcattggttctaaaacttttgataatggtatgatttgtgcttctgaacaagtcatggttgttgataaagaagtatacactgacgtcgttaaagaattcaaattacaccaaacatattttgttaataaaaatgaactacaacaattagaagatgccatcatgaatgaagataaaactgcagttaaacctgatatagttggtaaatctgctgtagatatagcgaaattgtcaggaattagtgttccagaaaaaacaaaattattagtcgcagaaattgatggaattggaaaagattatcctttatcacgtgaaaaattatcacctgtactcgcaatggtaactgcaaaatcaacaggacatgcactacaaatttgtgaagacatattaaaatttggtggtttaggtcacactgctgtaattcacaccgaggatagtcaattacaacaaaaattcggtctaaaaatgaaagcttgccgtgtattggtaaatacaccttctgctgtcggaggaattggaaatatgtataatgaactcattccttcactcacgttaggttgtggttcatatggtagaaattctatttctcataatgtaagcgcagtagacttattaaatattaaaacaatagcaaaacgtcgtaataatatgcaatggtttaaactcccacctaaagtttattttgaagaaaattcagttatgtatttgacagagatggataatgttgaacgtgtaatgatagtttgtgatccaggaatggttaatattggttatactgatatagttgaacaagtgctgagacgccgagaaaaccaaccacaaatcaaagtgtttaacgaagttgaacctaatccatcaactcatacagtctataaggggttagaaatgtttataaatttccaacctaatactattattgcactcggtggcggttcggcaatggatgcagccaaagcaatatggatgttctttgagcatccagaaacttcattttttggggcaaaacaaaagttcttagatattcgtaaacgtacttataaaattaccaaacctaaaaacgcaaaatttatatgtataccaacgacatcaggaactggttctgaagtgacaccttttgcagtaattactgatagcgagacacacgttaagtatccactagcagattatgcgttaactcccgatattgctatcgtcgatccacaattcgtattaagtgtacctaaagatgttgccgcagatacaggaatggatgttttgacacatgccattgaatcttacgtctctgtcatggcttcagattatacaagaggcttaagcttacaagcaataaagttaacttttgattatctaaaatcatcagttcaagaaaatgacaaacactcacgagaaaaaatgcataatgcttcaacaatggccggtatggcatttgccaatgcttttttaggaatttctcattctatcgcacataaaattggtggtgaatatggtattccccacggcagaacaaatgctattttattaccacatgtcattcgctataatgccaaagatccacaaaaacatgcactgtttcctaaatatgatttctttagagcagatactgactatgctgacattgcaaaatttttaggactcaaaggtaatacaactgaagaattagtggatgctctagctaatgcggtgtatgatttaggatgttcagttggtattgatatgaatttaaaatcacaaggcgtaactgaagagcttcttcactctactatagacagaatggctgaattagcatttgaagatcaatgtacaactgctaatccaaaagaaccgctaattagtgaacttaaaggcattatcgaaacagcatatgattatgaaagataa

SEQ ID NO: 2624 - DNA, 1077 bp, Staphylococcus epidermidis
agtaattatttgaaagggttagccatgatgaaagaaaagctaaaatggatatggataacaacactaatcatacttgttgtctcacttatattggcttttaatttgaagagtcattataaccatgttcatgataaacagaagagcaagacaaatgttcaaattaataacaaaaatgtaaaattatatagagatatctcatatggtaaaggtatacccaacagcaaattagacattattaccccagctgatatgagcaatgatacgaaattaccggtaattttttggatgcatggtggaggatttatcgctggagacaaacaatataaaaatcaattattgtcaaaagttgcagaacaaggatacatcattgtcaatgtaaattatgcgttagctccgcaatataaatatccaacgccgctagtacaactcaatcaagctgtaaagtttataaaagagaataagcatgagttacctattgattttgatcaagttgttattgggggagactctgctggcgctcagttaactagtcaatatgtagctatgcaaaccaatgaagacttgagagatgaaatgcattttgaacagcagttcaagccttcacaaataaaggctgctgtattttttggtggtttttataatatgaaaaccgttaaagcaactgagtttccgagaatacaattatttatgaaaagttatactggaacaagtcattgggaaacagattttaaaaacttatctcaaatgtcaacgctcaatcaagtgactcacgaatacccaccgacatttctttcggttggtgacgctgatcctttttatagtcaaaataaagaatttgcgcaaggtttgaaaacagaaaatattccagtagatacattattctatgatggttcgcatcacttacatcatcaatatcaatttcatctagataaaccggaatcaaaagagaatatcaaaaaagtactgctatttttaagtcgaaacacatcatcttctggagtggagagtaacgagtcatcacaaaatcagccaactcaaaatactaatgaagtatccttatacccttttgattcttaa

SEQ ID NO: 2625 - DNA, 471 bp, Staphylococcus epidermidis
cagttttatgctataatgacatttattattgtaagggttaaggtgagtagtaaattgaataaaaatattaacattcaaacccgtcaagttttgaaacagaatggtgaaaagcagagatttgagtttactacaaaaggttcttggcaacaaaaatttgcagattttatacgttacgaagaacaaattgaagatgctaaagttaatgttacgattaaaattgaagatagcggtgtaaagttaattcgtaaaggcgacattaatatgaacttacatttcgtcgaaggacatgagacgacaacactctatgatgtacctaccggaaaaatacctttaactgttaaaacactaagccttatgcatttcgttactcataatggcggtaaacttaaaatacattatgagttatatcaagatgaacaaaagatgggttcttatcaatatgaaataaattataaggagataagcgaatga

SEQ ID NO: 2626 - DNA, 213 bp, Staphylococcus epidermidis
ataagtaaagcaattgaaatcattgtattaacaatcatagttgtaatggataggattttcgaaatacgatttttatttttagtgaagactaaaattaaagcacatacaaaaggcaacaacataggcaatattattaaattactcatcatcttcatcacctttcaatgcacttatttcatcctctttagttactctgtaagttctatatattaa

SEQ ID NO: 2627 - DNA, 378 bp, Staphylococcus epidermidis
acgttgaaagcaaaaatgactttctattgttttattcccacatcaaagtatttaaaaacttatttatcattaatagcttttataccaggtaattctttaccttctaagtattctaatgatgctcctccaccagtagagatgtgtgtaaagtcatcttcgaaacctaatgaaattgctgctgcggcagagtcaccaccaccaataatagtagtagcgtcttccaatttagcaatagactcacatacaccgattgtacctttagcaaaattactaaattcgaatacacccataggtccattccatactacagtatgtgcaccttgtaattctttattaaataattctactgttttaggtccaatatccattgcttcttga

SEQ ID NO: 2628 - DNA, 2001 bp, Staphylococcus epidermidis
gaggcgtattttggaatggtagaacatgttccatttaagttaaagtctgaatttgagccacaaggtgatcagccacaagcgatacaaaaaattgtggatggcgtaaatgaagggaaacgtcatcaaaccttattaggtgcaactgggacaggtaaaacttttactatgagtaacgtaattaaagaggttggtaaacctacacttattattgcacataacaagacattagcaggtcaactatatagtgaatttaaagaatttttcccagaaaatagagttgaatatttcgttagttattacgactactatcaacctgaagcatacgtgccttcaacagatacctttattgaaaaagacgcctccattaacgatgaaattgaccaactacgacattctgctacaagttctttatttgaacgtgatgatgtcattattatcgcaagtgttagttgtatctatggtttaggtaatccggaagaatataaaaatttggttgttagtgtacgtgttggtatggagatggaacgaagcgaattgttgagaaagttagttgatgtacaatactcacgtaatgacatagattttcaacgtggtacatttagagtgcgtggagatgttgttgaaatattcccagcttctagagaagaaatgtgtattcgcgtagaattttttggagatgaaattgatcgtatcagagaggttaactatttaactggtgaagtaattcgagaacgtgaacattttacaattttcccagcttcgcacttcgttactcgtgaagagaaaatgaaagtagctattgaacgtatagaaaaagaattagaagagagactaaaagaattacgtgatgagaataaattattagaagctcaaaggttagaacaacgtactaactatgatttagaaatgatgagagaaatgggcttttgttcaggtattgaaaattattctgttcacttaactttaagaccattaggttcaacaccatatacattgcttgattattttggagatgattggcttgtcatgattgatgagtctcacgttacgttacctcaaattcgtggtatgtacaatggggatagagctcgtaaacaagtattaatagaccatggatttcgtttgccaagtgcgttggataaccgaccattaaaatttgaagaatttgaagaaaaaacaaaacaacttgtttatgtttcagctacaccaggcccatatgagttagaacatacagatgaaatggttgaacaaattatacgacctactggtttacttgatcctaaaattgatgtgcgtccaactgagaatcaaatcgatgatcttttaagtgaaatccaagatcgcgttgacaaagatgaacgtgtacttgtgacaacacttactaaaaaaatgagtgaagatttaactacatatatgaaagaagcggggattaaagttaattatttacactcagaaattaaaacattagaacgaatagaaattattcgagacttacgtatgggtacttacgacgcaatagttgggatcaatctgctgagagagggtatagatatacctgaagtatctttagttgtaattttagatgcagataaggaaggcttcttacgttctgatagatctcttattcaaactattgggcgagcagcacgtaatgacaaaggagaagtcattatgtatgcggataaaattacagattctatgcaatatgcaatagatgaaacacaaagacgtagagaaatacaaattgctcataacaaagaacatggcatcacgccgaaaacaattaacaaaaagattcacgacgtcattagtgctactgtggagagcgatgagacaaatcaacaacaacaaactgaattacctaagaaaatgacaaagaaagaacgtcaaaaaacaatagaaaatatagaaaaagaaatgaaaaaagcagccaaagatttagatttcgaaaaagcaacagagttaagagatatgttatttgaattaaaagcagaagggtga

SEQ ID NO: 2629 - DNA, 1380 bp, Staphylococcus epidermidis
aatctaatggctataggtgtcatattaaatagagtttttaggctaaataataatccattatttgattatatatatagtaataaagaatctataaatcattgttattttattattccaactgaagagtttgaagaagaagcaaaaaagaaagcacaatactattatgggtccatacagaagtttatgtatgaactacaacgatatgatatagaaccctttttgatgtcttatgataaattaatagacttttgtaaaaaacaagctatagacaaagttgttgttgcaggtgatattatgagttatcatcacgaagaatatgacattttacatcaaaggaaacgatttaaacaagctaatattcaagtaatatcattaagagcaaatcattattttaacccccgcaaaacacataataaacaaggggaaccatataaagtatttaccagtttttatagaaaatggcgtccttacttaatgattagagatgaatatgactatcatttagaagatatttcaaaggttgtagtgaaatctcaacataaaattaaagaagattatcattcatatggtataagtgaacgtgatgttcaaaatcgttggtctgaatttttatctcaagatatcgaaaattataaagaaaacagggaatacttgcctgaagtattaacaagccaactaagtatttacttagcttatggaatgatagatattatacaagttttcaacgatttacttcaaaattatgataaaaatgaacaaaattacgaaacttttatacgtgaattgatttttagagagttttattatgtattaatgaccaattatcccgaaacagctcatgttgcttttaaagaaaaataccaacaattgaaatggtcttataatgaagagaattttaaactgtggaaagatgggaatactggttttccaattattgatgcagcaatggaggaacttaaaacaactggatttatgcataatcgcatgagaatggtagtttctcaatttttaactaaagatttgtttattgactggatttggggtgagtcatttttcaaacaaaaattaatagattatgatgcagcttcaaatgttcacggatggcagtggtcagcttctactggaacagatgctgtaccatactttagaatgtttaatcctataagacaaagcgagcgttttgataataatgcacgatatataaaaacttacattccaagattaaatcaggtagatgctaagtatttacacgatactcataaattcgagcaacaaataaaggggcaaggtgttgaaataggtaaagactatcctaaacaaatgattgatcacaaagaaagtagacaacgtgtaatgtcagaattcaaagcattagattaa

SEQ ID NO: 2630 - DNA, 477 bp, Staphylococcus epidermidis
gtaatagtggctaagaaaaaatcaaaatcaccaggtacgttagctgaaaatcgtaaagcaagacatgactacaatattgaagatacaattgaagcgggtattgctttaagaggtactgaaattaaatctatacgtcgtggtagtgccaatttaaaagatagctttgcgcaagtgagacgaggcgaaatgtacctgaataatatgcatattgcaccatatgaagaagggaaccgttttaatcatgaccctttacgtacacgtaaattactcttgcacaaaaaagaaattcaaaaattaggtgagcgtacacgagaaataggttattctattattccgttgaagttatatttaaaacatggtcaatgtaaagttttattaggcgttgctagaggtaaaaagaaatacgacaaacgtcaagcacttaaagaaaaagcggtaaaacgagatattgatcgtgcagttaaagcccgttattaa

SEQ ID NO: 2631 - DNA, 798 bp, Staphylococcus epidermidis
tttatgcattttaaacgtgttgtaaagtggggattgaatatgtatcaaaaccaaagaataaaagataaaattaacatattaggtgtaagttttgataatactacaatgctggaaatggtagaaaatattaaacaattcatatctagcaatacagatgataatttatttatagtgactgctaatcctgaaatcgtggattatgcaactgaacatgagctatatagaaatttaattaatcaagctgattatgtagttccagatggtacaggaatagtaaaagcttcaaagcgattaaaacagcccttaaaacggcgtgtgccaggaatagaacttcttgaagaatgtctgaaaatagcacatgtcagccatcagcgcgtatatctgcttggatctaaaaatgaaattgttgagtcagcagagaaaaaacttcaatctcaataccctaatatccactttgcacatcatcatggctatattcatctagaagatgaaacagtcataaaacgtataacaagttttaatcccgattacatttttgtaggaatgggatttccaaagcaagaacaatggattcaaaagcataaggacaagtttaagcacactgtgatgatgggcgtaggtgggtcgtttgaagtattcagtggctcaaagaaaagagcacctcaaatatttagaaagttaaatattgagtgggtatatcgtgtgcttattgattggaaacgcattgggagaatgataagtattcctaaatttatgttaaaggtagcaatacaaaaatataaaatgaaatcaaaataa

SEQ ID NO: 2632 - DNA, 327 bp, Staphylococcus epidermidis
ggatttaattttggaggtgacacgatgattgaaatgttcactcaaatatttattataagtgcattagtgatttttggtatggcactacttgtttgtctagtcagattaattaaaggtcccactactgctgatagagttgtatcatttgatgcctcgagtgctgttgttatgtctattgttggtgtgatgagcgttatttttaactcagtgtcttatttagattcaatcatgttaattgcaattatttcgtttgtcagttcggtctcaatttcaagattcatcggggaaggacgtgtcttcaatggaaatcataaaagacatcgttag

SEQ ID NO: 2633 - DNA, 612 bp, Staphylococcus epidermidis
cgcgttaattttatattaaaatataggcaaaataagcattttcgattaaatggagtgtttaagatggttatttatattgaaactgaacgtttaaacttaagagattgggaaaccaaagatttattaccttttcaaaaaatgaatgctaatgcgcaagtacgtagatacttccctagtttacttagttatcgtcgttctgagatagacatggaaaatatggatagcataatacaagagagtggcctaggtttatttgctgtagagttgaaagagacgggagaatggttagggtttataggtgtgaattacgtttcaaaagatagccattacccttttaaagagttaccgttttatgaaataggttggaggctaattccagaagtatggggaaatggtctagctacagaaggggcagaagccgtaatgaaatatgctagagataaaggaattaaagaattatatagttttacttctgaaaataatttgccttctagaaaagtcatggaaaaattaggaatgacttttttagacaattttgaatatccgaatcttagtaaataccatccccttaaacgtcatgtaagatattataaagagctacttccttcttga

SEQ ID NO: 2634 - DNA, 771 bp, Staphylococcus epidermidis
gccactctttattggctaaggtatcacttaaagaaatcatcgcttattttagagaccgtaataaccgaggtgaagataagcatgacccacttactaatcgtggatgatgaaaaagatattgtagacatttgtcaaacgtatttcgaatatgaaggatatcaggttacgacaacaacatgtggtaaagaagcactaaaattattatcttcagatatagatattatgattttagacattatgatgccggaagttagcggatacgatattgtcaaaaaaatgaaagatatgcaacttgatatacctttcatatatctaacagcaaaaactcaagaacatgacacgatatacgcactgacgttaggtgctgatgactatattaaaaaaccctttagcccaagagaactagtattacgtactaataaccttctcgctagaatgagtaaatcaaatcattctaataaaattgagcaattagaatttgatggtttagttttaaaaaatttaagcaagacacttaccattaacaatatagagatacctatgcgcattaaagaatttgaattgctatggtatcttgcttctagagaaggtgaagttatttctaaatccgaacttctagaaaaagtatggggatatgactattacgaagatgctaacactgtcaatgtccacatacatagaattcgcgagaaattagaaaaacatgattttttaccctacactattacaactgtgtggggccttggttataagtttgaaaggagccgataa

SEQ ID NO: 2635 - DNA, 207 bp, Staphylococcus epidermidis
aaagaggtttatatgttatacgtaattataggcttttttataataggaatcggactatatatttttagtttctttttagcacaaaatcaaggattatcttataaaagtcattgcagaaatttttctgcagtttttatatcactcggtgtattatgcttaatgggatatctcgttcattatgtatctaaacactatttaggcatatag

SEQ ID NO: 2636 - DNA, 183 bp, Staphylococcus epidermidis
ctgttgtattactccaagaaggttaaaagtaatggactttcaggtgctattagtggtggcgctgaacaattgtttggtaaacaaaaacaacgtggcgtcgatttattcttgcatagattaacaataattttagctattttattctttgtacttatgttttgtattagttacttaggtatgtag

SEQ ID NO: 2637 - DNA, 183 bp, Staphylococcus epidermidis
aaaactcattacattgaactttactttattacaatttatctaataaatattaagaaaagtaacgaaatatgtcttataaatagcgatatatcaactttctttaataaatgttcagaacaatacattattttaacaatgttacaagataataacaaagcccacaaagtcaaatatttttgttag

SEQ ID NO: 2638 - DNA, 348 bp, Staphylococcus epidermidis
atcatgaatttaatattactccttgtgataggatttttagtgtttattggaacttatatgattttatctattaatttaattcgtattgttattggtatttctatttatacacacgccggtaatttaattattatgagtatggggaaatatggacctcatatgtctgaaccgctaattcaaggtcatgctcaaaactttgttgatcctttattacaagctatcgttttaacagctattgtgattggatttggtatgactgcgtttttattggtgttaatatatagaacttacagagtaactaaagaggatgaaataagtgcattgaaaggtgatgaagatgatgagtaa

SEQ ID NO: 2639 - DNA, 249 bp, Staphylococcus epidermidis
tggatttgttacaaatatttagtgcaaaagcacgtggaggtattctatatgaataacggtacagttaaatggtttaatgcagaaaaaggatttggtttcatcgaaagagaaaatggcggagatgtattcgtgcatttctcagcaatcgttgaagatggatataaatctttagaagaaggccaaagcgttgaattcgatatcgtcgaaggtgaacgtggtgagcaagctgcaaacgttgttaagatgtaa

SEQ ID NO: 2640 - DNA, 435 bp, Staphylococcus epidermidis
cattattgttacaaaaggtcctgttttaaatggttttttggtcactgtagtttggcaattgatcatgacactgtacttcaaattgaaggtccaggggataaaccaatgacggaagattttgaatcttatcgtgacagatatggaaaaggtaaaaatgaatggataaaagtctatcgatgttcacaccctaacgctggaacaaaagcagctcaatgggcaaagaaacattatgagaatagcgatagcgaatatcttgttacattcaacttaaaaagtgaaacatttacatattgcactaaaattatatatcaagcatataaatacggcgtagataaaaattccgtaagtgatcacggtttatatattatttcaccctatgcgctaacagataattttacagatgaatataaattaaaattagtaaaaacatattaa

SEQ ID NO: 2641 - DNA, 219 bp, Staphylococcus epidermidis
gtcatgttatattctttacacataaagcacctcgttaaattagtttattggtatttattaaattatacgaaagggccatattttttaaagtattttaatataaaattacatataagcacaaagtattttggcgagactcttgagagaacaggacaagctgaagactacaggctgaagctgtccgataagaaagcgagccaacaatacgaagtattgtaa

SEQ ID NO: 2642 - DNA, 210 bp, Staphylococcus epidermidis
gactatcaatatgtcattctatgtattttgttaatgatgaacaatgatgaacaacaaaaaaatgaaagcgtttgttttacgtactatatttctgtgcaaaccccaaaagttcttttaatcttacaaaagttattataccacgtgaaaaatagggttaaaatgacatttttacaaaacttatataaaaaaccacgcccttccactcattaa

SEQ ID NO: 2643 - DNA, 558 bp, Staphylococcus epidermidis
acggagggatataaaatgaaattgaaactattaggaacattagcactctcgtcaataatattaacagcatgtggacaagaaaatgtaaaaaaaacagaaagcaatccaaaagaagaacaaaataaaacggataatatgcaaactaatgggagcgtaacaaattctaatagtaatcaaaaacaaaaaacagctcaaaaacaaatttccgctcaagaagcagaacaaattgtctcgaactattacattaataaagggattaataagcaacaagttcttgaatttaaaacaaatatagatagaagcaatgctaatgaatattatgttgaacaccttgtaagagatgcagccggaactcctataaaattttgtgctgtagtaaacaaaagtacaggtgaagtgatcaatcgatttaatgacatgaatgaggaagaaatgaaggaatttgaggaatttaaaaaaagaagtcctaagtaccataattctggtgaagaaaaaaataaaatgcaagaaaattcttcatcttccgaacaacaagaagtccacaattctgttatataa

SEQ ID NO: 2644 - DNA, 219 bp, Staphylococcus epidermidis
gtgttcaagtatagttttaaagaaggtaatataatgaaaatgaatccaagatatgttaaagtgttttttctatatttagtaagcacatttatttctaatcgcttaacaacgaataaatctttatgcaaaacattaatgcaaggcattttaggttatggtttatttgcattaggattaaagtatttaactattaagaaaaaacaacatcaagcgcaatag

SEQ ID NO: 2645 - DNA, 2169 bp, Staphylococcus epidermidis
agtttgaagtacaagggacaaataaagacattattgaatttaaggataaggtgggcaatttcaatgaaaaccatggaagaaaagaaatacaatcatattgaattaaataatgaagtgaccaagagaaaagacaatggtttctttgatttagagaaagatcaagaagcattgaaagtgtatcttgaagaaatccatgataaaatgatttcttttgatgatgaaatcgaaagacttcattatcttgttgataataatttttattttaatgttttcgaaaaatatagcgaagcagaattaattgaaattactgaatacgcaaaatcaattcacttccaatttgctagttatatgtcggcaagtaagttttataaggattacgctttaaaaacgaatgataaaactaagtttcttgaggattataatcagcacgtcgcaatcgttgcactttatttagcgaatggtaatgttaaacaagcaaaacaatttatttctgcaatggtggaacaacgttatcaaccggcgacaccaacattcttgaatgcaggtagagcaagacgtggagaacttgtttcatgtttcttattagaagtagacgatagcttaaattctatcaatttcattgattcaactgcaaaacaacttagtaaaattggtggtggtgtggccattaatttatcgaaacttcgtgcacgtggagaagcaattaaaggaattaaaggtgtagctaaaggtgttttacctgttgctaaggcacttgaaggtggatttagttatgcagatcaattaggacaacgtcctggcgctggggcagtgtacttaaatattttccattacgatgttgaagagtttttagatactaagaaagtgaatgcagatgaagatttacgtttatctactatttcgactggtcttattgtaccttctaaattctttgatttggctaaagagggtaaagatttctatatgtttgcacctcatacagttaaacaagaatacggtgtgactttagatgatattgatttagaaaagtattacgacgatatggttgcaaaccctaatatcgataaaaagaaaaaagacgcacgtgaaatgttaaatatgattgcacaaacacaattacagtctggttatccatatcttatgtttaaagataatgcaaacaaagtacatgcgaattcaaatattgggcaaattaaagtgagtaatttatgtactgaaattttccaattacaagagacatcagtaattaacgactatggaattgaagatgaaattaaaagagatatttcatgtaacttaggctcattgaatatagtgaatgttatggaatcaggtaaattcagagattctgtgttcacaggtatggatgctcttacagttgtaagtgatgaagcaaatattcaaaatgcaccaggtgtaaaaaaagcgaatagtgaactacattctgttggactaggagtaatgaacttacatggttatctagctaaaaataaaattggctatgaatctgaagaagcaaaagactttgctaatatattctttatgattatgaactattattccatcgaacgttcaatggaaattgcaaaagagcgtggagaaaagtatcaagactttgagcaatcagactatgcaaatggtaaatattttgaattctatacatctcaagaatttgaaccaaaatttgaaaaggttcgccaactttttgatggtatcgatatacctacttcaaatgattggaaagaattgcaaaataaagtagaacaatatggactttatcacgcttatagattagctattgctccgactcaaagtatttcttatgttcaaaatgcgacaagttctgttatgcctattgttgaccaaattgaacgtcgtacgtatggaaatgcggaaacattttatccaatgccatttttatcaccagaaacaatgtggtactacaaatcagcatttaatactgaccaaatgaaacttattgacttagtagctacaattcaaactcacgtagaccaaggtatttcaacgatactttatgttaattcagaaatttcaacacgtgaactttcaagattatatgtatatgcacaccataaaggccttaaatctttatactatacacgtaataaattattaagtgtggaagaatgtacaagttgtgcgatttaa

SEQ ID NO: 2646 - DNA, 648 bp, Staphylococcus epidermidis
atgttagatttcattaaccatttgcttagttatcaatttttaaatcgtgcattaatcacatctattttagttgggattgtatgtggaacgatgggtagcattattgttttacgtggtctttctttaatgggtgatgccatgagtcatgctgttttaccaggtgttgctttatctttcttatttaatattccaatgtttatcggggcacttgtaacgggaatgcttgcaagtttgtttattggttttattacttcaaacagtaaaacaaaaccagatgctgcaataggaataagtttcactgcattcctagcatctggcgtcataattattagtttaatcaatagtacaacagatttatatcacattttatttggcaatttattagcaattacacatcaatcattttggacaacaattgtcattactgtactggttattttacttattattatcttttatagacctttaatgatttcaacatttgatgcaacttttagtcgtatgagcgggctgaacacaacattaattcactactttgtcatgttattactccgcacttgtaactgttgcgagcatacaaacagttggaattatccttgtagttgctttactaatcactccagcttctacagcttttttaatcagtaa

SEQ ID NO: 2647 - DNA, 1032 bp, Staphylococcus epidermidis
attatagatttacattggttcaaaactctttattttatacataaatatgacaggaggattttaatgaaggcggtaaattggaacacccaagaagatatgactaatatgttctggcgtcaaaatatctcacaaatgtgggtggaaacagaatttaaagtatcaaaagatatagcaagttggaaaacattaacagattctgagaaaaatacttttaaaaaagcgcttgcaggtttaacaggtttagatacacatcaagctgatgatggtatgccattaatcatgcttcatactactgatttaagaaagaaagctgtttattcatttatggctatgatggaacaaatccatgcgaaaagttattctcatatcttcactacattattaccatctagtgaaaccaactatttattggatacttgggttattgaagagccacatttaaaatataaatcagataaaattgtagaaaattaccacaaactttggggtaaagaagcatcgatttacgatcaatatattgctcgtgtttctagtgtattcttagaaacatttctattctattctggcttctattatccattatatctcgcaggacaaggaaaaatgactacgtcaggtgaaattatacgtaagatacttttagatgaatctatacatggagtgttcacaggtttagatgcacaaagtctacgtaatgagttatctgaaagtgagaaacaaaaagctgatcaagaaatgtacaaattattaaatgaactttatgataatgaagtttcatatacacatttattatatgatgatattggtcttgctgaagatgtattaaattatgttcgatataatggaaataaagcattatcgaatttaggttttgaaccatatttcgaagagagagagtttaaccctattattgaaaatgcactagatacatctacaaagaaccacgatttcttctctgttaaaggtgatggctatacattggctttaaatgttgagcctctacgtgatgaagactttgtttttgataattaa

SEQ ID NO: 2648 - DNA, 186 bp, Staphylococcus epidermidis
  unsure (22): Identity of nucleotide at the above locations are unknown.
aaatggaatctttttgggaatngggaaaatttcaaaggaactgatatagataaatttttagaaattaatggagctgctattttgtattcatacagccgtgcacatataagtcatattactaatacaagcaaatacccttcatttgatttacctttttataatttcacagacaatgattatcaatag

SEQ ID NO: 2649 - DNA, 681 bp, Staphylococcus epidermidis
caattgattcagtacccgaaaatgaagttcaggaatttcacgataaaactaaaattttggagcggttataatatgcatttatttgaaacaatgaaattggataagggattcattcctcgtcttgactaccattatcaacgtatttcaacttctagtgagcatctaggatttcaatttgatcatctattttggaagcagtttattcataatataaaaaccttgcattcaaaaggcgtatttcgtttgaaggtgacgttaaacaaagaaggtgaattaaactatgagttatttccgatacccgataaacctttttttaccgctcgactagttcaacaaaaaaagaatattgataaagtaatcataactaataaaacaacagaacgtgattatttaacacataatcatttcacagacttaatactgatctatgatgaagatggtaaaattttagagtttgacattggcaacgtgatgatacaagaaagagataaattgtatacaccaacatataaaggagacatgctccccggctgtatgagacaatctcttatagatcaaggcaaagttatagaaaaagatttttatatcgaagaatttaaagaaaaaatcaaatcgagtcaaatcaacgtctatttaatcaatagcttaagagaggttgtcggtgttaaagtatatgtataa

SEQ ID NO: 2650 - DNA, 1137 bp, Staphylococcus epidermidis
caaatagttcagagaaaaggatgtcatttaatgaaaatcagagtcatcgtcccttgctataatgaaggcgaagtcgttttgaaaacttatgacaaattaactgaaataatgaagaaagatagtttaatcaaaaattatgaatacgatttactctttattaacgatggtagtacagatacgacaatacatcatatcaagaatattgttgcgtatgataaccatgttaaatatctttcattcagtcgaaactttggcaaagaagctgcaatgattgctggctatcagcatagcacaatgcacgacgcggtgattatgattgatggagatttacaacatccgcctgaatatattccacaaatgatagagggttacattgaaggttatgatcaagtggttgctaagagaaatcgtcagggagagaattttgtacgtaaaactttgtctcgttgttattataaattaattaatgcatttgtagaggatatccaatttgaagacggcgttggtgattttagattactcagtcgacgtgcagttcaagctttaacaacacttgatgaatataatcgtttctctaagggtctatttgaatggataggttatgaaacaaaagtatttaaatatgaaaatgtgacgcgtgaagatggagaatctaagtggacttttagaaagttactcaactatggtattgatggactcatctcttttaacaataagcctttacgcatgatgatatacttaggtatgttcacgttttctatcagtattttatatataatttatttattaataaatattttgattaatggtataaatatacctggttattttactacgattgctgctatattattgttgggtggtattcaattaatgtctattggcgtagtaggagaatatattggtcgtatttattatgaagttaaacatagaccgaagtatattgttgaaaactctaatattcagactgagaatctcgacatgagatataatgctttaaacctgaataaaaatagaaacaacaagcgtagtaatgatttatataaattaagttctttttataaagttaaaacatatagtgatacgtatgcatcaaattattctcaagatgaaggttttaaagagcgtgtacattaa

SEQ ID NO: 2651 - DNA, 261 bp, Staphylococcus epidermidis
gcagtactccatttaacacctttcgcacgatttgaagcacctacacctagaatagatgaagacacaacgtgtgtagtagataatgggaaatgtaatgatgacgctacgaaaatcgttaatgctgaagaaatatcagcggctgcaccgttagcaggtctaattttcataatatttccgccaacagttttgatgattttccaaccacctactgctgtacctaatcccatagctgttgcacacgcaactttaacccatacttga

SEQ ID NO: 2652 - DNA, 1128 bp, Staphylococcus epidermidis
caaattttacatagcgtgaggtacaacttattcaatgaaggtgaactgatgtatacactattacttatagcttttactatgatagtcagtttaataattacacccattattattgtaatatcaaaaaaattagatttagtagatcgtcctaatttcagaaaagtacatacgaaacctatctcagtgatgggaggaacggtcattttattttctttcttaatagggatttggctcggacaccctattgaacgtgaggttaaaccgcttatattaggtgcaattacaatgtatatggttggattgattgatgatatttacgatctaagaccttatttaaagttagcaggtcaaattgttgcagctttaattgttacgttttatggaattacaatagactttatttcattgccaattggtccaacgattcattttggcatattcagcattcctattacagtaatatggattgtagcaattaccaatgctattaatcttatcgacggacttgatggacttgcctcaggcgtctcagcattggcattaatgactattggattcatcgctattttacaagcgaacatatttattatcatgatttgctgtgtacttttagggtctttacttggtttcttattctataactttcacccagcgaaaattttcctaggtgatagtggtgcattaatgataggatttattatcggtttcttatccttactcggctttaagaatatcacatttattgcattattctttcctatagttatattagcggtgccatttattgatacattatttgcaatgattcgtcgaatgaaaaaagggcaacatataatgcaagcggacaagtcacatttacatcataaattacttgctttaggatatacgcatagacaaaccgttttacttatttattcaatagcgattatgtttagtttatctagtgttatcctctatttatcccaaccgttgggtgcacttatgatgttcattctcattgtctttacgattgagttgatcgttgaatttactggattaatagatgataattatcgaccaatattaaatttaattacaaaaaaaggaaatggtaagcaacatcattatgatgagcatcaccgttcataa

SEQ ID NO: 2653 - DNA, 207 bp, Staphylococcus epidermidis
tggataacacataagattccggttcttaaaatagaggttcgattcctctcgagggggttgctgaatgatgaggagattttaatgtctgagcttatttgtaatctcagtcttaaaatctcattttttataattcaatttgttcaccatttcttattttatccgctaattcattcaactttcttaaacggtgattcatacctgatttag

SEQ ID NO: 2654 - DNA, 852 bp, Staphylococcus epidermidis
ggagtaacacacatgaatataacattaggatatatcgatcctgttgcctttagcttgggaccaatccaagttcgatggtatggaattattattgcttgtggtatcttacttggatacttcattgcacaagcagcattgaaacaggttggattacataaagacaccttaatcgatattatattttatagcgcgattgttggattcatagttgcgagaatatactttgttacatttcaatggccatattacatgaatcacttgagtgagataccaaaaatttggcatggtggtattgccatacatggtggcttaattggtggacttatctctgggattattgtttgtaaaatcaaaaatctacatccgtttcaaataggagatattgtggcaccaagtattattttagctcaagggataggacgctggggaaactttatgaatcatgaagcgcatggaggtccagtatctagagcttttctagaacatttacatttgccagactttattattagaaatatgtatattgaaggccaatattaccacccgacgtttctatatgagtctatttgggatgtaataggttttgtcattttaattactttaaggaaacgtctaaaacttggagagacattctttggttatcttatttggtattctgtagggcgctttttcgttgaggcgatgagaaccgatagtttgatgcttacgagtcatatacgtgtcgcgcaacttgtttctgtcgtgcttattatgattagtgtgatattcgtaatttatagaagagttaaataccaaccaataaaatatgaaaattcaggaccattaacatggccgattaaaaaggctaagtga

SEQ ID NO: 2655 - DNA, 1056 bp, Staphylococcus epidermidis
ggagttgcacatatgaaaaaaacagtcttatttttattattgtctctagttttagttttaacggcttgtagtaatagttcgaataataattcaacttcgaaaaagaaaaatagtgattctaaagaaactgtaaccatcaaaaatagttttgaagcaagtggtaaagaaaataatggcagtgataagaaaaaaatctctaatactgtcgaagtaccaaagaatcctaaaaatgccgttgtattagattatggagcgcttgatgtgttgaaagaattaggtgtggctgataaagtaaaaggtttacctaaaggtgaaaataaccaatctttacctaaatttttagatgaatttaaagatgataagtatattaatactggaaatttaaaagaagtgaactttgataaagttgcatcagctaaaccagatgtgatttttatttcaggaagaacagctaatcagaaaaatttagatgaatttaaaaaagctgcaccaaaagctaaagttgtatatgtaggtacaagtgatgacaacttaattaaagatatgaaaaaaaatacagaaaatttagggaaaatctacgataaagaagataaagctaaaaaaattaataaagatttagatagaaaaatatctgatatgaaagataaaactaaagactttaataagaaagtaatgtatttattggttaacgaaggtgaactatcaacgtttggaccaggaggaagatttggtggtttagtgtttgatacattaggatttaaacctgcagacaaaaaggttagcaaaagcccgcatggtcaaaatataaataatgaatatattaacaagcagaatccagatgttattttagctatggatcgtggttcagttgtaggtggtaaagcaacaacaaatcaagttttaaaaaacaaagttataaaaaatgtaaaagcagtaaaaagtaatcatatttacgaattagatccaaaactatggtatttctcttcaggatcttcaacgacaactatcaaacaaattgatgaattaaatgaagtagtagagaaagttgaaaaataa

SEQ ID NO: 2656 - DNA, 726 bp, Staphylococcus epidermidis
gtaggacaacacctcagacttcttgggaaaattggacaatgtagcatgcgagatataacaatcatgcgaagatttgtagggggagaaatcatgttatcaatagaaaaattatatcaaattctatatcaaaatatgggccctcaatattggtggccagcagaaacgccaatagaaatgatgcttggggcaattctagtccaaaatactaattggaacaatgcagatatagcgttatcaagattaaaagaagaaacttcttttaatgcacagacgatattgaaaatgcctttagaatcgttgcagcaagtgatacgttcgagtggtttctataaaaataaagctaaggctatacaggcattgttactatggttaaatcaacatcattttgattatagtagtatagctaagttatacggtgatagcttaagaaaagaattactcaccatccgtggtataggtgaagagaccgccgatgtcttaatagtatatatttttaaaggtaaagaattcatacctgatagttatactagacgtatttttagaaaattgggatatcaacatacagaaagttatcataaattgaaacaggaattaacacttcctgaatcattttcaaatcaagatgcaaatgagtttcacgctttattagataattttgggaaaaattattttaatggtaaggggaaacaacgctatacctttttagatacctattttaaaaaataa

SEQ ID NO: 2657 - DNA, 681 bp, Staphylococcus epidermidis
ttcgttatgcaaatattattagtcgaagacgataatacgctttttcaagaattaaaaaaggaattagaacaatgggattttaatgtcgttggtgtcgaagattttagtcatgtgatggagacatttgaaacatttaatccagaaatagttattttggatgttcaattaccgaaatacgatgggttttattggtgtcgaaaaatgagacaacagtcgaacgttcctattttatttttatcatcaagagataatccaatggatcaagtgatgagtatggaacttggtgcagatgattatatgcaaaaaccattttatacaaacgtcttaattgctaagctacaagctatttatagacgcgtttatgaatttggagttgaagaaaagagaacgttaagttggcaagacgctactgtggatttatcaaaagatagtattcaaaaagatgataaaactatctttttgtctaaaacagagatgattattttagagatgttaatcaataaacgtaatcaaatcgtgacacgagacactctcattactgctttgtgggatgatgaagcttttgttagtgataatactttaacagttaatgttaatagattaagaaaaaaattatcagaaattgacatggatagtgcaattgaaaccaaagttggtaaaggatacttagctcatgaataa

SEQ ID NO: 2658 - DNA, 687 bp, Staphylococcus epidermidis; identical to SEQ ID NO: 1857

SEQ ID NO: 2659 - DNA, 531 bp, Staphylococcus epidermidis
caaaattttaaaatttatgttgaaaaaaattttaactcgggttactttctcagtggaggcgataatatgaaatataagattgaaaaattggatgacagtagcgtcgtttatatgagaatgataggtacttatcaaagtgataaaaactttgaaatgatgaagacttttaagcattggattcagactaatcattattggaaatatgttgagaaatacggtgtgttaggtatagcattagataatcctctccacgttcaaagtaatcaatgtagatatgacgttgttttgagaatagatgaaacagtaaatgatcagacaatatctaaaagagattttacaggtggcatatatgctgtgtttaaagttagtcatacaaaaataaatatagagaagttctttagcaatttagaaaatattttaaatgaaagtcatttgcgtatgagaaatgaaccaattatagagagatacattgaagaagagggaacagataaagtgtgtgaaatgttagtgcctatctatgaagtaaattaa

SEQ ID NO: 2660 - DNA, 264 bp, Staphylococcus epidermidis
gaggcatttaaaatgactgaagtagatgttgatgtagcaataatcggtgcaggtcctgccggtatgacagcagcagtatatgcatctcgtgccaatttaaaaactgtcatgattgaacgcggtatgccaggcggtcaaatggcaaacactgaagaagtagagaattttccaggatttgagatgatcacaggtcctgacttatctactaaaatgtttgaacatgctaaaaaatttggtggcggaataccaatatggcgatattaa

SEQ ID NO: 2661 - DNA, 492 bp, Staphylococcus epidermidis
tgtagatttaaaataatgatgactgctaatgattggatagaccggttggaattaatttcgcatcctgaaggcggatattttaaagaaacaatgagaggcgacggtaaaggaagagcgtcttttagcagtatttattttctattaacacagcgcgatatatcacattttcatagaatagatgcagatgaagtatggtattatcatgctggtcagacgttgaagattcatatgataacccctaaaggtgaatatcatactgttaaattaggtagagatatagattgtggtgagtgtttacaatattgtgtgccaaaagggacaatttttgcttctactttagatagtgcagagggatatagtctagttggatgtatgtgtcaacctggatttgaatacgagcattttgaacttttaacacaagaatatttgattcgtcaatatccacaatatgaaagcataataaaaagattagctatatctcaagaagattaa

SEQ ID NO: 2662 - DNA, 189 bp, Staphylococcus epidermidis
ttgaaacttttgtttgattcaatttcaaaattatcaattaatgagacagttggtgatggtgctgaaataaatgacgttgtaaataaacgtgatgaatataaagagagtatacggtattataataatcatttagttttagtgaagtataatgaaaaatctatatgtaagttaaaatatcttcgaaattag

SEQ ID NO: 2663 - DNA, 1296 bp, Staphylococcus epidermidis
agtaaaattaaatattacggtagactgatttctccaacgcatcaacttgaagatgaatcagtatctcaagtttcaaaaggtgttataaaagacagtgagcgttggtattgtattcaatgtggaaacacttccttgcaatattttgtgacttacaattcaacgatattggataaaacaatcacatactgtagacgatgcattcaattaggcagaatggatagtattacagatatatgtctcgtaaaaagttttcaaaaagcaacaaaagcgaattatcagttaccctttgaattatcaaagcaacagcaatacgcttcagaaactatcgttcaagctataaaaaataataatgacctcttgttatatgccgtcacaggagcagggaaaactgaaatgatgtttgagggaattaggatagctcgtcagatgggacataatattgctattgtatcacctcgtgtagacgttattattgagataagtcatcgaattaaagatgcttttatcgatgaacatatagatgtgctacatcaatctagtagacagcaatataatggtcattttgttattgctactatccatcaattattgaggtttaaacagcattttgatactgtatttctcgatgaggtagatgcttttccgttgtctatggatccacaattatcaaatgcaatacaacttgcttcaaaatcgaatcattcacatattttcatgacggccacaccaccgcgtcattttttaaaacaattccccccagaaaaaataattaagttaccagcccgttttcaccgatccccccttcctattcctaagttcaaatatttcaaattaaaatcaacacgaaaacaaaatttattacttaatatatttagatatcaaattaaccaacaacgttttactttggtctttattaataatatagaaattatgaataaaatgtatcaacagtataaaatggacatccctgatttgatttgcgttcacagtgaagatgatttacgatttgaaaaaattgaagctttaagacgaggacaacacaaaattgtattcactacaactattttagaaagaggatttacaatgacacacttagatgtcgttgtagttgatgctggaagttttcaacaagaggctttaattcaaattgctggtcgcgtaggacgtaaacagcagtctccaagtggcttagttttatttcttcatgaaggtgttacattatcgatgattttagctaaaagaaacattatttcaatgaatcgtttagcaattaaaaggggatggattgatgcgtaa

SEQ ID NO: 2664 - DNA, 453 bp, Staphylococcus epidermidis
attaaagttaatcttaccaataaaggaggattaactatggaattatatagtatgcctatgtttaataaatttttagttaacgacatagagaaatcatcggaatggtatcaagagaatttaggttttaaaagtatttttaaatttaaaaatgaacaaaatcaaattttaatggagcatttacgattagcaaaatatcaagatttgatgttaatttctggcaaacagtttgaagtcggtaatgcagtttatacaaatatacttgtaccaaatattcgaattttaaaacaacgaatatcttctcaatatatcgtggaagatcttgaaggaaaaccatggaattctattgaaatgacaattaaagatttagataatcatttaattacgcttacacaaagtaacataaaaaatgaagaatttaatgctttgatgcaacatacttcaaaaactttttaa

SEQ ID NO: 2665 - DNA, 1101 bp, Staphylococcus epidermidis
ctaatggttaataaaggagtcggtatggaaatgtttgaagctatcatatataacatatctgtcatggtggcaggtatatatttatttcataggttacaatattctgaaaataaaagaatgattttttctaaagaatatgtaacagtactaatgacattcgtttctttacttttagcggcataccctatcccatttcaaaacgaatacctcgtccatttaacatttgtacctcttttgtttttaggacgttataccaacatgatatatacactcacggctgcttttatcgtatctttagtcgatgtatttatctttggaaactcaattatttatggtattacattaatcgttattgcaggtattgtcagtgcagtgggaccattcttaaagcaaaacgatatcatttctttacttattttaaatttgattagcattatcattttgttatttttagcattattaagccctatttatgaactcgtagagattttagtgcttatccctatttcatttattattacaattgcttcagcaataacattcgttgatatatggcactttttctctttagtcaatcgttatgaaaatgaagataaatacgattatcttacaggtctaggtaatgtgaaagaatttgatagacacttaaatgaggtctcaagtaaagctgaagaaaagaaacaaagtttagccttacttctcattgatattgatggctttaaagatgtaaacgatcattattcacaccaatcaggagatgctgttctcaaacaaatgtctcaactattaaaaaactatgtcccaaaccagttcaaaatatttagaaacggtggcgaagaattttctgttgtaataagagattacacactagatcaaagcgtgaaattagcagaaaatattcgaagtggtgttgaaaaatcttctttccacctaccaaacaaagaagtaatcaagctatcagtttcaattggtgtaggatacttaactcaagaagatcgtaaatctcaacgtaaagtatttaaagatgctgatgacatggtacatgtggctaaaagtgaaggaagaaataaagtcatgtttaatcctattgtcaaattataa

SEQ ID NO: 2666 - DNA, 1242 bp, Staphylococcus epidermidis
ctgcaatctaaaaataggatagaggtcgagaagatgtttacagcattattgcaaataaagaattataaattgtttgtggtcaatatgttgttactaggtatgggaatagcagtgactgtaccttatttaattttatttgctacaaaagatttggggatgacgacaacacaatatggactgctacttgcacttgctgcgataagtcagtttatagtcaattccattattgcaagattttctgatacacatcatcttaatagaaagattctaatcatcactgctttgtttatgggggcagtgagcttctcaatttatttctacgttcatcaaatatggttattcatcgtgttatatgcgttgtttcaaggattatttgcaccagcaatgccacaattgtatgcctctgccagagaatcaatcaatgcttcaagttcacgtgatcgtgctaagtttgctaatactgttttacgttcaatgttttcacttggttttttatttgggccatttataggtgcacaacttattgagttaaaaggttattctggattatttggtggcacaatagctattattttatttactttaattttacaagtgtttttttataaaaatttaccggtaaaaaatcaaatttctgaacaacagcatattgagaaaatcgcaccaaatatgtttaaagataaatcattatttattccatttatagcgtttatattacttcatattgggcaatggatgtatacgatgaatatgccactttttgtgacagattatttaaatgaaaaggaaagatatgtaggctatttagcaagtttatgtgcaggtttagaagtgccgtttatggttatattaggtatattatcagctaaattgccaactcgaactttattgataattggttctgtatttggtggcgcattttactttagtattggtgtatttaaaaattttcatatgatgcttgttggacaaatatgtttagccatctttctagcaatattactaggtcttgggattagttattttcaagatattcttcctgattttccaggttatgcatcaacactttttgccaatgccatggtaataggacaacttggtggtaatttgctaggtggtgtgatgagtcattgggttggtttggaaaatgtattctttgtctcagcaagttctatcttcgtagggatgatactcatcttgtttacgaaagatcaaaaaattacaatagaagatgtggagtag

SEQ ID NO: 2667 - DNA, 1194 bp, Staphylococcus epidermidis
ataatggctaaaaaaatcgtttcagacttagatttaaaaggtaaagttgttcttgagcgcgctgattttaacgttccaattaaagatggtgaaatcactaatgacaacagaattgttcaagcattaccaacaatcgaatatattattgaacaaggtggtaaattagttttattctctcacttaggtaaagttaaagaagagagtgataaagaaggactttcacttaagcctgttgctgaaaacttatctaagaaattaggtaaagaagttatattcgttcctgaaacacgtggcgaaaaactcgaaacagcaattgaaaacttaaatgaaggcgatgttttattagttgaaaatacacgtttcgaagatttagatggtaaaaaagaatctaaaaatgatcctgaattaggtaaatattgggcgtcattaggtgatgtatttgttaatgatgcatttggtacagcgcaccgtgaacatgcgtcaaacgtaggtatttctactcatctagaaacagcagctggttacttaatggaaaaagaaattaaatttattggtggcgtagtgaatgatccacaaaaaccagtagttgctattttaggtggcgctaaagtttcagataaaattaatgttatcaaaaatttagttaatatcgcagataaaatcttaatcggtggcggtatggcttatacatttattaaagcgcaaggtaaggaaataggtctttcattattggaagaagacaaaattgattttgctaaagacttgttagagaataatggcgatcaaatagtattacctgtagattgtaaaatcgctaaagaattttctaatgatgcaaaaatcactgaagtatctatcaatgaaatcccttcagatcaagaagcaatggatattggacctaaaacagtagaattatttaataaagaattacaaggtgcacatactgtagtatggaatggacctatgggtgtattcgaatttagtaattttgctaaaggtacaatcggtgtatgtgagtctattgctaaattggaagacgctactactattattggtggtggtgactctgccgcagcagcaatttcattaggtttcgaagatgactttacacacatctctactggtggaggagcatcattagaatacttagaaggtaaagaattacctggtataaaagctattaatgataaataa

SEQ ID NO: 2668 - DNA, 528 bp, Staphylococcus epidermidis
gaggaacataaggagacatgcagaatgaagcatcaaaaaaatcagagcaggtttaaactactaatagctggcataatagcaggacttttatctggtgtagtcaaactaggttgggaggtaatgttcccaccccgaacacctagtagagatgccactaacccacctcaacaactcttacaattactaggaataccgtcaaatattacccatctcacatacaatttttctgagcatgcattaccttggataagttttatcgtacactatagtttttctatcgctattgcaataatctatatttatatcgcaaagaaatatacaaaaatcacactaggttatggtgctttatttggtatagttatttggattgtttttcatttaatcttaatgccaattatgcatgtcgtaccgaatgcttttgatcaaccattttcagaacacctatcagaattttttggacacattgtttggatgatggttatagaaatggtcagaaggtatttctataatattcaattaaataaataa

SEQ ID NO: 2669 - DNA, 843 bp, Staphylococcus epidermidis
tatgggcataaaagactgagggaaagaggtaaagatatggcaaattcttgtttgcatatactttcaaaaaaagaatatacggcaacacgatgtcaagacggcattttattattttggcctatcgaagggagtatgcactttcaacaatttatgaaagaaaggatactctcagatgagttatatattgtgaataatatggatgtgtttagtatcagtgacaatggcatcacactagaagtatatatttctagtgattggtttacagagttaggctattctttttttaattaccattatatttcggatttaatacaatctaagaaagaaattaaagaactagttgctcaacttacgttgaattttttagataatgatgtggataaagagcaagatattatcaataaaattgttcatattcttgctaatgaggctattattgacaaaaaaattgctgaagaccaatatatgtatgattattatggtgagttaaaggatgaattgaattatatatataatcacatcgaagaaagacttactctaaaagatatttccaataaattatatgtttctaagtccaacctttctacgcagtttcatttgttattaggtatgggatttaaaaaatatatagatacacttaaaattagtaaatctatagagatgctacttacgacaactaaaacgataagccaaattagtgaaacgttaggatttagtaatgtatctacatattctagacaattcaaaaattatttaagtgtaacgcccaatgcatatcgtgcaatgaaaaaatatgataagtacaatggatgttctgatgatgatgtttcagaacacttttaa

SEQ ID NO: 2670 - DNA, 228 bp, Staphylococcus epidermidis
gtatcaaataaacataatcatttattatttaataactttgtagtttatattattgacttattattttcaagttttttattatatggattatcatttccaattatacaaaaactacaaatccccatccgtgaaggtgcttttatgaatcacaatttcatttgtacaagaactactaactttcctttcaagaaggaagtagctctttataatatcttacatgacgtttaa

SEQ ID NO: 2671 - DNA, 1044 bp, Staphylococcus epidermidis
ctcatgaataattttcgatggttttggttttttataaaatctcgtattaattggatattgtggatattatttctcaacattattttattaggtgttgcctacatagattatgagatttcagttgaaagtgtattttatatagtgatattaaacgtaggattgagtatacttttcttattatttacgtttgttaaagaagtccgtctatctaaacatttttatgaagataaagaaattgaagaaattaagcataaagatttggcagaaaccccatttcaacaacaagtcatagattatctgtatcgtcatatagccgctcaaaaagagaaagtagtcgaacaacaattacaaattaaaaatcatgaacaaacaattacagagtttgttcatgatataaaaacacctgttacggctatgaaattattgatagatcaagagaatgatgatcagcgtaagcgagcgttattatttgaatggtctcgtattaatgagatgttagataagcaattatatttaacaaggcttgaaacacatcatcgtgatatgtattttgattatatttcattaaagagaatggttatagatgaaatacaagttactcgacatatcagtcaggcaaaagggataggttttgaattagattttaaagacgaacaaaaggtttatacagatgttaaatggtgccgtatgatgattaggcaagttctatctaactctttgaaatatagtgataattctacaataaatttaagtggttataacatagaaggacacgttgttttaaaaattaaagactacggtcgtggaattagtaaaagagatttaccacgtatatttgatagaggatttacttctacaacagaccgcaacgatactgcgtcttctggtatgggattataccttgtacaaagcgtgaaagaacaacttgggattgaagttaaagttgattcaatagtggggaaaggaacaacgttttatttcattttcccacaacaaaatgaaatcattgagcgcatgtctaaagtgacaagattgtcattttaa

SEQ ID NO: 2672 - DNA, 957 bp, Staphylococcus epidermidis
aatatttgtaatagtaaaggatatattaaaatgaaaaataataaaaatgaaaagttgaaaatcacaatcgttagcggtttcttaggcagtggtaaaactacgttcctgacacattatattaatgaattattaaaaattgatgagaaaataacagtaattatgaacgaatttggatcatttgatgtagatggtaaccatttgagtgaattagtcaaagtgtatccattgttgaacggttgtgtttgttgtgatatgaaatcagatttagttcaacaaattgagatgctcagtcacaaccatgaaacggaccatattataatagaagcaactggtatcgcgcatcctattgaattgattatggcgtgtcaagatcctcgcatagttcagtttgttgaacgtccccacgttgttagtattgttgatgcacttcgctttttacaaagacaacagtatactgactccacaaagcgtctcatggaagaacaactcgaggtaagcgatgtgctcgtcgttaataaattagatttaatatctgttgaagacagagatgctttaaagaaccaacttaacgaagtaaacaaatatagttcaaaaatatatactacttatggacaagttaatatcgaggagttgtcacaatttcgtgatcaattagtaatgacacacacacattctcatcaccatggtataaatagtatgcaatacacatttacaacagctattgaccgacaattattttaccaatttattttgcgtatgcctgataatgttttaagattaaagggatatgtacaatttaaagatgaacccaatgtgacatatgagtttcaatattcatttggtatgccggattatgaagttattaatggggattatccgttaacaatagtattgattggtgaacaacttgatgttaacagactaaaaaataaactcgatgttttgcaattctcataa

SEQ ID NO: 2673 - DNA, 639 bp, Staphylococcus epidermidis
ttttctagtaaaaagaagaaaaccgtgcctatcaaaattaataatccagtggtagttaacacgagtttagagtgtaaggataattttctaaaacttttggcgttccacaaatcaaccacgactaaatgtcccaaacctcccaaaatgataagtattggaatagtgataatgattaccggatcatttgaaaaatcgattaagttgtttttaaaaagggcgaatcctgcgttgttaaatgcggaaactgaagtgaataaacttaaaaatagacctttacctatgccaaattttggaataaacgataaacatagacaaagtgtaccaaataattcagtggcgatgctgtatatggctagatgtttaataagtttaattacaccaccgggttcgtcaatattccaagtaatcataaataaaattctattgttaattgatattttcttatttaaaaagatgagagttagcattgctacagtgacaatacctaatccaccaatttgtataagtaataagataatgatttctccaaaaatattaaattgtgttccaacatcaactggtgatagacctgttactgtgaatgcgctagaagctacaaacaatgcgtcaataaagttaatgggtttcttccctgtatag

SEQ ID NO: 2674 - DNA, 1062 bp, Staphylococcus epidermidis
ttgcctctcaagtacctttgttacaaagatataaggaggaaggtagtagtgaaagacttaattaaagttcaacaaaagcttatacctgatcttatagataagatgtatagacgcttttatattttatctactatctctcaaaatcaacctgtaggaagaagaagtctaagtgaacatatggatatgactgagagagttttacggtcggaaacagatatgttaaagaagcaagaattaattcgtgtcaaacctacgggaatggaaattactaatgaaggtactgaagtattagcacaactaggtgaatactttaatgtttatagcgatgaccataaattggccagtgctatcaaagataaatttcatattaaagatgtacatgtcattccaggagattccgattctaatcgaactgtaaaacgtgaaatgggtcaacaagctgggcaacttttagaaggtatactttatgaagatgctattgtctctgtaactggtggttcaacaatggcgtgcgtgagtgagtcgatacatttattaccgtttaacgtattctttgttccagctagaggtggacttggagaaaatgttgtttatcaagcgaatacaatcgcttcgagtatggcccaacaagctggtggctattatacaacactctatgttccagacaacgtgagtgagtccacatacgatacgttaatgttggaaccttctgtcatgcatacactagataaaatcaagcaagctaatataacaatacacggcattggtgatgcgctgaagatggcgcatcgacgtcaatcatctcaaaatgtgattgataaccttcaacatcatcaagccgttggagaagcttttggatattattttgatgctcagggtcaaatagttcataaggtcaaaacgattggccttcagctagaggatcttgagaacaaagactttatctttgcggttgctggtggacaatcaaaaggagaagctattaaagcttatctttcaattgcaccggaaaacactgtattgattacagatgaagccgcagcaaaagtcattttacaatag

SEQ ID NO: 2675 - DNA, 762 bp, Staphylococcus epidermidis
tcacaggtcctgacttatctactaaaatgtttgaacatgctaaaaaatttggtggcggaataccaatatggcgatattaaatctgttgaagataaaggcgactataaagttatcaatttagggaataaagagataacagcacatgcagttattatctcaactggagcagagtataaaaagattggcgttcctggtgaacaagaattaggaggacgtggagtaagttattgtgcggtttgtgatggagcattctttaaaaataaacgtcttttcgtaattggcggcggagattcagcggtagaagaaggtactttcttaactaaatttgcagataaagtaacgattgttcaccgtagagatgaattacgtgcacaaaacatcttgcaagaacgtgccttcaaaaatgataaagttgactttatttggagtcatacacttaaaacaattaatgaaaaagatggtaaagttggttcagttacacttgaatcaactaaagatggtgctgaacagacttatgatgccgacggtgtattcatttatattggaatgaaaccactcacagcaccatttaaaaatcttggtattacaaatgacgcgggatacattgtcacacaagatgacatgagtactaaagtacgaggtatttttgctgcaggtgacgttcgtgataaagggttacgtcaaattgttactgctacaggagacggtagtattgcggctcaaagtgcagctgattatattacagaattaaaagataattaa

SEQ ID NO: 2676 - DNA, 1047 bp, Staphylococcus epidermidis
tactttttaaatatcattttaaaggaggccattataatggcaattaaagtagcaattaatggttttggtagaattggtcgtttagcattcagaagaattcaagatgtagaaggtcttgaagtagttgcagttaacgacttaacagatgacgatatgttagctcatttattaaaatacgatactatgcaaggtcgtttcactggagaagttgaagttatcgaaggtggattccgtgtgaacggtaaagaaattaaatcattcgatgaaccagatgctggtaaattaccatggggcgatttagatatcgacgtagtattagaatgtactggtttctatactgataaagaaaaagcacaagctcacatcgatgcaggtgctaaaaaagtattaatctcagctccagctaaaggtgatgtaaaaacaatcgtattcaacactaaccatgatacattagatggttcagaaacagttgtttcaggtgcttcttgtactactaactcattagcaccagttgcaaaagttttaagtgacgaattcggtttagttgaaggtttcatgactacaattcacgcttacactggtgaccaaaatacacaagacgcacctcacagaaaaggtgacaaacgtcgtgcacgtgcagcagctgaaaatattatccctaactcaacaggtgctgctaaagctatcggtaaagttattccagaaatcgatggtaaattagacggtggagcacaacgtgttccagttgctactggttctttaactgaattaactgtagtattagacaaacaagatgtaactgttgaccaagttaacagtgctatgaaacaagcttctgacgaatcattcggttacactgaagacgaaatcgtatcttctgatattgttggtatgacttacggttcattatttgatgcgactcaaactcgtgttatgactgttggagatcgtcaattagttaaagttgcagcttggtacgacaatgaaatgtcttacactgctcaattagtacgtacattagctcacttagctgaactttctaaataa

SEQ ID NO: 2677 - DNA, 258 bp, Staphylococcus epidermidis
ctttggttaaaaagtacaagtaaggtgatgaatatgaaagactggacaattaacaatcattccaaacgacaattgattattcaaagtaatcatgatgatatttcgattatagaaccattgcgaaatggttcttttaaaatacttgctgaatttaatgcgttaaatacagattacattcaagtttatgaccacacacttgttgtttctatacatgagaaagagattagtgtgttagatcgatcttcacagtcaatttaa

SEQ ID NO: 2678 - DNA, 507 bp, Staphylococcus epidermidis
gatagaataaatcttaagagaaatgtgggtaaggagatgaaattgaaaaacttatttttaagttctgttgcagttattttatcaatttgtttagtacttttattatttttagctacaaaccaaaatgcattagcgaaagtccataaaacaatttgtacttttactaaagtgaaaacagtatctcataacgatatattccctaacttaaatatgaatcatgttgctgaagcttcagaaaaaaactctgatcaccaaaagaatgttaataaaacaaatcaacaaagtgtaagaacgcaagcatcttatgatttcaacccacaggaatgtaaagtaattgctttgaattacgctgagaatcatttaagcaaaaaatataatatagagcgtactttcaacgagtcgcttcattcagtatatgtattttctagtgaaaataaacttcatcaaactaaggttaaagtcaataaaagtgggactgtacatgcatcaaacatcaataatcattaa

SEQ ID NO: 2679 - DNA, 261 bp, Staphylococcus epidermidis
tttatagtaaagggatgtgatgttgtgatgaataaaaatctattaaaaaaatacttgaatgatgatagtttcaaatcagttgtcgttgttatagggaataagagaatcgtattagagaatgatattcatgttgattatgaaaacgaagttattatttatccatgtaaaaattgtacacgtattataccgtttagttcaatttcctatttagaacttattgataagcaagaccaatttattaactattttaaagaaggatga

SEQ ID NO: 2680 - DNA, 225 bp, Staphylococcus epidermidis
tttctttcaaaacttcttggaaagcttgcttatcaccatagacttttgacaactgtcttacctctaatatcgacaaataatcactcctgtcatacttcaaccaaattatctttttacgaagacaaacttaatgtagactatcatatcttctttaatttacatcttttattatatcgattatttattacaattgtgataatagtaagtaacaaaacgcacgtttaa

SEQ ID NO: 2681 - DNA, 444 bp, Staphylococcus epidermidis
gtaactacaaaggagtctatcatgagaaaatggttaaccttactattaattacaacattggtgttaactgcatgtggtaaaagtaacgaaaaagcttctttagaaaaaagcattgatcagttgaaaaaagaaaataaggatttaaaaaaacagaagaaaaagttacaagagcaaaaggataagcttaaacacaaacaggatagtctccaagaagatgtaaatgacttgcctgctaaaagcacatcccgagataagaaaaataaagataatcatgatgcaaaagaaaagtcttcagataatcaatcgacatctgctaatcatgatgatcaaactaacaaaataaaaagcaatcaagatgaacatgacagtcaatcctctaaaccacatacacagcagaagccctcacagaatgatagaaaaaataatcatcgacaagaacgatag

SEQ ID NO: 2682 - DNA, 759 bp, Staphylococcus epidermidis
aaatatcaaaaatatcttaaaatacttaataaagtagtaccattaaatgacgacgaaacctttaaattaggaatcgtattgagttatttaaaacagtatcgtgcttctcaaaatttactttatccactttataaaaaaggtaaatttgtctctattcaaatgtataatgcattgagtttcaatttttattacctaggaaataaagacgaaagtattgagatgtggaacaagctcactcaaatttctgaagttgatgttggttatgcaccttgggtaattgaggaaagtaaaacggtatttgaatcacgagtgttaccattattactagatgataataatcattatcgactttacggtatttttttacttcatcaattaaatggaaaagaaatactaatgactgaagatatttggtcaattcttgaatcaatgaatgactatgagaaactttatctcacatatttggtacaaggactcacactcaataaattagattttatacacagaggtatgcaaaggttgtataattttaagaaattcaaatataacacgtctttatttacagattggattaatcaagcagaaatgattatagctgaaaatgtagatttagtagatgtcgatagatatgtagctgcatttgtttacctatcgtatcgtcgttctagccaaccacttaccaagaggcaattgatggacgattttaatgtttctagatacaaactgaataaagcaattgaatttatattgagcatataa

SEQ ID NO: 2683 - DNA, 681 bp, Staphylococcus epidermidis
atggcacaaaaagaaaataacatcattccaatgatttttgatgaggctttttatcgtaaaatggctacccaaaagtggcgacaacaggactacaagaaggcggcagaatattatgaaaaagtgcttgagttgtcacctaaggattttgatattcaacaacactatgctcaatgtttagttaaattaaatatcggcaaaaaagcagaacgtctattttatgagaatattgttaaagactttcatgtagcagaaagtttctatgaactaagtcaattaaatatagaattaaacgagccaaacaaggcattcttgtttggtattaattatgtaatattgtcagaggataaagattttagagaaatgcttgaaaaaacattcgaagtcacgtatacaaatgaacaaaaaattgaattagaagcacaattgttttcaacacaacttttatttcaatttctcttttcgcaaggtaggttagaagaagcccgaacatatattttgaatcaatcttacgagatacaacagcatagggtgattaggaatttacttgcaatgtgttatttgtatctaggtgagtatgatagcgccaaagcaatgtttgaagaacttttaaaggaagataattcagacgtgcatgcactttgtcactacacattattactttataataaaaaagaagcataa

SEQ ID NO: 2684 - DNA, 390 bp, Staphylococcus epidermidis
atgattaaaaagacataccaaaagggcgttaaaatcatcgttgatatgagagataggataataataattgtacctgttgtcattggtcttttaattttacgaaatagtgaaagacgttcaacttcgtctattttgaaagtacctacaaaaagtaaaatcgcccctattataaatatcgtgggtgataaatatgggatggacatgtacaccgattgtgtgctcgatttatctgtaataaattgcaataagcttataacaatggctagtattatagcaataaacttttggtcagaaattacaaaaggatatagcttgaaatttaaatatatttgtaaaagtgtccatatcataaatagcgtgacggtaaacatcgtaataaaattgaattga

SEQ ID NO: 2685 - DNA, 243 bp, Staphylococcus epidermidis
aatcataaaaagacatttgatttcagccccttttttaaagtgttaaaaacacttgagtcacctacttatatactttcacctattaatcataccagattgctcgagtttttatgtgcaaaaaattcttttttgcactatatacataaactttttttgctaataatgataattttcatttatttttgttcttgtgatgaaattacagttgttagaggtttaaaaataactataacattaaattga

SEQ ID NO: 2686 - DNA, 1197 bp, Staphylococcus epidermidis
ttcaaagaaaagaagggttcaatcatgtcagaatatgttttaacgaatggcatcgtatatacagaaaatgaaatgattaacaatggatatgttcatattaaagatgggaaaattttagacgttggtaagtgtccttttcatccgtcatcgtcgcataatacaattgacattattgatgtaaaaaaacgacatatactgccaggatttatagatattcacatccatggggggtatggtgaagatgccatggatgcatctgaacaaggcttacaacatttagcagaatcactcctttctgaggggacaacatcttttttagcaacaacaatgacacagtcaacagtcaatattgagcgagcacttcaaactattgctaaatatactcaacaacaagatgttacaaatgctgccgaaattgtgggagtacatcttgaaggtccatttatttcagaacataaagtaggcgcacaacatcctcaattcgtacaacgtcctacggttgataaaataaagtcgtttcaggaagtagcgaatggactaattaagattattacgtacgctcctgaagttgatggagcaacagaaacgttaaagacaatgaaaaatgatatcattttttcaatcggacatacggtggcaacgtttgatcaagcgaatacagctgtgagtcatggtgccaaacacatcactcatttgtataatgcagcgaccggctttcaacatagagaaccgggtgtatttggtgcagcctggttaaatcaagggttgcatactgaaatgattgtggatggtgttcattcacatcctgcatccatcgcacttgcatatagacttaaggggaatcaaagctgttatttaattacagatgcgatgagagctaaaggaatgccagaaggacattatgatttaggtggtcaggatgtgattgtaaagggaagtgaagcacgcctgtcttctggggctttagctggaagtatactcaaaatgaacgaaggacttaaaaatttaatacaatttacaggtgacacgattgagcatttatggagagtaacaagtttaaatcaagcgataacattaggcatagacgacataaaaggtagtattaaaatcgggaaagatgcagatattgttatcatagatgatgcatgtaatgttgaaacgacgattaaaaatggaaaatatcatgctttcaaatga

SEQ ID NO: 2687 - DNA, 558 bp, Staphylococcus epidermidis
agggagcgaaatacattggaattacaagaagctatatctaatcgtagaagcgtcaaaaaatttaaacacgatatggtggttgatgatcaaacggtttacgatgcaatatataaagctactgacgctccaaatcatggtatgagagaaccatggagattggttcatatttcaaaagataaactcggtgattttagtagggatatcacaagatttgcttttccagatagtccggataagcgagaggatcactttcatgcagtaacaaatttaggtggcatgttgttgttgattttaaaagatgatccaagacaacgtcaaagtcgtgaaaattattttgcatttggagcttttgctcaaaatttaatgttacttttatacgaagcgggtattggtacttgttggaagtcgccacaatatatctttgatcctaaaatacgaaaagctttgggtgtaaaggataatgaaatattagcaggatttttgtatcttactgatttagaagaagtaccaacgaaggctaaacgtaaaaataaaaatcttattaccgaatttgaataa

SEQ ID NO: 2688 - DNA, 975 bp, Staphylococcus epidermidis
aaggtaggaaaaattatgcaaatgagcgctaataaaaaaataagtatactggtcgttatggcaatttgtatggcaattttttatttattggtaggtttagattttgatatatttgaatatcaattccaaagccgtttcaaaaaatttattcttatattattagtaggagcatcgataggaacgtccgtagttattttccaatctattactacaaatagattattaactccttctattatgggacttgattctgtgtatttatttgtcaaagtcttacctatttttattttaggtgaacaagcaactgttgttacaaatatctaccttaattttttaatcactttgatcgcaatggtgtttttttcattgctattatttcaagttatatttaaactaggtcacttttcagtctatttcatattactagttggtgtaatattaggaactttcttccgtagtattacaagttttctccaacttataatgaatcctgaatcttttttagcagttcaaaatgttatgtttgctagctttgaagcatcaaattctaaattagtaactgtttcaggcatattattagttatattaataattgttacaataatacttcgaccatatttagatgttcttttgttaggtagagcacaagcaattaatctaggtgtttcttatgagaatatgacgcgtatgtttcttattttggttgctttactcgtctctatatctactgcattaataggtcctgtaacatttcttggcttattaactgtcaacttagcacacgaatttatgaagacctatgaacacaaatttattttaccggcaacaatattattcagctggattagtttatttatagcgcaatgggtagttgaaaatctattcgaagcaacaactgaattcagtttgatagtagatttagttggtggaagttacttcatatatttgcttgtcaaaaggagaaatgcaaattga

SEQ ID NO: 2689 - DNA, 600 bp, Staphylococcus epidermidis
acagaaggaaaaaattttgctatactaaacacgtatatcacgaacagggagtgtaagagcatgacgcgacagagaatcgccattgatatggatgaagtgcttgctgatacattgggtgctgttgttaaagcggtcaatgaacgagcggatttaaatatcaaaatggaatcattaaacggtaaaaaattaaaacatatgatacccgagcatgaggggttagtcatggatattttaaaagaacctggattctttagaaatttagatgtaatgccgcatgctcaagaagttgtaaaacaactcaatgagcattacgacatatacatagccacagcagcgatggatgttccaacctcttttcatgacaaatatgaatggttattagaatactttccttttttagatccgcaacattttgtattttgtggtagaaagaatattattcttgcagattatcttattgatgataatccaaagcaattggaaatttttgaagggaaatcaattatgtttactgcttctcataatgttaatgaacatagatttgaacgcgtaagtggttggagagatgtaaagaattattttaattcaattgaaaaatag

SEQ ID NO: 2690 - DNA, 516 bp, Staphylococcus epidermidis
gtgcttatgaagaaactaataacatcattacttgttttaggattagttttaactggagtaagcgttggaaacaacgttgaagcggcaactggtaattcaatgaaaacagtacaacaattaaacaaaggtgataaatcattagaaaacgttaagataggcgaatcaatgaagagtgtattaaaaaagtatagtcatcctatctattcttataacccaaatagtaatgaaaagtattacgaatttagaactgataaaggtgttttgctagtaacagctaatggtaaaaaagaaagaggaaatgttacacgcgtatcaatgacatataatgatgcaaacggcccttcatacaaagccgtaaaacaacaacttggtcataaagctataagtcgtgtacattataataatgttacaggtaactttggctatattcaaaaagatcaagcaagttatcaattcagttcaaattcaccaaaggataaaaatgtgaagttatatcgtatagatttaaataaataa

SEQ ID NO: 2691 - DNA, 1245 bp, Staphylococcus epidermidis
actcgtatgaagaaacaaattatcgaaagattaacgagatatgtaaaaattgatacacaatctaatcctgattccaagacgacaccatctacgaataaacagtgggatttattaaatctattagaagaagagcttcaatcattaggtcttaaaacagacatggatgaacatggttacttatttgctacactcgaaagcaatattaattataatgtacctactgtcggttttttagcacatgtagacacttcaccagatttcaatgcttctcatgtaaatccgcaaatcattgaagcctataatgggcaacctatcaaacttggtgaatctcagcgtatcttagatcctgatgtttttcctgaattaaataaagttgtgggtcatacactaatggtgacagatggtacatctctactaggcgccgatgataaagcaggtgttgtagaaataatggaagggataaagtatttaattgatcatcctgacattaaacacggtacaattcgagttggctttacacccgatgaagaaattggacgaggcccgcatcaatttgatgttagtcgatttaatgcagattttgcatatacaatggatggcagtcaattaggagaactacaattcgaaagtttcaatgcggcagaggtaactgtcacttgccatggtgttaacgttcatccaggttcagctaaaaatgccatggttaatgcaattagtttaggtcaacagtttaatagtttacttcccttacatgaagttcctgaaagaactgaaggatacgaagggttctatcatttaatgaattttacaggtaatgttgaaaaagcaactctacaatatattattcgcgaccatgacaaagaacagtttgagctacgtaaaaaacgcatgatggaaattcgtgatgatattaatgttcattataatcattttccaattaaagtagatgtgcatgaccaatattttaacatggcagaaaaaattgaacctttgaaacacatcattgatatacctaaacgtgtctttgaggctttagacatcgtacctaacactgaacctattcgaggtggtacagatggatcacaattatcttttatggggttacctacacctaatatttttactggttgtggcaatttccacggtccttttgaatacgcttctatcgatgtaatggaaaaggctgttcatgttgtcgttggtattgctcaagaagtagcaaacagccatcaatcttataaataa

SEQ ID NO: 2692 - DNA, 330 bp, Staphylococcus epidermidis
atagtgatgaaaaatattcatcaaaccgaagaatttaattctactattggtagtactgatccagtaattatcaagtttgaagccgactggtgtccagattgtaaagcgatggatatgtggatagatccaattgttgaaaaatataataattatcaatggtatgtggtcgatcgtgacgaattagaagatgtgacaactgaaaatgatgttatgggtatcccaagtattttaatattccaaaatggtaaaaaattagcacacttgcattcagcaaatgctaaatcacctgaacaagttgaatcattcttgactgaacatttagatcaataa

SEQ ID NO: 2693 - DNA, 1515 bp, Staphylococcus epidermidis
aaggtgatgaagatgatgagtaatttaataatattgcctatgttgttgccttttgtatgtgctttaattttagtcttcactaaaaataaaaatcgtatttcgaaaatcctatccattacaactatgattgttaatacaatgatttcaattgctttacttatttatgtcgttaatcataaaccgataacacttgattttgggggatggaaagcacctttcggcattcaatttctaggtgattcactgagtctgcttatggtgtcagtatcatcttttgttgttacgctaataatggcatacggctttggtagaggggagaagcgagtcaatcgatttcaccttcctacatttattcttttattaacagtaggtgttattggttcgtttttaacttctgatttatttaacctatacgtgatgtttgaaattatgcttcttgcttcgtttgtacttgttacattaggacaatctgttgaacaattacgtgcagcgatagtatatgttgttctgaatattttaggttcgtggttgcttttattaggaattggcatgttatataagacagtcggaacacttaatttctcacatttagcgatgcgattgaatcatatggaaaataaccaaacaataacgatgatatctttagtatttctagttgcttttagttcaaaggcagcactagtgattttcatgtggttacctaaagcatatgcagtgcttaatacggaacttgccgcgttatttgcagcattgatgacaaaagttggagcttatgcgcttattcgtttttttactttactattcgaccatcatccaagcgtcacgcatacattgctcgtgtttatggcttgtatcacaatgattatcggtgcatttggtgtcatcgcttacaaagatattaagaaaattgcggcttatcaagttattttgtctattggattcattattttaggtttaggttctcatactatatcaggtgtaaatggtgctatcttctatttagcgaatgatattatcgttaagacattattgttttttgtaattggtagtcttgtttatatgtcaggctatcgaaattatcagtatttaagtggactggcaaaaagagaaccattctttggtgttgcatttgtcgtggtaatttttgctataggtggcgtacctccttttagtggctttccgggtaaagtcttaatattccaaggggctattacaaatggtaattatattggtttagcacttatgattgtgacaagtttaattgctatgtatagtctttttagagtgatgtttataatgtattttggtgatgctgacggagaacaagtacaatttagaccactacctatttatcgtaaaggtttacttagtgttttagttgtagtggtattagcgatgggtattgcagcccctgttgttctgaaagtaacagaggatgcaacaaatcttaatatgaaagaagatgtctttcaaaagaatgtaaatacacatttgaaggaggttaatcataagtga

SEQ ID NO: 2694 - DNA, 1968 bp, Staphylococcus epidermidis
tggggagtgaaaaagatgagaattactgaactgttaactaaagaaacaatagcgatggatttagatgcttctgataaaagtggggtgattactgagcttgttaatcaattggataaagcaggtaagttaagtgaccctgtatcgtttaaagaggcaattcataatcgtgaatctcagagcacaacaggaattggtggaggtattgctataccacatgctaaagttgcagcagttaaaacacctgcaattgcattcggtaaatctaaagaaggtgtggattatcaaagtttagacatgcaacctgcacacttattctttatgattgcagcgcctgaaggtggagcacaaacgcatttagatgcgcttgcgaaactttctggaatattaatggatgagaaaatacgtgaaaaattaattcatgctgaatctcctgaagaagtgttaaacattatcgatgaagcggatgatgaggcaacaaaagaagaagaagcagaagcgaacgaaaatgcaactgtttcaactgacaactcaaatcaagataataatgagccatatgttttagctgttacagcatgcccaactgggattgcccacacatatatggcacgtgatgctttgaaaaagcaagctgagaagatgaacatcaaaattaaagttgaaacaaatggttctagtggtattaaaaaccatttaactgaacaagatatagaacgtgcaactggaataattgttgcagcagatgtccatgtagaaactgatcgttttgatgggaaaaatgtggttgaggttcctgttgctgatggtattaagcgtcccgaggaactaattaatacagctttagatacaaatcgtaaaccatttgtagcgcaaggtggatctaaaaaacatgacgataatgaagaaaagttaagcccaggaaaagcattctataaacacttaatgaatggtgtttctaatatgttaccacttgttatttcgggtggtatcttaatggcaattgtattcttattcggcgcaaactcatttaagcctgatagttcagaatataatgcatttgctgaacaattatggaatattggtaaaaatagtgcctttgctttaattattccaattttagctggtttcattgcacgtagtattgcagataaaccaggttttgcagctggtttagttggtggtatgttagctatttctggaggttctggctttattggtggaattattgctggtttcttagcaggttatttaactcaaggaattaaatatattacacgtaaattgccacaagcaattgaaggcttgaaacctactttaatctatccattactttcagtttcaattactggattgttaatggtgtatgtctttaatccgccagcagcttggttaaatcatttgctactaaatggtttaaatagtctgtcaggctctaatattatgttacttggtcttgtgattggagctatgatggcaattgacatgggcggtccatttaataaagcagcttatgtatttgctactgctgcattaacggaaggaaatgcagctcctattactgcagcgatgattggtggtatgattcctccattagctatcgctacagcaatgttaatctttagaagaaaattcactaaagagcaaagaggctcaattgtaccaaactatgtcatgggattatcatttattactgaaggtgccatcccattcgcagctgccgatccattacgtgtgattccttcaatgatggttggctcaggtgtggctggagcaattgctttaggtttaggatcaagtatcaaagcacctcatggtggaattttcgtcattattggtactgattttaaccatatacttcaaactcttattgctttagttgtgggtacgttagtttcagctttaatttatggtttcttgaaaccaaaagtaacagaaaatgaaattcaagcatctcaagctatggatgaatag

SEQ ID NO: 2695 - DNA, 789 bp, Staphylococcus epidermidis
atatttaagaacatttattgtttatataaaaaaggagttactatgagagacaaagacaatcaacattcgagattatattatattattttgacaatcgttattatcgcaatttgcgttgttgttgtaatactttttaatactttaaagacaaaccgttctcattctaccgatagatacgcagattttactgaattaaaaaaagatacgataaaaaataaagattggcgtattaaaacaaaacaccgtaaaaataaggatattttagtcactgcaattcacggtggaggtatcgaaccaggtacgactgaaattgcacgacgtatttccaatgttggaaaatataatttttatacctttgaaggtcttcgaaagtctaataacgatcaactacatgtaacatccactcattttaacgaacctatattagataagttacttaaaaacactaaagaaacattatctatacatggattctctggagatgaccctattgtttatatcggaggtaaagataaagagatgtctcactctatcacgaaagaattacgtaaaaaagactttactgtaaaagaaagtcctaacaaaatcgatgcaaagtcatcagataacatagctaataaaaatgaatctaactcaggtgtccaattagaactcacgactgcattgcgaaaacagtttttcaaacattataaattagatcgacatacacgtagtgattcagataaatatactaaagatttttacaaatttgcgaacgcagtgcaaaaaggtatcgaaaaggtaaattaa

SEQ ID NO: 2696 - DNA, 978 bp, Staphylococcus epidermidis
tttttaaagaaaaaattaaacaagggggcattgcttatggtcaatagaagaaagatatcaattattggcgcgggacatacaggtgggactctagcattcattcttgcacaaaaggaattaggagatattgtgttgattgaacgccagcaatcagagggtatggctaaaggaaaggcgttagatattttagaaagcggacccatttgggggtttgacacatctgtacatggttcagtaaatatagaagatattaaagattcagacatagtggtgatgactgcaggtatacctaggaaatcaggaatgacaagagaagaattagttcaaactaatgaacaaatagtacgagaaactgcattacaaattgcaacgtatgcacctcattcaataattattgtattgactaatccggttgatgttatgacatatactgcatttaaagcatcaggttttcctaaagaacgtattattggtcaatctggaattttagacgctgcaagatatcgaacttttattgctcaagaacttaacgtgtctgtcaaagatgtaaatgggtttgttttaggtggacatggtgatacgatgttacctttgattaataacacacacattaatgggattccagttaagcatcttatttctgaagaaaagattgatcaaattgttgaacgtacacgtaagggtggtgcagaaattgttgcattactaggtcaaggctcagcatattatgcaccagcaactgctatatatgaaactatagatgcaatttttaatgatcggaaacggttattaccaagtattgcttatctagagggagaatacggttgttcagatatttgtttcggagttcctactataataggatatcaaggaatagaaaagattatagaggtagatatgaataatgatgagtatcaacaactacaacactctgcgcaagctgtgagtgaagtcaaaaactcactaaaattcaaataa

SEQ ID NO: 2697 - DNA, 852 bp, Staphylococcus epidermidis
attcagtttgatagtagatttagttggtggaagttacttcatatatttgcttgtcaaaaggagaaatgcaaattgattcaaattcgaaatttagataaaacgatagacaataaacctattttaaaagatattagcgtagatattaaaaagggaaaattgacttcactcataggtcctaacggtgctggtaagagtacattattatctgctatcagtcgcttatttagttatgagaacggttcaattttgattgaagacaaagaaatttcagaatataaaactgacgatttagctaaaaaattaagtattttaaaacaatctaatcacactgatatgaacataactatcgagcaactagttaaatttggtcgttttccatattcaaaaggtcgaatgaagcaagaagactatgacaaagtggaatatgctcttgacttattacagcttaatgaaattaaacatcgtaatattaaaacactatctggaggtcagcgacaacgtgcatatattgctatgactatagcacaagatactgattatatattattagacgagcctttaaataatttagatatgaaacattcagtacagattatgcaaacgttacgagatttatgtcgtcagttaaataaaacaatcattatcgtattacatgatatcaactttgcttcttgttattcagacgacatcattgcgcttaaacaaggtgagctagttaaagctgatgataaagataatgttattcagtctgacattttaaaaagtttatatgaaatggaagtacgtatagaggagataaggggacaacgtatttgtctatattatgatgaaactacttttgactcagtttaa

SEQ ID NO: 2698 - DNA, 186 bp, Staphylococcus epidermidis
acctgctctgatttttttgatgcttcattctgcatgtctccttatgttcctcctatatatttaaacaccattagcgttgttaaaaagagaaactttaatataattcaacctaattatattacttttatgttctttaaatgtttaaataatatgagctttaatttacaggatatgttagttttatga

SEQ ID NO: 2699 - DNA, 1272 bp, Staphylococcus epidermidis
tcaatgcatgaaagtataaaaatacatataggtaggtgccaaatgtttttattagttaatatcattggattatttattttcctaggtataggagttattttctctagaaataggaagaatatacaatggaaatctatttttattttggttattttgaatttgtttttagcttggttctttatatattttccatggggaagagcaggggttaaaggagcagctaacggtatagcatgggttatagaatccgcacatgagggtaccggatttgcatttaaaagcttcacgtctaataaaatgatggacatggcggtaagcgcgctcttccctattttattagttgtaccattatttgacattcttatgtactttaatatacttccaaaaatcattggcggtattggttgggtacttgctaaagttacacgccaacctaagtttgaatcattttttggtgttgaaatgatgttcttaggtaatactgaagctcttgcagtttctagtgaacaacttaaacgaatgaatgaaatgcgggtactaactattgcgatgatgtctatgagttcagtttcaggagcaattgtgggcgcttatgtgcaaatgatacctggagaacttgtattgacggcaattccacttaatattattaacgcaattatagtttcttgtattttgaatcctgtatcagttgaagaacaagaagatgtcgtgtatagcattaaagatcaccaaactgaaagacaaccatttttctcatttcttggagattcagttttagcagctggaaagcttgtattaattatcattgcatttgtcattagctttgtagctttggctgacttaattgatagattgattcatttaatcacacatcttattgcaaatggtattggtgtcaaaggtagctttggtcttgatcaaatcttaggcgttttcatgtatccatttgctttactattaggtttaccgtttaatgaagcgtgggaagtagcacaacaaatggcgaagaaaattgtaacaaacgaatttgttgtgatgggggaaatttctaatcaagtcaatgcgatgacgcctcatcatagagcagttatatcaacatttttagtttcttttgcaaacttttcaactattggaatgattataggtacattgaaaggtattgttgataagaaaacgtcggatttcgtttccaaatatgtaccgatgatgttgttagcaggaattttagtatccttacttactgctgcatttgttggattatttgcttggtaa

SEQ ID NO: 2700 - DNA, 1980 bp, Staphylococcus epidermidis
cgtaaaaatgattcattactaaaaacggaggaaacaaacatgagtttacccaagaagaaaataggaatttttgcgttcttcttattaacggtattcaccattactttgaagacatatttttcatattatgttgacttttctttaggtgtcaagggtttagtacaaaacttaatattgcttatgaatccctatagtttgattgcacttgtactaagtgttttcctattttttaaaggtaagaaggcattttggttcatctttattggaggatttttacttacgtttctactatacgcaaacgttgtgtacttcagatttttctcagatttcttaacttttagtacactaaaccaggcaggcaacgttgaatcaatgggtggtgcagtaagtgcttctttcaaatggtatgactttgtctacttcattgacactattatctatcttgctattttaatatttaaacgcaaatggttagataatagagcattcagtaaaaaattcgtacccgttgtgatggctacatcagtagcattatttttcttaaatttagcgtttgcagaaacagatcgtcccgaattattaacaagaacttttgaccataaatatcttgtgaaatacttaggaccatataacttcactgtttatgatggtgtaaaaacaatcgaaaataatcagcaaaaagcactagcttctgaagacgacttaactaaagtgctgaattacactaagcagaaacgtactgaacctaatcctgaatattatggtgcagcgaaaaagaaaaatataattaaaattcaccttgaaagtttccagactttcttaatcaataaaaaggtaaatggtaaagaggttacaccgtttttaaataaattatctagtggtaaccaagattttacgtatttcccaaactttttccatcaaacagggcaaggtaaaacatctgactcagagtttacaatggacaacagtttatatggcttgccgcaaggctcagcctattcactgaagggagataatacgtatcaatcattaccagctatactagaccaaaagcaaggttatacatctaatgtaatgcatggtgactacaaaacattttggaatcgagatcaagtttataaacatttcggtattgacaatttctatgatgctacttactatgacatgtctgacgacaatattgttaatcttggtttaaaagataaaccattctttaaagcatcagcagattatcaatctaaaatgaaaaagccgttttattcacacttaattactttaactaaccactatcctttcacattagatgaagaggatgcttctattgataaacctaataccggtgactcaacagtagacggttatatacaaacggcacactatctcgaccaagctttagaggaatatattactgaccttaagaaaaaaggtctatatgataactcagtcattatgatttacggtgaccattatggtatttctgaaaatcataataatgctatggaaaaattattaggtgagaagattacaccagctaaatttacagatttaaaccgcactggcttctggttaaaagttccaggtaaatcagggggcgtaaataaagagtatgctgggcaaatggatgttatgcctacattactacatcttgttggtattgatagcaagaattacctaatgtttggttctgacatgttctctaaacaacacaataacgtagtaccgtttagaaatggtgattttatcactgaagattataagtatgtgaatggtaaaatttactcaaataaagataatgaattgcttactgaaaaacctaaagacttcgataaaaataaaaaacaagtagagaaagatcttgaaatgagtgacagcgtgttaaatggtgacttgttcagattctacaaaaatcctgactttaaaaaagtaaatcctggtaaatatgaatataaatcaggtccaaaagggaacgaaaaaaaatag

SEQ ID NO: 2701 - DNA, 750 bp, Staphylococcus epidermidis
ttattgctcgaagtgaatcatttgaatttatttttgggaaaaaagcacattcttaaagatattacattctcattacctataaatggtgaaatcattggtattgtaggacctaatggtgccggtaaatcatctcttctcaaagcatttatcggagaatttaaagcgaccggtaaacatacattatatgatcaccctatacatacacaacttagatatattacatatatcccacaaaaagctcatattgatttagattttcctataaaagtggatcaagtgatactatcaggatgttatgaagacattggatggtttaaaaaagcaagtgtagttgaaaaaacgaaacttaaccaattacttaatgatttagaactcgaccatatacgccatcgacaaattgcagaattaagtggtggacaattgcaacgtgttcttgttgcaagagcacttatgagtaatagtgatatttattgtttagacgaaccttttgttggcatcgacatttatagcgaacaacttattatgaagaaaattaaacatttaagacatatgggtaaattgattttaattgttcatcatgacttatcaaaagcagatcaatattttgaccgcattttattattaaatcaatcgttgcagtttttagggccaacaaaagaagcattatcatctgaacgattaaatgcaactttcattaattacaaagatgattcgcttttaacactatcctcacaagggagtacgaattag

SEQ ID NO: 2702 - DNA, 342 bp, Staphylococcus epidermidis
atatttttagaggtgaatagaatggctattaagctgagttcaattgaccagtttgaacaagtattagaagaaaataaatatgtttttgtattaaaacacagtgaaacttgtccaatttctgcaaatgcgtatgatcaatttaataagtttttatatgaaagagacatagatggttattatctaatcgttcaacaagagcgtaaactatctgattatatcgcagagaaaacaaacgtaaaacacgaatcaccacaagctttttattttgtagatggtgaaatgaagtggaatgcagaccacgatgatattaacgtttctcaacttgctcaagctgaggaataa

SEQ ID NO: 2703 - DNA, 828 bp, Staphylococcus epidermidis
ggagacttagatatgtcagatttattccaaaacgcaccaccctatattcaggcgcttatagccggaataatcacgtggttacttactgctttgggtgcggcagcagtttttatatttaagaaagtgaatgataaagtcttaaattcgatgcaaggttttgcagctggaatcatgatagcagcaagtttttggtcattgttacaacccgcaattgaatcgagtgaaaatagtgctatgccatggcttcctgcagcaataggttttattctcggtggcgtttttatcagggttctagattatattattccccatattcaccaaaatgcccaagataaaaaccaacaacaagagggtgtgcctacctctcttggaaaaaatgcattacttgtgttagctatcacacttcacaacatacctgaaggactatctatcggagttgcattcggtggtgttgtatctggcaacagtcacgctacatttttaggtgcgattggtctagcgataggtatcggcatacagaatattcctgaaggtgcagcactatcgatgccaatccgtgctgcaggtgcaacacgttggaaagcatttaattatggacaagcttcagcaattgttgagcctattttcgctactatcggtgctgcagcaattttagtggtaaatcctatattgccttatgcattggcgtttgctgcaggtgcaatgattttcgttgttgttgaagaactgatacctgattctcaatcaagtaacaacactgatttggcaactttaagtctaatgattggttttacaattatgatgattcttgacgttgcacttggataa

SEQ ID NO: 2704 - DNA, 288 bp, Staphylococcus epidermidis
atgttgagcctctacgtgatgaagactttgtttttgataattaatatagtacttttaaagagatttctattaaaattagtaggaatctctttttttatgaaagttggtattataaaatattttgatgtattattactgctggataaaacatttataaaattcccaaaaaatatgaaaaaactattgaaaaaagaaaatagagtctataatattgatgttaatgataatcattatcattatcattatcattactttcgtatattgaccttatacatctttaatatttag

SEQ ID NO: 2705 - DNA, 984 bp, Staphylococcus epidermidis
ataagaatagaaaaaagggttaggaagggtgagtgttcaatgagctttgcatcagatatgaaaaatgaactaacacgcatagaagttgacgaatcgaatgctaaagcagagctcagtgcattaattcgcatgaatggcgcacttagtctatcaaatcaacagtttgtaattaatgtacagacagaaaatgcgacaacagctcgtcgaatttactctcttatcaaacgtatatttaatgttgaagttgaaattttagttagaaaaaagatgaaattgaaaaaaaacaatatttatatatgtcgaacaaagatgttagcgaaagaaatactaaatgatttaggaattttaaaaaagggagtttttactcacgatattgatccggatatgattaaagatgatgaaatgaaaagaagttatttaagaggggctttcttagcaggtggttctgtaaataatcctgaaacatcttcatatcatcttgaaattttttcacaatatgaagatcattccgaaggtcttactaaattgatgaatagttatgaactcaatgcgaaacatttggaacgtaaaaaagggagtattgcgtatcttaaagaagctgaaaaaatttccgactttcttagtttgataggtggctatcaagcattgttaaagtttgaagatgtaagaattgtccgtgatatgcgtaattcggttaatcgtcttgttaattgtgaaacagcaaattttaataaaactgttagcgcagcaatgaaacaggttgaaagtatacaattaattgatgaagaaattgggcttgaaaatttacctgatcgtttaagagaagtagcgaagctcagagtagaacatcaagaaatatcgttaaaagaattgggtgagatggtttctacagggcctatatctaaatcaggtatgaatcaccgtttaagaaagttgaatgaattagcggataaaataagaaatggtgaacaaattgaattataa

SEQ ID NO: 2706 - DNA, 765 bp, Staphylococcus epidermidis
gatatgtcagattcaatcactatcattgatgaaaataaagtgattgatgtagtcttaattgctgggcgaatcttacttgaagcaggcgctgaaacatatcgaattgaggatacaatgaatcgtattgcccatagttatggtttacatgatacatacagttttgtgacatcaactgcaattattttctcattaaatgatcgtactagtacgaagttgattcgtattcgcgaacgtacaaccgatcttgagaaaattgctttaaccaatagcctatctcgtaaaatttcgagtaagcaacttacaattgacgaagcaaaaagtgagttactgcaacttaaacgtgcgtctcttcagtattctttcttaacaaatctcattgctgcctttgtagcttgtggttttttcttattcatgtttggtggcgtagcttccgacgcttggattgcatgcctagcgggtggcatagcttttttaacgtttagtttcgtgcaaaaatatatacaaattaaattcttttcagagtttgtagcatctgctgttgttattagtattgcagcaatattcactaaactaggtatagctaaaaatcaagacattattactattgcaagtgtcatgcctctcgttcccggtattttgattactaacgctattcgtgacttacttgccggagagttacttgctggtatgtcacgtggtgttgaagctgctttaactgcatttgctattggtgcaggagtagctattgtattactattattataa

SEQ ID NO: 2707 - DNA, 1791 bp, Staphylococcus epidermidis
atggttctggagaaacagaaattgactttactttacacgcaacgaaatggtgttactcgtagacgtaaaatggtttttgaaggtgtgatacctaacattgaccgtcgttaccatgaatctccctctgaatatacacgcgaaatgatgagtaaatatatgacagagttaccgtgtgaaacttgtcatggcaaacgcttaagcaaagaagcgttatctgtatacgtaggcgactataatataggtgaagtcgttgaatattcaattaaaaacgcgctttattatttcgaaaatttaaaattaagcgaccaagataaatcgattgcagatcaaattttaaaagagattatttcaagattatcatttttaaataatgttggtttggaatatttgactttagatcgctcatcagggactttatctggaggggaagcacaacgtattcgtttagcaacacaaattggttcacgattaaccggagtactatatgttttagatgaaccttctattggattacatcaaagagataatgatagattaattaatactttaaaagaaatgcgtgatttaggtaatacacttattgtcgttgaacatgacgatgatactatgagagcagctgattatttagttgatgtgggtccgggagctggtaaccacggtggagaggttgtctcaagtggtacccctaataaagtaatgaaagataaaaaatccttaactggtcaatatttaagtggaaaaaaacgaattgaagtccctgaatacagacgagaaatcaccgatagaaagattcaaattaaaggtgctaaaagtaataatttgaaaaatgtaaatgtagacttcccactatctgtcttaactgttgttacaggtgtgtcaggttctggtaaaagttcactcgtcaatgaaattttatataaagcattagctcaaaaaattaataaatctaaagtgaaacctgggaattttgatgaaattaaaggaattgatcaattagataaaatcattgatattgatcaatcgccaataggtagaacaccacgttctaacccagccacatacactggtgtctttgatgacataagagatgtctttgcacaaacgaatgaagctaaaatacgaggttatcaaaaaggtagatttagttttaatgtcaaaggtggacgatgtgaagcttgtaaaggtgatggaattataaaaattgaaatgcattttttaccagatgtctatgtaccttgtgaagtatgtgatggtaaacgctataatcgtgagactttagaggtaacatacaaaggtaaaaatattgcggatgtattagaaatgactgttgaagaagctacgcatttctttgaaaatattcctaagattaaacgtaaattacaaacacttgtagatgttgggttggggtacattactttaggtcaacaagctactacattatctggtggcgaagcgcaacgtgtaaaactcgcatcagaattgcacaaacgttcaacggggcgttctatttatattcttgatgaaccaactacaggattacatgtcgacgatataagtcgtttattaaaggtattgaatcgtatagtggaaaatggtgatacggtcgttattatcgaacacaatcttgatgttattaaaacggctgatcatattattgatttaggtccagaaggcggtgaaggtggaggaacaatcatcgcaactggtacacctgaagagattgctcaaaataaagggtcttacactggtcaatacttaaaaccagtattagagagagacagcgttgaatag

SEQ ID NO: 2708 - DNA, 402 bp, Staphylococcus epidermidis
attaatcaggaggggattctcgtggcagtaccgagcgaatttaaatattctaaagagcatgagtgggttaaaattgaaaataatgtagcaacaattggtattacagaatacgcacaaaacgaattaggtgatattgtatttgttgagctacctgaaactgacgatgaattaaatgaaggtgacacattcggtagtgtggaatcagtaaaaacagtatcagagttgtatgcgccaatttctgggaaaattgttgaagttaatgaagaattggaagatagcccagaatttgtaaatgaatcgccatacgaaaaagcatggatggttaaaattgaaattagtgacgatagtcaattagaagaattattatcagcagatcaatactcagaaatgattggtgaataa

SEQ ID NO: 2709 - DNA, 336 bp, Staphylococcus epidermidis
ttcttcaaggaggacacatcattggcaaaggtttatggatcactcatagataatgaaacacgatgtacacattattattcatctttagatgttattgccattaaatttaaatgttgcaacaaatattatccgtgttataaatgtcataatgaacacgtatctcatacaattgaaagatgggctgaaaatgagtttgatgaaaaagctattatgtgtggtgtttgtaaacatgagatgcgtattcgtgactatatgatggtagaaatgtgtcctcgttgtaaagcgcattttaacagtcgttgtaaatttcattatcatttatattttgaagtataa

SEQ ID NO: 2710 - DNA, 951 bp, Staphylococcus epidermidis
acaaaaaaggagcgctttaacgtgaaaaaaattctcgctttagcaatagcatttttaattatccttgccgcatgtgggaatcacagtaaccatgaacatcactcacatgaaggaaaattaaaagttgtaactacaaactctattctctatgacatggttaaacgtgtcggtggaaataaggtcgatgttcatagcatcgttccagtaggacaagatccacatgaatatgaggttaaacctaaagatattaaagcattaacagatgctgacgttgtattttataatggtttaaacctagaaactggaaatggttggtttgaaaaagcacttgaccaagcaggaaaatcaacaaaagataaaaatgtgatagcagcatcaaataatgttaaaccaatatacttaaatggtgaggaaggtaacaaaaacaaacaagatccacatgcatggttaagtttagagaatggaattaaatacgtaaaaacaatacaaaaatcactagaacatcatgataaaaaagataagtctacatatgaaaaacaagggaatgcatatatatcaaaattagaagaacttaataaagatagtaaaaataaatttgatgacatacccaaaaatcaacgtgccatgatgacaagtgaaggtgcatttaaatattttgctcaacaattcgatgttaaaccaggttatatttgggagataaacacagaaaaacaaggtacacctggtcaaatgaaacaagccattaaatttgttaaagataatcatttaaaacatttattagtcgaaacaagcgtagataaaaaagctatgcaaagtttatcagaagaaactaagaaagatatttatggtgaagtatttaccgactctataggtaaggaaggtactaaaggtgactcatactataaaatgatgaaatctaatattgatacaatacatggtagtatgaaataa

SEQ ID NO: 2711 - DNA, 711 bp, Staphylococcus epidermidis
aatttaagggagtattttattatgaaatccactgcgcaattaacaaaggagaataatgtcaaagctttgcgactgaacaataccgatcgtgaaatatttgaaaattacatgacatatgtgcgtgctgacttacgagttaaccctcacgattcagaattaatgttaaaccgtactttgaaacacttaattcgtgcaggtgatactggaatgcttgcgatggagtttttcaaccatgatcctaaagcacatgctaaaaaagagataagggaactcccaaatgaaacatttaaaaacatttttaaatatataagtcataacttcattcttttaataggtattttttgttttctcaaaggattgattggcttttttatagggggcgatagtaatttactatatttatatacgtttcccctaactgtcattattggtttagtaattatatttttatttatttggatgaactttaaaacggtacaattacagtgctttaacaactcttattggacctggtggctcacctatggtgtcatcgcattattattaatcactcttttttatgttttttttataccgcaatcatttttagcgtttggaccatatattaaagttagtaattggactttcatcattattgcgataataatcatccctatttcattttatgtgaatcatcacttttataataaagaagcaaatacacgcatataa

SEQ ID NO: 2712 - DNA, 1011 bp, Staphylococcus epidermidis
aagtggagggagataatgaaacaaatgaatgtagtacttattggtggtggcactggactttctgtccttgctagaggccttagagaatttccaatagacattactgccattgttactgtagcggacaatggtgggagcacggggaaaattagagatgtcatggatattccagcgcctggtgatattcgtaatgtcattgctgctttaagtgactcagaatcgatattaactcaattgttccagtaccgttttggtgaaaatcaagtagatgggcattcattaggtaatttagttattgctggaatgactaacattactaatgattttggacacgctattaaagagttaagcaaagttttaaatattaaaggccaagtcatcccttcaacaaacgcaagtgtgcaactcaacgcggtgatggaagacggtgaaattgtacatggagaaactaatatacctaaaacacataaaaaaatagatcgtgtgtttttagaaccaagtgatgttgaaccaatgaatgaagcgatagaagctttagaacaagcagatttaattgtcttaggaccaggttcattatatacaagtgttatatcaaatttatgtgtcaaaggtatttcagaagcattattacgtacatctgctccaaaactttatgtatctaatgttatgacacaaccaggcgagactgataattatgatgtcaaagagcatattgatgcacttactcgacaagttggtgaaccatttattgattttgtcatatgtagctcagaatcctatagtaaagatgttttacaacgatatgaagaaaagaattcgaaaccagtagcagtacataaagaacaattaaaagatagtggaattagagttttaacggcatctaatttagttgaaatatctaatgaacactatgtcagacataacacaaaagtattatcaaaaatgatttatgaacttgccttagaattaacaagtacaattcgctttactcctagtgataaaaagaaataa

SEQ ID NO: 2713 - DNA, 1014 bp, Staphylococcus epidermidis
aatggtctactattttgtagagggaatgaaggtgaaaaagtgattaaatttaaaaatgtcacaaagcgatatgctaataatattgctgtagataatgtaagttttaatattaaagaaggagaattttttgtgttaattggtccttcaggttgtggtaagacaacaacacttaaaatgatcaatcgtttaattcctttaagcgaaggttacatatattttaaagataaaccaattagtgattatccagtttacgaaatgcgttgggatattggatatgtactacaacaaattgcattatttcctcatatgactatcaaagaaaacattgcacaagtaccccaaatgaaaaagtggaaagataacgatattgatttacgtgtggatgaattattgacaatggtaggtttaaatcctgagcaatttaaaaatagaaaacctgatgaactatcgggtggacaacgacaaagggttggtgtagtgcgagcattagctgcagatcctcccgttattatcatggatgagccttttagtgctcttgacccaattagcagagagaagttgcaggacgatttgattcatttgcaaactcaaattaagaaaacaatagtttttgtaacgcatgatattcaagaagcgatgaaactaggtgacagaatttgtttactcaatgaagggcgtgttgaacaaattgatacacctgatagttttagaacgcgacctaaaagtgactttgtaaagcaattcatgggtagtcatttggatacaacgcataatattgtgaatcaagtgaagattaaagatttaggaattaatcggtctgtagatgacaatgcaagcgttattcattatcctgaagtagatgctgagttgtacttaaataatatttatgaagatttgtctcattatgatgcagttgtggtcaacgataaagaacaacatcgtcgatatttgttaaatagagaagatgtgtttacttatttatctcttaataaggaggaagcgacacatgaatga

SEQ ID NO: 2714 - DNA, 1125 bp, Staphylococcus epidermidis
ggtatgagtttgtttataataggtactaagttttttaaaatttcagtcaatttaaggtgtgatttatgtatgaagaaacaattagaccaattaacagcatatacgccagggctttctccagaatctttaaaaaaacagtatggcattaaaggtgaattacataaacttgcttcaaatgaaaatgtatatggtccaagtccaaaagttaaaacggctattcaatctcatttagatgaattatattattatccggaatctggatcgccaaaattaagggaagcaataagtcaacaacttaatgttgatgcatctcgtattttatttggtgcgggtttagatgaggttattctaatgatatcaagagccgtattatcaccaggagataagattatcactagtgaatctactttcggacaatattatcataatgcaattgtggaatcagctgatgttatccaagtgcctctcaaagatggtggatttgatttagatggtatgttacaacaaattgataataaaacgtctttaatttggttatgcaatcctaacaatccaactgggacttacttttcgcacgatgaattatttaatttcttaaaacgtgtcccaagtgatattcctgtattaattgacgaagcatatgtagaattcgttactgctgatgattttccagatacgctaaaattacaggaggattttgacaatgcctttttattacgtactttttctaaggcatatggattagctggattaagagtaggatatgttatagcctctgaagacgccattgaaaagtggaatatcattcgtccaccatttaatgttactagaatttcagaatatgcagcaatcgctgccttagaagatcaagagtatttgaaagaagtgacacaaaaaaatagttttgaacgagataaattttatcaaattcctcaaagtcagcattttttaccaagtcaagcgaattttgtctttgttaaaacttcaagaagtcaagcactttatgatgcattgttaaacgtaggatgtattacacgtttattccctaacggtgttagaattactattggtttaccagaacaaaataataagatgattgaagttttaaaacattttgagtattaa

SEQ ID NO: 2715 - DNA, 192 bp, Staphylococcus epidermidis
ttgaagcaacttattataagccaactttcaactcagtcatcgtctgccattatattgaaaaattttgagcagaggattactcctttatactcatcatactatataactagtagtcccatatcgtgtggttttatattaccctcctataatataaacaacatcttttacacacgatatggtggtattagttag

SEQ ID NO: 2716 - DNA, 960 bp, Staphylococcus epidermidis
ttacacaaactatttatcgaaagtaggtatatatttatgaaacaaccgtataaccatggtgttcttttctatcatgaacatagcggtttgaaagatatacataatggcataggagaagttgcaaaatctcttagttcaatgtgtaaacacctctctcttcaactcagtgaaaataaaggcgatattattaaatattgtaaatctattaaaaatgaaaattatagctctgatgtagacgttttatttattttaggtggagatggtacacttaatgaactagtaaatggcgttatgcagtatcagttaaatttaccaatcggtgtaataccaggtggtacctttaacgattttacaaaaacacttcaactgcaccctaattttaaaacagctagtgagcaattattaacatcacatgctgaatcatatgatgtgttaaaagtgaacgacttatatgtacttaatttcgttggacttggcttaatagtacaaaatgcagagaatgttcaagatggttctaaagatatattcggtaaattcagctatattggatcaaccgttaaaacgttattaaatcctgttaaatttgatttctcattgactgttgatggtgaaacaaaagaaggcaatacttcgatgatgttaatagcaaacggtcccaatataggtggtggacaaattccgctaaccgatttatcgccacaagatggaagagcaaacacatttgtatttaatgatcaaacactaaatatattgaatgatatattaaaaaaacgtgatagtatgaattggaacgaaatcacacaaggtattgatcacatatcaggtaagcacatcacactctcaacaaaccctagtatgaaagtggatattgatggcgaaattaatttagaaacaccaattgagattcaagtattacccaaagcgatacaacttcttactgcaactgaacaaaataattaa

SEQ ID NO: 2717 - DNA, 246 bp, Staphylococcus epidermidis
gttaattcttgtaaaattaaattctgtcgtttttctgatatcactgctatacctcccctaattcacttatattgtaatggctacgcttacatatttcaatcaaaatcttccattttcaatcaaaaacaatcattttatgacaaaaataaaaacacctttcagattaggtgtttgaaatggattgtatcatcacactttaagacgtacattttaattttcagaaatcattttctaagtattaaataa

SEQ ID NO: 2718 - DNA, 1125 bp, Staphylococcus epidermidis
tataatgattggaaatttaaagatggtgaaaaaatgagattgataattaaaaagatttatatcatagctattgtgcttttaaatatggtttttaaaccgtttaatataaattcgaagcacattgtgataatgatgacctttaagcaagatatactgcctattatagaggccttatgtagtgaaggataccatgtgacggttataggtaaaaaaatatatcagaaagatattaataacattaatcatgcatattttatacctgccggaaataaatatattatgagacatatgaaagtattaagtaaagcaaaggttattattttagatacgtattatttaatgatgggtggctatcagaagaaaaaagggcaaactgttattcaaacatggcatgctgctggtgcgcttaaaaattttggcttaactgatcatcaagttgatttaaaaaataaggctatggtaagacaatacaaaaaagtttatgatgctaccgattattatttggtaggtggggagaaaatggctcaatgttttatacaatcgtttgatgcatctccatcgcaaatgttaaagtttggacttccaagactgacccaatactttagaagcaatcttaagttagaacaacaacgattaaaaaagaaatatcatattacaaataaactcgcagtatatgttccgacttatagagaaggtcaagtagcacaacgtactattgataaagaaaactttgaacggcacttgccgaattatacgttattgagtcatttgcatccttcgactgttgattgtcaaacttctcattcaatcgatgttacttcattgttaattatggcggatattattataagtgattatagctcattacctattgaagcaagcgcacttaataaaccgacacttatttataattatgatgaacagcaatatgaaaaagtaagaggattgaatgaattttattatgctattccagaacgatacaaaatgagtaatgaagagtcaattatacaagcgatacaggataacgatgagcaatttcaatctttatttaatgattggcatcaatataactcaaaagatagtcttaaccagttagttcattttattaataagttggtgaaataa

SEQ ID NO: 2719 - DNA, 681 bp, Staphylococcus epidermidis
gaatatagactaattttaatattaaggaggtgtcttattatgggaatgcatcaatattttaaaagactatcagatttagaaaaattaataagattaccaggtaaatttaaatattttgaacacaatgtcgcagctcattcttttaaagtaactaaaattgcgcaatatatggctactgtcgaagaatatcatggaaataaaatcgattggaagagtctttatgaaaagtcactcaaccacgactttgctgaagtgtttacaggtgatatcaaaacaccggtaaaatacgcaagtaaggaattaaaacatttattctcccaagttgaagaagaaatggtcgatacgtttatcaaagaggagataccaacacaatatcagcacgtgtatcgtgaacgtttacaagaaggtaaagatgattctctagaaggtcaaattctatctgttgctgataaaattgatttattgtatgaaacatttggagaaatacaaaaacgtaatcctgagccactattttttgaaatatatgaaatgagtttagaaactattatacaatttgatcacttagaatctgtaaaagattttattgaaaatgttatacctgaaatgctcacagaaaactttattcctcgaactgaattacgtgaaacaacaatgtcaattctaaacagaagaaatgggtga

SEQ ID NO: 2720 - DNA, 1104 bp, Staphylococcus epidermidis
ttctcactgtgcaactctaaggaggtaaatattcacatggggctgaataaagaagctataaaaattggttttgcctatgtcggcattgttgtcggcgcaggattttcaacaggacaagaagtgatgcaatttttcacaccatttggtttatggtcatatattggagtgattatctcaggatttatacttggattcataggaagacaagtagctaagataggtactgcatttgaagcgaaaaatcacgagtccacattgcaatatgtgtttggaaaaaaatttagtaaagtttttgattatattcttgtctttttcttatttggtatagctgtcactatgatagccggatcaggttctacttttgagcaaagttttggaattcctacttggttaggcgcattaatcatgacagttttgatttacttaacattattattagattttaataaaattgtaagagctttaggactagttacaccatttttaatcataatggttattcttattgctgtgttttacctatttacaggtagtatttcattaggggaagtaaacagtgctatgcctgaaacgagtgcttggaaaggtatcttttggggattagtatacggcggattagcctttgctgtaggatttagtacgatagtagctatcggcggtgatgcgtctaagcgaagagtttcaggtgcaggagcaatgtttggtggtgtgctatacgctatcctacttgcgttaattaacttctcgcttcaaacagaatattcaaaaattaaagatgtggcaatacctacgcttaacctagcgaaaggtatacatccatggttaggtcttgtactcacagtcattatgttagctgtgatgtacaacacgattttaggtctttgttattcttttgcagcgcgtttcacagaaccttatagtaaaaaataccatatattcattattatcatgatggtgatggcatttattttaagtttcgtaggattcgctgatttaatcaatgtcttatacaaatttatgggtattgtcggattatttattgtagtagcagtattgattaaatattataaacgtaaaaaagatgatgaagagcatatcgcgtaa

SEQ ID NO: 2721 - DNA, 834 bp, Staphylococcus epidermidis
gagaaagcgtggttaagtttaatgttcgcagttggaacggttttaaaagaacatattaaaaacttctatttaattcaaagactagcacaattccaaattaaaattaccaatcataataactatctaggtattgcatgggaagtgttgaatcctgctttacaaatcatggtgtattggcttgtttttggtttaggaattagaagcaatgcacctatacacggcattccgtttgtattttggttgttagttggtataagtatgtggttctttattaatcaaggtgtcctagaaggaactaaatcaatctcacagaaattcaatcaagtggcaaagatgaatttcccactctcaatcattcctacttatattgtaacaagtaggttctatggtcatttaggattattagcaattattataatagcttgtatgttcaatggaattatcccttcaattcacattgtacaattacttatatatgtaccttttgcatatttgctaacatcgtcggtggcacttttaacatccactttggggattttaattagagatacgcagatgattatgcaagcattaatgagaatattgttttatatgtctccaattttatgggtgccaaaaaatcacggcgtaagtggtttgattcatcaaattatgttatttaatccagtatattttatcgcagaatcataccgagcagcgatattgttccatcaatggtatttcatagatcattggaagttaatgctatataacgttattatcattctcttattctttatagtaggttctattttacatagacgctatagagatcactttgcggacttcttgtaa

SEQ ID NO: 2722 - DNA, 606 bp, Staphylococcus epidermidis
gtgaagaggtgtttacaattggttaaaacattatatttaatgagacatggtcaaacagtatttaacttaaaaggtaaaatacaaggggctagtgattctcctttgactgcattaggtgtacaacaagcgaatgcagcacaacaatattttaaaacgaaaaatattcattttgactatctttattcatcaccacaacaaagagcatgtgacacgttagagaacgctgtaccaaaccaacaatattggtgtgtaaaagatcttaaagagtgggggtttggattatttgaaggggaaagtatcgagttattaagagctattaaacaacctagatatttgtatggtgacgctgttgtaccatttggtggagaatcaagatctgaagttgaacacagggtttatcgagcactctatgaaatgatggatacaacagatggagagacaattctagcagtgagtcatggtagcactattggtttgtttgtaagaaatatattagggtatgacaagggaagtaaatttgaaataggaaattgtaacattgtaaaatttgaatacgatggagaagaatttatctttaaagatttaattaatcccattaaaaaatag

SEQ ID NO: 2723 - DNA, 414 bp, Staphylococcus epidermidis
ggagaatttcgtatcatgaaaagagtcattacttatggtacatatgacttgcttcattatggtcatattgaattacttagaagagctcgtgagatgggggattatcttatcgttgcgctttctactgatgaattcaaccaaatcaaaaacaaaaaatcatattatgattatgaacaacgtaagatgatgttagagtctattagatacgtagacttagttatccctgaagaaggatggggacagaaagaaaaagatgttgatcgttttgatgttgatgtatttgtgatgggtcatgattgggaaggggagtttgacttccttaaagataagtgtgaagtcatttatcttaaccgcacagaaggtatctcaactaccaaaatcaagcaagaattatacggaaaagatacaaaataa

SEQ ID NO: 2724 - DNA, 813 bp, Staphylococcus epidermidis
gtttgtcttcgtaaaaagataatttggttgaagtatgacaggagtgattatttgtcgatattagaggtaagacagttgtcaaaagtctatggtgataagcaagctttccaagaagttttgaaagaaattaatttagatgttgatgaaggtgagtttatatcaattatgggaccttctggttcaggaaagacaactttattaaatgtacttagttcgattgattatatgactaaaggatctattacaatcaacgggaaacaacttgagaagttatctaataagcaattatctgatattagaaaaaaagatattggatttatttttcaagattataatattttaaataccttaaccgttaaagaaaatatcatgcttccactatcagttcaaaagttagataaacaaataatgcatgaacgttatcaacgtatagtagaagctttgaacattagtgatattagtgataaatatccatcagagttgtcaggtggacaacgtcaacgtacctcagcagcaagggcatttattaatttaccttcaattatatttgctgatgagcctacaggtgctttagattctaaaagtacactagatttacttaagcgtcttaaatatatgaatgaggaatttaacacaaccatacttatggtgacacatgatccagtagcggctagtttttcaaaccgtgttgtgatgttaaaggatggacaaatctttactgagttgtatcaaggtgatgatgataaacaaacgttttataaagaaattataagaacgcaaagtgtacttggtggcatcaattatgagctttaa

SEQ ID NO: 2725 - DNA, 681 bp, Staphylococcus epidermidis
  unsure (40): Identity of nucleotide at the above locations are unknown.
aaaagaattcgtgcacttcaacaggatattaataactatntgataccggagtttaaaaaatataaaaattccactcaacatttaacagcagatactaatgaggttaagcacttgaaagaggattatctaaaaactgttgaaaataaagagaaatctatatatgatttaaaagaatttgtagatttatgtaatcgctcaattaaagataatgaagatattttggattatactaaattattcgagaaaaatagaactgaagtggagtctgacattaataaagcacaaaataaagaagatgcaagtcaacttaaatcaaaattagaagaaaataatcaacaattaaaagatactgctaaaaaatatttaaattcttcaaataatgattctgattcagcgaaagaagcaatcaaaaatcatatttcaccacttattgacaaacaaattacggatattaataaaacaaatatttctgataatcatgttgataatgctagaaaaaatgcaattgagatgtattatagtttgcaaaattattatgatacgagagtagatacgattaaaactagcgaaaaattagctcaaattgatgttgatcgattgccaaaagaaggaaaagatatatcagagatggataaatcgttcaaaagagaatttaaaaaaataagagaaagtgtgaattaa

SEQ ID NO: 2726 - DNA, 222 bp, Staphylococcus epidermidis
gaattacatcgtaagaagaagggatataaaatgaaagatactcagttaacatatatattattaatcattgcaagtattttattaattgctaatggtatatttgcatttgaacgtacgttatcaatgatattaatgtcgatattatttatattagttggaatcattttattatcaacaacattgaataccatgtatcaatcatcaaaacactcaaaacgttaa

SEQ ID NO: 2727 - DNA, 537 bp, Staphylococcus epidermidis
gtgattattttgagaagattaagtaaagagaagcatcatcaagtgaatcctttatggcatatatatagaaaaattaaattcgtaaaagtgctaaagcaaacgttgattatagaaattgcaagatttgttcctagtatgaaacttaaaaataaaatatataaaaagcttttaaaaatggatgtcgggaatcatacttcatttgcatataaagtgttgcctgatttgttttatccagaatacatttcggttggcaagaatacagtcattggttataatacaacaatattaactcacgaagtacttgttgatgagtggagagtaggaaaagtcattataggcgattacactttaataggtgcaaatacgacaatattaccaggaataaccataggaaatcatgttaaaattggtgcgggtacggttgtgtctaaagatgttcccgattacagttttgcatttggtaatcctatgcaaatacaattagattcaggaggtgacaatgaatggcacaaaaagaaaataacatcattccaatga

SEQ ID NO: 2728 - DNA, 612 bp, Staphylococcus epidermidis
attatataccgggtacttattcacgaatttggccacgtcttatttaacaaactcgctggtggaaaggccaaagatcttgtcattgtgacaagccctagagaaagaaaagtcacttcacaacaaggctatgcgattacacaatctaaaggatacttaggtcagtttattacaactataggtgggtatcttatgccaccattgatgtttttaactggattggtatctattcactatcaatatccaagtatatttattactatatatttatttatttttatatattatttctttattacttcccgtaaactatcacctttgattgtcattatactcatctcaagtttactctatttagtatttaaacaagaccatcaatggttcatttacgacattgtcacattaagttaccattttattttaggcgtacttttaggtgaaatattacaatcctcatggacgatttttcgtcttacctttcaacgacctaaaccttcttgggatggcagtgctttaacgaaagttactcgagtacccacctttatctttagtttagtgtggatattattcaatctctatactgtgtatttattaatcaaatacacaatactataa

SEQ ID NO: 2729 - DNA, 468 bp, Staphylococcus epidermidis
gtatttatacgttacttaattacaaagataggagggggcaagatgaaagagaatgatgtagtacttaaatcagttacaaaaattgtagtgtttattttgttaacatttggattttatgtattttttgctggccataataatccaggtggtggctttattggtggcttgatttttagctcggcatttatcttaatgtttcttgcctttgatgtaaatgaagtgttgaaaagcttgcctattgattttaaaaaattaatgattataggttcactcatatctgttgcaactgcatcagtgcctatgttttttgggaagccatttttatatcaaactgaagcaaatgtaacatttccattactaggacatgttcatgttactactgtgactttatttgagcttggcatcttattaacagtagtaggtgtgattgttacagttatgctatctataagtgggggtagatcatga

SEQ ID NO: 2730 - DNA, 1035 bp, Staphylococcus epidermidis
atcgtgcaacgaatggaagccagtcgttttacactttttaagtattgttttgttaatatagtgattaagaaagtattgaaagagagagttatgaataaatatagaagtgtcattatatggttatttattttaatattaagcatgagcttaagtttaagctgggatgtaggaaaacttgatgatgtttttaatcaaaccatactattccaggttcgtttacctagattacttgaagccatgctcactggtgcagtacttacattagctggccaagtgtatcaaattgtgttaaataatccacttgcagatagttttacattgggattagctagtggtgcatcattaggatctggaattgctttatttttgggacttagttttttatggttccctatattttccattattttcagtttaatcacactgttacttgttttaagtgtttcagcgatgttagccaaaggatatcctgttcaaatgcttatattaacgggattactatttggtgcactattaaatgcattattgtatttgcttgttttgattaatcctaagaagatgaatccaattgctagttatctgttcggtggttttgcatcagctgaatatcaggatgttatgattattagtttgatagcatctgtcgcaatcatagtattatttttaatgcaaaaaggaattaaattactgcaagttggtgaattgaaaagtcagtctctaggattaaatgtacaacaagtaacgtatattgttcttatagtagcctccatcatgacagcagttgtggtcgcatacgttggagttattggttttataggcatgattattccacaactgattagaaaattttattggcgttatcaaataggtttacaaatgttattgaatataatcataggtgctgtagtcatgataattgcagattttataggaagtacaatgatacaacctatacaaattcctgtaggcatcgtgatggcattgctcggtgtaccagtcctattttatattttaattaaacagactaacatatga

SEQ ID NO: 2731 - DNA, 498 bp, Staphylococcus epidermidis
aatttaaaacgaatgattaagtacatctactggtgggtatcaataaaatacatacaatttgaggaggtaataatgatggcagttcaatatgaaactaaagcgactaacgtaggtggacgtaaaggtcatgtccatactgacgataatgcaataaatgtagatgtattaccaccacaacaagctgacggtaaagcgactaatccagaacaattatttgctgcaggttacgcttcatgctttaatggtgcatttgatttaattttaaaacaaaataaagtgcgcgatgctgaacctgaagtaacgttaacggtacgcttggaagacgatccagatgccgaaagcccaaaacttagcgttgatattcatgcaaaagttaaaaatgttttatcacaagaagatgctgaaaaatatttacaagatgcgcacgacttttgtccgtattcaaaagctacacgtggcaatatcgatgtaaacttaaatgttgaagtagtagaataa

SEQ ID NO: 2732 - DNA, 1674 bp, Staphylococcus epidermidis
ggagataagcgaatgaatataatcgatcaggttaaacagacgctaatagaagaaatagaagctagtattagaaaagctaacctcgcagaagatattccagaaattaaaattgaaatacctaaagatactaaaaatggagattattcttctaatattgctatggttttaacaaaaattgctaagcgtaatccacgtgaaattgcgcaagctattgtcgatcatttagatacaagcaaagcacacgttaaacaggttgatattgctgggccaggtttcatcaacttttatctggataatcaatatttaacagacattattccagaagctatcacaaaaggtgatcgatttggatatgcaacacaatctaagaatactaacattttattagaatatgtatcagctaatccaacaggagacttacatattggtcatgctaggaatgcagctgtaggcgattctttagctaatattctcattgcggctggttacaatgttacacgtgaatattatattaatgacgcaggtaatcaaatcactaatttagcacgatcaattgaagcacgatacttcgaagctttaggtgatacgagttatgagatgccggcagacggttataatggtaaagacattattgaaatcggtaaagatctcgctgttaaacatccagaaataaaagactactctgatgaagaacgcttaaaaacgtttagacaacttggtgtcgattatgaaatggaaaaattaaaaaaggatttatctgattttaacgtgcactttgataattggtttagcgaaacatctttatatgaaaatggcgcgattaaaaatacattatctaaaatgaaagagctaggctatacgtatgaagcagatggcgcgacttggttacgtacaagtgactttaaagacgataaagatcgtgtattaataaaaaaagacggtaattacacttatttcacaccagatacggcctatcactacaataagattaatagaggaaatgatattttaattgatttaatgggtgctgatcaccacggttatattaaccgtctcaaagctagcttagaaacatttggtgtagacagcgatcgtcttgaaattcaaattatgcaaatggttcgccttatgcaaaacggagaagaagtgaagatgagtaagcgtacaggcaatgcgattactttacgtgaaattatggatgaagtcggtatcgatgctgcacgttatttcttaacaatgcgtagtcctgattctcattttgactttgatttagagttagctaaagagcaatctcaagacaatccaatttattacgcacaatatgcacatgcacgaatttgttctattctaaagcaagctaaagaacaaggtattgaagtgtctactgatgcagacttttctaaaataaataatgataaagcaatagacttattaaaaaaagtagcagaattcgaatcgacgatagagagtgcagccgaacatcgtgcacctcatcgtctaactaattatattcaggatctagctgcagcattccataaattttataatgctgaaaaagtgcttacagatgatacggaaaaaactaaagcacatgtagctatgattgaagcggtgcgtattaccttgcacaatgcattagcattagtaggtgttacagcaccagaatctatgtaa

SEQ ID NO: 2733 - DNA, 234 bp, Staphylococcus epidermidis
atgaaatttagagaatggacaataacgattaacggaaaagggcctataaatgttgtagccaatgaagatactttactcatattacagaaatatcaacatgtcgaagtagcattaaaaatagataatgagacggttcaagttaaatctctcggttataacgaagatataattattaaccataatactaaagaaattacgattaatgtaaccaacttgttagaagatgatgaataa

SEQ ID NO: 2734 - DNA, 276 bp, Staphylococcus epidermidis
cttaacattagatttacatggaataaaggaggattaatgatgtctactcatagtcaatgtaactatgtcaatcctaattcaatttctttagattgggaatgtttaattataagcaaaacagatatgctactcgatggtgtacctaaagaattaattaatacttggttagatcaaaatgttatcgagccgttttgtgttcgtaataatgaaataaactttaaaactaaagatgtttggaatgctcttaagacccataactggtattattcaaattaa

SEQ ID NO: 2735 - DNA, 1710 bp, Staphylococcus epidermidis
ggtgaagatagatcaatgaaatcacatattcattttagtatagatagagatttaatatgcgctatcatggtaggtgttttaagcggaattgtaacattagcaatgttctttttaagtggttatatgattactcaaagtgcgctaggtgcgccactttatgcattaatgattttagttgtatctgttaaattgtttggttttttaagagcaattacacgctatatagaaagattactttcacacaagacgacatttacaatgttacgtaatgtacgagttcaatttttaaaaatgctatatccagtcgttccagatatctatagaagatttaattcaagtgatcttattacaaaaatgataagccgtgtagaagctttacaaaacatatatctgagagtatattacccaccgattgtaatcggattaactgcaattgtttcagtaataactatgttgtttttatctccactacatgcattagtgattactttaagtatgttattaactttatggattgttccttggttaagtgctatgaaagcacgtaaattaaagcaacaagtgacccaaacgcaaaaaacatttcttaaaagatattatgattataaagaaggtcatgaagaattaaaacgtttcaatcgcagcgatgacttcgaaaatacagtttcccagtctttacgacaatttgatgatatgcaacttaaggaacgccgatttctttctatttatgactacttgttaaacttaatagcgatgttctcaatatttatgtgtttagtgttaggtgcgcaacagattcatgatggtcagctcaatgctatttatattacaagtattatattgatgatattaactttatttgaacaagcagtacctatgagcaatgtggcatattataaagcagatacagacctggcacttgaagagatacaagaggttattgtacctaagtataaaattccttcagaacatacaaacttaaagcgttcgcaaaatcttttattagaaattaaaaatgtcacatttaaatatgaacatcaacatcattctactttaaaacagattaatctaaccattgaatatggtgataaggtggcaatcattggtccttcaggatcaggtaaaagtactttgcttcatgtattacttgggctatatcaaatagaagagggagaagtgagattaaatggtaaggatatgaacagtatcaatgacaatgataaatatcaaacatttaatgcaatgcttcaatctcaatatatttttgatggttcaattcgtgataatttattttctgagcaatcagatgataacctcaaaaaggttctcgaagatgttggattagaatatttaaatttagatagtatagttacgttagacggtcataatttatcaggtggggaagctcaacgtctaagtttagcgagattgctattaagaccttcggccggtttttggatattagatgaacctactacagcactagatattaataatacccaaaaaattataaatttgattgaatccttatcccaaacactcatcatagctacacatgatttagaaatacttccaagatttaataaaattatagtcatgaatgacggagaaataatagaaaatgattcatatcaagaattaatgcagcatgacggttatttaaaaaaagtaatagaaatgaatggaaacgaaatgaaattttttaattaa

SEQ ID NO: 2736 - DNA, 438 bp, Staphylococcus epidermidis
ttttaccaaagaaaatggacgctcaatcaacttgtagactattttagtaggtggttagatgagacaaaaggaacttttgtacatactcaaaaacaagatcatcactacatcatttacaataggaacattaaaagacctttagctattttcaaaatggttaatacaacagaagatataattacattacatcttgttgatggtaaattgatgaaacctaaatcaaagaagcaagcaaaattagaatttagacttcttaaaggaacacgtttaattatggttcatttatacgattatatccctagattattttggccaatttactatttcatacaagcaccgattcaaggacttcttatgagaggttttgaaattgattgtagaattaagcattatcaaggtcgcattcaatcaggtgagaagattaaatatactaaataa

SEQ ID NO: 2737 - DNA, 621 bp, Staphylococcus epidermidis
tataataaaagcaaggagttggtgactgtgaaagtaaaatatatagacaaacgtcactggcgtcgcctggtagagagagaatatacagaggttaaagttaataataatagatttaaaggtattataggcttggtcacgatgaaaaaggttcgtgagcctttagaggtgacggtagttggacaaaacataatagttgcagatgacaattataaatggttacagatactaccggataagaagcggtatagtatgactgtcatgtttgataataaagggaatccattagaatactactttgacattaatataaagaacattactcaaaaaggaaatgcacgtaccatcgatttatgtttagacgttctcgttctacctaatggtgagtatgaacttgtagatgaagatgatttaatgtacgcactacaaaataaacaaatttcaaagaagcaatatcatgaggcatatattatcgcccatcaattaatgattgaaatagaagataatttttcagaaatacaagataaggttatgcgttgttatcataaaatcaatcataaagcacagaaaatgaaacataaacgtccctataaagctaaaaagaaatcacaccgacgacattaa

SEQ ID NO: 2738 - DNA, 480 bp, Staphylococcus epidermidis
ttttgtaaaaggagtacaattatgacagactcaaatgctaaagaaataagaactggacgtttaattgcgataagttcattagtgttttgtattttacttatcatacaccactttattgtattagatgaatcaacagctaaatcaattttatctttagctggtcaaaaaacatcagatacagcagtgaaaaacattttaaatagtgaccgatacactggaattatgtatattttagcttacttagcaggtactgttgctttctggaatcgccatccatatttatggtggtttatgtttgccgtatatatttctaatgcactatttacactcgtaaatctttacttatttattcaaggtattttagatgtaaaaaatgtacttgcagttttaccaattttaattgtagtgattggatctataattctagcaatttatatgctagttgtttctattacacgtaaaagtactttcaatagatag

SEQ ID NO: 2739 - DNA, 2052 bp, Staphylococcus epidermidis
agaggtgaaagtgtggagatatttgaaactctactcatatttgtcgcactagttattgtgagctcctttgtacatactttcatacctaaagtacctcttgcatttatccaaattttccttgggatgattttatacctcactcccattccagttgaattcaattttgattctgaattatttatggttacattgattgcaccactactattcgttgagggtgttaatgtttcaagagtacatttaaggaagtatatcaaacctgttatgatgatggctctaggtcttgtcataactaccgttataggcgtaggattgtttattcattggatttggcctgaattacctataggtgctgctttcgcaattgcggctatactttgtcctacagacgctgttgcggtacaagcaatcacgaaaggtaaggttttaccaaaaggttcaatgaccattcttgaaggtgaatctttacttaatgatgctgcaggtatcatttcatttaaaattgccgtaggtgtattgattactggaactttttccatttttgatgcgattcaacaatttttgattgcctctattggaggtgctattgttggtctaattataggcatggctttagtgagatttcgtttaacattaatgagacgtggcattgagaacattaacatgtttacatttatacaattgctgacgccgtttgtcacttatttgattgctgaattattccatgcatcagggattattgcagcagtagttgcgggactcgtgcatggatttgaacgtgaccgtatagctcaaacgagaacacaattacagatgagctataatcacacatggagtattttaggctacgttttaaatggttttgtgttttcaatcttaggttttttagtacctgaggtaatagtgaaaattattaaaactgaaccgcataatttattattcttaatcgtcatcacattgctagtcgctcttgcggtgtatctctttagatttgtgtgggtatatgtactttatccttatttctatttatctgtcagtccattccaaaaaatgatttctaaaaatgatgaagataaagttactgagagtaaacctaagcgtagcttatatgcactaatcatgactctatgtggtgtacatggaaccatttcactcgcaatcgccttaaccttgccatatttattagcaaatcatgaaacatttgcttatcgaaatgatttattatttattgcttccggaatggtaatattaagtttaattattgcacaagtcattctgcctttagtaacgcctgatagccctgaagtgaagataggtaatatgtcatttaaagaggcgagaatctacattttagaacatgttatcgattacctaaatcaaaaatcgacgtttgaaacgagttaccgttatggaaacgtcattaaagattaccacgataaactcacatttttaaaaacggttgaaaaggaagatgaaaactccaaagaactagaacgacttcaaaagattgcatttaacgtagaaacaaaaacgctagagaaattggttgatgatggcgaaattactgagagtgttcttgaaaactatatgcgttacgctgaacgaacagaagtgtataaacaagcttcgttattaagacgaattattgttggtttaagaggaatgctattgaaacgtcgtgtaaaaacaaaaattaattcggcatcatctcttagtgttactgataacttattagaattgggtaaaatcaataagcttgttcattataacgtcgtaagtcgtttagccaaagaagctactactgataataaactagaagtaggtatgatttgcgatggatatctgatgagaatagataacttaacaccaaacaatttctttaattccagacatgaagatacacttaccaaaattaaattaaatgctttaagagaacaacgtcgtattctaagagaactaattgaaaatgatgagataacagaaggtactgcattaaaattaagagaatccattaattatgatgaaatggtaattgtagatagtatgacataa

SEQ ID NO: 2740 - DNA, 312 bp, Staphylococcus epidermidis
gaggagagaagaacgatgcatgaacaagattttaatattctagaaggtaaaaagatgacattagtagaattaggtcgtgagttagagaatctaactggtcgtactattaaagatacaacaagtgatattaaacgagtcattgcacatttgcctaactttgaatcagatacagatacatttgtagcaacataccaccttaatcatcaaaatgattttattgatgcaacatttgttgcacctaaaaatcaaagtgatcgtttgaaagaaataccggtacacattaagttgattagttatatttctaaaaactaa

SEQ ID NO: 2741 - DNA, 750 bp, Staphylococcus epidermidis
aatattaagaggtcattgaaaatgaatttaaactgcattaaggctatcgtctttgatttagaaggtactctattagatagagtaaaatcgcgtgaaaagtttatagaagagcaatatgaacggtttcatgattattttattcatgtgcaattagcagattataagaataaatttattgaattagacgatgatgaagacaacgataaacctgatctatataaggaaatcattaaacaatttcatatcgaccgtcttaaatggaaagatttatttaatgactttgaaatgcatttctatcgttacgttttcccttactatgatactttgtatacattagaaaagttatcgaaacatcattacatgattggtgtgattgcaaatgggaaatccaaaattaaacaatttagattgcattcattgggtattatgcacgttattaattatttaactacttctgaaactgtaggctatcgtaagccacatcctaaaatctttgaagatatgattgatcaattgggggttaaaccatctgaaataatgtatgtcggagatgatgcattaaacgatgttgctcctgcacgtgcaatggggatggtaagtgtgtggtataaacaagaagatgcagaattggagccattaacagaagaagtagattatacgattactaccatagaggaattgcttaaaattttaccagataattttgaaacagaaggagaagaacaacatggcaatggatttaattactaa

SEQ ID NO: 2742 - DNA, 537 bp, Staphylococcus epidermidis
tttggaaagagctgtactataatgtttgtgaattatttcacaatatctaaggagtggttgtatatgttatctgtaactaaaaaaaatacatatgaatcaaacaaagatgaagtcacacaaatgattgattcattagcagaaaaaggacaagaagctctaaaagaactatctaaaaaatcacaacatgagattaatgacattgtacatcagatgagcatggctgctgttgatcagcatatgcatttagctaaactagcttacgacgaaacaggtagaggtatttatgaagacaaagctatcaaaaatttatatgcctcagagtacatatggaattcaatcaaagacaataaaacagtaggtatcataggtgaagataaacaaaaaggattaacgtatgtagctgaacctataggcgtgatttgtggagtgacaccaacgaccaaccctacatctacaactattttcaaagcaatgattgctattaaaacaggtaatccaattattttcgcatttcatccaagtgcacaacaatcataa

SEQ ID NO: 2743 - DNA, 315 bp, Staphylococcus epidermidis
atcaaggagagtatgataaaaatgaatgaagataaccgtaacaaacaaattaaatttgaaagaaacctaatcacttttccatatttaggttttgcctttattgttttattatttaatattttttatactgatgtaaaaattacaatggtcttatttggtctattctttgcttacaatttaggaatgctttttatagccttcataagacattttaaacgtacacttatattaaccttaatactaacaatattaagtggtatagcattttttgtactactttatgtttttggattaaatcacgatatttttggatag

SEQ ID NO: 2744 - DNA, 465 bp, Staphylococcus epidermidis
aatgtctggaggagaactttaatgtctgaacaacataatttaaaagagcagctatgctttagtttgtacaatgctcaaagacaagttaatcgctactattctaacaaagtctttaaaaagtacaatctaacatacccacaatttcttgttttaacaatattatgggatgaatcacctgttaacgtcaaaaaggtcgttacagaattagcacttgatactggaactgtatcgccattactcaagagaatggaacaagttgatttaatcaaacgtgaacgttctgaagtagatcaacgtgaagtatttattcacttaacagacaaaagtgaaatgattaggcccgaattaagcaacgcatctgagaaagttgcaaccgcttcttctttatctaaagaagaggtcaaagaacttaatcgcttattaggtaaagtcatcgatgcatttatcgaaacaaaagaaaagtaa

SEQ ID NO: 2745 - DNA, 306 bp, Staphylococcus epidermidis
catagtcggaggcagattttgatggaaaaccttacaaaagaacaaaaatatacaatagctaaattttataaattatatatggaaagatctaatgcggggcaaccagaagaagaagctaatcattttaaagattctgtaacggcacaagatgattatttttgtgatagaaaatatgaagatttcattcataactgtaaagtcttaataaatgaaggttacttagatggcgaggttgaagataacaaaatatataatattcaggttacaacaaaagcttttacagaaattgagcgtagctttggttaa

SEQ ID NO: 2746 - DNA, 939 bp, Staphylococcus epidermidis
ttttataggagggaaatcatgatatatacagttaccttcaatccttcaatcgattacatcatttttactgatggatttgaaatatcaggattaaaccgggcaaaagcaacgtataaatttgcaggaggtaagggaatcaatgtatcaagagtacttaaaactttagatgttgattctacagccttaggattttcaggaggtttccctggagattttattgctcaaacacttgaggacagtaatatccaatcagattttgttcaagtagatgaggatacgcgtattaatgtaaaactaaaatcaggtcaagaaacagaaatcaatgcacccggacctaaagtgacacacgcgcaatttgaacaacttttatctcaaatacgtcgtactacaaacgacgatattgttattgtagctggaagtgtaccgaacagtattccaagtgatgcttatgcacaaatagcacaaatcactgaaaaaactggtgcgcaactagttgttgatgcagaaaaagatcttgttgaaacagtattaccatatcgaccattatttattaaaccaaacaaagatgaattagaagtaatgtttaacactacagtcaagagtgatgaagatgttataaaatatggtaaagaaattttgaaaaaaggggcacaatcagtcatcatttcacttggtggcgatggtgcaatatatgttgatcaacatcaaagcattaaagctgtgaatccacaaggacatgtagttaatacagtaggatctggtgatagtacagtggcaggtatggtagcagggttgtccatgggtcttaatatagatgaagcttttcaacaggccgtagcttcaggaacagcgactgctttttcagaagatttagcgacaagagatgctatagaaaatattaaatctcaagtgacaatttctgtacttgatggggagtga

SEQ ID NO: 2747 - DNA, 2406 bp, Staphylococcus epidermidis
agatgtaggagagaaaggaggggcataatgaatttaaagcaatccatcgaagaaatgataaaacaacctgactatgaacccatgtcagtatctgactttcaagatgcgttaggtttaaacagtgccgactcatttagagatttaattaaaatactcgttgaattagaacagtctggtttaattgaacgtacaagaacagacagatatcaacgtaaacaatccaacaaaacaaattcaaaactaatcaaaggaacgttaagtcaaaataaaaaaggctttgctttcttaagacctgaagatgacgagatggatgatatttttattccaccaactaaaatcaatagagcattagatggagatactgtcatcgtggaaattcaaaaatctcgtggagaacataaaggtaaaattgaaggtgaagtaaaatctattgaaaagcattcagttacacaagttgttggaacgtatagcgaagcaaagcattttggtttcgtattaccggatgacaaacgtattatgcaagatatctttatacctaaaggacaaaatttaggtgctgtagatggtcataaagtattagtacaaattacgaagtatgccgatagtactgacaatccagaaggccacgtctcagcaatattaggtcataaaaatgatccaggtgtagatatactttccatcatttaccagcatggaatagaaatcgagtttccagatgatgtattacaagaagctgaagaagtaccggatgtaatagaaccatctgaaatcgaagggcgtcgtgatttaagagatgaattaacaatcactatagatggcgcagatgctaaagatttagatgatgccattgctgtaaaaaaattaaaaaatggcaacaccgagcttacagttagtattgcagatgtaagttactatgtaaaagaaggatcagctttagataaagaagcttatgatcgtgcgacaagtgtgtatcttgtcgatcgagtaatcccgatgattccacaccgtctaagtaatggaatatgctcattaaatccagaagaagatcgtttaacattaagttgtcgaatggaaataaatgaacgaggcgaagttgtaaaacatgaaatctttgatagtgtaatacattcaaactacagaatgacatatgatgcagttaacaaaattatcactgatcaagattctgaaatacgttcacaatataaagatttaacacctatgttagatttagcgcaagatttatcaaatagattaattcatatgcgcaaacgtcgtggagaaattgattttgatattaatgaagcgaaagtacttgtgaatgacgaaggtattccaacagaagtgctaatgagagaacgtggcgaaggagaacgtttaattgaatcattcatgttagcagccaatgaaacagtagctgaacacttcaataaattggaagtaccatttatttatcgtgttcatgaacaaccaaaatctgaccgattaagacagttcttcgactttattaccaatttcggtattatgataaaaggtacaggtgaagatattcatccaacaacattacaaagcattcaagaagaagttgaaggtagaccagaacaaatggttatttcaacgatgatgttacgttctatgcaacaagcacattatgatgatgttaatttaggacattttggtttgtctgctgagtactatactcactttacgtctccaatacgccgttatcctgatttaacagtgcatagattaattcgtaaatatttaatagagaattctatggataaaaaagaaatacgtcattgggaagagacgttgccagaattagctgagcacacatcacaacgtgaacgccgtgccattgaagccgaacgtgatactgatgaattgaaaaaagctgagtatatgattcaacatattggtgatgaatttgaaggtatcattagctcggttgctaattttggtatgtttatagaattacctaatactattgagggtatggttcatatcgctaatatgacagacgattattatcattttgatgaacgacaaatggcactaatcggtgaacgtcaagcaaaggtctttcgcattggtgatacggtcaaagttaaagtgacacatgttgatgtggaagaacgcatgatagatttccaaattgttggcatgccattacctaaaaagacatcatcacaacgacctgctcgtgagaaaaccattcaagctaaaacacgtggcaagtcgttagaccacactaaaagtgatcgtaatggtaaaggtaaaaagaaaaaacgtaagcaacgtaaaggtaaaaatgcacgtaaaaaagataaacaaggtaatacgcatcacaaacctttttataaagataaaagtgtgaagaagaaatcgcgtcgaaagaaaaaatag

SEQ ID NO: 2748 - DNA, 525 bp, Staphylococcus epidermidis
caaaacaggagtgttgatatgacacatctcattcgtgaaattagtattaaagacgttgaaaactttatcagcctattaagccaaatatatgatgaatcagaatttacattctacaatccaggtgaatatttaccaacgatatcttccgcaagtcaacacttagaaaaatacatcacctcacctaccaaagcaatatatgtcgctgaaagtgatgagcaacttgttggatacgtatttgttaatactgaaacttatgaacgtacacagcacgaagctgtggtgtaccttggtgttagagaatattaccaacatcaaggtattggacaagcacttatcaatagaattgaagcatgggctttaaatcatcatattcgacgtattgaagctacggttgttactgaaaacattaacgcaatagaattgtttaaaggcatgggctttcaaatcgaaggtgaacttaaagataagctttttataaaccaaaaatattataacgaatatgtaatggctaaaatattaaattaa

SEQ ID NO: 2749 - DNA, 210 bp, Staphylococcus epidermidis
  unsure (174): Identity of nucleotide at the above locations are unknown.
aatgtgtttggaactaataatagaaatatgagtccgaaaacaataaataagggccattcaaaagctttgactggtttgaacaattttaaaagtagacaaagttcaaatggcacgtatgctaaaaataaatttaacgtcataaagttaaaaatatgtgattcagtcatagatatnacaaataagataataaagtatattcttgcaaagtaa

SEQ ID NO: 2750 - DNA, 663 bp, Staphylococcus epidermidis
attgtaggtggcaaaaataagatggataaatccataattactattaaacaagcacattcaattgaaaatgtgataagtaaatcacgctttatagcatatattaagcctgtttcgactgaaaatgaagcaaaagcttttatagatgaaattaaaacaaaacataaagatgcaactcataattgttcagcctatactgtcggaccagagatgaatattcaaaaggcaaacgacgatggcgaaccaagtggaacagctggcatcccaatgcttgaaatactgaaaaaacaagagatacacaatgtttgtgtcgtcgtgacacgctacttcggtggtatcaagttaggtgcaggcggtcttattagagcatatagcggcgccgtgcgtgatgtgatatatgatataggtagagtcgaactaagagaagctattccagtaaccgttacgttagattatgatcagacaggtaaatttgaatatgaacttgcctctactacattcttattaagagaacaattttataccgataaagtaagttatcaaattgacgtagtaaaaaatgaatatgatgcttttatagactttttaaatcgaattacttctggaaattatgatttgaaacaagaagaccttaaactattaccttttgatattgaaaccaattaa

SEQ ID NO: 2751 - DNA, 1065 bp, Staphylococcus epidermidis
atcaaattagggggtctctttgacttagaaaataaagagacgaacatacaagagtatgaagaaatgatgactgatcctgatttttggaatgatcaaactaaagcacaagatatcattgataagaacaatgcactaaaatctatagtaaatgggtattatcaactgacaaatgctgtcgatgatatgagtgcgacgagagagttattacaagaagaatatgatgaggatatgaagatagaattagaagaggaagttcagcaatttgaagaacaaattgatcaatatgagttacaattactcctcgacggaccacatgatgcaaataatgctatattagagcttcatcccggtgctggcggtacagaatcacaagattgggtaagtatgcttcttaggatgtatcaacgttactgtgaacaaaatggctttaaagttgaaacggttgattatcttccaggagatgaagcaggcgttaaaagtgtcacattacttattaaaggacataatgcttatggttatttaaaggcagaaaaaggtgttcatcgtttagttagaatttcacctttcgattcatctggtagacgccatacttcttttgcatcatgtgatgttattcctgattttaataatgatgaaattgaaatcgagattaacccagatgatatcacagtggatacttttagagcttcaggcgctggtggacaacatattaacaaaactgagtctgcaattagaattacacatcaccctacaggtattgtagtcaacaaccaaaatgaacgatctcaaataaaaaatagagaagctgcaatgaaaatgttgaagtccaaactttatcaattaaagttagaagagcaagagcaagaaatggctgaaattcgaggcgaacaaaaagacattggatggggaagtcagattcgttcttacgtctttcatccatattcaatgattaaagatcatcgtacgaatgaagaaactggtaaagtagacgctgttatggatggagaaataggcccattcatagaagcttatttaagaaaagaaatggatagtcgagacgtataa

SEQ ID NO: 2752 - DNA, 696 bp, Staphylococcus epidermidis
caattaaaaggggatggattgatgcgtaaatgtatccagtgcaatcaacctattcatgagaccattcatatttataacttatttaaaccacctcagatattttgtgaacgatgtgaaacattatggcttaactccaaaattcataaagatggtaggtgtcctaagtgccttaacaacaaaatttctactgatggcgaatgtcatgactgtcaattcttaagtaaaacattttatttaatggaacaattgttttgtgattatagttatgatggtatgatgaaagaaatcatacaccagtataagattaagcgagacttctatttggcagaagtattggcgagaaaattagttttacctcaaacgcaatatgattatatagttcccattccttctccaattgaacgcgacattgaacgtacatttaatcctgtgaccactgtcttagataaaatgggcatctcatatcaagatgtattaggtacacatatacgtcctaagcagtcaaagttaggaaagattgaacgttcaaaagcccctaatccattttatataaaagatgaagagataaatatcgaagggaaagtaatactactcatagatgatatttatacaacagggttaactattcatcacgcagggtgtaaattgtacgataaaaaagtcagaaaattcaaagtgtttgcgtttgcacgataa

SEQ ID NO: 2753 - DNA, 681 bp, Staphylococcus epidermidis
tatagaaaaggagttattataatgtcacaatcgacacaccaatcaactgatcataaaagacaatctcaagataagaaccaaacacatgcctatgcaaaagtttggttatattttatgtattattggatgatttttgggattggttgttattttggacaatatcttcctatgtcatggagaaaaccattgtctctaggattgttaattctgatattagcaacgttgtttattaaacgtgcgcgaaaatatggattagtgatctctcatatatacgctattattgtaggtttgctttcgtatgctctttttacgacttacttacaaaatttaggagcagaagtattctataaaaatattattcttgctattggtgcatttatagcttttggtattataggttactttttaataaaagacgcttcgagtatgggaaaatatttgtttgtgacattaattgcgctaattatagctgggattatagggatatttattaataatccaatttttcatactgtcattacaatagtgagcttattattgtttctcctttatactttatacgattttaatagaatgaaaagaggtcaattctcaccaagagaaatgggatttaatttgtttatcaacttattaaatatcatcgaagatatacttagtttagcaaatcgctttaaaaactaa

SEQ ID NO: 2754 - DNA, 204 bp, Staphylococcus epidermidis
cgcttgagaggttcatccactttaataatatctttaggaagaattgactctaatccgcgtaagatgtcatttttattcaatgttttgaacatcctttctcatcttcttaatatcaacattattatatcaattataaaagttatttgcgaaatttggatatatgaattgattataaatataaaatggttatgtcgtactttatga

SEQ ID NO: 2755 - DNA, 795 bp, Staphylococcus epidermidis
ctaaagggaggtgccaagatgaataaaattcaaatttgtaatcagattgaacttaactatattgatgaaggcgaaggcatccccatcattttaattcatggattagatggaaacttggcaggatttaaagatttaaaaaatgaactcaagaagcagtatagagtaattacttatgatgtcagaggtcatggaaaatcttcacgaacagaatcatatgaattaaaagatcatgttgaagatttaaatgatttaatgggagcattaaatatcgattctgcacatattttaggacatgatatggggggcatcattgcgagtgaatttactgaaaaatatcaatataaagtgattacattgacaattgtttcggccaaaagtgaagacattgcaaatggtttcaacaaattaatggttgattaccaagaagaattagcaggctttaataaatctgaggcaatgattattttattctctaaattatttaaagagaaagataaagcaatgaaatggtatcaaagccaaaaattatacaatagaccaactccggaagaaagtgcaattgcagtacgtgcattgcttaatattaaagatttaactcgtgttcatcataatgtgtccatacctactttaattgtgaatggtaagtatgacccactcatacaaaataaaagtcattatgatatggatcaatattatgatcaagttacaaaaattgtatttgataattcaggacatgcaccacatatcgaggaaccagaaaaattcctgaaactctacttagattttgttagttaa

SEQ ID NO: 2756 - DNA, 777 bp, Staphylococcus epidermidis
attaggggaggtatagcagtgatatcagaaaaacgacagaatttaattttacaagaattaactcaaaaggactttttaacacttcaagatttagttgatagaacaggatgtagtgcatcaactatacgaagagatttatctaagttgcagaatatgggtaaattacaacgagtacatggtggtgctacaattcatcaaaatcgagttaaggaacctaagttatctgaaaaaagaactcagaatttacgtgaaaaacaagaaatcgctaaacgtgctgcatgtgatatccaagatcatgaatgtatatttctagatgcgggttcctcaacttttgagttaattcaatatattgaggcaaaagatattactgttgtaacaaacggaatgacacatgttgaagaactattaaagcacggtattaaaactttaatggttggtggccaagttaaacctacgacaatggctacagttggtgctaacgcgttagaaacattaagacgttattgttttgatcgtgcttttataggaatgaacggtattgatgtgaaatatggattaacaacccctgatgaacaagaagctttgattaaagaaacagctatgaaactatcaaatcacaaatatgtgcttgtcgatcaatcaaagtttaatcaaatttattttgcaagagttccaattttagatggacttagcatcataacttcgcaaaaagcaatgcaaagcaagatgactgaagcttacatgaatgaatttaattttataggagggaaatcatga

SEQ ID NO: 2757 - DNA, 1182 bp, Staphylococcus epidermidis
aaaaaaaggggggttcctatgaaaaaacaattattcattctttattttaatatatttcttatatttttagggattggattagttattcctgtacttcctgtatatttgaaggatttaggattaaaaggtagtgacttaggaatgctagttgctgcttttgcattatcacaaatgattatttcaccatttggtgggacactagctgataaattgggtaaaaaattaattatatgtatcggtttagtattctttgctgtctctgaatttatgttcgcagccggtcaaagttttaccattttaatcatttcacgtgttttaggtggctttagtgcaggcatggtcatgcctggtgtaacaggtatgattgcagatatttctccaggagctgataaagctaaaaactttggttacatgtcggcaattattaattcaggttttatattaggacctggatttggaggctttttagctgaaatttcacatagattacctttctatgttgctggaacattaggtgttgttgcattcattatgtcagttttattaattcataatcctcaaaaagcaactacagatggattccaccaatatcaacctgaattattcactaaaattaattggaaagtatttattactccagtcatattaacacttgtattagcatttggtttatctgcttttgaaacattattttctttatatacagctgacaaagtaaattatactcctaaagatatttcgatagctattatcggtggaggcgtgtttggcgcattattccaagtattcttctttgataaatttatgaaatatatgagtgaacttaattttattgcatggtcattactatattcagccattgttctcgttatgttagtgcttgcaaacggttattggacgattatgattattagctttgttgtttttataggttttgatatgattagaccagctttaaccaattacttctcgaatatagcaggcaaacggcaaggttttgcaggtggattgaattcaacttttaccagtatgggtaactttataggtcctcttgtagctggtgcattattcgatgttaatttagagtttcctttatatatggctattgcggtttcattaagtggaattatcattatttttattgaaaaaggacttaagtcacgccgtaaagaagcaaattaa

SEQ ID NO: 2758 - DNA, 456 bp, Staphylococcus epidermidis
agaattttcttgcattttatttttttcttcaccagaattatggtacttaggacttctttttttaaattcctcaaattccttcatttcttcctcattcatgtcattaaatcgattgatcacttcacctgtacttttgtttactacagcacaaaattttataggagttccggctgcatctcttacaaggtgttcaacataatattcattagcattgcttctatctatatttgttttaaattcaagaacttgttgcttattaatccctttattaatgtaatagttcgagacaatttgttctgcttcttgagcggaaatttgtttttgagctgttttttgtttttgattactattagaatttgttacgctcccattagtttgcatattatccgttttattttgttcttcttttggattgctttctgttttttttacattttcttgtccacatgctgttaa

SEQ ID NO: 2759 - DNA, 930 bp, Staphylococcus epidermidis
atcactttcttaactcactgtgttatatttattttcaacaaaatcttctattcactttacactaggttaataaatttaacaactgatgtgttgtatattataatctatataaatgtttataaggaaggtacaaaaatgagcgtttcggtaaatattgaaaatttaacaaaagaataccgtatctatagaaataataaagatagaattaaagatgcattaatacctaaaaacaaaaataaaacattttacgctctggataacgtaagtttaacagcgcatgagggagatgtgataggtttagtcggcatcaacggttcaggtaagtctactttaagtaatatgattggtggctctatttcaccaagttccggtgaaataacgagacatggtgatgtgagtgtcatcgctattaatgcaggactaaatggacaattgacaggtgtagaaaatattgaatttaaaatgctctgcatgggctttaaaaggaaagaaattaaaaaattaatgccggaaattatagaatttagtgaactcggcgaatttatttatcaacctgttaaaaaatattcaagtggtatgcgtgcaaaacttggattttcaattaatattactgttaatcctgacatattagttattgacgaagcattatcagtaggcgatcaaacatttactcaaaaatgtttagataaaatttatgaatttaaagcggctaaaaaaacaatattttttgttagtcataatattagacaagtgcgtgaattttgtacaaaaatcgcttggattgagggcggtaaactaaaagaattcggcgaacttgaagaagtattacctgattatgaggcgtttcttaaaacttttaagaaaaaatctaaagcagaacaaaaggaatttagaaataaattagatgagtcacgttttgtcgtaaaataa

SEQ ID NO: 2760 - DNA, 1368 bp, Staphylococcus epidermidis
aattcacttatgatattatcatctttgttatataactcatataaagaatggtggaaatttatgagcaaagtaaataaacctttatatttctatcttatgttatttctgttgacaactttaattggtgcttttctactctatttgccctatacagggaagaaacccattaactttattgacgcattgtttgtagcttctagcgcattcacagtaacaggtctatcaccagttgatgttggaacacaatttaatatttttggagaaatcattatcttattacttatacaaattggtggattaggtattgtcactgtagcaatgctaactctcatctttttaaataagaaaatatcaattaacaatagaattttatttatgattacttggaatattgacgaacccggtggtgtaattaaacttattaaacatctagccatatacagcatcgccactgaattatttggtacactttgtctatgtttatcgtttattccaaaatttggcataggtaaaggtctatttttaagtttattcacttcagtttccgcatttaacaacgcaggattcgccctttttaaaaacaacttaatcgatttttcaaatgatccggtaatcattatcactattccaatacttatcattttgggaggtttgggacatttagtcgtggttgatttgtggaacgccaaaagttttagaaaattatccttacactctaaactcgtgttaactaccactggattattaattttgataggcacggttttcttctttttactagaaaatcaaaactctatgttacacatgggattaattgaaaaaataggaaatgcatttttccaatcagtgacaacaaggactgcaggatttaacacaattgacgttggaaacattaaaacaccgacagctttattacttatggctctcatgtttattggaggtgcaccattgagtgctgcaggtggtataaaggttacaacttttgttattgcaacaatcgctatttttaatacgatacgcaaagaaaaaaacaactctatatttaatagagaaatatcagaaagatacatacagttgtctttcgtaactattctcatttctattgcatttatcggtatggttacgtttatacttaccataatcaattccaatatacctttaatcaaaatactcttcgaagtcgtatcagcattcggtacagtcggtctcactatggatttaacttccgaatactataattggactgagtttattattatcatcgtaatgttatgtggtaaaattggattactgaatattagtagagcgcttgttccacctaaagaccctaaaaattatagatataccaaaggacacattcacttataa

SEQ ID NO: 2761 - DNA, 726 bp, Staphylococcus epidermidis
gatgacattatgggacgtaaatggaacaacattaaagagaaaaaagcccaaaaagataaaaatactagtagaatatatgccaaatttggtaaagaaatatatgtagctgcaaagtctggtgagcctaatccagagtcaaatcaaactttaagattagtattagaacgtgcaaaaacatattcagtacctaatcatattatagatagagctattgataaggctaaaggcgctggtgacgaaaactacgatcacttaagatatgaaggttttggtccgaatggttcaatgcttatagttgacgcattaacaaacaatgtaaatcgtacagcatcagatgtacgtgctgcgttcggtaagaatggaggaaatatgggagtatctggttcagtagcttatatgtttgaccatactgcaacctttggtgtagaaggtaaatctgtagatgaagtcttagaaacactaatggagcaagatattgatgtaagagatgtaattgatgacaatggcttgactattgtttacgcagaaccagatcaatttgcacaagttcaggatgcattacgtgaagctggcgttgaggaatttaaagtagcagagtttgaaatgttacctcaaactgatattgagttgtctgaagaggatcaagctatttttgaaaaattaatcgatgcacttgaagacttggaagatgttcaaaatgttttccataatgtagatttaaaataa

SEQ ID NO: 2762 - DNA, 507 bp, Staphylococcus epidermidis
atgattgttataaagggtgagaatatgtctaaaactaaaaaaacaaatgcaatgcggattttagatagagctaaaattaattatcaaatgaatacttacgaagttactgacaagcatcaacatggagaagagattgcacaactcgtaggtgctaaaatagaagaagtctttaaaacacttgtactagagaattccaatcatgaacactatgtttttgtcattccagttaatgaaaccttagatatgaagaaggcggctcatgttgttaatgaaaagaaattgaatttaatgcctctcgatcaattaaaacaagtaacagggtatgttagaggaggatgttcacctatcggtatgaaacattcctttaaaacgacgattgatgcttccgctaaaaatttagaaaaagtttatattagcggaggtcaaagaggaatgcaaattatcattcatgtgaatgatttaattgacatgacaaaggctcaggtagaatctattacacagaattaa

SEQ ID NO: 2763 - DNA, 627 bp, Staphylococcus epidermidis
  unsure (57): Identity of nucleotide at the above locations are unknown.
tgcgtggttatgcaatctcgttactttgcaagaatatactttattatcttatttgtnatatctatgactgaatcacatatttttaactttatgacgttaaatttatttttagcatacgtgccatttgaactttgtctacttttaaaattgttcaaaccagtcaaagcttttgaatggcccttatttattgttttcggactcatatttctattattagttccaaacacattttatatgattaccgatctcatacacttaaaccaatttcaatttaactttttagctggattaaacatcacagaatggatttatttcacctatttaatacttggcgtactcttagcaatatacctcacaattcttatatttttagaaattgcacattttacgtcttatgtatggttaaatcgactattgatagttatattaatgttcttaaatggattaggtatttacatcggtcgattcttaagattacatactgtctatttattaaatgcacctttaaaaattgtgaaagaggtttttttaatcatagatgttaaagcgttactatttgtcgttttaatggtgctcatacaagcaacagtcatattgtttattaaaggggtgagattataccaatga

SEQ ID NO: 2764 - DNA, 240 bp, Staphylococcus epidermidis
ggaggaatttttatgattacaaaagaagatattgttgcagatgttgtaacagattatcctaaaagtgcagatatatttagaaatgctggaatagatttttgttgtggcggacaagagagtatcgcttcagctgtcaatcataaaccaaatattgacttaaattccttattaaataagttgaatcatattgataatacagaaggtaacagtaccattaatcctggaacttttaaatggtga

SEQ ID NO: 2765 - DNA, 909 bp, Staphylococcus epidermidis
ggtgaaactatgaaacgctatttaattactggtggaactggcatggtcggttcccacttggtcaacgaaattaaacaaaccgatgcacatattacaattttaaccagacaggataaaacttctaatcatcccaaaatcacgtatatcaactggtcaaaagagggttggcaacatcaagtaccagatatagatattgttattaatctagctggtgcaacgttgaataaacgttggacatcttcccacaaacaagcgatgatgcttagtcgtattcaatcaacgcaaacactatttgaactttttgaaacacgtgaacacaaaccagaagttttatttaacgcaagtgcaatgggctactaccctccagatttatttacaagttatacggaattatatcgaacacttccatttgatttcttatcagaaattgtatatcaatgggaacggtttgcgaataaatttaagcaattcggtacacgtgtcgttttaggtcgattcggtcttattctatcagacgatggtggtgctcttgaaatgatggaacttccgtatcgtttatatgttgggggaaaactcggctctggaagacaatggtactcttggattcatatcgatgacttaattagaggtattttatttactatcaatcatgataacgctgaaggtccatttaatttaactgcacctattcctgaaagacaaaacttatttggttatactttagcacgtgcgatgcataaaccacatgaaacgtgggcacctaaattgatactacgtgcagtgctaggtcagatgtctactgtcatattagatacacaaaaagtacttccaaataaattacatgcactaggttttgagtttaagtataataatttaagaaatgctttagatgatttaattaaagcttaa

SEQ ID NO: 2766 - DNA, 864 bp, Staphylococcus epidermidis
ggggacgctatgaaaatagatgattatcgtttgctcattactttagatgagacaaaaactttacgcaaagcagcagaaattctatatatttctcaacctgcagttactcaacgtttaaaggcaattgaggctgcatttggagttgagatttttattcgtacaaaaaaacagctcattactacgactgaaggttcaatgattattgaacatgcgcgtgatatgctcaaacgtgaacgtttattttttgataaaatacaagcacatattggtgaagtgaacggtacaatttcaatcggttgctcttcgcttattggacaaacattgcttcctgaagtattaagtctttataattcgcaatttcccaatgtggagatacaggttcaagtaggatctactgaacaaataaaagcgcatcatcgagactaccatgtgatgattacacgtggaaataaagtaatgaatttatcgaatacacatttatttaatgatgaacattattttatatatcctaaggatcgtaaggaagatgtaactaaactgccttttattgaatttcaagcggatccaatttatattaaccaaattaaacaatggtataacgatcatttgggacatgattatcacgcgacaatcacagttgatcaagttgccacatgtaaagaaatgttgcttagtggtgtaggggtaactatactaccaaaaattatgatgaaaaatatcgataagaacatgtttgaatttgaaaaagtcactattgataaaaagccacttattcggtcaacatacatgagttatgacgcaagtatgctacaacttcctcaagtagacgcattcgtaaatttaatgttgaactttattagataa

SEQ ID NO: 2767 - DNA, 201 bp, Staphylococcus epidermidis
cctctgtatattctctctctaccaggcgacgccagtgacgtttgtctatatattttactttcacagtcaccaactccttgcttttattatattaaactaggatgtcaatgtcatcttaagtctcagataaatactgtttacataaatgttcttattaaatcattaagactattttactataaattgatttattttacttaa

SEQ ID NO: 2768 - DNA, 894 bp, Staphylococcus epidermidis
tcatataatattgaggcgatgatattgaattcaaaagttaaaggtattattgctatattgatttcagctgtgggttttagttttatgtcagtcttttttagattggccggtgatttaccagtctttcaaaaatctctagctagaaattttgtagccatgtttataccattattttttatttataaatataggcaacctatgtttggaaaattaagtagtcaacccctactcatctcacgttcaacacttgggttaattggtgtcttacttaatatctacgcaattgatcacatggtattaagtgatgctgatacattaatgaaattaaatcctttttggacaattgttcttagtttaatttttttacatgaaaaggtacgaaaatatcaaatcacggcgatgattattgctataatagggatgctattaattgttaaaccagaattttcatcatcagttattccttcaatagcaggattactatccggtatttttgcagcttctgcctacacatgtgttagagcactcagcactcgtgaaaaaccttatacgatagtgttttatttttcattattctcagttgtagttcttatacctttttcaatatttacttatacacctatgacaacaattcaaattcttttcttactcggcgctggattatcagcagctgtaggacaaattggtataacattggcttatagttttgctccagcaaaagatatctccatcttcacatatgcgtctataatatttactgcattatttggatttattctgtttggagaatcacctgatatgtttgcaacagtaggatatattgtcattatcggagcaagttactatatgtttgataaagcaagacgtgaaacaactataaatcaaaataattaa

SEQ ID NO: 2769 - DNA, 354 bp, Staphylococcus epidermidis
gggggtaatatgcgtagtgtaattaagttggaaaatacatttatattcataatcacaatcgccgtttatgttaaattagaattttctatatggctgtttttacttttactattagttccagatatatttatgttaggatatgtgattaatagaaaaacagggagttatgtctacaatattggacacacgtatatcacacctataattatcgcgctattatatttatacattgatgaaaggttactattacagatttctttaatatggttagctcatattagtatagatagaactttaggtttcggactcaaatattcatcagatactgataaaacgataatacaaaagatgtaa

SEQ ID NO: 2770 - DNA, 1161 bp, Staphylococcus epidermidis
gggttaaatatgcacattgaatttaagtatcgctattatgaaaatgaaaaggactatgaagactatcaattagaaatggataactttcaagattctaaaattgcatatcgtcttgatgaagtaggggatgtcattcactttgcagaacaagaacaacgtaacggaagctatgttgcactttatgttacttatgaagcagcacctttttttaataaggaaatggtggtcaataatgtgaaacaatcccatatttttgctgcagcttattcatttaaatcggtcaattcgataaaaaatataaaaaaagtaatgcccaataaaaatcatataaaaactgaaggattttatttttgtgaaagtgataaagcgatgattaacaagatcaaatcgattcataaagccattattgaaggggcaacgtatcaggtgaattacacaacccgcttaaaagcagaagttttctgtcctataagtcacttatattatcaacttactatgtcacaaaatggtaattataccgttttaatggacacacctgatataaaagtagcatcaatatcgcctgaacttttctttcaaaaaggtgactataaaggtaaatcaaatatgattgttagtaagccgatgaaagggactatgcctagagggaaaaatgttaaagaagatgagctatattataataatttaaaaacctcctctaaagatatggcggagaatgtgatgattgtagacttattacgtaacgatattacaagaattgctcaaagtggaactatagatgtacctgaattgttttcgattgagaaatatgacacagttttccaaatgaccagtacagtgtgtggccgattacaagatgacattcaattgatagatatgatgcgagcgctctttccttgtggttctattacaggtgcaccaaaaataaatacaatgcaatatatagctcagttggaggacatgccaagatccatttactgtggaacaattggcttattacttccaaaccaaaggatgatatttaatatccctatacggacaattgagtataatcatgaagaagcggtttatggggtgggtgctggtataacaattgattcagtacccgaaaatgaagttcaggaatttcacgataaaactaaaattttggagcggttataa

SEQ ID NO: 2771 - DNA, 597 bp, Staphylococcus epidermidis
ggtatgaatatgattttaatgatagataatcaagattcctttacatgtaacttaatagattatattaaagtacaaactactgaagaagtgaaaatcatttctgtaaatgatttgatgacacagcatctcgatgcattgaatccgagagcgattgtcatttcacctggacctgggaaacctagtgattatccaatactatcatccgtattagaaatatttcaccgtcacgttcccattttgggcgtctgtttaggttttcaattaatcattgaatactttggaggaaacattattcataatgataaacctattcatggacatattaccaagataaggcatagcaatgagggtatttttaaaggtctaccatcgtattttaacgtgatgcgataccattcacttatggctgacccctctacaatacctagcgcattaaaagtcacagctctgaacaacgagaatgttattatggctgttgcacatcataagtatcctatttatggtttacagtatcatcctgaatctatactaagtgaatatggtcacgaacaattaaatttattcttaaccgaggtaggggttaaatatgcacattga

SEQ ID NO: 2772 - DNA, 405 bp, Staphylococcus epidermidis
gataatgatatatgcgttgtctacttatatttggaggtgcagattttgaatgagcagaaattaattaaattactagaattttacaaacaatataaagcattatctggatatatagataaaaaatataagttgacgttaaacgatcttgctgtactatatttagctaaaatatattgcttagatgagcgaattcttatgcaaacttttctaaaactggctacaggagagttagatattagtagaactaagattttgatgtctattagaagattgatagacaaagaaaagttaaataaagtaagatcgaatagagatgaaagaaaaatttttctatatatggatgaaaataatatgagtgaatttgatgctttatttgaagatgttgaaaaattcttaagttattaa

SEQ ID NO: 2773 - DNA, 744 bp, Staphylococcus epidermidis
cgaggtgatattatgaaaatatatagtcaaggcgaccaagccattgttgtttcaatagagaaaaatgtatctcaaagactgacagaagatttactttcattgagagcatatttaattgataaatcatatccatttattactgaaattgtagctacagagtctgacctaatgatttgttatgacgcaagagatatgattaaacatcaccatattcagtcaccatttttatatatgaaagctttaattgattctataaaattagaaattagacatcatcgacaacaacttcaagcaaaatatattcaaaaacaacaatctgttaatattccagttatatatgggggagaatttgggcctgatttacaacatttgttaaagcatcttaaactcaaattagaggattttgtaaaattacatactcaagaaaaatattttgtatcaatgatggggtattcaccaggatttccgtatcttactggaatgaataaaaaattgcatgtgaaccacacaagtgaaaagaaaaaattcatcccttgtggatcagttattatggaaggaaaaaaatgtggaatagttactactgatacatataatgattggttagttatcggatatacaccagttcaacttttctttcctgagcaacaaaactttacattattaaagctaggagacaatgtcacgtttgagtctaaagatatcaatgaaatagaactaggagattataaaacatgtcaatcataa

SEQ ID NO: 2774 - DNA, 1743 bp, Staphylococcus epidermidis
agacgaggtataactatgaaagaacaaaaccctttgtttttcttatttaaaagactctcatggccatatgggttaatcattgcagcggttatcattacttcgttgggaagtttaagtggtttattagtaccattattcaccgggcgtttagttgataaattttccgtcagtagtattaattggggaatgatagctatatttggctcgattttcttagttaatgcattgcttagcggtataggcctatatttgttaagtaaaattggtgaaaagattatttatgcgattcgttcattattgtgggaacatattattcaattaaaaatgccgttctttgataaaaatgaaagtggccaattaatgagtcgtctaacagatgatacaaaagtgattaatgaatttatttcacaaaagctacctaatttattgccttctgttttaactttaataggttcattagtcatgctatttatcatggattggaaattaactttattaacatttattactattcctgtatttattttaatcatcgttcctttgggacgtgtgatgcaaaaaatatctaccaatacgcaatctgaaattgcgaacttcagtggattattaggtagagtgcttaccgaaatgcgtttagttaaagtatctaatactgagcgtttagagttagataatgcgcatacaaatcttaaaaaaatatatagattaggattaaaacaggctaaaatatcagcagtcgtacagcccatttctggtgttgttatgctattaactattgcgattattttaggttttggtgcattagaaataggtactggagcaattactcctggaacacttatagctatgatattttatgtaatccagttatctatgccactgattaacttatcgacactagttacggattataaaaaagctgtgggtgcgagcagtcgtatatatgaaattatgcaagagcctattgaacctactgaagctttatcagaatctaaagacgttacgatcatcgacggcgaattagtatttgagcacgtggattttaaatatgacgttaaaaagattttggaagatgtgtcatttagtattccacaaggtgaagtgagcgcgtttgtaggaccttctggttcaggtaaaagtacgatttttaatttaattgagcgcatgtatgatattgaacgtggagatattaaatacggtaatcaaagtatttttgatattccactttcaaagtggcgcacaaaaattggttatgttatgcaatctaattcgatgatgagtggaacgataagagataatattttatatggtattaatagaaaagttgatgatgaagagttaatagagtatgctaaactagctaattgtcatgattttattatgcagtttgacgaaggttacgacacgatggttggtgagcgtggactcaaattatcaggtggtcaacgacaaaggatagatatcgctagaagttttgttaaaaatcctgatattttgttattagacgaggcgacagcgaacctagatagcgaaagtgaattgaaaattcaagaagcacttgaaacacttatggaaggcagaactactgtagtcattgctcatcgactttcaactataaaaaaagctggtcaaattgtatttattgataaaggtgaagttaccggtaagggaacgcatcatgaattgatggcaagtcatgataaatacagacattttgttacatctcaaaaattatcagattaa

SEQ ID NO: 2775 - DNA, 834 bp, Staphylococcus epidermidis
agcaagattttagagaatgaaagtaggggaattattatgagtcgtttaagtggtgaacaagtgaaaattggctacggtgattctacgattattaataatttggatgtcgcaattcctgatggaaaggttacttctattattggacctaacgggtgtgggaaatcaactttattgaaagcgttatctagactattgtcaattaaagaaggtaaaattaatttggatggtaagagtattcatgccacatccacgaaagaaatagctaaaaaaatagcaattttaccacaatcaccagaggtcccagatggacttactgtaggagaacttgtttcttatgggcgttttccacatcaaaaaggatttggtcgtttaactgcagaagataaaaaagaaattgattgggcattgtcagttacaggtacaagtgaatttcgtcatcgtactataaatgatttaagtggtggacaaagacaacgcgtgtggattgcaatggcactagcccaacgtactgatattattttcttagatgaacctacaacttatttagatatttgtcatcaattagaaatattaaatttagtcaaaaagctcaacgaagaagaaggttgcactattgtgatggttttacatgacattaatcaagcaattcgcttctcagatcatctcattacgatgaaagctggagatattgttgctactggtcaaactgatgaagtgttaactaaggacattttagaaaaggtatttaatattgatggtgttttagatatagatccgagaacagggaaaccaattttagttacttacgatttattctgtcagacgtattcgtga

SEQ ID NO: 2776 - DNA, 456 bp, Staphylococcus epidermidis
aacattatcttgaacataaaggagaagaataaggaaatgcaacaaatatatccaagtgtcactcacccatatcaattcgaacttaacaaagattttaacttttcagctgcacattacattccctttgaagaagcgggaaaatgtattcgtacacacggtcatacgtattacgtcaacttaacaatcgctggtaatacactagataaatgtggatttttagttaattttagagatttaaaaaagctagttcatgaacaatttgaccattatttgcttaatgacttacctgcttttaaggataaaagtccctcaacagaaattgtcgcacaaacgatttaccacattattcaaaaagagttaaatcaaagagagaatcaaccgaaatgtgttcaagtttatcttagagaaacaccttcaagttacgtagtttatagaccaaaggaagatcaagtgtaa

SEQ ID NO: 2777 - DNA, 447 bp, Staphylococcus epidermidis
ttaactatctttaaatttaaaaagatgggttttaagatttatggatatgatataaatagggaggtttcattaatggctatttcaaaaatcaatgactgctttgaattattagctatggtcacttatgctgacagattaaaaggaataattaaaaaagaattctcaatcagctttgaagaatttgcagtattaacttatattagtgagaataaagaagaggaatattatcttaaagatattatcaatcacttaaattataaacaacctcaagttgttaaagctgttaaaaatttatctcaagaaaattactttaataaaaaacgtaatgaacacgatgaaagaactgttttaatcttagtagattctaagcagcgtaaaaaaatcgatgatttacttaaacgagtaaacaaccgtatcacagaagcaaataatgaaaatgaagtataa

SEQ ID NO: 2778 - DNA, 216 bp, Staphylococcus epidermidis
ttaaaaatcttaaaagtaaattaccaagcaaataatccaacaaatgcagcagtaagtaaggatactaaaattcctgctaacaacatcatcggtacatatttggaaacgaaatccgacgttttcttatcaacaatacctttcaatgtacctataatcattccaatagttgaaaagtttgcaaaagaaactaaaaatgttgatataactgctctatga

SEQ ID NO: 2779 - DNA, 240 bp, Staphylococcus epidermidis
ggaggatacatcagtatgtcaaaaactttggaactcgtatttaaatcaaatcttaataaacccgtcaaattactattacccgattttaacgctattactacagaacaattaattaaagaaagtatgaaccaacttttagaattagacattttaagatttagtttgggaaagcctgtcaaaatttatgctgcacaacttattgataaaagtacaactgttatatttgaagataaaaattaa

SEQ ID NO: 2780 - DNA, 609 bp, Staphylococcus epidermidis
gagttcaacatgattatatatatattaattaacatcgccatcgtcttgctaattcttggcttcgatttataccgacatcgtttcagacagcttaagtttagctccatattattatctgttttaatcaatagcatgattgatatttttgcgattaatcaattcaattttattacgatgtttaccgtcacgctatttatgatatggacacttttacaaatatatttaaatttcaagctatatccttttgtaatttctgaccaaaagtttattgctataatactagccattgttataagcttattgcaatttattacagataaatcgagcacacaatcggtgtacatgtccatcccatatttatcacccacgatatttataataggggcgattttactttttgtaggtactttcaaaatagacgaagttgaacgtctttcactatttcgtaaaattaaaagaccaatgacaacaggtacaattattattatcctatctctcatatcaacgatgattttaacgcccttttggtatgtctttttaatcatttatagcttactcattggttttatattatggcaaggtgttttcttcataaaagataaaaaataa

SEQ ID NO: 2781 - DNA, 1080 bp, Staphylococcus epidermidis
ttttatgacatattaaaaaaattgagttataaaaagttagagaagttacaaacgaatactcatttaagttatttaaatgggattaagggtataataactttaaaattaaacagacgtatccacgcctggaggagagacatggaaaataaacctgattattttcaccacattgaacatagaaagtttcaaagtagctcaaaaattacattatggttatctttagttattactatgatattcactgtagttgagttcgtaggaggtattgtgtcgaattcactcgcgttactctctgactcatttcacatgctaagtgatgttctagcattaggtttatcaatggtagcgatttatttctcgagcaagccacctacaaagaactatacatatggttttttacgcttggaaattatcgtagcttttctcaatggcttagcacttattgttatttcactaggaattatgtatgagggtatcatgagaattatacaccctagacctgttgaaagtggcattatgattctaattgcgtttattggtttaattgccaatatcgtattgaccatcattttaatgatttctctaaaaaaagagaataatattaatattcaaagtgcattatggcattttattggtgatttattaaattctttaggtattattgtggcgtttgtgttgattcattttactggatggaacattgttgacccaattattagtattctcatttcattgattattttaagaggaggatacaaaattattaaaaatgcttcaaaagttctgatggagcgtgtgccggatcgatatgatacagatgaaattatgggagcaatgaaagatgttgaaggcgtgatagatattcatgaattccatttatggagtgttacaactaatcaaagttctttaagtgcacatgttgtactaagtgatgactacattaaatcgccttatgctacaataaataaagtttcggatttgttaaaaacacaatacggtttagaacatgtaacacttcaaattgaaaatataaacctcaatcatttagatgaggagtatttcaaacaacttcaagaatag

SEQ ID NO: 2782 - DNA, 1278 bp, Staphylococcus epidermidis
ttaagggacataatgaagaacacgcagaagatatgttatttctttagtgtcaaatcattgttacttagatttatagattattctcatacatcctttagtatgtttaaaataatttttggaaaagagaaaaataaggtggttaagacaatgaaagttttagtagccatggatgaatttaatggaattatttctagttaccaagctaatagatatgttgaagaagcggtagcaagtcaaattgaagatgcagatatcgttcaagttccactatttaacggtcgtcacgaattattagattcagtctttctttggcaatcaggaaataaatatcgtgtgagtgcgcatgatgctgacatgaaagaaaccgaagcaatatatggacaaacggatagtggtatgactattatcgaaggtcacttatttttaaatggcaaaaaacctattcaacatcgatcaagttacggtttgggagaggttataaaagcagcattggacaatcatacagaacatcttgttatttctttaggtggaataggaagttttgatggcggtgcaggcatgttgcaagcattgggtgcaacattttatgatgatgaagcacaaattgtcgatatgaggaaaggtgcatatttaataaaatatattagacgtattgatttatcaggtgttcatccacaattaacaaaggtaaacattcaattaatgtcagatttctcaagtcgattgtatgggaaaaaaagtgaaatcatgcaaacatacgaatcattagatttgtctcaaaatgaagcagccgagatagataatttaatttggtattttagtgaattatttaagaatgaattgaaaatagcaatgggaccaatcgagcgcggtggtgctggaggtggtatagcagctgtattaaatagtctctatcaagctgagattttaacaagccatgaattagtgaatcaaatcacacatttagaaaacttaattcaacaggcagatcttattattttcggagaaggtttgaaagaagaagatcaaattctagagactacaacaatacgtatagcagaacttacccaacaatacagcaagccagctattgcaatttgtgctacaaatgataaatttgatttgtttgaatcattgaatgttacagcaatgtttaatacatttattgatatgcctgattcatatacagattttaagatgggtattcaaatcagacattacacagtacaagcactaaaattattgaaaacgcaaataaacttaccgctttcatcctaa

SEQ ID NO: 2783 - DNA, 225 bp, Staphylococcus epidermidis
atctactgcatcatcacttcgtatatctttgaattattcttaaattactttaattttaaaatcaaatttatactgtttaattataaaaacgcaccccaaaagctaaaatttagtctagcttttggggtgcacaatattgtcttgagcattttaatatgctttcagtcgatgactggattaaaaatgtatttatgtcaagcttactatatcaataattcagagtag

SEQ ID NO: 2784 - DNA, 942 bp, Staphylococcus epidermidis
ggtgaatgcatgttaacaacagatagattagttaatacgttaaatttagaattacttactggtgaagaaggtttagatagaccaattaaaaacacagatatttcacgtccaggtttagaaatggctggatatttttcacattatgcttcagaccgtattcaattattagggacaacggagttatcattttataatttacttccagatgaagagaagaaaggaagaatgagaaaattatgccgacctgaaactccagcgattattgttacacgtgggttagaaccacccgaagaacttatacaagcatctcaagaaacgcatacaccaattattgttgcgaaagatgccacaacgagtttaatgagtaggttaacgacatttctcgaacatgaactcgcgaaaactacttctttgcacggtgtacttgttgatgtttacggtgtaggtgtactaattacaggagattctggcattgggaaaagtgaaactgcattagaattagtcaaacgaggccatagattagtggctgatgataatgtagaaatcaaagaaattactaaggatgaacttgtagggaaaccgcctaaacttatcgaacatttgctagagattcgtggtctcggaatcattaatgttatgactttgtttggagcaggatcaatattaactgaaaaacaaattcgattaaatattaatttagaaaattggaataagaataaattatacgatcgtgtaggtcttaatgaagaaacattgaaaattcttgatacggaaatcactaaaaaaacgataccagttagaccagggcgtaatgtagcagtaattattgaagtagctgctatgaattatcgtcttaatatcatgggtattaatacagcagttgaatttaatgagagacttaatgaagaaatcgttcgaaatagtcataaaagtgaggagtaa

SEQ ID NO: 2785 - DNA, 297 bp, Staphylococcus epidermidis
ccgcctggcataccgcgttcaatcatgacagtttttaaattggcacgagatgcatatactgctgctgtcataccggcaggacctgcaccgattattgctacatcaacatctacttcagtcattttaaatgcctcctacttattaatcattatgcgcattatatatcatacttttcatttcataaatttatatgctcaatataaattcaattgctttattcagtttgtatctagaaacattaaaatcgtccatcaattgcctcttggtaagtggttggctagaacgacgatacgatag

SEQ ID NO: 2786 - DNA, 333 bp, Staphylococcus epidermidis
atgaatttaattcctacagttattgaaacaactaaccgcggtgaacgtgcgtatgatatatattcacgtttgttgaaagaccgtattatcatgctaggttctcaaattgatgataacgtagctaactctattgtgtcacaattattattcttgcaagcgcaagattctgaaaaggatatttatttatatattaattcaccaggtggcagtgtaactgctggatttgctatttatgatactatccaacatatcaaaccagacgttcaaacaatctgtattggtatggcagcgtctatgggttcattcttgttagcagcaggtgccaaaaggtaa

SEQ ID NO: 2787 - DNA, 306 bp, Staphylococcus epidermidis; identical to SEQ ID NO: 1918

SEQ ID NO: 2788 - DNA, 453 bp, Staphylococcus epidermidis
tcatttctaatctacttttggctgaatcaatggttgacgaaagaaggtgattcaatgaaagtagtatattattcattttctggtaatgttagacgatttattagtcgtgctggtattaaagatacatttgaaattactcaagataattgtaacgaatcagttaatgaaccctacattttagttactggcactattggatttggagaggtgccgcagccggttcaatcttttttaaatgtaaatcatactcagttacaagctgttgctgcgagtggaaatcgaaattggggacaaaatttcgctaaagctggccatacaatttctgaggaatataaagttccattaatgatgaagtttgaagtacaagggacaaataaagacattattgaatttaaggataaggtgggcaatttcaatgaaaaccatggaagaaaagaaatacaatcatattga

SEQ ID NO: 2789 - DNA, 528 bp, Staphylococcus epidermidis
atcaaaataattaaaggagctagaaaattgacacaaggacgtcaaaaagatgaattaaaagatattactttattaggcaatcaaaataacacttatgaatttgattatagaccggaagttttagaaacttttgataataagcatcaaggtcgtgattattttgttaagtttaattgtcctgaattcacatcactatgccctattacgggtcaaccagattttgcgacaatttatatctcgtatatccctaatatcaagatggtggaatctaaatcattaaagttatatttatttagttttagaaaccacggagattttcacgaagattgtatgaatattattatgaatgatttaattaatttaatggacccacattatattgaagtttggggtaaatttactccgagaggtggcatttccatagatccttacacgaattatggtcgtcctgatacaaaatatgaaaaaatggctgaacatcgattaatgaatcatgacatgtatccagaaaaaatagataatcgttaa

SEQ ID NO: 2790 - DNA, 288 bp, Staphylococcus epidermidis
agtaaatcaattatttttgcaactagctttatgaattattcaaggagcttctttaaatatatgaaattaatatctaaaagcatatacttatcatttatattttttatttttagtctcatgttatttaccaatcaaagtttcgctaatgataataaacgttttcagctaaaaccaggtgacattattgttacaaaaggtcctgttttaaatggttttttggtcactgtagtttggcaattgatcatgacactgtacttcaaattgaaggtccaggggataaaccaatga

SEQ ID NO: 2791 - DNA, 1008 bp, Staphylococcus epidermidis
aacatgtcaatcataattgaaaatagtggcctatttagtagctttcaagattttggaagaaagggatatgaacatgaaggtgtcatcccgagtggcgcactagatgaattagcacatgaaatagccaaccgtctggttgcaaatgacaaaaatgaagcaacacttgaaatgactcaaaaaatggcaacaattcgtttcactgagccggcacttatagctttaacaggtggtaattttaaagctgaaactgaacatatgaaaatttatcctaataaattatatctcatcaatgaaggtgagacattgaaatttaatgaaaccagtcgtacatcacgtgtttatctagcagttggtggaggttttaaactagaaaaatggcttcattcagcatctacagattttaatgtggaaattggtggttttgagggaagaaagcttaagaaaggtgatgaaatagaattaaaacaccactattctcaacgacatcttaagctatttgataacttatctgacaaacgtacaactgattggggaattgatggttacgcattgtctttcaattatgtttcggatgtttttcatgttataaaaaataagggaacggaagattttaaaaaagaggcgacgcgtcgttttacaacggctgaatatagtgtgtctagtaaaacaaatagagtaggtatggtgcttgatggcccccaaatcaaagcatactatgatgatatgccggctcatcaatcagtaaaaagaggaaccattcaagttaagagagatggcacaccgattgtattattaaacgatcattatacattaggaagttatcctcaaataggtacaatcgcaagctatcatctaacaaaattagcccaaaaaccacaaggctcaaaattgaaatttcaatttatagatatcgaaactgcagaaaaaaacttaataaagtatagcaattggttaaatcaattgttccatggtattgaacaccgtatgcaattagaaatgttaaagtga

SEQ ID NO: 2792 - DNA, 246 bp, Staphylococcus epidermidis
ggtaaaacaatgtcgaatcataattattctgacgaaaaaatcgaagttatagatccgagtgatgatagatataaaggagatgattattttaataaaaattcatctcaaaacaatcaaaatttaaaaacttttaatcaaacttattcttatggttgcacacattcaggatgcggctgtatattaggctgtttaactatttcacttatttcattcttactttcattactaattttttggattatataa

SEQ ID NO: 2793 - DNA, 651 bp, Staphylococcus epidermidis
ttgatgacaatcgctcaaaatggaggatttttaatgtttagtaagaaaaaggataagttcatggttcaattagaagaaatggtattcaatctagaccgtgcagctattgaattcggcaaaatggacttcaatacacacttagatttgaaagcttattctgataatattaaaacgtatgagtcacatggtgacgaacttatgcatcaagttatttctgatctcaaccaaacattcattacaccaattgaacgtgaagatatcttatctttatgcaatgcaatagatgatgttctagatgctatggaagagacatcagcaatgtttgaaatgtattcaattgaatatacagatgagtacatggctgaatttgtagaaaacatacaaaaagcagttgccgaaatgaagctagctgtaggattacttgtagacaaaaagttatctcacatgcgcattcattctattaatattaaagaatttgagacaaattgcgacggtatcttaagacagtcgatgaaacacatcttcaacagtgaaacagatccaatcacattaattaaaataaaagatatttatcaaagcatggaagaaatagcagataagtgtcaagctgttgctaataattttgaaactataatcatgaaaaatagctaa

SEQ ID NO: 2794 - DNA, 714 bp, Staphylococcus epidermidis
atggctaaaatacccgttttagaaatatttggaccaacgattcaaggtgaaggtcgtgtaataggaagaaaaacaatgtttgtgcgtacagctggttgtgattatcgatgtagctggtgtgattctgcatttacttgggacggtagtgctaaagaagatatcaaattaatgactgctgaagaaatttatgatgcgttacttgaaataggtggtcatcgatttaatcacgtaactatatccggaggtaaccctgcgttaatcaaaggtatacaggaattagtagatttatttgaagacaaacatatttatacagctttagaaacacaaggtagtcgtttccaatcatggatgacacaaattgacgatttaacgattagtccaaaaccccctagttcgggaatgaaaactaatctagaaatattagattctgttataaatcaatgtacatttcattcacttaatttgaaagtggtgatttttgacgatgcagactatgattttgcaaaattaattcatcatcgctaccctaacatcccattctatctacaagtaggtaatccttatcttgatgataacgttgaccaacatacagataaattacttgaaaggtatgagcaattagtggatcgtgtaatgcaaagtagtgatatgaatcatgtctatgtactaccgcaattacacacattattatggagtaataaaaaaggtgtctaa

SEQ ID NO: 2795 - DNA, 918 bp, Staphylococcus epidermidis
cttaagaaaatgacaagcaacgaaaaagaaatgggtaaaagtgaattgttagttgttacaggtatgtctggagcgggtaaatcattggtgattcaaagtctcgaagatatgggatttttctgtgtagataatttaccacctgtactattacctaaatttgtagaattgatggctcaaggaaatccttcattgcaaaaagtagcaattgcaatagatttaagaggtaaggaattatttaaatctctagttaaagaaattgatattattaaaagtcgtaatgacgtgattttagatgttatgtttttagaagctaaaactgaaaaaattatttcacgttataaagaatcaagaagagcgcacccactaaatgaacaaggacaaagatcattaatagatgcaataaatgaggaacgtgaacatctatcagaaatccgaagtatcgctaattacgtgattgatacaacaaaattaaaacctaaagaattaaagcaacgcatttcaaagttttatttagatgaaaactttgaaacatttacaatcaacgtgacaagtttcggtttcaagcatggtatacaaatggatgctgatttagtttttgatgtcagatttctacctaatccctactatgtagaggaattgcgtccatttactggtttagatgagccagtgtacaattacgttatgaagtggaaagaaacccaaatattttttgataaattaacagatttattaaaatttatgattcctggctacaaaaaagaaggtaaatcgcaattggttattgctataggttgtacgggtggacaacatcgatcagtcgcattagctaaacgtttagctgaatatcttaacgagatttttgaatataatgtttatgtgcatcatagagatgcgcatattgaaagtggagggagataa

SEQ ID NO: 2796 - DNA, 1077 bp, Staphylococcus epidermidis
gttggtgaaataatgaaattagcaataattattccagtgtataacgctgaagaaacgattaaacgtgctatactctcagttgatactagtgtgccttatgagattatttgtatcaatgatggttcaactgatcaaacacaacatgtacttacagaattacaacaaaaacatccacacattaaagtcattcatcagagtaatcaaggagcagctcgaagtagaaatgttggcttagaagctatgtctgaagatgttgatgcatttttatttttagacgcagatgatgagtttttacctagtaggattgatttaatggtgaatgcttttaataaaaacaaagaaaccgatgttgttatcggtcaaatggcaagagatgttaacggcgaatggcaagtcatttcgacccatcaatctatggtaaaagatgcgattgtcacacttgatcgtaaaccggatattttacaatcgataggacctggagcaaaattatttagctcgaagtatgctggattacgttttgatgaagatgtcgttttctgtgaagagcatacctttattgtcaaagcgttctctaaagcgcgagatattcaacttatacctaacattgtatatggctataatgagagagaaggatcagtaacagcgcaacgtgctgatacattcttaccttatatgagtgatgcgttaaaagttcgtcaacgcgtgatggaattactattattattagacgaaaaaatctactatagttatcgaatggataacctcatagtaagttacttaatacaggcacatttaaagaaaaataacaaaataacgcaatctttgcttgaaagtgttatagcgtatatgaaagctatgcagcatacacattactcgggagaggctatgtttcgaattgttagagctgttgaacagagtgcaacacattggacaaagcctttatacttacaatggaaaaaggcacttagtgaggttggaattggcagaccaggattaattcgttttaaacttcaagttatacctaaaaagatatccttttctggtaaagaatcactaaaaagaatttttaaaaaataa

SEQ ID NO: 2797 - DNA, 207 bp, Staphylococcus epidermidis
cttaaagaaatacgaggttcactcatgatttatttacaaaattttattactacaactatccaattaaatatctatcttattttagttattggactgctttacgtaatcatccactattatagaaataaaggtgtgaacgctttcttagatatttatttaaattatataccgggtacttattcacgaatttggccacgtcttatttaa

SEQ ID NO: 2798 - DNA, 507 bp, Staphylococcus epidermidis
atcatattgataatacagaaggtaacagtaccattaatcctggaacttttaaatggtgaatctcttagacaatatatacaatcagcttatcacgaaacgttaaaagaagaatttaagaatcttacaccttacatgactaaattggcaaaagtacatggtcgtagtcacccatacttattaaaattacaagacttatatcgcgagtttggtgatagtatgttggatcatatacgtaaagaagatgaggaagattttcctaaactcattcaatatagtcaaggacaagatgtacaaaacattaaaatcatattagaagatttaattaatgaccacgaagatactgggcaattattaaatgttatgaatcaactaacctctgattatcaaaccccagaagaagcatgtggaacatggaagcttgtttaccaaagattacaaaatatcgaacgtcaaacacaccaacatgtacatcttgaaaaccatgtgttatttaaaaaggtaagttaa

SEQ ID NO: 2799 - DNA, 276 bp, Staphylococcus epidermidis
  unsure (273): Identity of nucleotide at the above locations are unknown.
tgtttagtgataaggagtgcaaatatgaaaaaactactatttatcataacagttatcattttaaccatagttgtatccgcttgtggaaatgaatcaaaaagagatattaaacaatttgaacgtcaatatgaagaaattcatcaaaaacaacacagtgtagaaaaagttatggataaaataccattaaaagagttagataatttaagtaaaactgataccactgataaaaataaaaaagaattcgtgcacttcaacaggatattaataactatntga

SEQ ID NO: 2800 - DNA, 1068 bp, Staphylococcus epidermidis
aaggagccgataactattttttcaataagaagtcaaatcattatcggtgtcatttcaagcgttattttaacaacaattatactggttattgcatataagctcatgtggtttaatggtcacatgacactcactttagccatcactactatgataacaagctgtttaacactttcgatttgtagtatttttattaatcctttaattcagaagattaagcaattcaatattaagactaagcaatttataaatcacgaaaaattcattgatgatgaaacatttcagtctcctagagaaattaaagagttgaatgattcttttaataaaatggcatatgaaatcaataatcaaatgaatatgataaaaaacgagcaacaagaaaaaactgaaatcatacaaaaccttgcacatgatttaaaaacacctttagctggtattcgatcatattctgaaggtttacgggatggcgtcattagtgatcctcaagaagttcatgaagcatatgaaatattaattaaacaagcaaatcgtttatcaattttatttgatgacattacacatgtgattaatttaaatactggacgttcttatcctttggaattaatacagctcgatcaattacttgttaatatattacaaccatacgagcaacacataaaacaagaaaatcgtacacttgaagttaatttctgcacagatattgatgcattctaccagtatcgacctccaatcgaacgtattttgaccaatttactagataatgcattaaaattttctaattctggtagccgtattgatattattatttctgagtgtaaagaaaacgacgtcattagtatttcaataaaagatgagggcataggtatcgttccagaacttcaatcacgtatctttgaaagaacgtttagagttgaagattctcgaaatactaagactggtggttcggggttaggattatacattgcaaatgagttagcacaacaaattgacgcctctattacagtccaaagtgatttagacattggaaccacgatgacacttaccttaaaaaaatttcaatttaaaaagtaa

SEQ ID NO: 2801 - DNA, 654 bp, Staphylococcus epidermidis
ggtgaaacgatgttaactgaagaaaaagaggattatttgaaagcaattttgactaatgatggcgacgtgtcctttgtatcaaataaaaaactatcgcaatttttaaatatcaaaccaccatcagtaagtgaaatggtagggcgtttagaaaaggaaggctatgttgaaacaaaacattataaaggtgcccgtttaactgaagaagggttaaagcaaacgttagacatcataaaacgacatcgattactagaattatttttaatagaaattttacaatataattgggaagaggttcatcaagaagctgaaatacttgaacatcggatatcagatttatttgtagagcgtttagataagattttaaattttccgaaaacatgccctcatggaggcgtcattcctagaggtgatcaatataaagaaatttttactacgtcaattcttaattttgaacctggagaacgtgttactgtacgacgagttcgtgataagacagagttgttagtttacttatcaagtaaggatatttatattggaaatacagttgaaattgtatccaaagatgataccaataaggttattattcttaagaggaatgatattgtaacaattttaagctatgaaaatgcgatgaatatttttgcagaaaaataa

SEQ ID NO: 2802 - DNA, 1566 bp, Staphylococcus epidermidis
atagagaagatgtgtttacttatttatctcttaataaggaggaagcgacacatgaatgagttctttgcgacattaagtgatagaaaagggcagctattttctactataattgaacacattcaactttcttttatagcgcttttcattgcaactcttatagcagtaccaattgcaattttgctcactaaaacaaaaaaactttcagaaatcgtcatgaatattgcagctgttctacaaacaattccatcactggcactacttggtttgatgataccaattttcggaattgggagacttccggcaattatcgccttagttgtatatgcgttacttcctattctacgtaatacatacacaggtattaaggaggtcgatccctctcttattgaagcggctaaaggcattggaatgaaaccacttagaagattgaccaaagtcgaactccctattgcaatgcctgttatcatggcaggaatacgcacagctatggtattaatcattggtactgctacactcgcagctttaataggcgctggtggtctaggagatttaatattattaggcattgatcgtaacaatagtgcactcattttaataggtgctattccagctgcacttctagctattatttttgattttattttaagatacatggaacgtttatcatataaaaaattgctcatttctttagggacaattgtaattgtgattatcatagctattgccatacctatggcagcgcaaaaaggtgataaaatcacattcgcaggcaagctaggttcagaaccgtcaattattacgaatatgtataaaatacttattgaagaagacacagatgatactgtagaagtcaaagatggcatgggtaaaacctcattcttatttaatgcgcttaagtcagatgaaattgatggttatttagaatttacaggtactgtattaggtgaattaacgaaagaagatttaaagtctaaaaaagaaaacgatgtatatcaacaagcaaagtctagtttagaaaaaaaatatgatatgacaatgcttaaaccgatgaaatataataatacgtatgcattagctgtaaaacgtgactttgcaaaaaaatatcaaattaagacaataggtgatttacgcaaggtagaagataaacttaaaccaggttttacattggaatttaatgatagaccagatggatacaaagctgttaaaaaaacgtatcatcttaatctttctaatgttaaaactatggaacctaaattacgttatactgcagttaaaaagggagatattaatctcatagacgcatactctactgatgcagaattaaaacaatataacatggtagtattaaaagatgatcaacatgtatttcctccataccaaggagcaccgctatttaaagaaaaatatttaaaagaccatcctgaagttaaaaaaccgctcaataaattggcgaatagaatcacagatgaagaaatgcaagaaatgaactataaggtaacagtgaagaaagaggatccttataaagtagcaagagaatacttagaaaaagaaaaattaataaaataa

SEQ ID NO: 2803 - DNA, 288 bp, Staphylococcus epidermidis
aggggtgagattataccaatgataattgaagtaattttaatggtatgtctcatcattattcaacttatgataggtcatttatggcatcaaataggatggagttatactaaagctattttattaatgtgtttaccgttagggataggattatatttgatgcaattattttattatgagccccgttatacaaattgggaagtacctttgaaaactaaattaaatcttaaatatatgtatattttaactttgttagaatatattttaatctatgtttgcttttttatgtaa

SEQ ID NO: 2804 - DNA, 1323 bp, Staphylococcus epidermidis
ttaaaggagatattaaacatgccaattattacagatgtttacgctcgcgaagtcttagactcacgtggtaacccaacagttgaagttgaagtattaactgaaagtggtgctttcggacgtgcattagtaccttctggtgcttctactggtgaacatgaagcagttgaattacgtgatggagataaatcacgttatttaggtaaaggtgtgactaaagcggtagaaaatgttaacgaaatgatcgcaccagaaatcgttgaaggtgaattttcagttttagatcaagtatctattgataaaatgatgattcaattagacggtacacacaacaaaggtaaattaggtgcaaatgccattttaggtgtttctattgccgtagctcgtgcagctgctgacttattaggtcaaccattatataaatatttaggtggatttaatggtaaacaattgccagtacctatgatgaatattgttaatggtggttctcactcagatgcaccaattgctttccaagagttcatgattttacctgtaggtgctgagtcattcaaagaatcattacgttggggtgcagaaatcttccataaccttaaatcaatcttaagtgaacgcggtttagaaactgcagtaggtgatgaaggtggtttcgcacctagatttgaaggcactgaagacgctgtagaaactattattaaagctatcgaaaaagcaggatacaaaccaggtgaagatgtattcttaggatttgactgtgcttcttctgaattctatgaaaatggtgtttatgattacactaaattcgaaggtgaacacggtgctaaacgtagtgcagcagagcaagttgactacttagaagaattaattggtaaatatccaatcatcactattgaagatggtatggatgaaaacgattgggaaggttggaaacaattaactgatcgtatcggtgataaagttcaattagttggtgatgatttattcgtaactaacactgaaattttatctaaaggtatcgaacaaggtattggtaactcaatcttaatcaaagtaaaccaaatcggtacattaactgaaacattcgatgctattgaaatggctcaaaaagctggatatactgcggttgtatctcaccgttctggtgaaactgaagatactacaattgctgatatcgcagttgctacaaatgcaggccaaattaaaacaggttcattatctagaactgaccgtattgctaaatacaatcaattattacgtattgaagatgaattatacgaaacagctaaatttgaaggaattaaatctttctacaatttagataaataa

SEQ ID NO: 2805 - DNA, 660 bp, Staphylococcus epidermidis
atagtagttttttcatatttgcactccttatcactaaacattatacataaacgtatttattatgaaaatgaattgtgttatagtatgtcagactttattgtatatattatttttataaatgaggagtatttcatgtacgctaatgtccaaccttttattaaaaatgaatctgtgaaacaatttacatatgaatataacaaagtgaaagacgtattgtttactattttagattctcctattaaatacactcagcatatcggtggtacctgtcattttaattatcaaactgagcccattttagatatacttgttggtgtaaataacttgcacgatattacttcactagatgaaaagcgcctaaattatgctggtttttatcgtttgcaccattcttacaagaaaaaagttgtcatggcacgttttaataatttaagtgaattaaaacaagaagtaagattacatattattcaaatggaaacttctcttttcaaacaatatcaaacagtcaatcatttactacacaacgataaagcaatagcagaatggtttgcaagtaagaaaaatgaaattgtgcaacatgctaaaaagatacgtgaatatgagtctcaaaaacaaaatttgtttgagaaattatataaggaatctaatttgttatcgtaa

SEQ ID NO: 2806 - DNA, 888 bp, Staphylococcus epidermidis
ttgaggaggataagtattaagatgaagattgcagttatgaccgattctacaagttatttaccacaacatataatagaacaatataacataccagtcgcttcactaagtgtaactttcgatgatggagtgaatttcactgagagtgatgatttttctgtagatgatttttataaaaaaatggcttcatctaaaactataccaacaacaagccaacctgctattggcgattggattgaaaattttgagagattaagagaacaaggatacactgatgtcatcgtgattaacttatcaagtggtataagcggaagctatccttcagcaacacaagctggtgaaatggttgaagatattcaagtacatacgtttgatagccgtcttgctgcgatgattgaaggtagctttgcaatttacgctgctcaattggtacaaaagggatataaacctgatgatattattaatgaactaactgaaataagacaacatattggtgcatacttaattgttgatgatttaaaaaatttacaaaaaagtggtcgtatcactggagctcaagcttgggtaggtacattattgaaaatgaaacctgtcttgcgttttgaagaagatggtaaaatacatccacacgaaaaagtacgtactaaaaaacgtgcgctaaaatctttagaaacaaacatttttaaagaaatagaaggcatggaagatgtgacagtatttgtaataaacggtgataaaactgaagatggaaagtcatttcttcagcaattaaaggaagatcatcctaatgttcatattcagtattgtgaatttggaccagtgatagcatcacatttaggatcaggcggtttaggattgggttacttcccaagaagaatcgacattaattaa

SEQ ID NO: 2807 - DNA, 759 bp, Staphylococcus epidermidis
gggagagggattttaatcatgcaaattaaactaccaaaaccattcttttttgaagaagggaaacgtgcagtgttacttcttcacggctttacaggtaactctgctgatgtaagacaacttgggcgttatcttcaaaaaaagggctatacatcttatgctccacaatatgaaggacatgcagcgcccccagaagaaatattaaaatctagcccttttgtttggtttaaagatgttttagatggttatgattatttagtagatcaaggttacgaagaaatagcagtagctggtttatcattaggtggcgccttcgcattaaaactaagtttaaatcgtgatgtgaaggggattataactatgtgtgcacctatggagaataaaacagaaggttcgatttatgaaggctttcttgaatatgcacgtaactttaaaaaatatgaaggcaaagatcaacaaacgattgatcaagaaatggaacaatttcatccaactgaaaccctgagagaactgagtgacactctaaatggagttaaagaacatgtcgatgaagtaattgatccaatacttgtcgtacaagcagaacaagatacaatgattgatcctcaatcagcaaattatatatataatcatgtcgattctgatgaaaaagaaatcaaatggtatcaacattcaggtcatgtgattaccattgataaagaaaaagagaaagtctttgaagatgtatatcaatttttagaatcattggaatggacagagtaa

SEQ ID NO: 2808 - DNA, 309 bp, Staphylococcus epidermidis
atgacgtttgtatcacatcaaaggcatttgcctatatttttcaaaaaatgtgtccttttttttcaatctatttcgatatatatagtgaaaggaggttttattatgaatgaagtcaatcaagtgacgattatctttactcaaatcaaacataattctgaaggtaaagtagtcgaacataagcgtcgtttttctaacattaatccgcttgtttctaatgatcaaatcaaatcttttcgttccatcattgaacgtatcagtggcgaagagtatgacaaagtcgagatcgttaaaacagaatctttaatttaa

SEQ ID NO: 2809 - DNA, 1704 bp, Staphylococcus epidermidis
aattattctgtgagcgaattgattttaattttttgtaaacactctataatatatgtaggtgatattattgtgaaaaaactaacaaaaatggttttaagttataaattataccccacactcatgttaatcatgagcgtttttttatcttttacggtcgttgcgcaaaacatttcaatttcacactttttaaatcacttactgtattatcaacaacaatctttattattattgttatcagttatttttatctctcttattttaagagcaacatttaatatgctgattcaatttttaggagatcatttggcatttaaagtaaaacatatgcttagagaacaagtgattttgaaaaaaagtgtccgttcaattggtgaagaaataaatattttaactgaaagtattgatggtatcggtccgttctttcagagttatttacctcaagtctttaaatcaatgttgattcccatcgttattattattaccatgtgttttgttcatttacctactgctattattatgatagttaccgcaccttttattccattgttttatgttatttttggacttaaaacaagagatgagtcaaaggatcaaatgacatatttaaaccagtttagtcaacgttttttaaatacagctaaaggtcttattacatttaaacttttaaatcaaacgaaacaatctgagcaacaactttataaagacagtacacgttttagagatttaacaatgcgtattttgaaaagtgcctttttatcaggacttatgcttgagttcataagtatgttagggattggattggtcgcattggaagcggctttaagcttagttgtatttaaccatatcaactttgtgactgcagcgatagcgattattttagctcctgaattttataatgcgattaaagatttaggtcaagcatttcatacaggtaagcaaagtgaaggtgctagcgatgtggtgttttcatttttagaatctgaagataaagctgattctcctacattaaaagtggatgagcaacagtttgaacaagttttaattaagcatgttgattttcaatacgctaatagtaatcatatggctttgaaaaacatttctttttcggtaaataaaggagaaaaggtcgctattgtgggaccgagtggtgcagggaaatccactttagctaagttgcttagtcaatcagtaacacccacacatggaacactttcatttaaccaagcatcattaaatatcggatttctaagtcagcgcccacatatatttgcagattctatcaaaaataatattgcaatgtatgatgatgagatatgtgatgagcaagtgattcaagtgcttgatgaagtggggttaaaagagaaagtactttcattaaaatatggtatctatacttctattggtgaaggtggggaaatgttatcaggtggacaaatgagacgtattgagttaagtcgtttattattattgaaaccagatattgtaatttttgatgaaccagcgataggattagatattgaaactgaaaaggtcatacaacaagtattagagcatcatttttctacaacgacagtgtttattattgcacaccgtgattcaaccattcgaagttcagcacggcgtatatatatcgaaagtggtcatcttataaaagatgattcgataatttctgttacgcgtagtgaggtgaagatagatcaatga

SEQ ID NO: 2810 - DNA, 189 bp, Staphylococcus epidermidis
tttaacaatgtttgtaacatgttaacagattttacaaagacggtagctaaatatataatatggtacatagatgatgaaagtgagatgacattatgggacgtaaatggaacaacattaaagagaaaaaagcccaaaaagataaaaatactagtagaatatatgccaaatttggtaaagaaatatatgtag

SEQ ID NO: 2811 - DNA, 276 bp, Staphylococcus epidermidis
aacaacaatgtcaattctaaacagaagaaatgggtgacgataatgatttggtatgtttgtgcggccttctttccttgtatattagttgtgctgtttagtgtggtgactagaagtaaatggattggtacattagtcacactggtaataataggggcatcagtttataaaggattctttcacaacgaatggattatttttatagatgtgacaagtttattagctggttatttaataattgatcaacttgaatttcataagaaccaaaatgattcttaa

SEQ ID NO: 2812 - DNA, 519 bp, Staphylococcus epidermidis
ctattaaatgtaggcgtttttaactatagaaagagagtgttaatcatgaagaaaataagtttatttataatatttttaattcgtgtaatttcaggtattgttattttcagacaaggatgggagaaatttacaggtgattttacattaaacgggctagttccggtaattagagataacacagactctcctcaatggtataaatggttttttgaacatattgttgcacacacaacaggattatttaatataatcgtacctttaggggaaatggcaattggtttaggtttaattttaggtatatttgcatacgctgcaagtttctttggagccttcgttatgataaattatattttagcagatatgatttttacgtaccctctacaattagctttctttattattttactcatgagccactctttattggctaaggtatcacttaaagaaatcatcgcttattttagagaccgtaataaccgaggtgaagataagcatgacccacttactaatcgtggatga

SEQ ID NO: 2813 - DNA, 198 bp, Staphylococcus epidermidis
tgcgtaaatgtatccagtgcaatcaacctattcatgagaccattcatatttataacttatttaaaccacctcagatattttgtgaacgatgtgaaacattatggcttaactccaaaattcataaagatggtaggtgtcctaagtgccttaacaacaaaatttctactgatggcgaatgtcatgactgtcaattcttaa

SEQ ID NO: 2814 - DNA, 660 bp, Staphylococcus epidermidis
gataaattcgtgtttaagaatgaaagagaggtaaacaatatgagcggtatctccaaatttattagtgcgattgtagttttgctattattaataggtttagcatttggtatttactcatttgtcgatagttcaaaaaaaggtaacgaacgactcagtgataaaacaacacagcaagaaaagaaaaaagacgataaagacaaaaaggaaaaaaaagataaaaaatcggtggaagaaaaaaagaataatacacaacaaacgcaacaagttcctcaaactcaacaaacgcaacaaacgcaacaaactgttcaaacgccacaaagacctacaactcaaactccggtgagacaaaatccacaaacaggagaaaagagagcaaaagaaccaaaaactgatgaaagaaaaaaaactagacaagacagttcaaattttaaagaaagcccaaatgaaaaagatcaatcgtcaacacaacaaaagccacaacaaaataaatctaaccagtcatcagagaatcgtcaaagtacccaaaataaatcaaatcaaacacagtcaaccagaccacaaaacaatggaaatagtggcaatcaaaatgctagttcggggcagaacacacaaaaacaaaataataacaatcaaaattctcaaagctcaaaaaaggattaa

SEQ ID NO: 2815 - DNA, 852 bp, Staphylococcus epidermidis
aggaattgcttaaaattttaccagataattttgaaacagaaggagaagaacaacatggcaatggatttaattactaaacaagacggtacaacattacactatagtactatgggacaaggatatcctgtcgtactcgtgcataccgcttttgataattatgctgtttttaatgatttagctaaggtattagcaaagtcttttcaggttgtgcttatcgatttgagaggacatggttactctgataagcctagaaatatagagttttatgactttgctgacgatataaaatttttattagatgctatatatatagatgaagcagcatttattgggcacgagatgggggcacttattgctgctgatatgtctgttagaaatcctggctatatatcctcaatcacattagttaatcctacttcaatagaaggtgaattgcctgaagaacgcttgttcagaaaatatgcgcataaaatacgtaactgggaagatgataagcaagaaaaatttttagataaacgtagatattataaagcgcgtaagatgaataaatttttaaagcatgtcgttgatacaaatagtatttctactaaagaagaaattcaagctgttaaagatgtcttcaaatctgaaggtattgcagatgttttcaagcatgttcaagttcctacgcttattgttgctggagaacacggagaacgtacaactacactagaagctaaagaagtcgcagatttgattcaacactgtgaatttaacgtctatcaacattcaagtgcatatccttttgttgaagaacaggctcaatttactcaagagacaacaaacttcattcaacaacatgcacctaaataa

SEQ ID NO: 2816 - DNA, 294 bp, Staphylococcus epidermidis
ttctttaacgtaacatcatgtggtgaactcagtaacacttcatttgttaacgtactacgacttaacgccgcaaaacataatacagaaactgttattgctgacacaacagtcattacagttagagaaaatgcattcttcttaacacgatatataataggtgatgtgaacataacatctgtgacacttaccgttccatttctcaaccgctgtatcgctttaaatatcaatgaaactgtacttctaaagaaaaaatatgatcctataacagttaaaaataaaatagcaaaaggttga

SEQ ID NO: 2817 - DNA, 1278 bp, Staphylococcus epidermidis
tgtttcaacgttttatcctgttcgttcaaattaattccaattgatgaaattaaaatgttgtttttgcaaggtattcataaaaaaatagggtatgaaggttcaaatattattttttgtattatgcctaacttatgccaatataagaatttgttctctcaagaagagatgaatgatatcattaaaattattattgaatatcgcttgcacgtcgcatttagcatcgataaaatcgagcaaatatatgaacttaatcaactttttacatatcaatatgaaaacttaaaaattatgaataaatgttctgtttcagattacaatgtgcaatttatatttaatttgaacgaaaaaagtattcgagaaatttatcgtaatatcttgaagatacaaaacatcgaattggaatataaaataggtttagatattagttgcatgtttaatgacactgcacaatttaaatcattagcttcgcaaataaagcgtttaaaatttgactatctttatattgataatgctagattaaagtcatcctatttacttgataatgaggaaggtttattactcaaaaatattctacaatttaagcatttaatagatgatttaaagcagtttgattttagtagtgaaaatttaatttttctaaatttatataatcatcaattactgaataataatgaaattgatttaagtaatagcgctccattactatttaaaacgatttcaaaactaaaaaaacattttaaaggctacggattaaatgtattttcaaatcctaaagtctttaacgctgtacatttatttgatgagaatgggtttaaaacaacgtttggactgatttttaatcatttgagttggatgactaatcaaaaccaaattgaacaacgattctataatattattgaaaatgctgatcaatattatctctacttatatgattggcgtgtgattgaaagtgaatctaatgagagcgactttaaagacgttgatatatggattaactttgaagatgaagcgttaatagatgaatatatttgtgtgattgctaaagttgatgatgaaggtggcaatattaatcatatgatttctcaaaacttacgtcacaaatatgtttggtctacaccgttcttgatgagagttgaggagaactttagaccatacatgcacattatggaacatgactttaaaaagggcccattgaaaatcagaatgaaatataatgcagtatatttagttgaaatatataaaaaagataaaataaataaaaggcgtagcacaacttaa

SEQ ID NO: 2818 - DNA, 2403 bp, Staphylococcus epidermidis
atgagtttagtatatcttatggcgactaatttattagtcatgctcatagttttattcactctgagtcatcgtcaactaagaaaggttgcgggctatgttgcattaatagctcctattgtgacatctacatattttattatgaaaataccagatgtgattcgaaataagtttattgctgttcgattaccatggatgccttcaattgatattaatttagatttaagattagatggtttaagtttaatgttcggcttaattatttcgctaataggtgtgggtgtatttttttatgctacgcaatatttatcccacagtacggacaatcttcctagatttttcatctatttactattatttatgttcagtatgattggcattgtaatagctaataataccatcttaatgtatgtattttgggaactcacaagtatttcctcattcttgcttatatcctattggtacaataatggtgaaagtcaattaggcgccattcaatctttcatgattacagtgtttggtgggctagcgttattaacaggatttatcattttatatatcattacaggaacaaacacaattactgatatccttaatcaacgcaatgcaatttcacgacatcctttatttataccaatgattttgatgctattattaggtgcttttaccaaatctgcacaatttccgtttcatatttggttaccaaaggccatggcagcacctacaccagtaagtgcttatcttcattcggcaacaatggtaaaggctggaatctttttactatttagatttacacctttattgggacttagtaatgtttatatttatacagtgacatttgttggtctaataactatgttatttggatctttaactgctttacgacaatacgacttaaaaggtatactcgcttattctacaataagtcaattaggtatgattatgacaatggtaggtctaggtggcggttatgctcagcacacatcagatgaattgtctaagttttatattttagttttatttgctggcttattccatttaatgaatcatgcggtttttaaatgtgcattatttatgggcgttggtatcattgatcacgagtccggaacacgtgatattcgtttgctaaatggtatgcgtaaagtcttccctaaaatgcatattgtcatgttgctcgctgcattatctatggcaggtgttccttttttaaatggctttttaagtaaggaaatgtttttagattcgttaactaaagcaaacgaacttgatcaatatggcttcgtattaacgtttgtgattatttcaataggtgtcatcgcgagtatattgacttttacttatgcactttacatgataaaagaaacattctggggaaattacaatatagaaaaatttaaacgtaaacaaatacatgaaccatggctatttagtttaccagctgtgattttaatgttactcattccagttatcttctttgttccaaacgtttttggcaactttgttattttgcccgcaaccagatctgtatctgggataggtgcggaggttgatgcatttgtgccacatatttctcagtggcatggtgtgaatcttccattaattttaagtatagttgttattattattggacttattttagctctagttgtgaattggaaagaggttacgcatcaaataatcaaaagtgcttcgattacagatggctatcggaaaatttatagagaatttgaattatactcagcccgtggtatacgtgcattgatgaataataaattgaattattacatcatgattacattatttatttttgtagctattgtagtttatggatatttgactgtgggttttcctcatgtacatcagcttcatattagttctttcggaccgttggaagttatcttatcagttgtaacattgattatcggcatttcattaatctttattcgtcaacgactaacgatggtggtattgaatggaatgattggattcgcagttacattatattttattgcaatgaaagctccagatttagctttaacacagttagttgttgaaactattacgacaatcttatttattgttagtttttcgagactacctaacatccctcgagttaaggcaaatttaaaaaaagagaccttcaaaatcattgtgtcacttgttatggcattgacggtggtatcacttatttttgttgctcaacaagcagatggtatgccttcaattgctaaattttatgaagatgcatatgaacttacaggtggaaaaaatattgtcaatgctatactaggtgacttcagagctttagatactatgtttgaaggactagtgttaatcatagctggattaggtatttatacgttacttaattacaaagataggagggggcaagatgaaagagaatga

SEQ ID NO: 2819 - DNA, 714 bp, Staphylococcus epidermidis
aaaagaatagtaaaagttatggaggcaacgtgtatggacaaaaagaaactcattaaaacacttatcaatgtattaccaatcgttatcgtaccattagtaactgaacgtaagcgtattaaagaacatccagatgtacagaaagtaactaatgctacatctaaagctacttcaaaaacaacttctgcaatttcaaataaagcttcagatgtcaaagagtacgtaggagataaaaagcaagaatttgataataagcgtgaattgaagaaaattgcgaaggaaaatgatccagcctacattgagaaaaaaggcgaaaaattagctaaacaaaatcgtaaagaagcagacaaaatggacaaaaagcttcaaaagaatattgagaaacgtcataaagaagaacaaaaacaacgtgaagctaatcagaaacaacgtattaaagacatgaaaaaaactcaaaaatacgaagagcaagttggcttaactcctggtaaaatagatcacgaaattgagaaaaaaggcgaaaaactagaaaaagataatcgtaaagatattaaaaaattagataaaaagcttcaaaagaatattgaaaaacgtcataaagaagaacaaaaacagcgtgaagaagcagagaaagctagaaaaaaagaatttaaaaaatatgaaaattacgtggctgacagtgtcgtaaaacaacataaggaatcaaatcattcttaa

SEQ ID NO: 2820 - DNA, 432 bp, Staphylococcus epidermidis
atgatgatagtgatagttactttgacgcttagaaggtggattgacatggctattgtaaataaggttattattgttgaaggtaaatcggataagaaaagagtacaacaagtaatcgctgaacctgcaaatatcatttgtacacatggcactatgagtatagataagatagacaacatgatagaaacactttatgacaaacaagtttatgttcttgctgattctgatgatgagggtgaaaaaattagaaaatggtttaaacgttatttaagcgaaagtgaacatatttatgttgataaaacgttttgtgaggttgctaagtgtcctaaaaattatttagcacatgtattaagtagatatggttttaatgtaaaaaaagaaaagaaacttatgaataatttaaaaactgaaaggctagttttagtaaatgaataa

SEQ ID NO: 2821 - DNA, 1914 bp, Staphylococcus epidermidis
ttaatgcaagtgataattatgcaagaatcaaagaacttaatgaggataaagagcaacttgaagcaacctatgaagcagacatcacgagatggagtgagcttgaggaaattaaagaacaataaggggaatgtaatcatgcaagagactttatcgcattattttggttataagtcatttcgaccaggacaagaagaaattataactaaaatattaaatcatcagcatacactgggggtactacctaccggtggcggtaaatcgatatgctatcaagtaccaggtttaatgcagggtggcacaactattgttataagtccacttatttctttgatgaaagaccaagttgatcaactacaagcaatgggaattcaagctgcatatttgaatagtagtttgactcataaacaacaaaaagagattgaagagcaaataaagcgtggtgccattcagtttttatatgtagctccagagcgctttgaaaatactttttttctaaatttattacgtaaaatagaaataccccttatcgcttttgatgaagcacactgtatatcgaagtggggacatgattttagacctagttaccaaagtgtcatacaaaaagtttttaccttacctcaaaacttcacaatagttgcacttacagctacggcaactgctgaagttcaacaagatatcatgtctaagttatcaattggacaaaatgatgttgtcaaaacaagtactaaaagacgcaatttaatcttcaaagtcaatccgacttatcagcgacaaaaatttgttgtggattatgttgcaaatcatgaaggacaggcaggaatcatttattgttccactcgtaagcaggtagaagaattacacgaagctctaaatagtgaaaaaattaagagcacaatttatcatgctggtttaacgaataaagagagaattgaggcgcaaaatgatttcttgtatgatcgtgtagaggttgtcattgcgacaaatgcatttggtatgggtattgataaatcaaatgtacgttatgtcattcactataacatgcctggagatttggaatcttactatcaggaagctggacgcgcgggacgtgatggtttaaaaagtgagtgtatccttttgtttagtgaacgagataagggattacatgagtattttattactgtatcccaagctgatgatgactataaagataaaatgggcgaaaaattaacgaaaatgattcaatataccaaaacgaaaaagtgtttagaagcgacaattgttcattattttgaacccaatgaaaatttagaggaatgcaatcaatgtagtaattgtatacaggaaaataaaacgtatgatatgactcgtgaagcgaaaatgattattagctgtattgctcgaatgaagcaacaggaaaattatagtgttattatacaagttttacgtggagaagtgacagattatataaaacaccatcattataatgaattaacgacacatgggttgatgaaaaattatacaacatctgagttatcacacttaattgatgagctacgtttcaaaggatatttaaatgaaaatgatgaaattcttatgtgtgatacatcagtgaaacaattactaaataatcataccaaggtttataccactccgttcaaacaaaaaactaaagagaaggtatttatcaacactgttgaaggtgtggatagagcgttatatcgtgagcttgttgatgtacgtaaacagctaagtgataaacttggaatagcacctgtaagtatattttctgattacacgctcgaagaatttgctaagcgtaaacctgaatcgaaacaagaaatgattgctattgatggtgtaggtagttataaattaaagcattattgtcctaagtttatcgaaaccatacaaagctataaaactagaatataa

SEQ ID NO: 2822 - DNA, 483 bp, Staphylococcus epidermidis
gtgaagcaagttgtattaaatattgttatcgcgttcctttgggtactctttcaagatgaagatgaatttaaatttacaaccttctttgctggatttttaattggtttaattgtgatttatattctgcatcgcttttttggtgaagaattttatttgaaaaagatatgggtggctattaaatttttagctgtatacctataccagcttattacttctagtataagtaccataaattacatcttatttaagacgaatgaagttaatccaggtttactcacatatgaaacttcattaaaaagtaattgggctattacttttttaacgattttaattattattactccaggatcgacagttattcgaatttctaaaaatactaataaattttttattcacagtattgatgtgtcagaaaaagataaagaaaatcttctaaaaagtattaagcagtatgaggatttaattttggaggtgacacgatga

SEQ ID NO: 2823 - DNA, 186 bp, Staphylococcus epidermidis
  unsure (106): Identity of nucleotide at the above locations are unknown.
gataataaagtatattcttgcaaagtaacgagattgcataaccacgcactactttctatagagtgtgataatcgagagttaatgataacttttacagtgagggatntcaaacaatttgaggtgtgttctggttatacagatgtgaaagcgaagaaaaattataccggtattttcattagactttaa

SEQ ID NO: 2824 - DNA, 1920 bp, Staphylococcus epidermidis
gaacgcaaagtgtacttggtggcatcaattatgagctttaatgaaattatcttcaaaaactttaaacaaaatgtgacgcactatgctatttatttattatctcttgttatcagcgttgtattatattttagttttgtaactttaaaatatgcgcaccatttacacggtaatcaatcgtttcctgccatcaaagaaggttcacaagtaggaagttattttttatttatcattattgtggtctttttgctttatgctaattttttatttttgaaaagacgaggtcgtgaactatcgttattacaaattattggtctaacaaagaaagatatcatgaaaatgattatgttggagcaattgatgacatttatgatgacaactattgtaggtatcatattgggaatctttggttcgaaaattttactcatgattgtattgcgattattaggaatcaacgtgagtgtttctattatatttaattatcatgccattttagaaacgttattattaatagctgtgtcatatgtacttatagtctttcaaagctatgtatatttacttaaacgttctattaaagagttagcgtctgatgtaaataaaaaagagttcagtcatacacgcacaacacttggtgaagttgtattaggtttgctagggattattatgatagttagtggttatataatgtcgactaaattagtagataacgtagaaacaattattcaaccttttgctattttatttttaactgttataggatcatattttttctttagaagtacagtttcattgatatttaaagcgatacagcggttgagaaatggaacggtaagtgtcacagatgttatgttcacatcacctattatatatcgtgttaagaagaatgcattttctctaactgtaatgactgttgtgtcagcaataacagtttctgtattatgttttgcggcgttaagtcgtagtacgttaacaaatgaagtgttactgagttcaccacatgatgttacgttaaagaatcagaaacaagcaaatgaacttgcttttaaattaaataaccgtaatattgaacattactataattataaagaggtcgtgtatgcaaaagtttataaagatcatctttttagcgaaggtgtatatagaccgaaagaaatcacagtaacgagtgataaatatattccaaatgtaagtacgaaaaaagggcagacagatattattatacctagaggatctctcaaagatgttgttaaaacagacaaaaaaaggacggcttatgtaggaagtaagaagtttcgtttaaaagtaagtttgagaaaagggataaataaagtctattttatgtctgatgttgatcgtggtagaccgacacttattttaaatgatgaagattatcaaaaaattagagaacatataaaagaaaagaatattgtttcccaatatggttttgatcttaaaaataaaaatgatttaccagaattagaaaaattagttagtagtatcaatgaagatatagaaacaagaagtgaagcggcaagtgaaatttctagtttaactggtattttattatttgtgacatcgtttttaggaattacatttttaatcgcagcaggatgtataatttacattaaacagattgatgaaacggaagacgaacttgagaactacacgattcttcgtaagctaggatttacgcatcaagatatgtctaaaggtttgaaacttaaggtaatatttaattttggtttacctttaattattgcattactgcatgcatattttgcttcacttgcttatatgcatttaatgaatgtgacaaatcaaatacctatttttatagttatggcagtttatacagcaacttatgcagtatttgctattatagcttataatcattctaaaagaacaattaaacattcgatataa

SEQ ID NO: 2825 - DNA, 675 bp, Staphylococcus epidermidis
gaagacgaggtggtcgtcacaaaggccctcctcccttcacaacagaggatagacttaaattcgagcatgcttttagaaaaatcattaatcaaatataggaggcatattatgaaaagaattgctgtttattgtggtgcaagtaaagggaaaaacccatcttatgttaaagaggcatacgaattaggaaaatatatggctgaacaaggatacgagcttgtattcggagcaggatcagtcggcattatgggagctattcaagatggcatacttgagcatggcggtaaagctatcggtgtcatgcctaaaatgttagatgaacgagaaataacaagccaaaaagtaagtgagcttatattagtagattctatgcatgaacgaaaaaataaaatgactgaacttgccgatgcttttattatggctccaggcggtgctggttcattagaagaattttttgaaatgtatagttgggctcaaattggtatacaccaaaagcctataggtgtatttaatttaaatggattctttgagccactacaacacttaatcgaccatatgattaaagaaggatttattgatgagaaatatcaaaagcttgcacctttatatgatactaaagaatcactcatcgaaggacttaaacattacaaaccacttggtgtacgtacatacgattaa

SEQ ID NO: 2826 - DNA, 198 bp, Staphylococcus epidermidis
ttaaaatttttaagaaggagaatttatttgagtttaaaggaaatatggaaagttctcataaataaaaaatggcaaactgaagaaatatgttatttaatattgtatatatttttagcgagtatttttaccacgccattgtttggtattcctttgggagttttagcatacttatatcttaatgaagaaatattgaagtag

SEQ ID NO: 2827 - DNA, 531 bp, Staphylococcus epidermidis
ttgcaattatttcgtttgtcagttcggtctcaatttcaagattcatcggggaaggacgtgtcttcaatggaaatcataaaagacatcgttagtcttattgcttcgatacttattttcttaggaagtattattgcattaattagtgcaatagggattgtaaaatttcaagatgtctttctaagaagtcacgcctcaacgaaaagttctacattgtcagtattactaactgtagttggtgtactgatctattttattgtgaattcaggttttttcagtgtcagattattattatcactagtttttatcaatcttacatctccggttggaatgcatttgataagtagagcggcctaccgtaatggtgcatatatgtacaggaaagacgatgcatctagacaatctactatcttattaagccaaaaagagtttaatacgccagaagaattaaaaaaacgtgcaaaactacgagaagaaagacgagaaaaattatactataaagaaaaagaatatattaataaaatggacgattga

SEQ ID NO: 2828 - DNA, 546 bp, Staphylococcus epidermidis
gagttgatatttatgaagcctaaagtattgttagcaggtggcaccggctatattggtagatatttaagtcgagtcattgaacatgatgctcaattatttgctttatctaaatatcccaaacctgacaaaggatctacgaacaaaatcacatggttaaaacgcgatatatataatcataaagatgtagttgaagctatgaaaggtatagacattgcggtatattatttagatccaactaaacattctgctaaattaacacatgcaacagcacgagatttaaactttatagcggcagataactttggtagagctgcatcaataaataagctgaaaaagattgtgtatattccggggagccgtcatgataatgaagctattgaacgtttaggcgcttatggcgtaccagttgattgtacggatgttgaagtgaaacgtcctcatattaacgtagaattacaaacagctaaatatgatgatgttcgaacagcgatgaagatgattttaccaaagaaaatggacgctcaatcaacttgtagactattttag

SEQ ID NO: 2829 - DNA, 225 bp, Staphylococcus epidermidis
tatgaatcattttctattatttctccgtcattcatgactataattttattaaatcttggaagtatttctaaatcatgtgtagctatgatgagtgtttgggataaggattcaatcaaatttataattttttgggtattattaatatctagtgctgtagtaggttcatctaatatccaaaaaccggccgaaggtcttaatagcaatctcgctaaacttagacgttga

SEQ ID NO: 2830 - DNA, 930 bp, Staphylococcus epidermidis
ataggaacattaaaaataatttgtgaaagggtgatgctccaaatgaaaagtaaactatggatagttatatgtgcattgattgtagtactggctgcatgtggtcaagatgccaatcattcatctaataataaagacactgaaaaaagcgataaaaaatatcatagaattatttcgctcattcctagtaacacagaaattttatatcgcttaggaatcggagaagatatagttggtgtatccactgtggatgattatcctaaagatgtaaaaaaaggtaaaaaacaattcgatgcgatgaatttaaataaagaagaattaataaaagctaaaccggatttgattttagcgcatgagtcacagaaaaattctgcaggtaaagtgctaaagtcacttaaagataagggagtaaaagtcgtttatgtgaaagatgcacaatcgattgatgaaacttatgatacttttaaatcaattggacaattaacggatcgtgaaaaacaagctaaagaacttgttgatgaaacaaaacacaatgtagaaaaaatcattaactccgttcctaaacatcataagaaacaagaagtgtttatggaagtatcgtctaaaccagacatttacactgccggaaaagataccttctttaacgatatgttagagaaactagatgctaaaaatagttttgatgatgttaaaggttggaaatcagtaagtaaagaaagcattattaaacgtaatcctgatattctgatttccacagaaggtaaatcaaaatcagactacatagaaatgataaaaaaacgtggcggttttgataaaattaatgctgttaaaaatacacgtattgaaacagtagatggggatgaagtttctcgaccaggtcctcgtattgatgaaggtctaaaggatttaagagacgatatatataaaaaatag

SEQ ID NO: 2831 - DNA, 210 bp, Staphylococcus epidermidis
cctatgacattattatggttagctatattaatacttcttactgtattaggtaaaaagatgtcaaaccaagccattaaaaacaatcaagtgcttattgctaagttaatagctactataactacattttgtgcgtttgtgttggtttatttgcttatgcaatctataatgccacatattattaaattgatgaatgtcttttatcatcattaa

SEQ ID NO: 2832 - DNA, 876 bp, Staphylococcus epidermidis
agtatgtttttacttgaattaataaaaggcatcatcttaggtatcgtagaaggacttaccgaattcgcccctgtttcatctactgggcacatgatacttgtcgatgatatgtggttaaagtcaactaattttctcggttctcaatcagcattcacatttaaagttgttatacagttaggttcagtatttgcggccgcctgggtatttagagaacgcttcttagaaattttacatattggccaacataaacctgaaccttccacttcgggagacagacgttcaaaaccacgacgtctgaatttaatacatgtattagtaggtatggtcccagcagggattttaggatttttatttgatgatttaattgaaaaatacttatttagtgtaccaacagtcttaattggtttatttataggtgccatttatatgattatagctgataagtattctaaaactgttcagcatcctcaaacagtagatcaaattaattatttccaagcatttgtcattggtatctctcaagcaatagctatgtggcctggatttagtagatccggttcaacgatttcaacaggtgttcttatgaaattgaatcataaagctgcatctgatttcacttttattatgtcggtaccaattatgttagctgcaagtggattatctttactaaaacattatgagtatattcatttagcacacataccattctacattttaggatttttagcggcatttattgttggattaattgcaattaaaacattcttacacttaattaataaagttaagttagtaccttttgctatttatagaattgtcttagttatttttatagcaatcctatacttcggattcggtattggcaaaggaatttaa

SEQ ID NO: 2833 - DNA, 354 bp, Staphylococcus epidermidis
ttgattaaattttatcagtatccgaaatgcacaacgtgcaaaaaggctgcaaagtttttagatgagcacgatgtgaattatgaatccattgatattgttcaacatacaccgactaaaaaagaattcaaaaatatcgtagataaaacgggtgtgaatattaataagttgtttaatacacatggtatcaaatatcgcgaattaaatttaaaagagaaacttaaaaatatgtctgatgatgaaaaactagaactacttgcttcagatggaatgttggttaaacgtccattagctatttctggtaaccatttgactttaggatttaaagaaaatgagtatcaacaccaatggttatag

SEQ ID NO: 2834 - DNA, 297 bp, Staphylococcus epidermidis
atgaataaattgaaggatattgaagacataactgttaattttaataaagaaaaacatctcatatttggttatacaccaatgtgtggaacatgtaagatttctgaaaggatgttggatattgctaatgaaatcttacaattgccaataaaaaaaatagatcttaatttttatcctgaatggagtaaagagaaacaaattatgtctgttcctgttttgttgcttatgcgtagagaggaagagataaaaagaatctacgcatttcagtcagttacttatttgttagaaaatttaaaataa

SEQ ID NO: 2835 - DNA, 978 bp, Staphylococcus epidermidis
ctaatgaaatttatttttaaaggttataccttatttattttattagtgattttaactattgtctctttatttataggggtgagtcagctctctctaatagatattttccatttaagtgatgaacaaataaacattttgttttcgagtcgaattcccagaacagttagtattctactttcgggtagttcactagctttatcaggattaattatgcaacagatgatgcaaaataaatttgtaagcccaacgactgctggtactatggagtgggcaaaattaggtattttaatgtcattgttgttctttcctaatggtcccattttaatcaaattattatttgctgttgttctaagtattgttggaacgtttttatttgtccaattaattaatcttatccgtgtaaaagatgtaatctttgttccacttttaggcattatgattggtggtattttatccagttttactacatttgtagcgttgagaaccaatgctttacaaagcattggaaactggttaactggtaactttgcagttataacgagtggtcgttttgaggtgttgtatctcacaataccattacttattttggcatttgtatttgcaaatcattttactattgcaggtatgggaaaagactttagtcataatttaggtgtaagttatgaaaaaatcattaaaatagcattattcataacagcaacgctaacagcattagttgttgttactgttggaacattaccatttttaggtttaatcgtaccgaatatcatatctatctatagaggcgatcatttgaaaaatgctttaccacacacgcttatgctcggtgcaatttttgttttaattgctgatattattggtagaataattgtttacccttacgaaattaatattggattgacgataggtgtatttggcacaattattttcctaatcttgctaatgaaaggtaggaaaaattatgcaaatgagcgctaa

SEQ ID NO: 2836 - DNA, 1350 bp, Staphylococcus epidermidis
ttggaaacttcgaccataattagtttagttatattttttcttttgattgcattaacaacagtattcgttgggtcagaatttgcactagtaaaagtgagatcaacgcgtattgaacaattagtagatgagggtaataagagcgcaaaaattgtcaaaaaaatgatagacaatcttgattattacttatctgcctgtcaattaggtattacagtaacatctttaggcttaggttggttaggtgaaccgacatttgaaaagatgatgcacccactattcgagttattacatttaccgagtcctttaacaacgacgatttcatttgttgtttcattcattgttgtgacatatttacatgttgtattaggcgaattggcacctaaatcatttgctattcaacatacagaacaacttgcacttttatattcaagaccattattttattttggtaattttatgaaaccacttatatggttaatgaatggttcttctcgtgtgattgtcagaatgtttggatttgatccagatgctcaaactgatgcaatgtcagaagaagaaataaaaattattataaacaatagttataacggtggagagattaaccaaaccgagcttgcgtatatgcaaaatattttttcatttgatgaacgtcatgcaaaagatattatggtgccacgtacacaaatggttacgctcaacgaaccatttaatgtagatgaattattagatactatcaaagaacatcagtttacaagatatccaatcactgaagatggtgataaagaccatgtaaaaggttttataaatgtcaaagagtttttaacagaatatgcgtcaggtaaaccgattaaaatcgccaattatattcatgaattacccatgatttcagagacaactagaataagtgatgctcttgtaagaatgcaaagagagcatgtacatattagtttgattatagatgagtatggtgggacagctggtattttaacaatggaagatattttagaagaaattgttggtgaaatcagagacgaatttgatgatgacgaagttaacgatatagttaaacttgatgatcatacttatcaaattaatggtcgtgttttacttgatgatttaaatgaaaaatttggcatagagtttgaagattctgaagatattgatactattggtggttggttacaatcacaaaatactaatttgcaaaaagatgacttcgttgatactgaatatgatcgttggacgattacagaaatcgacaatcatcaaattatttgggtcaacttaaattatgaatttaatagtggacgtccttctgttaatgaagaacaagaagatgacgaacgtgattaa

SEQ ID NO: 2837 - DNA, 1509 bp, Staphylococcus epidermidis
tttatgacttcaaataagtcccatgaaaaagcagttcaagaaataccacaacatggattcttcgggcatccaaaaggattaggcgttctctttttcgtagaattttgggagagattcagctattacggaatgagagcaatgcttattttttatatgtattttgcactccaggaaaacggacttggaatggacaaaacaacagccatgtctatcatgtctgtatatggatcattaatttatatgtcttcaattccaggtggctggatagctgatagaattacaggtacccgaggtgccacattaatcggagctatattaattattataggtcacatatgtttaagccttccttttgcaatggtaggtttattcacttctatgttctttattattgtaggatcaggtttaatgaaaccaaacatttcaaatattgttggtagactctatccagaaaacgacgtacgcatggatgctggatttgttatcttctatatgtcagtgaacatgggtgcactcgtttcaccaattattttacaacactatattgatattagaaatttccatggcggcttcttgattgcagcaatagggatggctcttggattagtttggtacttactatttaaccgaaaaactttgggtagtatcggtatgaaaccgacaaacccattatcttcttctgaaaagaaaaagtacggaacaatcatcggaatcgttgttatagcaatagtattaatccttatgattgcttactttacgcatacgctatcatttaatttaatcagtaatactgttttaattttaggtattgctttaccaatcatttactttacaacaatgattagaagtaaagaagttactgatactgaaagatcaagagtaaaagcatttattccgttattcattttaggcatgttattttggtcaattcaagaacaaggatctaatgtattaaatatctatggtattgaaaactctgatatgaaattaaatttatttggttggaaaacacattttggtgaagctattttccaaaccattaacccattatttattttattatttgcacccgtggttactcttttatggcaaaagctaggaaagaaacaacctagcctacctattaagtttgcaattggtactattttagcaggcgcatcctacatacttatgggagcaatcggtcatatttatggggatacacaattctcagttaactgggttattctttcatacgttatctgtgttattggtgagctttgtctctctccaactggtagtagtgcagcagttaaattagcacctaaggcatttaacgcacaaatgatgagcctttggttattaactaacgcttcagctcaggccattaacggtacattagttaaattaattaaaccacttggtcaaaccaattactttatcttcttaggtgttgttgcaaccgtgattacgttaattatattagcgtttattcctaagatttctaaagcaatgaaaggtattcgttaa

SEQ ID NO: 2838 - protein, 67 aa, Staphylococcus epidermidis
LLQTHIYVKVRFELTKLHSYNNKHNFHHNKLLACVYTPFSLLNYLYSHLGIINKPIFLNFNSFRITH

SEQ ID NO: 2839 - protein, 113 aa, Staphylococcus epidermidis
FLLNIKEVKSMLEFRNVYKSFKKKEILCDVNYKLSAGEKVGLIGSNGSGKSTLMKLIAKTQLPSKGNVYLNNIDIHKSHNMIKDFSFMIGQIYYPELNARTNIENYLKINNKN

SEQ ID NO: 2840 - protein, 126 aa, Staphylococcus epidermidis
INLFFSILTLLELRIDVYLANLLIILVPSITSAILIIFTSKMKLYLWLNVISNLIFYIIYSKYIMHLDGYLSYIERAQINNSDIEIKISPNMLELSQIIFLFFVYLIPQMIVVFIKHKRGEINARI

SEQ ID NO: 2841 - protein, 65 aa, Staphylococcus epidermidis
  UNSURE (13),(16),(22),(49),(54): Identity of amino acid at the above locations are unknown.
AHQRGGARRGVAXVVXAATGIXQVAAAAKANGCTHGYHQYFSKFSGLAXKRAFXQSGTCLYSSRS

SEQ ID NO: 2842 - protein, 182 aa, Staphylococcus epidermidis
IQTSAGLDECPFMGQPGKFREVLVVTMSTSICLCGSGNLMDACCGQYHNGHPAPCATALMRSRYSAYVLGLVDYLVANTLPAQQNGLDRDAIGAWSAQSTWLGLEVESSEVFGGQPEHAFVTFTARWHDSTGEHSHREQLSFVQNDGRWYFIDPTVEVKAGRNDACLCGSGQKFKKCCSSYL

SEQ ID NO: 2843 - protein, 80 aa, Staphylococcus epidermidis
MPVYGPTRKISRSIGGNHEYIHLPLRQRQLDGCLLRPIPQWPPRAVRHRVDALTIQRLCAGAGGLSGGQYATGTTERPRP

SEQ ID NO: 2844 - protein, 79 aa, Staphylococcus epidermidis
SIQALSGDGVALHYLLEAYKHLKAIALAGEAKQLLQVLKLDADAGLIVGGDAKALKAFIAAIAQHRVWEREPMAKAVPA

SEQ ID NO: 2845 - protein, 82 aa, Staphylococcus epidermidis
DGHRRGPTRRVAGPIARRPGTRAVSAPTGRGLFAAQPDRPAKRRCQRRRYGLEPRPGVDAQGSRADRWGQQRHRPRAQGRAG

SEQ ID NO: 2846 - protein, 244 aa, Staphylococcus epidermidis
  UNSURE (114),(162),(167),(171),(237): Identity of amino acid at the above locations are unknown.
INPLHPFSQQRVQPRVILGARHLDAHITLVIHHIGGDGIQLMAQFLDIREVQRHRGAFGGGVDDLGWRLGFGSFQGGFGFIQLGLARVGDGVVDPTGQRGSLGHQRPGAAQGRXGGVDIAFLQDDLAALQIGLGQLALIRLECRVVGRLGLQRGELVLGGGXLTAGXVLFXLCNGHSARIPHLRGQRAGCFCRRPPPGKMPAGTNKRRLTASFLPLSNCAKSEQVYPPPTGAGTNSXINNCGGR

SEQ ID NO: 2847 - protein, 88 aa, Staphylococcus epidermidis
GEAVAAGAQAGRGCGVDCRRGCQGVEGVYCGDCPASGLGTGAYGQGGSGLSHWLFDRAPSRASRIVALPAIGFSRLYAESTQPAPEYA

SEQ ID NO: 2848 - protein, 78 aa, Staphylococcus epidermidis
RRICKSQVWKKPGVGDEKPYISVAISERTVGTKSTSGSDEQPAQSSSSPSSESHSSQQAHQPQPQQDQHPSGVAGFNF

SEQ ID NO: 2849 - protein, 107 aa, Staphylococcus epidermidis
KMNLENLTTERKNENTMGLNEMSVKEALQKMNQEDQKVAMAVGQELAAIEPVVEAIIKSFNQGGRLIYMGAGTSGRLGVLNAAECVPTFGVKPKMVQGPIRWWAKNH

SEQ ID NO: 2850 - protein, 295 aa, Staphylococcus epidermidis
  UNSURE (169): Identity of amino acid at the above locations are unknown.
PRFRFGSSRPLIELGVTGLRMDYGITIEQMAHASHKIDIGLNASTITLEEVAELKAHQADFSRLEAWHNYYPRPETGIGTTFFNEKNRWLKELGLQVFTFVPGDGQTRGPIFAGLPTLEKHRGQNPFAAAVGLMADPYVDAVYIGDPTISERTMAQFGYYHQTNQFLLXVAPSESRYLKRILGTHTNRLDAARDVLRSELSKTSEMFRKDEIATIESEQTEARPVGTVTIDNEKYGRYMGEIQVTLVDLPKDEKVNTITRIIEKDQTILPLIKAGNQFTLVTEGTIENEFRKLNN

SEQ ID NO: 2851 - protein, 75 aa, Staphylococcus epidermidis
LATTAAMARRDTVLPVGRRTVPCLLGCSGRDLHAAARPGPVAAFAASAAVARQSRPVPAGPDRHRAAGRSPAVAG

SEQ ID NO: 2852 - protein, 61 aa, Staphylococcus epidermidis
PGIAQPAQELRQGVQAPANPGHRRDQQPGTGPVAQEPAVLYRQSHPADAAHAKPQGTLRPG

SEQ ID NO: 2853 - protein, 456 aa, Staphylococcus epidermidis
EEKARETKREKERERNQPEREPEKRTRKKRGNREEQMTKTERRTGQSDQERDKGTREEERREKTRRKKAGKRKRAKKAKEEKRTKGQKREEGREQAGGEAPKMGFSLFNPFRRGVVLVDGHENVALEWVKGEIADTVKQARAAMDAFADDASEQALAQCVEGIHQVHGALQMVEFYGAALLAEEMEHLAQAMQAGHVSQREEGIRLLQQALGQLPLYLDRVHSARRDLPLVVLPLLNDLRSVHGKSLLSETSLFSPQLLVIAPLPDDDLAQRAPADFAEQLQHWRQMLQQGLAGLLREDHGPSNLEDMARFFAQLEALCHGAPLLPLWQVTSALAEGMLTGVIANSPALRSLLKSCDKVFKRLQTQGIEGINSPAPDQLLKSLLFYIAKVTRPTPRMQSLKERYGLDEALPDSTVVDAERARLAGPDRNAMGSVLGALCEELVRVKERLDLFVRDS

SEQ ID NO: 2854 - protein, 147 aa, Staphylococcus epidermidis
RARKRRPRMGQGRDRGHREAGPCGNGRLCGRRQRASPRAVRGGHSSGPRRPADGRVLRRGTARRRNGAPGPGHASRARQPARRRHPPAATGPRATAVVPGPCAQRPARPAPGSVAAAQRPAQRARQKPALGNQPVQPATAGDRPAAR

SEQ ID NO: 2855 - protein, 88 aa, Staphylococcus epidermidis
RKRKEEPGRATKSETREPEKRREEKKQEGKKRGRERGRRKQKRKKERKAKKEKRGESRQGGRPPKWDSHFSTHSEGESYWLTGTKTSP

SEQ ID NO: 2856 - protein, 118 aa, Staphylococcus epidermidis
RRKSKRDEERKGKGEEPARKRTRKKDKKEERKPRRTDDENGKKNRAERPRARQGNQRRGEKRKNKKEKSGEEKEGEESKRGKKNERPKKRRGERAGRGGGPQNGILTFQPIQKGSRIG

SEQ ID NO: 2857 - protein, 65 aa, Staphylococcus epidermidis
GIFLRLSPLGRSHFEEHQFGHRTVFSRYIKLLPGVFWGGAQKREGQNAAQKRGLRGKHGKMAENS

SEQ ID NO: 2858 - protein, 68 aa, Staphylococcus epidermidis
RQILHPLNPHAPTAKRKLFAAFPTLIRFAHIYIEKKRMRKRHNRFTKNRYTKNKLRDAVYASLNLLIK

SEQ ID NO: 2859 - protein, 131 aa, Staphylococcus epidermidis
AKFIITKLKRVIMNEKNIKHSHNFITSKHNIDKIMTNIRLNEHDNIFEIGSGKGHFTLELVQRCNFVTAIEIDHKLCKTTENKLVDHDNFQVLNKDILQFKFPKNQSYKIFGNIPYNISTRYNTQNLFLIV

SEQ ID NO: 2860 - protein, 134 aa, Staphylococcus epidermidis
YAKFVFDSIADEIYLMVEYGFAKRLLNTKRSWALLLMAEVDISILSMVPREYFHPKPKVNSSLIRLNRKKSRISHKDKQKYNYFVMKWVNKEYKKIFTKNQFNNSLKHAGIDDLNNISFEQFLSLFNSYKLFNK

SEQ ID NO: 2861 - protein, 107 aa, Staphylococcus epidermidis
  UNSURE (104): Identity of amino acid at the above locations are unknown.
RGFLYHRRDLADRRWRPRLIHRYLQTLTHNNNKESTAMRTHDVHSIIDNAPFNRFHWLVVSLCALLLIFDGYDLFIYGVVLPSIMRESGLTPLQTGALSIYDCXAPP

SEQ ID NO: 2862 - protein, 244 aa, Staphylococcus epidermidis
NRARLLVDAAVAFHRAAVEGLVDDLLVPHALLLALRLAVARDAPRWGLGAARCGGIDTDAAAGGLQGQARGQGIDPALGRAIGHPIDPACGDRRHIDDGPTALLQHVGQHAMATPQRGEQRAAHFGFDLRYRVELKGLGPDSPADVVDQNVDAPKPHLGGGHDLGTRGMLLKVGDQGQQPRMLQLMHQLRAIDRDHPGALRQQPLGHAPADALGGAGNQRYLGVKTWIHADLLTRRQNLRRHWR

SEQ ID NO: 2863 - protein, 103 aa, Staphylococcus epidermidis
GGGETIIYAQGAGLQGRQPRLAHDRWQDHAIDKQVIAIKDQQQGTQADNQPMEAIERGIVDNRMNVMGTHGSALFIVVVSQCLQVTVNQPRSPPPIGKVTPVI

SEQ ID NO: 2864 - protein, 272 aa, Staphylococcus epidermidis
RRNSPPMPSQVLTPREEISMNPRFDTKVALVTGAAQGIGRRVAERLLAEGAWVVAVDRSELVHELQHARLLTLIADLEQHAACAEVMAAAKVRFGRIHILINNVGGTIWAKPFEFYAVAQIEAEVRRSLFPTLWCCHCVLPYMLEQGSGAIVNVSSVATRGVNRVPYGAAKGGVNALTACLALETAGSGIRVNATAPGGTEAPPRRIPRNSQPQSEQERVWYQQIVDQTLDSSPMKRYGSIDEQAGAILFLASDEASYITGVTLPIGGGDLG

SEQ ID NO: 2865 - protein, 62 aa, Staphylococcus epidermidis
SRMSVACWKRGVADAMNYRGQTPNAANVKPCANVAEGLTPVLDNASCHPHAVPPSWRFQAAM

SEQ ID NO: 2866 - protein, 187 aa, Staphylococcus epidermidis
  UNSURE (2),(96),(122),(133): Identity of amino acid at the above locations are unknown.
FXASATPRFQHATDILDHIQRLQQLRRRTDLGRKRHAGLALGALGIDADHVDLFTRKDFGDVAQQALAVAGQNENIDRIHGVVATRAAPFREDHAXGRLGAHFLEILARGAVDKTPLPRVTXPTMLSGGAGLXHLGSTVIKPSVPTTKKPDLGPCSTLEARLLPNTTGLPAPQLPQCRATPAPPGAG

SEQ ID NO: 2867 - protein, 167 aa, Staphylococcus epidermidis
  UNSURE (157): Identity of amino acid at the above locations are unknown.
QGLSTRAALVHVMGDLLGSVAGIIAGAVIYCTGWMQIDPLLSVLVSLLILKSTFGVLRESYHFLMEGVPLHIDYIVVGTDVDQVDGVIAVHDLHVWDMSPGQPALIGHVEIEHLDHWPNVLRAIKKMLLDKHGIDHITLQPETATMAGLHAGDKTHXPALGSDPRPR

SEQ ID NO: 2868 - protein, 242 aa, Staphylococcus epidermidis
ALGIMRGNPCPQGPGSWWKEFLARGGGKAAVQFGNRWPKRLGFSQVGRVFPFPSARVNSACPRWSRRCTTLGKLWCRKTRCVGQEPRFQCRAGPQVRLFGGGDGGFDDGAAQVMQAGAAGQHRRIRHARQGCFIHRATCKNFEEMRAKSPERVIFTEWGSTGGHDTVYPVDIFILAGDRQGLLRDISEIFSREKINVIGVNTQSAKGQARMTFTAEISSTAQLLKALNVIKDVGGVLEARRS

SEQ ID NO: 2869 - protein, 250 aa, Staphylococcus epidermidis
RGFPPRAGGAAGPGIPRRSAAGICRRLLQWRPDGFPPGRRSTGVAGGDRNGGGEPADHGERCLSAGRAADRCVADQRHARSDQSLSRRQGQPVRLRRPGRGTLDTGLGTLVGRPERHRSAAGRGAADPSRPGVDRAPALAGRRPSAGGAAQRAWRRPRAGAAGLSLPADSRQERPGTGRASGNLALLQPVAALRLRPRRRIPDGTRLSRGDSRPDWPAPVPGRCGSRGHRGRDRAASSRPAPPVRRGWKR

SEQ ID NO: 2870 - protein, 118 aa, Staphylococcus epidermidis
SATQRSAARPADRHRSPWSAGSPPPLRSPPATPVLRRPGGKPSGRHWSSRRHIPAADRRGIPGPAAPPARGGKPRHRRHAAAPNSWRPCGNRSSGPRSRPGRPPGNLLAPPAGRSRSR

SEQ ID NO: 2871 - protein, 283 aa, Staphylococcus epidermidis
HSEDSSLKVAGLRRHYLLYVPPGVTEGAPLLVVLHGSRGDGAHMRRISGYGFDRLAAQEGFLVAYPDGFEGHWNDCRKAASYSARLRDVDDVAFLRALVARLAQEYRVDPQRVYVAGYSNGGQMAFRLAAEAPGLPAAIATVAASLPTTENDACRPVERPTAALLINGTRDPINPYLGGKVSLFGFGDRGAVRSTLDSARWWAGLNGIAAPPDVAPLTRPGPVWTERQRWQEDGHPPVELLSVHGAGHVLAQPDYRFPRILGKSDPELDAPVEIWRFFSQLPR

SEQ ID NO: 2872 - protein, 232 aa, Staphylococcus epidermidis
VKIPAVLSNDYRMGYDFIQSIQELSGIPTYFVPGNHDLWSDQADKTSTEILSFFRSKEECLIGNPIIINDQYAIVGHVGWYDYSYADHRFSQQKIASGKHYGATWQDKVRTDWSLSDPKLSLLAAQEVEKDINNVSPRQIILVTHVVTHPQFVVPTPHRIFDFFNAFIGTHDFDTIYRNYPIRFSIMGHVHFRKKLVENNILYICPCLGYQRQWMTDDIAYEINHALVDFDI

SEQ ID NO: 2873 - protein, 208 aa, Staphylococcus epidermidis
NTCAKGPEKKLLHPQTAASTPRAIYYFDMVRRCHSIREAARRLNVASSAVNRQILKLEDEMGATLFDRLPGGLRVTAAGEILTRHITLLLQDVERVRGELDGLHGVQTGHVEIATVEGAAVEILPAALKRMRERYPKVTIGVTVQGSQSIPSAVVNGQADLGLAFALPRGGEITQLCVGHFRLGALMTPSHVLAGESHVSYAQCCEHG

SEQ ID NO: 2874 - protein, 348 aa, Staphylococcus epidermidis
LHNKNRDLPTMTIPKASPQRPEDENLGVAANMAYGLQHVLTMYGGIVAVPLIVGQAAGLSPADIGLLIAASLFAGGLATLLQTLGLPFFGCQLPLVQGVSFAGVATMVAIVGSDGAGGVPAILGAVMAASFIGLLITPVFSRITKFFPPLVTGIVITTIGLTLMPVAARWAMGGNTRAADFGSMSNIGLAALTLMLVLLLSKIGSATISRLSILLAMVIGTVIAVFLGMADFSGVTQGPMFGFPTPFHFGMPTFHVAAIISMCIVVMVTLVETSADILAVGEIIDTKVDSKRLGNGLRADMLSSMFAPISGSFTQSAFAQNVGLVAVTGVKSRSVVATGGYPPDLFTM

SEQ ID NO: 2875 - protein, 207 aa, Staphylococcus epidermidis
HGEEIRRIPAGRHDRTALHPGNRHQADVLGKGTLGERTRDRREHARQHVGAQAVTQALGIDLGVDDLAHREDIRRGFHQRYHHHDAHGDDRGHMEGWHAEMEWCGETEHRPLGHPGEVSHAQEHGNHGADHHRQQDRQTGDGCAADLAQQQHQHQGQRGQADVGHAAKIRRAGVAAHRPACRNGHQCQADGGDDDTGHQGREEFGYS

SEQ ID NO: 2876 - protein, 63 aa, Staphylococcus epidermidis
LLRGDPGADVRFPHTIPFRHANLPCGRDHLHVHRGDGNAGGNLGGYPRGGRDHRHQGRFQALG

SEQ ID NO: 2877 - protein, 247 aa, Staphylococcus epidermidis
DFVTKVHCTKGSTCLTLPIPAQPSQVGGRATRKPQRRESFAGRGAFLIAAIGSAVGLGNIWRFPYVAYSNGGGAFIVPYLVALLTAGIPLLFLDYAVGHKFRGSPPMALRRLHRRMEAIGWWQTLICWVIVIYYAVIIAWAIRYVGFSVTKTWGHDPEGFLTGSFLHVASNVDVEFHFVSGVFWPLLLLWLFVLAIMATGVEKGITRASWIFMPLLAVMFITLVIVALTLDGASPGLKRRSPDNHHG

SEQ ID NO: 2878 - protein, 60 aa, Staphylococcus epidermidis
DVGEIYFAHEPGEAYPGGVNGAVTEGVVFEILLVLGLRQVKLDAVGHGDRGRDGSIARVE

SEQ ID NO: 2879 - protein, 92 aa, Staphylococcus epidermidis
LESWPARRQHMNKTEMVSSDNALPGGHTPVLAMPYFHRVTGDRLDRPFPSSETIYLAMGCFWGAEKLFWNTDGVLQTAVGYMGGLTPNPTYR

SEQ ID NO: 2880 - protein, 79 aa, Staphylococcus epidermidis
QQQWPEHSRHEVELDVNVASHVQEAARKEPLRVVSPRFRHREPDIANGPGNDDRIVDDDHPTDEGLPPPDGLHAPVETA

SEQ ID NO: 2881 - protein, 128 aa, Staphylococcus epidermidis
PYSGNAPGQRRGHTVPFGDLVHHHRTVHDGHHCQGLLPSQPTQRGLWSHHDRDLHGQRRRVLPGGGRAPAVSRRQPLRLLPRSRHRGMPRRARERSRSLPRPTINALGRDSGHDVVATPPEHHGYDHY

SEQ ID NO: 2882 - protein, 149 aa, Staphylococcus epidermidis
VYTGCTGHAETVRVTYDPTQVSTEAILTIFLENHDPTQGMRQGNDVGTQYRSEIWCTTTEQFMTATTVKGSYQANLLNAGYGAITTAISMANGVEFYLAEAEHQQYLEDNPFGYCPVHATGVCLAGLVSEVDLSHVLRSMHLVATQGTM

SEQ ID NO: 2883 - protein, 112 aa, Staphylococcus epidermidis
VGLVRALDSGGRHELFGGGAPDLRTVLCAHVVALAHSLSRVMVFQEDSEDRLGRDLSGVVGYSNGFGVSGASRVHLAVGGVRGETAHVPDGGLQYSVSVPKQLFGSPKTAHG

SEQ ID NO: 2884 - protein, 61 aa, Staphylococcus epidermidis
QQPANNEHLIHTDCRLHSGRMHSGLSKPCANIPIIQANPTNRKRCFDQLDWAITAQRLSSL

SEQ ID NO: 2885 - protein, 428 aa, Staphylococcus epidermidis
LLGEPFCIWVVGGVFLAVIGLSAIYLFTAHKIIRWRRKHIDRINEQEDELGAILFNTLKSGKSIKLEGAEHTATHPLNEAFTQYANAAVTVTSSGGFLNGIKILFISLATGGLLGWGVLDQLSGQPVISLGQLVATFSIAGSFLINITALTEGYRVLDQFLADQRRLLHLLSLPNFGDDNGQLEIPLKPKSTLILNPCIVTDTSSIRLTIKTAIEFTQIQSVAITGPSGAGKSTLLEVLAGLNPSLTSRLLIDDKPICELSAQAHLRYLRYCPQSPQFLEGYFDHSVLFGIPPSPHLNHAIEQLNLEEIVLNRSLSENASNISGGEAKRLSLLRFVNRPGEFNLFDEPSASIEQKLATPVWDLLFDIFGKRGLICVTHDVRHLHRFDQVIVMSNGAIIDQGPWSELANKTSILTLLSDFDLENQTGNR

SEQ ID NO: 2886 - protein, 63 aa, Staphylococcus epidermidis
GCGLKRFLPGSVAQLRGSSVGRGGFQTVRSDQSSLPGTGATGGNTSGTSNALGHSVRKWACRR

SEQ ID NO: 2887 - protein, 107 aa, Staphylococcus epidermidis
NNTYIIQALRQGGINLLKNNLNNLKFRKSNKDSLKLKWISLEKRKLRGCILAYDRRLNGKFLEPLHLCTEIAIFGDGLDTVLSETKKGLNEFLMFLQSYDSICSERR

SEQ ID NO: 2888 - protein, 64 aa, Staphylococcus epidermidis
ACLELLASSIPPASVSQNAGIMGMGHHAQPNSVFLVSYRIKAMINYNSNFNIKSIQHEKNKKDE

SEQ ID NO: 2889 - protein, 329 aa, Staphylococcus epidermidis
KVLSSFLMLSIISSLLTICVIFLVRMLYIKYTQNIMSHKIWLLVLVSTLIPLIPFYKISNFTFSKDMMNRNVSDTTSSVSHMLDGQQSSVTKDLAINVNQFETSNITYMILLIWVFGSLLCLFYMIKAFRQIDVIKSSSLESSYLNERLKVCQSKMQFYKKHITISYSSNIDNPMVFGLVKSQIVLPTVVVETMNDKEIEYIILHELSHVKSHDLIFNQLYVVFKMIFWFNPALYISKTMMDNDCEKVCDRNVLKILNRHEHIRYGESILKCSILKSQHINNVAAQYLLGFNSNIKERVKYIALYDSMPKPNRNKRIVAYIVCSISSFT

SEQ ID NO: 2890 - protein, 321 aa, Staphylococcus epidermidis
LVSSIDTKRRIIMKKSVRLYNMIEYCNENRNFKLNDLMSEFNISRSTALRDIKEIEALGVPLYSNPGKNGGYTIIGNRDQTKIAITDEELKALVFTLSSISNVSNLPFQTEYQEILKKLYNNSNKKELINQYNDLFQYFNEDKYQFKSYKLFNEIIRLIIENKSFETCYSQNYIKEQYKGIGIMYKNHQWYFVVANIESKLVNLLNISKIKELYEMGETQECNDITMQNFQQFMVKNETAIDILIRSNVMGLNILKGYLWSDYMIENIDEETYLFKSKVNAKDIDFIAKLIVTGGVNVKVETPNSLKNAVKVELTKIINMY

SEQ ID NO: 2891 - protein, 413 aa, Staphylococcus epidermidis
VKFLASQLFKGGFFIDYLGVDISKRSSVVAHYKNGKFQKEFFIQNNKNGYNYLLKYLNDLDHPQLIFESTGIYSRGMERFCCVNQINYIQMNPLEAKFKTSALRSWKTDQADAHKLACLGPTLKQTGSLPIHELIFFELRERARFHLEIENEQNRLKFQILELLHQTFPGLERLFSSRYSIIALNIAEIFTHPDVVLDIDKDVLITHIFNSTDKGMSMDKATKYALQLRVIAQESYPNVDRHSFLVEKLRLLIQQLKQSIHHLKQLDDAMIQLAQQLDYFENIHSIPGIGKLSTAMIIGEIGDIKRFKSNKQLNAFVGIDIKRYQSGHTHCRDTINKRGNKKARKLLFWVIMNIIRGQHHYDNHVVDYYYKLRKQPNEKPHKTAIIACINRLLKTIHYLVMNHKLYDYQMSPH

SEQ ID NO: 2892 - protein, 181 aa, Staphylococcus epidermidis
FSTFNFFLLSACTINIERDEENSEKNKQKENTHTDSNNTSSNESNTSKQSSQENTINQTEQNQPTENNSSSQQDLQLITENEAIQKVKDEFPPIRTGNDYRIDTTRTDNNVYAIKFTSQDAEGYPMKAAVTIDKRTGEFIDYIDDRSDEDKERHVQHAKESTLYKGPYDAFRKDFSHKINE

SEQ ID NO: 2893 - protein, 187 aa, Staphylococcus epidermidis
TAELPKKTTRIGKPYYKTDNLLQRQFKASCPMEVLTTDITYLPFGHSMLYLSSIMDIYNGEIVAYKIDDKQDQSLVNDTLNQIDIPEGCILHSDQGSVYTSYAYYQLYEEKGIIRSMSRKGTPADNAPIESFHSSLKSETFYINNELNRSNHIVIDIVEKYIKNYNNNRIQQKLGYLSPVKYRELIA

SEQ ID NO: 2894 - protein, 147 aa, Staphylococcus epidermidis
LVYTLHLLYFKKEVSMMTKKIIYFICTGNSCRSQMAEGWGKKILGDEWQVYSGGIEAHGVNPKAIEAMKEVGIDISNHTSNLIDKNILNQSDLVVTLCSDADNNCPILPPNVKKEHWGFDDPAGKPWSEFQRVRDEIKTAIESFKTR

SEQ ID NO: 2895 - protein, 425 aa, Staphylococcus epidermidis
VMEFNGILEDYATYIYRGKQPKYSTNGIPVINQKAIQWSGLNKEFLKFHNNEIKVDSRHFVKKNDLLINSTGTGTVGRVYHFKFQPEKMFVDSHITIIRTDENKLRSRFLYYQMRTNKFQNMILNEFLAGSTGQVEFNKSMVKKLPISIPEVNYQDVVIKVLDELEDKIEINKKIIANLEELSQTLFKRWFVDFEFPNEEGNPYKSSGGEMIDSELGKIPSNWKIYKLKDIASHKKETFNPKKSEEVTVKHFSLPAYDNEEQAIEEEVNKIKSNKWIINNNCVLFSKMNPDTKRIWLPVIDNKKLNVASSEFVVMESPNNKINSFIYNICLNSQFIDYLKANTTGSTNSRQRVKPTIAVNYKLAIEDSIVKKYSEIITPYMEEMKILRSEIGKLTQLRDTLLPKLMSGELEISDDIEVNSDELSI

SEQ ID NO: 2896 - protein, 127 aa, Staphylococcus epidermidis
SSNTRTQTKIEITIYKRGDYSMEFIKSSSNGTEEEQLEFYEQIFNALADKIRLKILHSIRQSNTKSLCVCDLEELLELKQSKLSYHLKKLVDANILIAEKHGTWNYYKINEQQIQVVLNEDTCCKIL

SEQ ID NO: 2897 - protein, 564 aa, Staphylococcus epidermidis
LLCTRCSIVRCVWRRIIMNHILQMLSKLLSVAKEAIDRQGLIAILTIPVNNDDEIEETAQGETVYNELIDQLRLNIPKDTDYRPNIYSYFGIKKNPNDTVLMEMMIKVFHIKRFNSELFVFKANGWQKINGDELQGLISKMIQVLLVDYKPSLSTLKNVVDGLQKSTDVEELVENEHYIGCGENMFDLNTFQVVKNSIDIFPKTRLNLSLSTNDVITDKIPPYFKQYMLQLANYDDDLQYFLFQHTAVLLTADTKYRRGLILYGGAKNGKSVYIELVKSFFYSKDIVSKPLNELEGRFDKESLIDKSLMASHEIGQSKIQEKIVNDFKKLLSVESMHVDRKGKTQVEVILDLKLIFSTNAILNFPPEHAKALERRINIIPCEYYVEKADTSLIDKLQSEKKEIFLYLMYVYQQIVKADIEYLENSRVTEITHDWLNFGYEFVSSRSVSIANQKACINLLRKLIEIKSGSRIKVSELNKVINEEIKVSSQVINQLIQANFDTQTKLYNGYDYWIDLGWKEANKKEIHDISEKDNIISLDKNENITDDEALDEENLDFDWEDCDDE

SEQ ID NO: 2898 - protein, 74 aa, Staphylococcus epidermidis
KGVTGNGKSYIAFTLVNHAIDNRYSVLFYRLTDLLSKLQQADYNSIDKLLKVISRTDILVNDDFLLPYTTEQEQ

SEQ ID NO: 2899 - protein, 144 aa, Staphylococcus epidermidis
TKLTRCLMYKDYNMTQLTLPMETSVLIPTNDISRHVNDIVETIPETEFDEFRHHRGATSYHPKMMLKVVLYAYTQSVFSGRKIEKLLNDSIRMMWLSQNQKPSYKTINRFRVNPKVDALLESLFIQFHSQCLKQNLIDDQAIFH

SEQ ID NO: 2900 - protein, 90 aa, Staphylococcus epidermidis
APSTKVAMAKVIKAFKLKPDCHCTSKYLNNLIEQDHRHIKVRKTRYQSINTAKNTLKGIECIYGLYKKNRKSLQICGFSPCHEISIMLTS

SEQ ID NO: 2901 - protein, 63 aa, Staphylococcus epidermidis
TIATFQPNKTHSINTINGFINGEAIKKLTAGPKGTLEFNRPASIGIVEQEQKGVIAPNIIPKK

SEQ ID NO: 2902 - protein, 109 aa, Staphylococcus epidermidis
MARTYNVIKYVIKKNKDDLKIHGLRLYEFNIKDEKAINISQPIFVNRATLIEKIQNDEAFTHAFRVNHNTYYAGQLISLSLNKNGYINNNFEASRDIIRNVEVSILDYE

SEQ ID NO: 2903 - protein, 162 aa, Staphylococcus epidermidis
MEFAYYEAKSLNDFENELKTLALNKKYTFSKETEVLKEEEILEKSNSHERELLKVFKDNAQITTYHFKSHKSNYLIIIGETKTPNIIGLTVIFDKKPFKQIGKVALGWLIALTSGGSILAIGAVFGILTSVARRTLVIKGPLGKEISQIIENELGEPIEIKK

SEQ ID NO: 2904 - protein, 65 aa, Staphylococcus epidermidis
LPYANTTATPNIATNKITPKLAKIFFTLLTPFYIYFNFILIYFATLFYIYSKIIEKEHILKSMCL

SEQ ID NO: 2905 - protein, 169 aa, Staphylococcus epidermidis
NKKALTTIAIIIIFGILAPVVFLLQQISRSRIRKNKLQAKQKENNGSNSQIISETSNNMNPENESSSNNQEKTQTTTHEATMNQQKVTRDNIFDYAIAAINKVGNADLLKFQQPEHNGSEWTINANNKSGTGANTIVVKDDETVQIWMDLKHLWIMKLNNQIGERLLVV

SEQ ID NO: 2906 - protein, 71 aa, Staphylococcus epidermidis
EALFIEKKHLRMIHFNMNSTKVFLYNSHYWGQSKIKIDNFFNKIDTLILKQGKKIELLKQRKQGLLQKMFV

SEQ ID NO: 2907 - protein, 230 aa, Staphylococcus epidermidis
QKGAFCMNYFRYKQFNKDVITVAVGYYLRYALSYRDISEILRERGVNVHHSTVYRWVQEYAPILYRIWKKKHKKAYYKWRIDETYIKIKGKWSYLYRAIDAEGHTLDIWLRKQRDNHSAYAFIKRLIKQFGKPQKVITDQAPSTKVAMAKVIKAFKLKPGCHCTSKYLNNLIEQDHRHIKVRKTRYQSINTAKNTLKGIECIYALYKKNRRSLQIYGFSPCHEISIMLAS

SEQ ID NO: 2908 - protein, 230 aa, Staphylococcus epidermidis
QKGAFCMNYFRYKQFNKDVITVAVGYYLRYALSYRDISEILRERGVNVHHSTVYRWVQEYAPILYRIWKKKHKKAYYKWRIDETYIKIKGKWSYLYRAIDAEGHTLDIWLRKQRDNHSAYAFIKRLIKQFGKPQKVITDQAPSTKVAMAKVIKAFKLKPDCHCTSKYLNNLIEQDHRHIKVRKTRYQSINTAKNTLKGIECIYALYKKNRRSLQIYGFSPCHEISIMLAS

SEQ ID NO: 2909 - protein, 101 aa, Staphylococcus epidermidis
TLQAIKEDMHLILFDGTITLEGEHAVRIDEHKIRGDRMVVPFDTFKQIGKPRNQNDIHFKNDPFQRVTNDLWITNPSLSEVDQEQIWQTGDYFSKHLQNIE

SEQ ID NO: 2910 - protein, 113 aa, Staphylococcus epidermidis
EITYIMISKQIKDLRKQHNYTQEELAEKLNTSRQTISKWEQGISEPDLIMLMQLSQLFSVSTDYLITGSDNIIKKDNKSYYEMNFWAFMSEKWWVIIIIVIIICGTIGQIFSN

SEQ ID NO: 2911 - protein, 157 aa, Staphylococcus epidermidis
KANYKWRIDETYIKIKGKWSYLYRAIDAEGYTLDIWLRKQRDNHSAYAFIKRLIKQFGKPQKVITDQAPSTKVAMAKVIKAFKLKPDCYCTSKYLNNLIEQDHCHIKIRKTRYQNINTAKNTLKGIECIYALYKKNRRSLQIYGFSPCHEISIMLAS

SEQ ID NO: 2912 - protein, 400 aa, Staphylococcus epidermidis
KDNYMKKHAYKQLLLGMIAMLIVMSISRFAYTPILPFMQQDTSMDNQEAGFLATWNYLGYLVGAVIPIFYIYKTKVIDLKIYLALNIISTILMGFTEQYLIWSIFRLISGITSGTVFVLTSNIVLDSLKKIQREGISGVLYSAVGLGIFLSSIYLYFFASVDSWKMVWFVLGIVSLVLGLIVLVFMKENTNTIINFKEEKMKINNRLNKKFVIFFSIAYFFEGAGYIITGTFLVAIVKSIPSVAEYATLSWMFVGLGAIPSTLIWSLIAEKISYKKAIYGAFILQIISVCLPVFTHEIFSLVISSVLFGGTFLGLTTLFISKGQSLMYKTDDPLNLVSLLTVIYSLGQMLAPMFAGILIGKSNNYNIALIFATVLLILGLISTIFSYKQNESIGEKYELK

SEQ ID NO: 2913 - protein, 83 aa, Staphylococcus epidermidis
VQEYAPILYQIWKKKHKKAYYKWRIDETYIKIKGKWNYLYRAIDAEGHTLDIWLRKQRDNHSAYVFIKRLIKQFGKPQKVITD

SEQ ID NO: 2914 - protein, 115 aa, Staphylococcus epidermidis
EKRYRIGYFKKVQGIGEEVVPTVVVDLVDQLKVKYSIKLILEVLNIPKSTYYRWKNKTHKNDTVTQKVIELCKANHYTYGYRKITALINQCYTSPINHKRVQRMMQKHHLNCRVT

SEQ ID NO: 2915 - protein, 301 aa, Staphylococcus epidermidis
EKRYRIGYFKKVQGIGKEVVPTVVIDLVDQLKVKYSIKLLLKVLNIPKSTYYRWKNKTHKNDTVTQKVIELCKANHYTYGYRKITALINQCYTSPINHKRVQRMMQKHHLNCRVRPKKMTKIGKPYYKTDNLLQRQFKASCPMEVLTTDITYLPFGHSMLYLSSIMDIYNGEIVAYKIDDKQDQSLVNDTLNQIDIPEGCILHSDQGSVYTSYAYYQLCEEKGIIRSMSRKGTPADNAPIESFHSSLKSETFYINNELNHSNHIVIDIVEKYIKNNNNNNNNRIQQKLGYLSPVKYRELIA

SEQ ID NO: 2916 - protein, 563 aa, Staphylococcus epidermidis
KERYDMKGKIALYSRVSTSEQSEHGYSVKEQEQVLIKEVVKNFPGYDYETYTDSGISGKNIEDRPAMKRLLQDVKDNKIEMVLSWKLNRISRSMRDVFNIIHEFKEHDVGYKSISENIDTSNASGEVLVTMFGLIGSIERQTLISNVKLSMNAKARSGEAITGRVLGYKLSLNPLTQKNDLVIDENEAHIVREIFDLYLNHNKGLKAITTVLNQKGYRTINQKPFSVYGVKYILNNPVYKGYVRFNNHQNWAVQRRSGKSDKNDVILVKGKHEAIISEDVFDQVHEKLASKSFKPGRPIGGDFYLRGLIKCPECGNNMVCRRTYYKTKKSKERTIKRYYICSLFNRSGSSACHSNSINAEVVERVINVHLNRILSQPDIIKQIASNVIEELKQKHSNQTEIKYDIDSLEKQKAKLKRQQERLLELFLDDQMDSGMLKAKQSEMNQQLEVLDQQIKEAKQANQSQDEIPNFDKLKGRLILMITRFSVYLRKATPEAKNQLMKMLIDSIEITTDKQVKLVRYKIDESLIPQSLKKDWGSFFMPKFQFEIYGQNDYFIDQITTFTT

SEQ ID NO: 2917 - protein, 289 aa, Staphylococcus epidermidis
CKYLSNILGGFIMKIKKLLKTLLIILLCFVLSVIVQNISMLWHIVSIWSVEYILHALTYIVLSYFSVKWFIEIVLKSNMKDYRIIPVKFFKSCFLIGLILILVIDLIYLLFIPGKLIIPHYSTSVGFMEMFFSAFLITGIAAPIFEEMVFRGILMRYFEKQYGILFGIIIPSILFSLVHLFNGELKGENLLLLLIGGSIAGIMYAVTAWTFNSIWASAILHMLWNINGLLNITTQDDHWGVYQYILETKNVLITGGDYGMDTSLLSICSYIAVIIVMIVTKRHFNFLLK

SEQ ID NO: 2918 - protein, 117 aa, Staphylococcus epidermidis
VLIQILKNVLSILHFMIQCLNLIETSVLLRILYVVYRASHETAKEALGDKELRAIAHELTKTVKDNMSVDWSKRDSAKAKMRVQVRRLLKKYGYPPDLQKMAVEQVVEQAELMASPQ

SEQ ID NO: 2919 - protein, 84 aa, Staphylococcus epidermidis
IEYQLYVHHNITYFLHSIQIVHINACILKMVAFFMVLITTTIKIYQEKFLLKFFKSLPFNRIKDNRFISSYSLLACSSSSSKAL

SEQ ID NO: 2920 - protein, 489 aa, Staphylococcus epidermidis
LIRLSFIKNIIEGESMEMEFNENNIDLETIIRDEVNKYLSRDIGDLPATQQAPLELREKYEKMEVPNKGRDIYEVLKDLNNEVLNYLYRPNHPRSFSFIPGPASRLSWLGDILTTANNIHASNFANATLPINIERNLINYLVGKIGYEIKPAGGVFVSGGSMANLTAIVAARDAQVEMEDIKKATVYLTSQTHHSVGKALHVAGFLKNNIRRIEYNDDFTMNTDSLKAAIDKDIEEGYKPAMVIATAGTTNTGSVDDFTTLGDICDHYNLWLHVDGAYGLSHILSDKAQHLFKGIERSDSASWDAHKLLFQTYSCAMVIVKEKNHLLQSFGEDAEYLDDIASDDDVIDPEMLGIELTRPARALKLWITLQVIGEDEIIERIKYGEGLAEYAEEYVSSLDNWRIISHANLSIVNFRYENSDLTEAQNNQLNSMAAQKIADSGYAIAYTTVLNNQRVIRLCTTNPLTTHDDIRETINRLDQYIGDYDMKDA

SEQ ID NO: 2921 - protein, 76 aa, Staphylococcus epidermidis
ELRHILYMNELILLLGDSITTNSDEATFNFLLSITGNQILLVSGFIFENNTQLLLIIHLLLFILLTSSSIACSSLS

SEQ ID NO: 2922 - protein, 237 aa, Staphylococcus epidermidis
VIFKGFIVMYEENIYIKNSEYEFDNNLKQLASYLNIPVSIVRPYKEDLTLYQYKKGQVIYHSTDQIKFVYFLVNGCILHESSNITGDNYLRLSKDENIFPMNFIFNETPAPYEICTALTDCKILTLPKDLLEYLCRKHNEIFESLFKKLNETIQFQVEYIMALRANSAKERIERILQILCLSIGDDNGEFYELKQIMTVQLISNLSGLNRKTTGEIIRELKIENIIYQDKRNWIIKK

SEQ ID NO: 2923 - protein, 85 aa, Staphylococcus epidermidis
LHFKGINAINLSSNCSILELYCCNLIVIIYILVYKAIVQHYRKLTTFYWRYYILNQFQNKLYTTYFLVLFVIRFCVSVKSAVFYN

SEQ ID NO: 2924 - protein, 164 aa, Staphylococcus epidermidis
GDFNMVKKDKDTNDQKSESHMKHNDESKVPEDMTSTNEGEFKVGDKVTITAGHMPGMKGAEATVKGAYKTYAYVVSYKPTNGNEKVNNHKWVVNEEIKDAPKDGFSKGDTVKLEANHMSGMKGATAIIDNVKKTTVYVVDYKSKDNGKIIKNHKWMTGNELKAR

SEQ ID NO: 2925 - protein, 107 aa, Staphylococcus epidermidis
MMTNVQRMIQMNKKSLHFLLLKRKVLGIAFNLPEGEEFTFHDLNSRANVTCSKEVQQNVGRWFAYFVKHAPRVPFIIIGKDTHGHLVYLKTGPNPHHNSNPSKGGVR

SEQ ID NO: 2926 - protein, 71 aa, Staphylococcus epidermidis
VYCLPTCCENLYASFGKTEEGRWIAKNAHNYGFIIRYPKNKESITGYQYEPWHLRYLGKRRRQKCTNLVKH

SEQ ID NO: 2927 - protein, 284 aa, Staphylococcus epidermidis
MNHNFIKLIGEVKMHYIKFIESKDNTKLYMKVNDIQDAKANIIIAHGVAEHLDRYDEITAYLNEAGFSVIRYDQRGHGRSEGKRAFYSNSNEIVEDLDAIINYVKSNFEGKVYLIGHSMGGYTVTLYGTKHPNTVNGIITSGALTRYNNKLFGNPDRNISPDTYIENNLSEGVCSDLEVMEKYKLDDLNAKQISMGLVFSIMDGVRYLKDNAQQFTDNILILHGKEDGLVSYVDSLQLYQEIGSAHKSLHIYDRLEHEIFNESSYNRTIFNEVIEWLETELTYN

SEQ ID NO: 2928 - protein, 60 aa, Staphylococcus epidermidis
AENNTKIYKKKDNFYIISIEIVFFHLFRNVISTEFFSKITGREKVDVSHQQNLLKMLSYT

SEQ ID NO: 2929 - protein, 124 aa, Staphylococcus epidermidis
TMNNDRGKSLQIPQSTSLKEGSIYVATLHSVTETDYSGDIKHQFTYEIEIDQQIFYVNRSVVVNVTHQQLSINDWLERHSNYSASHENYEPYIDQKHLILLGQYNGNYYVQDVASLDAFGGVLS

SEQ ID NO: 2930 - protein, 124 aa, Staphylococcus epidermidis
PKNKIFLERVVRMMDENRSKGNRWGVWAFFGILLVPLLVPLLCCAGPILLVALGSTGIGALFAGATGNWWLTGIFAALAIVMIALILSKLLKNKYNSPEGNGKTKNKTDCCTPPESVDRKHETR

SEQ ID NO: 2931 - protein, 422 aa, Staphylococcus epidermidis
CECNKAKEEFEMVQGPIQVNSEIGKLKTVLLKRPGKELENLVPDHLSGLLFDDIPYLKVAQEEHDKFAQTLRDEGIEVVYLEKLAAESITEPEVRENFINDILTESKKTILGHETEIKEFFSKLSDQELVNKIMAGVRKEEIQLETTHLVEYMDDRYPFYLDPMPNLYFTRDPQASIGRGMTINRMYWRARRRESIFMTYILKHHPRFKDKDVPVWLDRNSPFNIEGGDELVLSKDVLAIGISERTSAQAIEKLARNIFKDANTSFKKIVAIEIPNTRTFMHLDTVLTMIDYDKFTVHAAIFKEENNMNIFTIEQNDGKDDIKITRSSKLRETLAEVLEVEKVDFIPTGNGDVIDGAREQWNDGSNTLCIRPGVVVTYDRNYVSNQLLRDKGIKVIEITGSELVRGRGGPRCMSQPLFREDI

SEQ ID NO: 2932 - protein, 69 aa, Staphylococcus epidermidis
IVANGYSDNILVKLFISEIVHTKDSFLLKLYYKFNFATEPLKDMFVIHICKNQKIMVIYIIIFDNNYLK

SEQ ID NO: 2933 - protein, 112 aa, Staphylococcus epidermidis
KKSKMEENSMKINRYITRGISEQLSLDLQILLWNMVKDRDNQLNTDYLHIFKLQEDDNMLSITHEQEQPAYKLEYHYTNYIKNQNALPKKVYVIREDDVDAFYYVMLLPEEY

SEQ ID NO: 2934 - protein, 74 aa, Staphylococcus epidermidis
YFIKEFDFMKINHAGTLSVDYFVSYLNLIMISREVSLKEAVSYMKNEFFKGKTDLYGKVTETHFNQAIQELKQK

SEQ ID NO: 2935 - protein, 85 aa, Staphylococcus epidermidis
LIIKKRLNDIETLKVYLVLNDSMAVLISSLTRWNSDQGLPAGSSNPQCSFFTFGGNIGQLLSASLHKVTTKSDWFSIFLSIKLEV

SEQ ID NO: 2936 - protein, 127 aa, Staphylococcus epidermidis
RKVKKVKKVENTNSNMHKNDNSYVLSALSYLSIFFAPVILPLFVWILADEPTSGHGKKALGNHIMTWISFCVGRGIFIFSKGVFDKPFDHQLLIFVIALIIAIVFFLIALILYILNIIRGIKILLKK

SEQ ID NO: 2937 - protein, 127 aa, Staphylococcus epidermidis
RKVKKVKKVENTNSNMHKNDNSYVLSALSYLSIFFAPVILPLFVWILADEPTSEHGKKAFINHIMTWVSFFIGRLAFIFSKEVFDKPLDHQLLIFSILLIITIIFFLIALILYILNINRGIKILLKK

SEQ ID NO: 2938 - protein, 84 aa, Staphylococcus epidermidis
NSSNMDGPKTSMDHETKQSDWRTVASCLASQNYISLVKGLVHYFTAIEDEEILDKIYDDFMNDDSITTVLNNDLQTIINHYLSK

SEQ ID NO: 2939 - protein, 374 aa, Staphylococcus epidermidis
KEQNTMYQTNTRDLITKLPQSNKTEHFLMNKFSNQDKVQQLQRQISQQLDQQYNELLSNEKAKLDQYVEVHHNLEPLKKEIESESINLDTDKLPDIKATMLEKAKNDEHSDKIEHLFDRLDQSLNGTNRLYTQLSLIGTRTHRITTKRFNVQGLPKLVQQTILPSQFKKVYTIDFKSFEPSVAAYMTQDEQLIDYLNLEEGLYDALLRDLSLSKEKRVSVKRAFIGSFLFGGRYSSSKFKINQEVSEINWLQVMSKFKKIIEFKEQVEKYKTMPTPYGIEHDMSAFQGSSIMAIYVQTVASYIFKHILLEVYKAQCEQKTFKIIVPIHDAIMIECNDKEIAQSVAQLMKDTANRLFNGEFAHVTVEALGGIDNE

SEQ ID NO: 2940 - protein, 670 aa, Staphylococcus epidermidis
VNKNITALKSTENTTYMQYTVHIDDQIINNIKECTKKFKILPMEDKIPLSPLLQPEYAGEVQDFISTYEQFMINFGKVILDSQGIKIQFESESLSSIQRGIQEHCYLNKRTNDIDVTKEWYLCKFSNRTLEEDKNQLYNALKQLMNDSKNKKQAFQEVFKVHIDIYLYNKEKSEYKYQASSYFYLVKENPKIIYKKRHLQEKQGIKGTTFTNKLKLLNKMYGVDVAKYQPFYNSNNPEYERGQFGERYISQRSNYEFNRLQYQIIYILSKILDKHPLPKSDNNYKHIPTIEKAILRDDSHNFYEYFEDIMKEIMNMDNSPLQEKLLTDFTYQSQCRWYSENKKLKLQLERFMHKVLESNYYEGNKLLRMMSNAIEETINEAKEDKVHFNYFKDYFLTDGGVKNWEQISEKITEFNGKVINDIQHEYNKIQSKNTNQNQKLNFVYLYHCFEFSNNIVKAKDNESKNYILFFIDKYKIKTPFLDQLLINCLNQEIDQESINYNMQTMFEKERYDRSSIIEKLVATRKFKYEKDDSDLFKQLFNDVENSIDRLGIYLLNNGINSNDENARYYRSFLKELSRIKSKLTPFSLEISKSSGREQHYPDDAVDDKDERRKNKEETYHAFDDKSDIDYKLKNKISDYIDNLLSVKIRNNLYDISPNTKSNNYNEPTQK

SEQ ID NO: 2941 - protein, 143 aa, Staphylococcus epidermidis
MFKNILLPYDFENDFSAIPDYLEKVTDEDSVVVIYHVVTENDLAISVKYYNKHKEDIIREKEKKLTPFLRELEKRDIQYKIDVDFGHIKDTILEKITSGDINNGEFDLVIMSNHRVDLNIKHVLGDVTHKIAKRSSVPVLIVK

SEQ ID NO: 2942 - protein, 428 aa, Staphylococcus epidermidis
SRKKLTHFKNKCLKSLKRGFYVMLSKKQIKKTLNSDKMPSLIVNELDRELRNKWKQQYPSKEELIKELKYDAVNENSAVLKNELTSKLKFKLKDYQDSNEFLFYLKNSQKMIEIHDYKMEQFFEDIPLEDSDVYKSIANNEDTETYIIMKAPEFNEEDKLNISIKVDGKFKELDFHRIAYDSKKEMKYLYQNRYIKIFMLIEKNLEYISWGFHHLFNESIGEVNTINIIDTYKMLIALASGEMYTANKIKFNNDSASKNKEILESLNRDLKLFEIIHEFQNSLDKEFKISTPFNSKEIIEGVKTYFLLYKQKLILEEKRLESLLIKTSSFDLEDIKGKKFTLIQEEKVTKTIFTQKISYTQYQCYYQVKSSDYEKLQDDEFKLKFNPEDVITIILKASFNTTEPIGLENIAFEEAETLDTFISNYKSN

SEQ ID NO: 2943 - protein, 146 aa, Staphylococcus epidermidis
GGKNMKFQVSPYFLITQNAEGLKKLYEELFGAKTLYIQRIKDRPIDKQLNIDENDLNKIDQCVLQFGDIKIMIADDTEGLPITQGNNISLCLTFDQVEETKHVYDQLIEKGSEVLKTFSPEFYTEGYGYVRDPYGISLHLFTKRKN

SEQ ID NO: 2944 - protein, 173 aa, Staphylococcus epidermidis
RSENFMKTIKSTLETEAIFSDDQQHRYLLKKTWNSEKQKITIITMYPNYTGLLRIDLTTQLIMNKVSEMDTFGSINFVNLYSNITTPINLKHLENAYDNHTDIQIMKAVKESDEVILAWGAYAKKPVVESRVNEVLEMLKPHKKKVKRLMNPATNEIMHPLNPKARQKWTLKA

SEQ ID NO: 2945 - protein, 226 aa, Staphylococcus epidermidis
SGENIRRNKLMKNISEFSAQLNQTFDQGEAVSMEWLFRPLLKMLAEGDPVPVEDIAAETGKPVEEVKQVLQTLPSVELDEQGRVVGYGLTLVPTPHRFEVDGKQLYAWCALDTLMFPALIGRTVHIASPCHGTGKSVRLTVEPDRVVSVEPSTAVVSIVTPDEMASVRSAFCNNVHFFSSPSAAQDWLNQHPESSVLPVEDAFELGRHLGARYEESGPTNGSCCNI

SEQ ID NO: 2946 - protein, 322 aa, Staphylococcus epidermidis
NQEKKKTIKFEVNQDSATLWYHPHPSPNTARQVYNGLSGLLYIEDSKKNNYPSNYGKNDLPIIIQDKTFVSKKLNYSKTKDEDGTQGDTVLVNGIVNPKLTAKEEKIRLRLLNGSNARDLNLKLSNNQSFEYIASDGGQLKNAKKLKEINLAPSERKEIVIDLSKMKGEKISLVDNDKTVILPISNKEKSSNKGNTPKVSKKIKLEGMNDHVTINGNKFDPNRIDFTQKLNQKEVWEIENVKDKMGGMKHPFHIHGTQFKVLSVDGEKPPKDMRGKKDVISLEPGQKAKIEVVFKNTGTYMFHCHILEHEDNGMMGQIKVTN

SEQ ID NO: 2947 - protein, 325 aa, Staphylococcus epidermidis
ADRKMSISEYKNRYLESLYNTFKTELENERTRYFILDTNYTNSDDTEKEFTWDVKQNNKIREGDLFIFRRPTNLSQIAQQFYFFGAGKIEKIERKNNVATAYISKPLLFVDRVLKDNIENLKWEFKERIKEEWEQFFFKNKISNITKNDFLKLLSLSRNVVEIESNYINNDISLTFKQMADMATRIKKNIYYVGNHEAFVQAKGSAHFEFSKRIKQNYSYRCAITGIKTKDFLVVTHIIPWHENEFIRLDPSNGICLSLFLAKAFKKGFITFSNSYRVVLSKEAEKDAALYEELKIYENQKIELPDCQKPNLKYLDWHREHIFKN

SEQ ID NO: 2948 - protein, 169 aa, Staphylococcus epidermidis
RYMNTIKSTIHTEAIFSDDEQHRYLLKKIWDDKKPACTVITMYLHLDGVLSLDLTTVLILNQLANSEQYGAVYLVNLFSNIKTPENLKHIKEPYDEHTDIHLMKAISESDTVILAYGAYAKRPVVIDRVEQVMEMLKPHKKKVKKLINPVTNEVMHPLNPKARQKWTLK

SEQ ID NO: 2949 - protein, 1041 aa, Staphylococcus epidermidis
IVMNFQFNEDDLEQVALEWLQSLGYDYKKGNEISMTGLTPERKSDKDVVLHERLEKALRKINSDIHPRFIEKAIHELTLEKSPNLLENNLTFHENLINGIEIEDYDDEGQSVVEIVKIVDFEYPQNNDFLAVNQFTVVNGDYTKRPDIVLFINGLPIVVIELKNSTIETVGVEDGYRQLETYKMRIPQLFTFNEVLVTSDGINTKAGSLTANYDRFMTWRSKDGETESSSSLASLDVLIHGMLNPETLLDLIRYFVLFQDDGKGHISKILAAYHQYYAVNKAVDRALLASSGQGDGKGGVIWHTQGSGKSLTMVFFSGKLIQMLNNPTLVVVTDRNDLDNQLYSTFVKSKGRSGKGLLRQTPKQAETRKELKSLLSVESGGIVFTTMQKFEPEQNETTMSALTERKNVIVMADEAHRTQYGFNAKYDDKGEGIKYGYAKYLRDALPNATFVGFTGTPVASTDKNTQMVFGNYIDVYDMTQAVADGSTVKIYYESRIIPLNLPQNLDLDEAYNDITEDQEEDVKQRLKSKWSRIEALAGAKPRVEALAKDIIQHFETRQQAMKGKGMIVTMSRRIAVDLYDEIIRLKPEWHSDDDDKGVIKVVMTGSSMHPISFQRHIGPKKRRNLLEKRMKDMNDELQLVIVRDMWLTGFDVPSMHTMYIDKPMKGHNLMQAIARVNRVFKDKPGGLIVDYVGIAESLKEALKEYTESDQAQTAIDTDKAVELMLLKYDVIQDMLYNLDYSKFNSEKKSERYYAISDTMDYVIGLGEDERQRFIKTVTELGKAFALCATEPTAQELNDEIAFFKAVKAGLVKLLQPPKEGKTRKTPAEVEAEINQLVSQSVVTEDVIDVYQTLGLEQPDLSILSDDFLKDVEGLKQKNVAVELLNRLLKGQVKSLMKTNATVSKRFSEMLGNSINKYNSRSIETSKVIEELIQLAKDIKQEQQRGNELGLNSDEIAFYDALASHETAKEAMGDKELRAIAHELTKTVKENMGVDWSKRDSAKAKMRVAVRRLLKKYGYPPDLQKMAVEQVVEQAELMASNQ

SEQ ID NO: 2950 - protein, 112 aa, Staphylococcus epidermidis
KSQNERKSLMNRYITQGIANNLPIILQQQLWKIVAQRENEQSKELEAIDYFHIFQFNMHNDQLYIKHKQERPEYIKTHKANYSKAININKVYIIREDDVDLSYYVMLLPEEY

SEQ ID NO: 2951 - protein, 82 aa, Staphylococcus epidermidis
LIKKMDEDKGTGKILSSLYIKDDELKKQYSTCREFLDDYLYTAWIIPVLLNEHATSQLEEYLGRYLINQNVPILNLLSHTFK

SEQ ID NO: 2952 - protein, 60 aa, Staphylococcus epidermidis
IVEKLKTLLNLSHFIFLYTVSRTQHTTNEFQKVRVKLTCFFYGFKILESGQSTPLYNYKK

SEQ ID NO: 2953 - protein, 61 aa, Staphylococcus epidermidis
IHRLVKMMDFFKLWMRYRVSLDKNRENLLKSDFCEEDNDDKEIRSYCDWYRFCGVNHSSKM

SEQ ID NO: 2954 - protein, 120 aa, Staphylococcus epidermidis
GGNDMKTTTQELKQYMTRLFQLSNNETWECETLEEAAENILPKRFINDSPLAHLILETYTYYNNELHELSIYPFLMYSNNQLISIGYLDHFDMDFLYLTDTKNTIIDERHLLKEGGNNHE

SEQ ID NO: 2955 - protein, 258 aa, Staphylococcus epidermidis
IMNDLLKIYEKLKKDIENRWLIPFHYVVFGLALVVYFLEIPIYKLVNNLDKELVDKVLYAFSLVYDHIVLIFILIIIIILIVYLFFDVFNMNRFVPSPTTYVDGSESSINYVSAIKRLINFMILIITKYWITYFIVNLIFHNDKLLYLNNDSKHLYKCLLFLNICIFIVHILKSIFIIKIMADDSLRLINENDLTDFYITLNKNDEYRMVKPKYRKIDNFIIIKKSEDFTNSNEYKVINKSKNFEEIIYHFDNLTSNH

SEQ ID NO: 2956 - protein, 61 aa, Staphylococcus epidermidis
YLMEVFEIRSREKSLILCSQMTSVEWHKKLSGKVIAYAILIRAVSKSFKIFLEVESLRKIK

SEQ ID NO: 2957 - protein, 149 aa, Staphylococcus epidermidis
TMKEINIVSLQMIKTDTLSYLKNHISNPEDAAEILRSFIGNSDREHLILICMNSKNEPTHIQTLSIGSINQTVIHPREIFKTAILSNANSIMLGHNHPSGDITPSPEDINVTKRLMLISEMMGILFYDHIIFSDSNTYSIRQHDLEVEV

SEQ ID NO: 2958 - protein, 128 aa, Staphylococcus epidermidis
TTSLLHYLGGNNMKTITQELKQYITHLFQLSNNEAWECEALEEAAENILPERFINDSPLVHLTLETYTYYNDELHELSIYPFLMYANNQLISVGYLDHFDMDFLYLTDTQNIIIDERHLLKQGGQDHE

SEQ ID NO: 2959 - protein, 70 aa, Staphylococcus epidermidis
KRALETDNLYYLAYVTTLDNCFKYYQLITQNEHFCYSQQEERESYQQKFQSMINGLKIKIGIQSSNDDAQ

SEQ ID NO: 2960 - protein, 144 aa, Staphylococcus epidermidis
RGELMHWKENRIKSAKNDTNPMVIKELKGSYVVFGDVQFLPGYCVLLPKREVRLLNDLTLEERQDYLLDMSFVGDAMMKALKPTRVNYEILGNKNHFLHAHLFQRYEWEDESVRYMPVWCMMLLIGLMKKRLTILINMMKLEIR

SEQ ID NO: 2961 - protein, 243 aa, Staphylococcus epidermidis
TGLWRGLAPCFKDRSGIMSFSFLFILTAGMVAAFNPCGIALLPSYISYLIGGETKDHSFRYAIFKGLGLGGAMTTGFLTIFVLAGLLIGGLGSALTGIFPILSLVMGILIALLGLGMLFGKHLPIKIGSFQVKPGKWSIYFYGIAYAVTSLGCTLPAFMLVVSASLNDNSVTAVIIKFIIYSLGMGIVVTAITMVSLISRQLVQKFLHNYMGSIQKIAAVVIFLSGLYMAYYWYFGSGGICTF

SEQ ID NO: 2962 - protein, 707 aa, Staphylococcus epidermidis
GGICYIISSFTITFSLGGVNLNNNSEEHNHQNHMNHSNHMHHDNHESHNHHSGHAHHHGNFKVKFFVSLIFGIPIILLSPLMGVNLPFQFTFPGSEWVVLILSTILFFYGGKPFLSGGKDEIAEKKPGMMTLVALGISVAYIYSLYAFYMNNFSNATGHTMDFFWELATLILIMLLGHWIEMNAVGNAGDALKKMAELLPNSAIKVMDNGQREEVKISDIMTDDIVEVKAGESIPTDGIIVQGQTSIDESLVTGESKKVQKNQNDNVIGGSINGSGTIQVKVTAVGEDGYLSQVMGLVNQAQNDKSSAELLSDKVAGYLFYFAVIVGVISFIVWMLIQNDVDFALERLVTVLVIACPHALGLAIPLVTARSTSIGAHNGLIIKNRESVEIAQHIDYVMMDKTGTLTEGNFSVNHYESFKNDLSNDTILSLFASLESQSNHPLAISIVDFAKSKNISFTNPQDVNNIPGVGLEGLVDNKTYKITNVSYLDKHKLNYDDDLFTKLAQQGNSISYLIEDQQVIGMIAQGDQIKESSKQMVADLLSRNITPVMLTGDNNEVAHAVAKELGISDVHAQLMPEDKESIIKDYQSDGNKVMMVGDGINDAPSLIRADIGIAIGAGTDVAVDSGDIILVKSNPSDIIHFLTLSNNTMRKMVQNLWWGAGYNIVAVPLAAGALAFIGLILSPAVGAILMSLSTVIVAINAFTLKLK

SEQ ID NO: 2963 - protein, 65 aa, Staphylococcus epidermidis
PKTRPVIASPLLALAFIESFTFEIKVWRSIDPINPNIVTSTSPEALDVSIFSEIDLYPTSCSLNS

SEQ ID NO: 2964 - protein, 117 aa, Staphylococcus epidermidis
MKKRISFTAIMTVLLIGLTACGAESDTANESKVQDIQGNPVSLPNEKPTLIYFMATWCPSCIYNEEIFKEIHQLNPNDVQLITVSLDPNTDTKESFAKFKQDYGGDWPHVLKIGVEL

SEQ ID NO: 2965 - protein, 229 aa, Staphylococcus epidermidis
ERVSMASYLFFHPKPACDTYGDMNIYHDKFGNNEDPYVWSERFLHSFCKITDYAYSKSTQKDIIFWISINKEGNNLKYLCDLVFKIEKWDFWYKTFSEQKDAIATNKELTINDAVVEGDEEAYEYHYSWINRGEHKWEPTYRRRRLTLKADPVLSFQPQNRQGNLLDVTELLKTIVNFNVEKSPAKSGTSYKAFELEEEQASKLYEEIKRLSFIRLKGRDLKNLRRNFS

SEQ ID NO: 2966 - protein, 180 aa, Staphylococcus epidermidis
NGVSNVKKIFASLGVILLVAILGVAVVFAYGSYKDLELKKEEAKLKDKKNKKIDKNKTTENENQDQINNQTITAPNEKAQYGNNLGVQEKSTDKNDPNGVLRFDTNGDGLISTSEVTPEAQKLVDEGKLQPSSDRMVEEWTKNKNNVDNTYDYDESYKKQQEMYKKAARGEVPEPGETIK

SEQ ID NO: 2967 - protein, 75 aa, Staphylococcus epidermidis
LNELKIIKKFIKKDNVYIISIEIVFFSLIPRTLCPGLIMIYFFIGDLPLILLAPQLVPQPFFEDLVDSHISLIGV

SEQ ID NO: 2968 - protein, 112 aa, Staphylococcus epidermidis
KKSRREGNSMKINRYITRGINESIPLDLQILLWHMVEKKDNQPHTDYLHIFKLQEDENILSITHEQEQPTYKLEYHYTNYEKNQNALPKKVYVIREDDVDAFYYVMLLPEEY

SEQ ID NO: 2969 - protein, 91 aa, Staphylococcus epidermidis
SYIRSILMKKIKIVPLILIVVVVGFGIYFYASKDKEINNTIDAIEDKNFKQVYKDSSYISKSDNGEVEMTERPIKIYNSLGVKDINIQDRK

SEQ ID NO: 2970 - protein, 277 aa, Staphylococcus epidermidis
IIRRCFFSMKRASYSVETKYKAVEMKAAGFPTKEIMKELNIRNRTQVKNWWRWYRNGESYRFSQHVGKQYTYGYRKITALINQCYTSPINHKRVQRVMQKHHLNCRVRPKKTTRIGKPYYKTDNLLQRQFKASCPMEVLTTDITYLPFGHSMLYLSSIMDIYNGEIVAYKIDDKQDQRLVNDTLNQIDIPEGCILHSDQGSVYTSYAYYQLCEEKGIIRSMSRKGTPADNAPIESFHSSLKSETFYINNQLNNSNHIVIDIVENTLKTIIIIEFNKN

SEQ ID NO: 2971 - protein, 172 aa, Staphylococcus epidermidis
ENFGSGIMKLRALEYSDLLFVHELNNEYSIMSYWFEEPYESLTELQHLFDKHLLDESERRFIVEDENQVVGIVELVEINYIHRNCEIQIIIKPEFSGKGYAKFAFEKAIIYAFNILNMHKIYLYVDADNKKAIHIYESQGFKTEGLLKEQFYTKGKYKDAYFMSLLKSEYIL

SEQ ID NO: 2972 - protein, 570 aa, Staphylococcus epidermidis
QIHGGQYGNKTNQHRFTVNDIVETIPDNEFDEFRHHRGATSYHPKMMLKVILYAYTQSVFSGRKIEKMLNDSIRMMWLSQNQKPSYKTINQFRVNPKVDALLESLFIQFYSQCVKQNLIDDKAIFIDGTKIEANANRYTFVWKKSIQNHESKMNEDSKALYHELVTNKIIPEIKEDHDNELTKEEIDLIGSHLDKEIEDLNQHINNEKCTKTRKQIRLKRTKIKKYKKQINDYFERKYRYEFQKSILKDRNSYSKTDYDATFMRMKEDHMKNGQLKPGYNLQIATNSQFVLSYNVYQNPTDTRTMIPFLNSIQETYGHLPEYIVADAGYGSESNYKAIIDDFNRTPLITYGMFIKDKTKKYKSDIFNTQNWNYDEINDEFICPNNKRLGFKRYAYRHDKYGYKRDFKLYECDDCSECPLKNQCMNFNSKTNKKIMKNYNWEYFKSQINKKLSEPETKNIYSQRKIDVEPVFGFMKAILGFTRMSVRRLNKVKRELGFVLMALNIRKVVAQRAENNQKIYKKRQCLYYLNRNCFFFTYSKNFMSRTHYDLFFYWGLAINSACSTTCSTAIF

SEQ ID NO: 2973 - protein, 549 aa, Staphylococcus epidermidis
MKKGCNIMQQLKTKRVGIYVRVSTEMQSTEGYSIDGQINQIKEYCDFHHFEVKDIYADRGISGKSMNRPELQRMLKDAKEGNIDCVMVYKTNRLARNTSDLLKIVEDLHKQNVEFFSLSERMEVNTSSGKLMLQILASFSEFERNNIVENVFMGQTRRAQEGYYQGNLPLGYDKIPDSKHELMINQHEANIVKYIFECYAKGHGYRKIANALNHKGYVTKKGKPFSISSITYILANPFYIGKIQFAKYKDWSEKRRKGLNDKPVIAEGKHSPIINQDLWDKVQMRKKQVSQKPQVHGKGTNLLTGIIHCPQCGAPMAASNTTNTLKDGTKKRIRYYSCSNFRNKGSKVCSANSVRADVIEDYVMKQILEIVKSDKVIQRVVTHVNQENQVDGAALHHDIAYKQQQYDEVQIKINNLIKTIEDNPDLTSVIRPSIQKYEKQLNDITNQINQLKNQQNEDKTLFDAKEISKLLQHIFHDIKHIEKSRLKALYLSVIDRIDIKKDGNHKKQFYVTLKLNNEIIKQLFNNKQLDEVHLSTSSLFLPQTLYLTI

(The sequence listing continues in the following parts.)

What is claimed is:

1. An isolated nucleic acid comprising a nucleotide sequence encoding a *S. epidermis* polypeptide selected from the group consisting of SEQ ID NO: 2992, SEQ ID NO: 3209, SEQ ID NO: 4536, SEQ ID NO: 4728, SEQ ID NO: 4737, SEQ ID NO: 5089, SEQ ID NO: 5172, SEQ ID NO: 5318, and SEQ ID NO: 5510.

2. A recombinant expression vector comprising the nucleic acid of claim 1 operably linked to a transcription regulatory element.

3. A cell comprising a recombinant expression vector of claim 2.

4. A method for producing a *S. epidermidis* polypeptide comprising culturing a cell of claim 3 under conditions that permit expression of the polypeptide.

5. An isolated nucleic acid comprising a nucleotide sequence encoding a *S. epidermis* polypeptide or fragment thereof, said nucleic acid selected from the group consisting of SEQ ID NO: 155, SEQ ID NO: 372, SEQ ID NO: 1699, SEQ ID NO: 1891, SEQ ID NO: 1900, SEQ ID NO: 2252, SEQ ID NO: 2335, SEQ ID NO: 2481, and SEQ ID NO: 2673.

6. A recombinant expression vector comprising the nucleic acid of claim 5 operably linked to a transcription regulatory element.

7. A cell comprising a recombinant expression vector of claim 6.

8. A method for producing a *S. epidermidis* polypeptide comprising culturing a cell of claim 7 under conditions that permit expression of the polypeptide.

9. A probe comprising a nucleotide sequence consisting of at least 40 nucleotides of a nucleotide sequence selected from the group consisting of SEQ ID NO: 155, SEQ ID NO: 372, SEQ ID NO: 1699, SEQ ID NO: 1891, SEQ ID NO: 1900, SEQ ID NO: 2252, SEQ ID NO: 2335, SEQ ID NO: 2481, and SEQ ID NO: 2673.

10. An isolated nucleic acid comprising a nucleotide sequence of at least 40 nucleotides in length, wherein the sequence is hybridizable to a nucleic acid having a nucleotide sequence selected from the group consisting of SEQ ID NO: 155, SEQ ID NO: 372, SEQ ID NO: 1699, SEQ ID NO: 1891, SEQ ID NO: 1900, SEQ ID NO: 2252, SEQ ID NO: 2335, SEQ ID NO: 2481, and SEQ ID NO: 2673.

* * * * *